United States Patent 9,328,346 (POLYCOMB-ASSOCIATED NON-CODING RNAS) - sequence listing, part 27

SEQ ID NO: 4538 - RNA, 539807 nt, Mus musculus
aaugaaccaaggagcggagggaggcgcuuggucguaggcguagccuaggcagggcgggcacuagagacgcacauuccuggcgcuacccauuggcuguccaugcgaucacggggaggaggcguggccccgaggcgggcuccggucccgcccccgcucggaacccagcccaggaucgcgguccuucccccucgccccccagcugcacagacaugacacagacacacagucacugcagcugccgaacgagcccgacgcucuaagcacgcggcggcggcuggacuagccuggagcuccaacaccagcgcccgccagcgcgcucccacgccgguccccgcacagcgauucucucccggccccgcgcgggaagcggggaucgcgcgccuguccguucgcggcuccaggcugcccacagcgucugcagcggacgagcggcuccaaaccugagcgcuccgggaagccggcgcgucuccaagguggcggcgggggcugcccgcccgggcuccccgcacccaucgggcugcgucccgcucgcggcgccccggcggccgugaccuuccaaggagcaucuaucccggccccgcgcccccggucccgcgccccaggcccgggcgaggcccucuucagcgcccgcuucucgcggagccgcgggcgggcggcgcaggcccggggggugggggggagggucaccgcaagcagcuacggucggucccagugcucguucgccacgcuggucucucgguccggcugagcugccuccagccuccugccuccugccucgccucuucuccguggcuggggcugccgguguacuugccuggccgggccgguugcgggcaggcccugcccugaagggguuaagcggucaggggcgcggaaggugaagccggcagagcugcggcuccccguuucuuccuggcgcugguuucccggauccaacccagggcggcccccaggcccuugcccaugcgaggcgcccagggcuuggaagaguccuucuggcguagagcagcucucggcagccgccucggaggaggagaaagaagggagagugcucagucccggcaaggcggaccuuuccuauugauauuuggagcccaaggcugucccgaagucugugcuuggcaccgucggucggucggguuagaacagcuccagcugggaucuccaccaggacccacugcacuuaguaggcgucaguggcaccacgcgguucagcucuuucggaguguaccucugccuggauguagucaaggccaagguaagagcccugaugugcgagagaaccaucgugggaacgcuuuagugagcaaugcuggacaacuuauccaaaccuguggcugguacccggugugcuuaggaugcuaguaaaaaggaugggcacaccguuucugacuuggcuuugagucccggaaaagcaggagguggaagaccccaaucucuaguguccccaggaucugucucagggccugacaugcucuuagguguacaagauauugauaggcaagagcgaguugguguguguguguagggggcagguucuuaguaacaccuggagguauuguuuucccgccacccugggacccuuccugcuuuucuucgacguucaccugccuuuuaugaugggaugcccagagaacuuuccaauagguugaaaagaggccggguuggguguaugcauccacauuuuccaaaagcucuuuaggauaaagugguuggauggcauggauacccgugagggggagucccaaccaacauaccuggucuguccuguuacacuaaacuucuuguagucaucagugucuacucagagcuuccuguaaaugucauugcuucuggagguuggaaugauaaguauguuuaucaugaaguuauacuguucaucgccuugaaaugcccccgcucuguaaggauaguucuuucuauaagcugucuuuaccagugugagauuuauuaaaccugugcacuucuggacuuuaaaugggucacuugagagggaacagauugucuuuugcugacccaguccaucuccugggugacccuuuuuaauagggaugcacugguuuggguuuuguuuuuuguuuuuuuguuuucccuguuccagugcugauguaccucaguugaguagguuucugcugaauucugaaucugugaauuuugucacucaguccauuaaaaugauaucccgagggagcaaaagagcagcuuacauuuucugugaaugucacaggaaguuuacugagucuuauguaagugucucaaaagagaacucauacucuuucuuccuuuagggcgacagagggagguuggagggaguggcacgccacccuuucugacacaggcgggcacccaaagugcuuucuuaugaguggaggcaggcaucugaggcugauguuucuuuuugccucuccugccuucccaccucaggauucacuuugauagacuccagauugggaaugauauaaauuaggaaaagaacaguggugauuucuuuucucgucucucacaaaugguugauaugaaucaauuacucaucuguguguugggaccuuacuggagcaggaaaaaaaaaaaaaaaaaaaaaagcagacuaagagaaaacuuccaugaagguuucacacaucucuuggguauuuucaaagagugcuuuuccuuauugaaaauugcuugaggagaacgcacauuuauggagcuggggucuguuaauuucagaacggaaagugaacugaaggaaggaucugcacagaagggcagaagcuaugaggauuuagauguuaguggauuugccaaagaaaggaggcgaacucccguaggagaacagggaggcuucuaaagaagacauucccaccagugugggugagcacaggcugccugcaagugugggcucccagugcuucaagaaauggucugaauuguggacuaauauauuuugaugugaaaggauauagauucuuuugacuuuuaaguugaaacuggaugagcuuuagaaauaaaaucaaagguuuuuauccucucauaaguuaugagaauacuucuugucuaggucaccaagguuuuucuaggaucuguguuccugagcuguucuuuaaagucagugcuggaaggcaagagucugcuuuucccagugucucucuccauccuucagccgccuacaggacacuagggggaauuguuuucuauucugucaccaaagcacaaagaccaggaacagaugcuagaaaugacuauggcuuguugugaaagcucaugaucguaaguuuuugguacucaguuugugcuugcacuguugaguggaugguuggccugguuuauucuacaaugucauguggacuguguggguguuaacugcaaaguguuaagggaauaucugguaagauucaaauacagugguuuaaguauauaagggcuauacauuuugggaacauuggcuccuguaaacugccuuuuuaacauuaguucaugcuaacuuuaaauucccuaauggugcugguaacuguccuccauccccuuuguacuucugaggaccaagccucaugauugcugagugagugcucugacgacuacuaagauacauccccagccccuccuuuuugggggacgauguggggaugugcuuuuggacaauauaacucagucuucaaaaauaacacuucuucaggacauuucugaaauuaauuccauuaaacuuaaauuuucuugcugucauacccuuaaaaguacauuccuuacacagauaguaacauaguauuugacagugugguuggacuuagaugugcucuccauuuuuaacagcguuaaaucauuagugucugggauuccuacagcagaauuagaagauaauuguauuuccccaaagaucaaagucccuuggcccaggucuacccauagcaacuagcucuuaugaaagacuuacaggggaugaaggaagagucuaagagacuggccauuccagcauacuggcacucaaaggacaauuuucaccaagauauugguccugcuggagucuuaaaagcuugauuuagcauguagacuuagacuuuguucagaaccugcaaaauucugcaaguuguuucaguaccuggaaccccagagucuguuagauugcaucugugaccuuuuacucauaaguauagugcauauguagguaguuuaaggagaauggcuacuguggucuaggaaaaaugaucaacacagagucucauccuucucuuagggcuuuaaggauugaucuucauaggugcaguaggaccaagggguaagagacugaaggaagaaaauauuuagggcugugguccuaaggcaugaagggaggcuuauaaauuuggggaaaucccuuugguagggguggcagaagaaguugaggcagaguauuggauucuguaaggucagugaggcaggaacaaugacaauuuggggauguggcuuugcuuuaugugcugggcacugugauguugauaucuggaaaucaguagguagauuucaguagaguuaacuguucuugcuuuuaguguagcaaguagugauuugauugauucuguuuuuuguuuuuguuuuugauuuuuuuuaauggcaaaugcuuugcucugugccgaagucauaaggguucuucauuugucucauuggugaucagcuguagcaggcagccauucacuccugcaaguuguguacaacugugcagguauguucaaaggaugacuuugaaguuucuacauuagugggaguaaggaagacagcaguguggaaaccccaguauacauuguguaugaauagucaguggaauggcaacuggaaaaggagaauuucuagaaaaggaaagcuuggagucagaaaguuagugccuugacugggccccuuacuagcaauugugccucagucucaugcucuaugaaaucaaaauggggcaagaaugguuguugggcaaguuccaacagagguaguugauuaucucauauuacuauuaaacauagacagauguuuugguguccauguuuuucuccauagagcauuuuuccuguccuuucaaaaacugcuagcaaugcagaugaagaaaggauuucuuuucaagccuaagucaggccucuguguacaugaaugacaucugcgguuucauguguaauuacacaguagugggaaaaaaagggcccaguuacuuaacacguaauacaguauggcaagggcaaagcugccuucuguuagaauacauuuuauuuuguauuagcuccagauagaguuaugacugugcuucccaccagaacauggcuucuguauuauagucauuucuauuuucuucuuaacuuucuuugcuguuggaauaguuuuaucuguaaaugggaguauuccugcaugugucugacuacuucuguguguuguaguacuaaacucuaguguuuuccugggucuucauaucugucagggauugguucuuagguccuuaccccuuaauaccaaauuccacauauguucaagcuacuuuuauaagauggaauaaugcuuguauagaaacuuaaaaaaccucuagauuauuuauaauaccuacuccaauguagaugguacauaaauacuuauuacagugugauguuuauagacuaaaugaccaaaugaaaaagucuacauguuuagcauagauaugauuuuuauuuuauauuuuauuuaaagauuuaguuuuacuuuauguguaugaguguuuugucugaaagaaaaguguacuauaugcaugucuguaucccagaugucagaagaggacacuggauucccuggaauuggaguuauagacaguuggaaacugccaguggguucuagaaacugaguucagguccucugcaagagcagcaagugcuuuuaacugccaugccaucucuucagcccuagacacaaauucuaaugcuucuuucugcuguuaguuaaacccucuuaaucugagggcugauugcauguggucaggaagaaacucaacaguggaguugugcacuccugucugcagguuauuagagagaguggaaagucaaaguuggaauugugaucuccauaaccaaguaaguacauuuaauuuuauuugccugccugccugccuaccuacuuaccuaccaaccuaccuaacuaccuaccuaccuaccuucucucucucuucgucucucugucucuguaucucucucucucuuuccaggaccaaguauauuaaauuucccuucccuccccuccccuccccuucccuccccuccccuccccuccccuccccuccccuccccuccccuccccuccccuccccucccucccucccucccucccucccucccucccucccucccucuuucuuucuuucuuucuuucuuucuuucuuucuuucuuucuuucuuucuuucuuucuuucuucauucacuuuacauuuugaucaaauuugcccccccaaccccuuagcucccccaccccccugacccccaacuucugaggccugagaaaccugcccagcuaggggaaagggaucaaaaggcaggcaagcaucuugagucugagacucaguccacaguccaguuguuaggggaccuacaugaagaccaagcuguacaacugcugcauaugugauucuuccacaagaaucccugagcauuccuaauguuuugcuguggguuucugcaucuguuuccaucaacagcuggaugaagccuuucagaugacaguugugcuaagcuccugucugggugcuccuuguccccacagguguccucuggagggaaggugauagaccuuagguggacaacauguagcuuaccucacguauauuuaauuuuuuuaagagcaggagccaaaauagaggugguaaaaggugugugugugcgcgcgccuacacaugaguaccuauaugugugcuuguauuuucucauuuccuuugcacccuccaugccugcauugaguggggucagauugucaacucagguuuccuguguuccuuggauuccaggaaccaucugucaguaaaguauugcuuaucuuguaccuuuuaaguuagugucucccgagagggaaaggacuaaccugagcuaguuugugguaagguuuagacugccagguaggguuuuuaccuuucugcucugaaaugggagaagacuuagagucaaaaacagacuugcuuaaaaagaaugucagccuuugcucuugguuacaaacgucauaaaaccucucauacaugaggccaugaacauaugagcaaucucuugcuucuuguauauggugccaacugguuaauccuggaauguuacacuaguacuuagcuacuaacuacuugagaaagaccugcauugugauagaaagaaaacaaagcaaaaacaauguaguagauaaauacaagaguuggcccuucugggaucuucucagaagaaagccuucccauuugaccuuauaguggagaggcuggauaaagaugaaaguaugaaagucaagucaggaagaauauacccugacuuguugcuucuggauucccuggggacagaguguaaugcuuauuggaaagaagaaaucucaagugcaaugugauucugagagucuguuauuauuuuaauauugaagcgaaaugggggaguacuauauuugaggaaaguuuggcauauaaaaucuucuguuaaaaccaaguaauuuaagauaaguaauuguuugagcuaugaaaagauuuuuauuuuacaaaagugauuuauugugggucucuguuuaauggcugcuccuuuaugguauuugaaauuauuuuaugaauacaauccugauggacaguuuuaggagacucauuuguuguuagguaauguuggggacuuugagccauaaaauagaaugucucauuugauagccaacuagacuuaccugccaugaagcccaguaugggauuuguacagaaagaaaagcauggcuuauuuaaauguuugaguucaccaacuaaguauauggaacaaaucacuugguaaacucacuguucccaggauucugauuuucuuguuaucuuaacuuuggcuuuuuuuuuuuuuuuuuuuuuuuuuuuacuuaaaugugugugugugugugggggguguacgcgagugugcacacacgcacucacgugcugacaguucuuucacugccacaguacuaucaguuguuuugcgguuguguguccccccacccccauccccaaguaccuuuaucucuuaucaaguucucagaagagaguuuguucuaggaauggagugcaauggaggcguuuacucugcagagguaauuuuggaauugcagguaaucacaggccccgguagaauggaaagugcagucucacccauaauuugagccucucuugccacauuaugggcuuugcuuuggacaggcagcagacauggauggaaauggaguccugacuacuggcagagcuuuugcccuuaacagugccuuuucugaauuaccaaggccaaauggaaagaaagggcuuggcuaaucuuuccagcucuccaugguagcucuagaguuuaggaggauuugcauagcacauggucuugugcgaguuucuuucuuuguguuuuuuuguuuguuuguuuaauucauaaaggcaucuggucuugaguguuagucuguaguuagauugcuauugcuucagaugcauugauguauaugaauaagguuaacauguguggcugacuagaaggcaucauugccuccuuccuuuaguuuccagaauaguuguguggauccuuaauaagccaaaaguauguaccaguuuugcugacagauacagauucucaucugggagaggcauuuauuguucuuuggaaaugcagguggaaggauaagggguggauuuuuuucuaccucuacuguggugacugguucuuaguagcucugcacuccaggaaguagucaaagugugugccucagaugauuuaguaaaugaaaguguggcccuauguucacaguuugguggagugaucauggaggggaguuaguugcagcagacccaggugugacuggaugaaguugggcaacuugaggucacuucguggaacuuucauuucccaccuguguuggaaauuucggaucaccauaauaaguucucugaaggcuugucuuuguguguuugacauugauaaccuggaaugggccccauguucuuuccucggaauauauagagauuuuaacuuguuuggaaugaaaaugggugugcucuuaagaugccucacaugcagauaccaagaugugcugaaaaugucuugagaagcauuuucaguacaagccuuagaaugaccgaggauguugacaucucuagugcugaugacaguggcugugacaugacuguggaucaggcuuguuagucuguuaggaucaaguggacuucuggaguugaaaggcuagagaccugccugagugggaaaaggucaagaugucuucuucuguguagaguugagggugcuucaccuaggcuccaaagggcucugggcuagcauggacaucucugugugaucagagcagcuauacugggacagcauuuagucugaagaaggcaccugaguucccagaugagcuccuucauccauucagccugaaggagacaguugaacccccugaccagcuccuuuaucccggaaccuuggauacccaugcugguaagguaaggagcauuguucacaggcacagugacuuaaguccauggucacuguucaccacucuugguucuucuaggcucugugcucagcucccugucugccuuuccaugcacuccacuucaguuuguuucauaccuuccuuaacaagacaagccuucauuagaaucacuuuuagugacuuuaucucuacagcuucucugauagugugguaaggucacaccaauauuagaauucaugggaacaucccauaagugugucaaauuaaaccuagagacuucugaucuuguccuugagauacucaguuggagagguugggaaaaaugugcugagugaagaagcacaauagcagauaacaauugagucacaauugaguagaaaggcaauggcauugaguguugagcugaagaugguaaugggaacugcacacuggagcuggcuuuagccuuuaaaacucagugaaagaggcaauauuuacaucagacccuuggauaugaaguucuuaaaccauuauuggaagggcuuauggaaggucaggccauguaaaguugacaaggcaaauaccuaauuugagguuugagaagaaaccagugagagucuauuagcagaagcauugcaaauaaaaugaagaaaggaauacacucugcuuugacccaaauaccucaccguaggcuccgucuucagauacuggcagaaaauucagguucugacacaugaacuucugugaacaaugcuccuuaccucugacuuaugaacuucuggaggacccacucaauuguaacagcaugcguugucuaaagaucccuggcuggcauuguugccauaggauagaggccaacagaugcuucuguaaacuuuuccagucuuaaucauuggcucaacuuaagcuuggcauugauguuguagauauuuaacauuacucaucauaaaggcagccuacuuggaacaaaguacacuugugacauagccacaaucuaaaaauagcacuuucuauuugggcugugcugggggacagggguuuggugaccuggaaccucucuuauuggaaguuuguuuaaauggacccaggguuauagagcaaacaaucuuuucucggcuuuggauaauaacacugaguguaauacagacaauucuguucuucgugagugucuccuaugucagcuacagagaggugaaagcagacugcucagaguucuuccaucugggcugugugccacaauuggagccugcucugugcuccacccucuacccucaugacugccuugcuucucugaaguuucuuccugcuggauuaugaggacauucuuugcaaaaugguggaguaagccauucuggauaguaggguuuuuuaaguaggauauuccacucccuaaaagagagguuuuuauaucucaucuuuggggaaugagagcuuuucuggaauauucuguggauuuacccucgcuggcucauugccagugacuggcaaccaucuacccuucuuaguggacauacaaagcuuuucugaaccaucugcagcacauuuguuucaucucuuccccucucccauuuuaggaaccaccagucccuaacucuguaguuuuuuuacuuauugguuauuuuccccaaaccuaauaaggucuguauuuacuuucuuugccugcucagcucuuuccuucuuuucagccugggacaucuuuaguucccauuugaaacaaguuuaggaaguccugucuccuagcuuuucugauucucgcuucauaaugacacugauacugccauccuguuccaguuucucagaguucuagcccucuaagcuggggcuuuccugucuucagcacucauugcaccaaucuuuguggcucuauccuauacuuggaaguacucuuuggccaauaaaugguguaaucuauuguagguuuugucauauuuacugggcugguguaauguagugguuuucuauuagaccucgagggucucauuuuccugaagggguaacuaggaugaugagaauuugcuccuuaaagcauuuucaucuaugcugacugcauaccccuuugucccagguuugagaccuagcagaggggagguaggaauggaguucuugauagacuagaagagcuggguucuggguaucugaacucagguccccaugcuuauguggaaaacacucuauugcccaagcuaucucuccagcucccugcuucauuuuguuguccccuucucucucaagcuuuugaaucuuucuagcuugagccuuggaugcugauagacccugacuucuacuuagauuuaauucuucccacauuccauuaacgaaccagauguguggaaugacaguuauaaaugauugagaaauuauugaagagugguguggagugacugagcaggacuggauucauuucuacagaaacucagcaguggugccuaaagucugcuuagauuaugucauauugcuugugguguugcugaggcccauuuagguuuucuuguacuggcccuguaagcuaggcauccugcuacaugaaacagauuaugcuuaguaaaucauaggggcuuuucagagaguuuguaugaucugggcacucacaugacuuccugaacuuacacuuggcucaggguguuuguucucggggccagaaugcuuuugcagaggugaucugacuuaauccaugccaacagauacuuucucuuggcuuaccuuuugcuuucccccaucuguuugaguuugccgacauacaauucccauugaaacagagcuuuugaguucauucagucuguuaacuuuuguaugauguugacaaaccccucaagaaguaccagcuguuuucguuguuauuuagaauucuaccucaccucuacacaccucuuuuaccuguacauuacccuuuuaugaugagugcacuugguuaacuugaugguaggaugguaccugagggauggaggagaaagaagagagggaggaaggcaggccacgugcuuuauguuuucaauucuagaaacucugcaaagguacuaaugauaaaagcaaauucuugcacuuguacuaacccacccaucauuguauuaguuauuuuucuguugcucugaugaaauacuagaacuuauagaggaguuuauuuuaccuuagaguuucaaaagacugaccaucgucaugguggugggaacuacaugguaugcuggcaggaacagcaagcuggaugauuauaugcccagaaguaggaaacuggcguguguggguuaaaguagggguggaggaguucagaaaacaggaauggggagagacuauuaacccucaaagccugcucucaguggcuuccuuccuucagcaagacugcauuuucuuaacggcaccauaacuccucuaaauaccauuaugaacuccaaauagguauucaaauacaugagccuauggggagcauuucccauucaaaucacuauagucuugcucuucugucucauaggaaauuugccuucugacagggaggaggguauuugaguugcauaagaaaagauccugacuuagcaaguugugauccaguuuauaaaauuauggugauugaugaugguaacaguuguagauaccauguaucauauacauguuuguaaguuaugcuuuaacugugggauauauuuugauacuuucuguauagcuuuugaguacuuuucuuuuacaguucagggaacugagguaaacagaaguugcuauuugcacagguauuaaacuauaggcuggaacuuccaguuccccaaauauuggauucuuuuuguuuaauuuuuaaagauucauuuauuauuuuaauuuauauguaaacauaugugccuacacaaguuuuuguguaccaugugugugcagguacccacaaugggcauuggauccccuggaacuggcaguagugagccaccuaacguggguacaaggaguugaucccaaguccucuugagagcaguaaguauucuuacccauugaacaaucuuuccaccccugugaaucccugucuccauauuggcuuuacaucucucucuuaggauucacuaauccagguggcuuguuuuguuuuugaagcauauaaacgcauaauaauauugaaaacuggucuguaaguaugcaaguagauuaugggagaucauucuuuagauccucaacuucaugaucccaguccugaauuugcucauucugagaugacccuccugccuugucugugguucucucaguuuccuucucaguuaucuuuagcauuuuguaaagaauacaccaacuaacauuacucugguacauuguucuggcuauaaaacucugaaagacuccuccauacaaagcaacuauuugaaauuguugugagaacccucuuucaauucauaaggaugccccuuguguguuaucugauuaauuucauaguggacacugggcauuguauucuugugcuaagaaaucuuaugaaguucuuagcuuuuacaaagaaacuuacucuuaaauuuuaaaguaaaugauggaucucagauugcuagauucauguagaaguuuuauuuguguuaauguuugucaugugagaaaaaauuauauccauacaaacuauuuaggguuuguuguaaaauuuagaugucaacuuaaaaauaagcaagguggugcauguguuuaaaacuuguaguaguaaaauaauauuggcuugacagucauucucucuacaauacugaaguuuggaauguauaaauuuuaaguguuuuucuccuuuagacucuuaucuacuuaagguuuggucuguagaauuuuugggacuuuuuuucuccucaaacucauguuuguggcugacuacucuugaaaguauauaggauuugcagaaaaugcaaacuuauuuuaaauuuuguugaaacaauugcccuuguagcuauacugugaguguauauagcaguuucucaguggcuacgugggggcucuguuaggaauaaaagauaaaaacuuaauuaacacugauguugcccagugcacuggauaguuuccugucaacuucacauaagcuaaagucaucugaggagggaaucauagugaaugaaacgccuccauaagauugggguguaggcaggcgcuguaaugcauuuuuagauuagugauugauggaggagggcccgacccauuuuaggugguacuaucccugggcuccugguucugaguucuauaauaaagcaggcugagcaagccauaaggagcaagcuagaaagcagcaccccuccauggccucugcaucagccccugccuucaaguuccuacccuauuugaaguucugucuugacuuccuucaaauaugucaaugauauugaaggauaaaccaaauaaaccccccuuccuguguugcuuugaacauggaguuuccucacagcaaaaguaacccuaacuaagauacccaggaucggucauaaugcaguuuuaucuguuuuugaaagugaaauuagaggccaaacuagacucggguucucaguguccuuggaugucaguuacucuuuuccucugccuuucaguauguuauuuucauucucuggaaagcucuuaaugugugguaggauggucccuguagccggucuuucauuuuaugcaacucaguaucucugcugaauaggagcauccuuucccagucugucugguaaagugauagccauguucugggugggagauccaaccuaacaucccagaaguggguuggauggaggggaugaguccuauuugaauggcucuccacagugcuccauaggcagauugaccaggauauuuugaagcuacuagguuuauucucuugugcgacuuccucuacugccccagccaccagcuuccuauugggaugugcacuuagucaauggcagcauggcaugggaauugccuucuauuucugggguuugucauuuuaagaccuuaggcaaaaugagggaauucuugacagugcauuuugugauuccuccuucccccucaacauuguuuuacuuauuaaacauguuaaaaagauacaauaaaaauacuagaaaccaugugggaugccaaggaugacaaaacagugcuucguaaagguguauucauaaggugggggauggguauuucaauaagugcuauuuaacauggccauuauccuuuuaauucaagcagcgguaauugcccauauucaaccagacccucacaggauaggacgugugauucuagucacucccuucugcccauucccuccuuaacugcauauuuucuugggagaugcuccagaauauaguagacgguugucugggauagggauuccagugauaaguuuuccuaaggucaucacucauaucagggcgauuuuuuuucuggucacacuauuuugggguuacccauacuuauguaaacagcacccauguuccuauaaguaaguccaauaaacuuggguucaucacacugagguuggaugggauacuuucuuugguauauuacaggaacugugucuagcuagguaagacauggcugguucaccuuuccccaggaaaagugccaaagccaccacagacauuuauugucuaauaauucugaggccaauguguagaaggacagugucuuccaaggccuggcuccuuugucagucuuacaugaucuucauccuuugcuuacagggcucuaaucugcucaucuuuuauggauaaaaccacacuggauuaggauaaugacuguauuuuaccuucauugccuucaugagaccccccucgacauacacagucauauccugauuugcuguggauaauuacagacuucaauauuugagcuuuguaaggagccauaauccugcucuuagcagggauguguuuuaaugcaguccaauggguuauauuuuaccagccucauguaaacuuucaaacacagauuuguagcagauucuugugaaugcaaacaaaccaauuuagggauggugugcuuguaggcugcuguuugggaaaacccuuucacuuggaaggaauggaaaggagcaagguauagagaagcuugccugaaaugcuuguaagugguggcaaggaucaccuugcacagguucagugcugccuugguggaaucacagcauugucauuaucauuacaaagaauuucucaagggugggcuuuguuuguaaaaugaacuccccaagguuaagaugcagcuuugcugcagugagauggucugcccuugucagaacugaccucucucuccacucugcaugaaguaguggauucuguggucaggagcucugcuggagucuaugguguuagagcugguguguacaugggugacauucuuguuguccuguuuuacgaguuuuagggagcacaauuugcagauuuagggcagauaagugauuugaccaagucauaaaagggccacuguugugauggaaugacuuucaugaauucccugagcucaucaucucuaacacuauucagaugacaaaccugcccauuuaucuguuuugucaagacaguuucacucuuguuuaguguuaaccguuguuuuaauuguuaacuguuguuuuaauugcuaugauaugcucauugucuggcuugucuggauuggaaauggagaaucaguugaggagauauggccauaggaguugucauguuagauuguaguuuuucuaugucaauccccauccuucauuuuaaucuugcuuaccugcuaucuaaaauguucuaagcuuuauguuugagagcaaucauugcuacaaguuguaguuaaaaaugcuuugauuacuucuugcuuagaagcuuucugagugaaaagcaauucaguccguaagagaaccagacugaauauuugugugugugcgcgugcaggcaugugcaugggaaugagaauaugugcauguggagguuagggguugauaucagguauuguuuucuauuggucuccaccuuauauauuaacacagaaucaccuaauugaacccaaagcucaugcucuggcuagccagcucacucugggaauucccugccuucacaguacuucucuuacaggggcuuuaccacaccuucccugcauuuauguagguacuuggcucugaaaucugauccucaugcuugugagguaagcguuuaacccauugggccaucccccagccucaugauucuccuuuugguccuaguaccagcuguuugcuuagggcucacauugauaaccccaccuuaauuugaucucuucgauaaagacuuuauucuuucugagguauuggggauuaggacucaagcauguuuuuggaggcaggaagugggacacaauaaaaucuauaauacccugaguuucauauuuucugauuugugaaacauugaccaccguccuuucccuuuagcugagggaacaagcacagucuugugggaaagcauucuagaacacagaugcuucaacuuugggaugagguggaaauacugugccuucauggaaacggaccuuuuuggguuuugaacugggaucuuuuccuggaugauauagaauagagucuucucaggaucauggagaacaagaaggaacaguaaccuacuacaccaugguggugaagaaccuguacucuaaaguguggaaugcugcugaguuauaaaguaugauagucuaggaauaugacauacaucauuuucauuuuauaauguguuuauugggacaugagccuaauauagguaaaggaacguuuucauguauccccagguugaugguaaaaugccucauaccaacuccgugauaucaaagcaggaguuaggucuuauccaugaaagguucugaguuuuuucaauuaaaaauuuuuuaaaaauaaaauaugaauuuuggcuuaaguugcaugcuagguaggaacucaaagaaugcugguccugcacugagaggggcacaucacuggaguggggacugcaccccauagacuuaaggaugucuaguuaacugauuugucugaauugaaugagcacugacuacugcuaugggugugaguccugagguauacauccuagucuuugagucuuucauuggguuguauuuuguuguuauuucuuuuugugaauuagauuuugguauccaaaacaguucguguucucuuacaacacuggagaucuucacacugacacugcaaagagccuaggcucuagcuuauuuuaguguaauacaaauugcugucagauuauauagauaucuugacuuuuuuauuuuguuuuguagcugauuuuugaaacagugucuugcuguagcccaggcuggcuaaggcagucagcucuuaauuuuuuuuuuuuuuuuauuaaacuacuauagaacuucuccucuuccuccuacuucuuuccuuuuaaaucauugauuuuguuggguuuuuuuuuuuuuuuuaauuugguuuuugagauaggaguguguguguguguagcuuuagcuguccuggaacucacucuguagcccaggcuggccucaaacucagagagcugcuugccucugccuccugaguacugggauuaaaggcauuuuacauugccuggcuagaaaucucacuucuuugugaaguagauuugggcuuaauuuucaucauuggguuggggucucugagggccuccagugauuaguguaacuuucccuagauauauuucucccuguacuuacucaaugauguguaauuguagaccaucugcaguaugccaggacugucugucccacccccuggggcaaggaggguaauaagacaguuucugcaugggacauucacucagggagaguuggcucaucgcagguuaggccacucuuuacucuuauguuucuaggcaaaggcacuauugucacucaccacauacaguucugggcuaagagcuacuauauaucuaacuccacuugguauuuauugggcuguuacaccaaauuuuguaaagccagaggcaucgcuuggcuagacagaauuuuuauuccacucccaagaggcugcucaacaagcuuugaugauccguaaaacccagcuccauuucuaacucaggagagcuuguaacuuuuuucuuuccuuuucugaauuugaguccuuuauagaguacuuugauaguugggcacuaucagacuggcagguuuuaugacauugucuuucagauggacgaugaacuuuugggaucaauuuuguuauaugguggccucacacaguaccacacuuggaagcauuacauugaaagaaguguucuuuucauggggagauuuagaugugauaauugaaauggggaugcuugaaagaacuauugaugucucuacucugcauggaguagucagcagucaucuugcagaagagcuaaggggauuugcugucuuucuuguucacuucugauggggaagagucuaauggccucucaccuuggugaucugacccagcauacucuccucuuaagcacucauccuucuauuuacuuccugauggauaauauggaaaaggacuuaaguagauuuccaaugagaugugcuggaaaauauaaccucacagaaggagaggacacagggaaaguucccacugggguaagggagcuggugacauaagucuuggaccauugcaugauuuucucuucaaauccauucuucuguggggagaaaggaggauguacaacuguuguuaucacagugcuuuguacuuucccuuugucuuguugaaagacaggacuucuaggucuuuaaaacaccuugaccaucagcuggauuauuguguagaugaggccacuuagguccagaaaaaucaagaaacucucgaugaaggaauauaaauaugaccccauagauagugggugaacacugagcuuugguuugauuugcucugccucgauauuuuucgcuaaaguuaugcuuguauugguucgccuuacauagauaggauuguugagcucaauuuuugguaaugcuaccauugagagacacucaccaaagaacugcuugugagguuuuuguggcaucugaccacuuaaguggcuuuuuacuucaguuugauuggcaaaccuggcaguuucuucaggacugaacuacagcugccuggugucugcuugcugaaaggacuggacuguagcugcugguuugggccuggugucugccugccuguagaggacuggucugcagcugcugaaucauauuugguauuugcuccuugacugaacugcugcccaagaagaucgaaagaacuauugcugaacaggucuacuucccccauauccuaauaacuuuccucuuccacuaucucugcugggugauggccuagaggagagguugaacccuuauuaaaauaaguugcaaaaaaauuaugccuacaguuaaaaacagcuauuauuauuuuuuugagcuccugcaauaugucaaccacuugauuaaugauucucucugugucuucccagcagacugauaagugggugugaaagaaccugauguacagaagagcacacugagauacuccgaggcucauuuccuugucauacagugcauauguguggccaggauagggacugcuggcaaguucucacuuuccggggcucauugcauccauagggaguagagguauugcucccugauccucuggcucagcuuuacauagaugguagagcugcaguucauggaagcugcuauaggguuccuaaaaauucauuccuguuggaccuacauggaaccacaugggcuguagaaaucugauagugaaguaaugcaaagggaccugggaaucaggagcauaggcuauagguaggugccuuuugcccuggcuagacucgaaaagucaggaagucuacuaaugcuugugcucuauccuacaagucaagggucaucugcagcauuuacaucuuagccucuggggucccacauauuccaggugauggacguguguagcuugcucuugaacauugggaaggacuucuauauaugggagguugaugauaaaacaaaugagauagagcuucauauuagaguauggucugacaaucacaaucccccacccuauuuagaggcagaugcugcuuauauccuuauacuggcauagaccaggcccacaggauagcauccaggaguuggaucugugaacauauaugggcaggcucuuugcuuuccuaugcauugaguagaucccugaauugucauuguauucuccucuuucuucucagcacaucuggggugucuguggggcugaaauguguauccaauaggccuucaagagcuuguauugcacgaacugccauuagccauugcuucuaauuuauggcucaucuguggcuuuuggguuuucagagaagguaccaaacuacagaugccucaaugggagggggcaucauguuugagucugguagagagaauggugugaugguucugugcucuguacaacuuaaauuagugacccacuuaagcauucuuucaaaguggaaggaaguacagauagccuaaggugccuuaggaugugaaaccuuuggcaauuaucacccuauuuaaaagucuacuucuguuaacugcacuccugccuccuuuagccugcaacauuuguauaauuucuuuucuuuucuccuauuuauggcaugacuguuauaugcugugauguuuauaugaauguaagcugaugguggcaagcuuuugcuuuccuuugucuuguaucucaauacauauuggaggaauggauagauaaaugguggcaugucaauggugucagcaggauacaaaugguaucaggaaauggaauaagcuaggauucaacuuggguugaguucuggaaagaacuacaagcauuccugggguuugcuguaugggauaauuugauuuuacuacccuuuuggagcaggugucuucauaucuaauuaaaaugcauucuuuucucccuuccucuuucucuuuuuuuagcccuuaccuuguaaugggaaacgaugcuucuguagaguuuagucuuuuauguguucuaaacugagcccuuuuccccugcugucgcuuuaauaucaucucauaaguucauggacuuuaaugugcugcugcugacaccucuauucucaacuagauaguuaaaggaacauaaaccaccuccuuuaccuuuuccccuuugaucccuuuccuuccccucuccaucuuaugcaaaucacuguuccuuuuucuuguuuugguaaaagaguugguaguauguauguaaagagcucuugguguaaauggaacuguugauuuauuucauagucagagauccaugaaaaaaauaacaguauaagaguacaaggcuuugaauaaccuccucuccaauuaaaguacagagcccagagacauagcaaacuaauauuuaaugagagugcuucuggcaggcuguacuuaggauuuguagugcugcuggugaaauugguguguauucugacauggcucugaagagcacucagucuuccuuccuucauuuguucauuuauucaggacuuaaugaucauuuuguauguaggagaugccuaggaggcacauggcauaaaccauuugcauaaauggccucaauccuccaugcuuuucuauuucuguccagguuccuugucuuuugacuuucaccuuuaccacaauacuuucuccuuuuacccauaggcugaaguggaggugguaguucuaaguuuguacaacuuaggccacaccagugagaagucagguccugccuaucagcugaguuccagccaucagauacaugagugaaggaugauuggugccuaauggcaucauuuuaagcugcacuugaugcaauggguauugacaugauauauaugaugugaaaacggauccugccuggaaccaguuuuggaguuucaugauggugaugggagguucucaggaugacaucauuacuauugugugcuguggagaaggugcugaguaccuugcauauggacucgguaaagagaguuucaggagggaggcugcuggugaaugaucagagaagaguucauggcagauauggacuuaggagaaacuguguucagacugugcugucaaagucuagaauagauaagaauugacuaggauucccaguaagacagaauauagcauuucaaguagauuuuucaucaaagccagagcaucaaugccaauuucccauuaaauaucuaaggauuuuguuuucacuggaccaaagaaaguuucuuaaauuaaagcuggugccagagaacagcaacucccuuugauaaucagcuuuucacaaagaacccaauauauauuucugccaaauguauauuugcuaugcauuucauagaucugaucucaugaaagcaugauugcaguaugagcuucauauacuaaugcugauuuuguuuugcagaaauuaagcaaucuagagagggccagcuucuugcuaaaguuaugcaguguagauauaaaaguuuacuucuuuucccugcaucugccuuuacuguuguugacauccucacaguucagcuucauggcugguaugaagcauaguaccuugcacacaguagauucucaaagaaugaaaaaaaaaaaagaucaacucuauuuagcacgaggaaugccuuccuccuuguuuugguagaagucauaguucaauaaggacuuuuggacuggauauauaauggagaggcaaguccacugguagagauucugaacuacuuccaguuaucagggggaccgugaagaaggguccuuguauaguuugggagugauaauuauugcuacaagggauaauuugugaaaugcaucucuacugccgauagagucugacaaggggcuuguugcagaggaugccaccuugcagaaccuggggcugagaagcacucauuugaaccaggggaauaaaucuucagagcagcugugauccaugaagaacgaucaaagcuugagccucuguagucucauaccuucccuggugcucgcuucuuuugggaaagugauacaccauauccaaagcgcuugacagagcucuagcuugauguaaaauccugaauacucccuacgugugguugguuauauguguuugccuuuguguuucucauccuucuuuacugaaguugcccaguccacaggggcaggggcucuucagauuuccugaaccauacuguauuuccugggcuaagcuuugugcuuuucauucaugaagcauucacgacacagcaaguaaaugaaucugccuggccccaucaaugucauuaucuuuugaagcccucauccagaagccuucccugcuuuguuacaaacauaacaaaguuuguauacaacuuucaucagccuauagcaaugauguaaaauaaaaacaaaauugagccuggagagauuucucaggaggcaagggugcuuagagagcucaguugaaaucuccagcauccauguaaacagauggucaugacucuauauaccuacuaccccaauauugagggauauaggcaaguggauccccagacaucacuggucagagccuagugaaaauggugagcuccuaacucagcaugagucuguuuuucaaggcaguaagguacagagugauagaggaggacaucaaacuucuuucuccgaccacuguauguguacauauaggcaugcauaacugcauauaccacauacugcauaccauacauagcacacaccaccacauuuaggucuccuuccuccuugcccuugaguacucuaagaucccuaaauaugccaaauccaggcauuggcucucagguucuuugcucucauuuagugucugaaucuuagugggcugaaugagggccccuccaagaaaccugauuuaccgcucucuuggaguucuagagggcaaggaaaaaaggaagaggaguuauuugaggaugugcaugguuuuccagcacaaguuaauccaguuuccaaaucuccgacuuaagaaugaguggacugcagaggaacugccuucuuuucuuucagugaaaaagaugucacuaguggagcugaggaauacuguuggcacacaaaagacugccuagcccaggagggagcuggauugcuggaccuuugccacaaaaauugucaagacagcugcacuugccaacacaacaauaaaacugaagacaauacaacugaauuuggacacuuuucauuuauauugaauaagggggcucgggagcaguuccuauaauuaaaagcagagcaguggagcuucugaagggaguguggugagaauuugcgaagcaggugucaccuguugauuaucaugguucccaguauaugcucaucauaugacuuuuccuugagagucuguuuccugcaggaagagagggcaaagacagacaaaagaaaucuuuucacuuuaguuuggugagccagugaaucucgcuggagguggggcuaccuacugaggcaugggcaucuauaccacauuucuuucaauaacuguuaguggcuuguagauccccugagggaagaggccuuguguaccuuguaaggacucuucucuauauucuguaaggagaugcucuuggacccaaucuuaugagggucuuauugcagaaaaucucugcaagauuuaaacaaggcaacugcaacaggguugucuguguagaacggagguggggucuuagaugaagcuccaacuucaggacuaggcagacaugaucaggcacuugauaugacuuugggaucaacuuuaagccacuggagagaccuuaucuguaaaguaugcagugcuauuuuagauucuugggaauacugcgugaggaugcauuugcagauuuuuuuuuuuccaggguagguauuuagggcucuguaaaugcuagccauaucuucaccacuaucugugacauagacauuaaaagcuugguagacacuuaccuaccaugcacacauuaugucuuagaugggaagagaaacggagaugcuuguaagagccacagggagggacuuuugaaguuguugaauauuuugaguuaguuuuucgucuuuggguuucuacaugugcucuuagacuuucagauuaauuucguuuucauuuaauuuuuaaaagauuggcauuuggaucuuuucuaaaauuaaugcaguuucugagucauucugugacugcuuauacuggguauaccagugagucacugcuucucuaccuaauaguccuucuuugacugaugggcagcagaggugacugaagguagcgaguguccuuagguggcucuacacugugucuacugaugggaugugcuuagugcccagguugagggcucaguacagaagaaccugcuuuguuuagacaacggaaucacucccucugggagguaggguagaacugugaggaguagaaccaagcaucaaccacugauacaguccaggugcuguugauuuuaugucuggugagggcugcuucucaguucacagauguugccugcucuagguguuccauuuuuguagaaauaacaggguagcucuguguggcuuauuuauuaguuuguguguuuauuuauuauuuuaaguuagauuuuuggcuagcauaugaggacaaugucugaaaauuucauacacuuauaccguucuuauugccuuucccauccuccaucucugcgaggccaaccuucaugagcuuugggaagaagagacucagcucucaagagugagcuugcagcucaggaccaggcuuccggguugucaggacacagcacaguucaaagugacuacaagcugugcuuauguguugaccuccuggaggcagcugagcugcugagcugcuucagccuccuccucagccuccaggagggcaggcuuuacucuuugcuuuugucauagccccuugccugcauagacuuuuccagguuacaaagccugucagcaaacccggugugucuuugcuaagguuacaaggacuauauggccccugugaugccucuguggcacaaacgucuguguuuuacaaauggacagacugagguuuagcagaacuguugcgaucugagggcuuuguaaccucacucacuuugucaucuggcuggccuaaggaaggcugcccacugugcuccugggccaaaugaaaugugagagucuggaguuucuaccgcccccaucucuacacacacagggucagcuaggauacuggcuugaaauaaagugacacagugguaauaaaguuaguuuucagcagaaugaacuauugguucucugaaaccaauaguggcugaagaaaacucuuugagauagucaacccuggauuugaaagccuguguggcuugcuuccugggacuugaguauaaucucagcuuuaguuuuuugcuugaaaaaaugggaauauauguuuauucagaccauuagaauaacaugaauuuuaagcucaacaauugcucuggaguccuuccugcuuucucuguagaagggaaagccuauuagccucguguugucaucucucugucuuccauuuucuuuuugccuuuauauguauggccugaggacaagaagucuggcugaagguucacauucuucccaggggaccucaagaguucaccauagacuaaugcaguuuauacauccuuuuguuuccgcacaguauuuaauaggguauccaagcgaugaaguguagcauugggucuccaacuccauagugaugaaguugggagagguuggaagaaaggacagugcuuaaacuaucauuuggucacuuuggaguuuaguuuccugguuguaacauugggaauauugucagcauggucacugagaguuuuguagauaaggagugaaaauugugggaagggcucaguggggauaacuguugucagucuaagugacccccgagaaaggaaauuguggagcucagugguagagggacuggcuguuugaccggugcaaaggccuggguuugaucccucacacugcugaaagcagcaauagcaagaauaaaaaccaaacccaaaccaauccugcagaguucagggcucccacaucagagcucucauuuguauucuuccaaagguguuuccugugcuuuuaguuuuugaaaacaauguuuuuccccugcagaaagcuuuacaaucaguguacuguuggugccaugaaggcucaggugacacugccuuugugcuuggcagggaucuugggcuucagaggauggggagagggcaauuugagcacucagaaaccuccaguugccugcuauuguucuaggaaggcugacuuuagucagcgacuaugccacuaagacaguaucugcacgagguguggaccuuccuucuugggccagcagaugaaaggcuguguugccagccugcaguguaagcuaugaccucgagacucugccagcucugcaggaugguggcuuauugccuuucagggacuccccaaucuggccuuguguggucucauacugauuuccugcauaguuuugacauucuugccaaaugcacagggcuugguggugguucaggccuccccaggguagcccuuuguuggaguuggcaugguguaccgcccucugacggcauguggagcuugauuaguaggcagcuucuucaggcugacugauccccaggauaggccuaugcauagugcccuuucuuuaauguuaccagggaaagaugugacauauagcaauccaggguaaucuuuguaaacacacaauugcuuuccaaauguaguguuucuagcagccuagagcugggaguggggcacuucaguuaugaguuagugagggaguugaccgaauagcauuaggugacaauuuguaaaguaguuuauggccauuagaggucauccugggauggacuuagaguugaacuuucauuuucuuuauugcacugauucacugcuauuuguugaguagcaguugguaugagacguacccuaagcacuguggauccuauagugauuguuggcccugccccgugaagcucauaaucuauuugggggaaacaguauuacacaaaacaaaaaaacaugucuucuuuggaguuaaguuccacacagaacaauaaaauauuaacauauagauagaugauagggagggcuggguaugugggguuagcaugccuuuaaaaguauuuuuuaaaaugugugugugugugugugugguguguuuauuucauggcucuuauguggagaucagagaacaacuuuugagaaucaauuuucuucuucuacuuuguugagucacgguuccuuuugguucugccaugccuuguauuucaguauagcugacccaugagcucuugugucuggcucucaccuugcuuuaggggugcuuggauuacagauguguuccaccucaucuaccugugcauauaggcucuggggaucuaacugccagacuuaggcagcaauaauuuuuaccugcugagucaccccuccagccugagcuuaacuuaccuuuugagacaaguauucauggagaugacuuugaacauuugaagaagguggaggaggaaugaguuaugaggaaagaguugaggcuaaggucagugcagaggcccugaggcuguuucugaguugcuguuuaugcuggcuuguauaugcuuggcacagagaguggcacuauuaggagguguggccuuguuggaguaggugugucacugugggugugggcuuaagaccgucauccuagcugccuggaagugagucuccucauaguggcugucauagucaggguuucuauucauggacaaaacaucaugaccaagaagcaaguuggggagaaaggguuuauucagcuuauacuuccacauugcuguucaucaccaaggaagucuggacuggaacucaagcaggucagaaagcaggagcugaugcagaggccauggagggauguucuuuacuggcuugcuucuccuggcuugcuuagccugcucucuuauagaaccaagacuaccagcccagagauggcaccacccacaaggggaccucccuucuugaucacuaauugagaaaaugccuugcagcuggaucucguggaggcauuuucccaacugaagcuccuuucucugugauaacucuagccugugucaaguugacacaaaacuagccaguacaauugacaccuugucaacuugacauacaaacacaucacaaguaagccucaacccuuaguuucuuauucauccccaauaucuaaacaacuuuaaagucccacagucuaugcaaauucuuaaaauuucaaucuuucuuaaaaucuaaagucuuuacaauuaaaagucucuuaacuguggguuccacuaaaauacuuccuucaggagggaaaagccaucaggccacagucacaaugaaaagcaaaaucaaacuccaacuguccaaucucugggauccacucaugaucuucuggauuccuccaagggcuugggucacuucuccagcucuguccuuuguagcacacacuucguccucuagacuccagcugccuuuacuccacugcagcugcuguucuugguggucaucucaugguacuagcaucuccaaaacgcugcuaucuuccacuguaacuaggcuucaacaauagccuuucauaggcucucuucauggugccaagccucaacucuuugcaugaccccuuuaguccugggccaucaauugcaacugaggcugcaccuucaccaauggccuuccauggccucucacagugccgagccucagcugcucugcaugaccccuucaugccuucaaaaccaguaccaccugggugacccuuacacauuaccuacuuccacuucagcaggaguacagccuuggcuaucuggaacacagccucuuugugcuuucagaaaacacuucccagaagaugucaccucaaugaugcuggucucuucuuaaucacagcuaauuucuuagcuccagcuaaccagcaucaauagucccaguaaugcagagguuucacuuuaguaguucugguaucuuguuaaucacagcugauucuucagccccagcuaaccagaaccacagaauaaucaaacuccaaaauagcaauggcccugaaaagagucuuuaguuuucccucugaaauuucacaagccaggccuccaucuucugcacuguucucaacauuaucuuccaagcuccuacacaaugucugacagagcacauaacauggaauggaucuucuggcccaaaguuccaaaguccuuccacaguccuccucaaaacauggucagguugucacaggaauaccccacuaugcugguaccaauuugucuuagucaggguuucuauucauggacaaaacaucaugaccaagaagcaaguuggggaggaaaggguuuauucagcuuacauuuccauacugcuguucaucaccaaggaagucuagacuggaacucaagcaggucagaaaggucaggagcugaugcagaggccauggagggauguucuuuacuggcuugcuucuccuggcuugcucagcaugcucuuguuuuguuuuguuuuguuuuuguuuuuguuuuuguuuuuguuuuuguuuuguuuuucaaggcaggguuucucuguauagcccuggcuguccugaacucacucuguagaccaggcuggccucgaacucagaaauucgccugccucugccucccaagugcugggauuaaaggcgucuaccaccaugcccggcuucagcuugcucucuuauagaaccaagacuaccagcccagagauggcaccauccacaaggggaccuccccccuugaucauuaauugagaaaaugucuugcagcuggaucucguggaggcauuuccccaacugaagcuccuuucucugugauaacucuagccugugucaaguugacacaaaaauagcccguacaauagccuuuagauguaaaacucuuagcucugccuguaccaugccugccuagauacugccauucuccugcauugguaauuauggacugaaucucugaaccuguaagccagccccaauuaaauguuguccuuauaagaguugccuuggucauggcaucuguucaaggcaguaaaacccuaacuaagacucugacugacuaugugggggucaugugucuggaaggagcaauauuuuagaaaaguagugagagauaauguuagaggcccauuuacucugggucucauguguucuggaaaacucaucucuaucaggauugugcagacugauucccauguugcugacugucucuuaagacagucaucagaggggauggugggacaugccaguuaucucaguaauagggacacugagguaggagcuugaagccugucugagcucuugggcaacauagcaggaucuugucucaauaaagcaaaaaugagaaaaagcaauaaggagaagguugcucaaguaggugauaauauguguugggcgcuaaugggggaaucuuuaaagcugagucucuguugcuguuauucucuccagucaugugaggaacuacucacuucauuaauuucaguuuuucucagcucagaugaagaugauaacagugagauuugucaggaugguggcagagugguaacuaugcuuacucccugccacugaaugauccuugccucaucucugaaggcuggagguuugugugcugccccacugucaugcccuugaaggguuugcauuugacugagacaugaagauccaguugcugcucuuugcguuccaggcacuuccaauucuggggucaagcagaucucuuggagaguuucuaacacaacccuaaugcaauauugacuuagacuccacagcucaaugugaugaguuuucacauuuuugacauaacucaucuagccauguuuaugucucacagccccaugaaucagaacaguggggagacuugugauucugugugaggaagauuggauuaagaagugauaaauuaaauaagugcucaaucuaucuacugaaaugcccagaauuuaaggaugaaacuucaugauagucacaauaaagaaggucacagaaugugagggguaagugcagaguugcucuguuauuucagcaggggauacccagcaguaguuuagcccugaaacagcugugucugccauuucgagucuucuacugcccugugaaagcgugacacuuucauuagcaaugguccugugccuuacccaugaucuuccuaguugucaaugcaaaugcugcuguuuuuuacugauaacacagcuuuuacuuuuagggcugaagaucaucuuugugguuuugcuaggccaaguccccuggcaggcugggcugucuuuuuuacccaucccuuggagacuacaagaggcaaaagugggagcuauuuggaaggauuuggcuauagccuauacugacuuucaacaugaauggaauugaugcgaagcucccauucugguaaagaaguggcauugugucugcucugcucauguguuuuguaccuuagauguguauccuaugucauuuauccacguuggguaugauacugcccuugaguucuuugugguaucaggcugucuucuggauuucaaagucaguaccauguucuuaccauggaagugucauccuucuuuaggacuccauuuuuauuagcugcugucuuuuuuuuuuuuuuuuuuuuuuuuuuuuuuuaauaggucacaugaaggccagccaccuccaucuuguugugcaggaguucaguuagcagacaagauggcugccauccacaugucaccuuucaucuuuuuuuuuuuuuuaaagauuuauuuauuuauuauauguaaauacacugucgcugucuucagacacuccagaagagggagucagaucuuguuacggaugguugugagccaccaugugguugcugggauuugaacucuggaccuucggaagagcagucgggugcucuuacccacugagccaucucaccagcccccuuuuuuuuuuuuuuuuuuuuuuuuuuuuauuuuuuguuugguugguuuuuuuacaaaucaguuuuucucuguguagcccuggcugucccagaacucacucuguagaccaggcuggccuugaacucagaaaucugccugccucugucucccaagugcugggauuaaaggcgugugccaccacugccugucuauuagcugcugucuuaaccucuuauuguuuaguauagcuuguuugccuagcucacucacaugggugaaaugcacacuguaguggcauuuuucaaagcauagugucucuauuugguauauucaagggaaaggggccaauucaagagaugcauauaauuuuggaguuuauauuuugaugguacguauaaacaaaauuaccauguuuccuuuaugugaucacuuggaauugaaauguauuuucauaaacuaagacucaguguuuuguaaccaggcuccuccccaugucuuuugaaaggaucaauauauaaucacauaugauaagcuuuguuaugaaucgaauucuuugaccuucuguuucucaacucauggaugcugagguuuagacagauguucuucuggacagauguucaucauuccuuugaguuuuccaccugcucauucagagcuggaacagauuuuaccugacugcucagcauaagaccuuagggccacagagcccacuguaggcuugaaacaguuugcucauuaagcuggacaguaagccaugcagcucgucuucugugccaugcucguuuucuggugccaggcuuucacggcugugcuuuugcaaaccugguacauaggaaggcaccuggaacguuucguuuucuauaucaagaaauaucauugcauuucugccagauagccucugacauaucauuauugaaagugaaaaaaaaaaacacaaacaaacacccaaauacuuaggagaaaggaauaguuuaaaaggauaauuauuaugcuuugcagucaguuacucccaacuacaguguugaacagugugguugauaggaaccaaggcaaagaugaagugauucucuuggaaauggaguguuuuccuccuugcuccccaucuuuccagccugcucucaucgcuaugaggaaauuccccagaaggaauuagaacaauuaggcgaguucauuuuggcucacaguuuaagggguacaucuacugaagauggggagccaugguguuaggucuucacccaugguggcacgagccuguaguguggcuuguggugaagaagagugcucaggcuggaugcagagcuggccagcaauccucaaggaccacgccauagugauccacuuccgaaugacauggcaucccaggcuggauacuaggugaucaaacacuuaaacuugugagagauguuucauauucaaaucauagcaccaccuguuucucuucugcuuuucuucuugagaguguugagugaccauugguacuaccaugaaugcuuugugucauuggauuugcggggagcaugaagcuuggggcagacuucaugggaguccaccaagagaggcagcacacuaggaauucauagaaauugagaaagcaguacuaguuagaguguauuaaguaccagaaauauuaauuguuuaauguuuccugaacccuacuaauaacuauucuuccauuuugaaaaugagauacagggagguggagaaacuugcccagagccauacaguuggagguuugagcccgaaugaucuaauugucaagagccuugcugauuaccuuaaaaaaaaccaaaaaacaaaaaaaaacuuggagaaaaauaaaaucuugggaaaagacuuggagccuccauuuggcacgaacuggguaguuuguguucuggugcuuggagugggaaugcccacggucuuaucugcaguaggcgaauccuuguagcaauuuuuuuuuuagacaggguuucuuuguuuaggccuggcuguccuggaacucacucuguagacuaggcuggcucaagcucagaguuucaccugccucugccucucaagugcugggauuaaagguuuguggcagcauucuuucuauuauuaagcaauuaauuaauuuuacuuauucgcuuuacauccugcucacugccccucucccagucaccccucccacacagucuuucccccauccccccccccccauucccuucuccucugagcagguggggccuccccuggguauccuccuacucuggcacaucaaguuucugugagucuagguggauccucucccacugaggccagacaaggcagcccagauagaagaacauaucccacauacaggaaagagcuuuugggauagccuuugcuccaguugcucaggacccacaagaagaccaagcugcacaucugcuacaaaugagugggaggccuagguucagcuggaguguguguuauuugguuggugguucagucucugagagccccaaggguccaaguuaauugagucuguugguccugcuugugggguuauuacugaguguugaaaaguauuucacuuagcaucuggguucagguucuggcguucuccuuuguuauccaucccccuuaggggcugcaauccuuccuccuaaucuucuguaaaaguuuccaagcuccauccacuguuuggcucuaggugucugcaucugugugagucagcugcuggguggaaccucucagaggacaaccaugcugaacucuugguugcaaagauaacaaaguaucauuaauagcuucagggauuagugcuugcccaugggaugcuucucaaguugggccuauuauugguugaccuuucccauagucucuuggcagaauucuuaaaaguuuuaauuuuacugcagcuccaccuuuuagauaccugucacacaaaacagagcuucuuaugcagucccuauuccucuguguuugggaucauaaaguaaaaaauaaacucuauaaaugaaauagcuuucuugauuuauguucauuucuagaucugagccuggcacagaucuggugcuuagaaugucuuuguagagugagugaagauacuuggaguuccaaaauuuggguaccuuugagaaguguacagguaccauuggaugguggccucauggauauauccuugggugagaaagaaagauauuggauguauugauaucuguaguggacuuuuguuuugauugcuugcuuguuuguuuguuuguuuguuuaaucugagucucuucauguagcuauggcuggcuuuuguaguggugauaggcaucugagagaaucaguuuaaagcugaaaggauguauuuuaguucagaguuucagagaucuugguccacugggagauggcucuguugcuuucaaucucugacaaagcaccauggaggaagggcauggccccugaaagcugagcaccgcauggcagcuaggaaacggguagaagaguaggaagagaccaagggcaguguuccccuucaggagcacuccacucuucaguaaccuacuucuuccugccaggcccuaccacugacauuuccaccaccucuuggcagucuuuguagacuucgauuccaucaguggaugccaacauuggaugagagcccccacacagacacagcuagagguguguuucacuaaucccagaggcauuucucagccaauugaaaucauuuucaggcaauuauaaucaagguuaggaaguguguagcgugguggacuuucccaaaggcaugcucuuguguggucaacucgaaggccaaucaguagaacauuaccacaaccgcagacagcucuggccuccaccacugcuccuguggcccccccggggguguucauccugauuuauguagaugguccucaguaucccauacugcucaucaauuccaaugcuuggagguaccauggaaaccgauauggguacaauuauuugugcuuugcauuuuugauuacuccaggauuaaucaccuaguucccaugucuguggcuaagaugagaaacaagaaucaaagagcuuguuaggucuggguugaagaaugagagcgguacuuuaagcuuguguuuguuccucacuauuguagauauucucuuuuauugcauguguuugcaauuccaagacauucggguugaacaaugucugggagaggccaccuuauagccaugaggaaccaacuauugcaucuguaaaucagggacaggcagauuccuggcccagaacugauggccacaccucacaugccagaguuuccagcagaccucagcuucaguaggggccacaggaggcuucagagcaggagggaagaggauucuucauggcaggcuauuuucuucuguuugcugaugccaaaugcucugggguacuggcaaggaaugucuucaguuaaagcaacccaaagugcuguguacuacucugugcccccucaaguuccugguccccuaccugcugcaggaugacugagaccgagugcugcuguguggcuuuggacuuucaauacaucagucccagucacucagagggcauccucccucaacuccagagucccuuuggaugguugagguaacauguauucaggcugaggagcuuugcucucuguggugcgucccucucuucccauaguuccccagucaaggacagguguuggcugauauucugcauuuuaucccaggccacagagugcuuugacaacaauuuugggauggaaaucuuuccggccucuuuggcccagagauugcagguccucauagagcugggaucagcuuccucuucuuucaucagaguaaugggggugggagugggcagaaagaagcucagguauuacagaaggcuccaugccccugggacuagaacuuaacuccccaaauaccaaauaagaucuccuuucuggaagcagggauucucauaaaugaagccaguauaguuuauugcuaugaucccaguuacagaaugcacagcuuauccugugcuggccucagggcaugguaucagcauccuaguagaaacuucccgguuuuuuuuuuuuuguuuuguuuuuguuuuuuuuguuuuucuugaacagcagaggaauugaguccuggaugcucugcuuagcugugugaguuuggauaagauucucaacuucucugauccugagcagaauggggaucacuaacuacaguuugaacauguucaguuuguguucacugcucagaguaaagaagcacuuacaauagccuauugaggguuugauguacauuaaacauucauaaaacugcaagacuguagauuccggaacauuccagagcagaaggugcuuuauuauucaugguuucuagacagagagauugagguacaugcggcuaaguuccuccuccauacugccacagcaguaggaagcugagcuaggauuugagccaagaggaacuugacuuuaggcuuuccuguguaugguggcagaaccauuugggguuuccccaagauuucucagcuaaagggcauguuucuaucaagaagacucccuauugcaguuaauauugauggucaacccaguggaauuuugaaucaccuaggacauaaacaucugagcaugccugugagggauuacuaugauuagcuuaauugcauugcaaagacccauccugagugcaggcagaggcauucuccaguuggcauccugaacugauuaaaggguaggaagugagcugagcauuuguuuacaugucauucugcauccugacuauagacacagccaccuccaccucauguacuuaucaccaugcuuuccuugccacucccuggggcuuugugugggugagguucccuagcugagacccagauauuacuaccuucuacaugcuagcuucucagccagguccccagguagauaugcaucuguuagugccuuuccagccuaguguucccuuugacacuguugagaaaagucaacacaaauaagcccuaccaugugacucuuuuguccaggaagagcucaugcucacuuaucuaggcgugccuccauggagugcuggaggaguuaaaaaaagaaguacucgggcugauccaagugcuuuuuguggacaggguaggaauaauaacacuaaacaugaagccagcagcagcgcuccagcaguguagauucuuucugcuaguaucuuguccucuuggcugugaaagguggccaauucccuuuccuuaagggccuucaugcuucccugagcagcuggggcagaggugagugggccaguuuuguuaaaacaguuuggcuuucauggaagaggcuuguuuucuuaguuaggucagucagcucuugacccugccuccuucacucugcucuggcuccucuuccaguuuccagcgggagcugggugaggacuuuggaugcucucugcuuaacaucuaguccuuacugaauaucuagggugcuuucacgggggaauucagguucaagaacauaagugaugcaguuugaggugguggccaugauagugccaaagggguagggcagcugccuuuuauuuuccccagcacuauguugaacucuuagguggagacuuggugaauaauaaccaaggauagcauagaucacaugucugccuugugcugggcaaggcacuaagcccucuuucugcucacauguucgaagagacuguacggcucaaaugcccacuuaaugaggucacuacuggagucagggucaagucuaaggguguguugcuuauuucugcucugccauauaacugucaugauggucaagacagauuuuuguguaggaaaagauaacggcuaucugauuuuauacuuugccuucuagaucuuccccaucuucuccugugcuuuugcuucguauuuguugaucuggaauuagaguggauuugcugguuccugaggaguuuagcugacacaaaaccaguaaccauuucccgcugucuaugaauucccuagcucuuaacuauuuuuaaaggugaucagcuaauuccauguccuucauuauagagccaaaaauaaagcaaaagccugaaguucaguuuaucuaccccacaaguaugcuucguucagcaaauaaaagcuuguuuuagaaaaaaggagcagagagagaagaagugggggagaugaugcuguauggguaugccaugccauacuguauuauuggcaguguuggaaaaguugcaaacgaaaguugagguuuccauacccugcucugaagccuuccccacuuaccugugcuguaccugcacauugguccugacuuuucaguucugugucccuuucugugucuuuccagagugaccagggacugucacuuguguacuuuuccugacacaucguagggcuggcacaucguagauguacuguaaaugucaagggaaugcaagauacagaaaaacauccugggagauaagaugcuuuugcccaaguacuuuuucuaauaucuguuguuauauggacuggggcugaaauuaugggauguaaagaagccacugcaguuugauucaguuguuuguauaaccacaauuauuuugugggguuacccagugcagaguauucuguugggaaauggaauaaauacagaauggauaaagaggcaaaagguuugaaagccaacugcuagagagaguaagucuuccucagucacuuguuucuugauuuaggcaguuauagcugaguaggaacauagauugugggucugaauuuuaauucagauuuuaccauguaugaccugcauaacacuuuccucuaacaugccccagacucgggagguuguugaguaaauguauaaagcauucaggauuacaauugguauugucugcugguguuauuucuguuaaugaagacucaguuuccucauggaaaacccagaugugucacaugacauuguaacaaggacugugagucuccuaggacuggacuuaauagugcuacaaaagggguggcucagacccauggacauuuacugucucaccaguuaagaggcuggaagucugaagcccagugaguugucaggguccuuccuuuugucuuccuggccuccggugucuuaaugcuguccuuggugcucauuggcuaguggaagcaucccugacuuccacucaaccuuauuuauccucaugcuuuccucuguccccgcuguuuucuuagaccaccagccaugugagccaagggucuacccuaucucaguauaccucaccugaauuauauuuucaguacccuguccccaaauaaggugacauucuggagugcugaugguuggcaccguaacaacuacuuuggggauacacaucugaacucuuaccuugggugcugaaagucugagcacagagcucagaaggaggcaguagcaaccaucgcuggauaaacugaugucacuucauccucaccuuuggcuaggggguggggggagauguuuuucugaacaugucuacucuuagcuuuggaugaugugauggcuugcaggugagugggcuccuuggucuuccuguuucuggcauaaagcggaaagaacauucccuuucucuaacaugacccaggaauccugaggugcuuguggcacaugugagucuagcugugggucagguuguuacaucuuuccuugccuuacuugucugauguuuugugucucuucaugggcaaaugaucaugguaguugcuugcacagaucggggcccaaggugucaggaaggcucugaaaagcauuguauacaugaguugguuuggguuucccaaauuccaggguuacuuugcagucagaauggaaacaugacuuucauuccacuugggaugauuugcuccagagaaguguggaaacagcccuaauuuuagcucugccauacuuaauaccaacccagaaagugcuauuuugggccagugcccagggaaucaggaacauaagcuugcugagggauuagaucaagcauagauuugcucagggaccacuggaacuauggagaacacuuuuuugaucuuuaguggaucaaaaaaggucagcuccugcuaagcaugaauguacaugccuaaucucagaacuuggcaggaugaggcaggagaauugcugugaguugcaggccagccugggcuacacagugaguucuagacuaaucugaacuacaaagaaagauaucugaggagauagcuagagagauaagcccugauccaaaaggagggguugcuuuccccuuuaauaugucuugucuaaguuuugcuaauuuuggagccaguucaugauauuucaucacaugucucuaucucuggaauccuuauucugguccugaauuccuggcauuuuuucacagcccugaucauggucugugagguugacucauaugccuugaagaccucauaauucugagguugacucauaugccuugaagacccaaaaaucauuuguaugccuuugagagucagccagggucaaugucauguaaguacugagcaaugcuauccaguagacauacauaaaauacauagugcaaggaauuugacaaacuuguugauuucuguuuuacccaucuaaggguaugagguagcuaaaauauacauuuucuuuuuuaaaugggaagacuugauauaugagagaaauagccugugauucuaauaaaggcagucuaugaaggcuuucugcaaggggagcccacgacuuggaggauguugggugcagugagaugagggaagauguguaaggaaauggauucaggucacuuaggaaauaacccugucuuuucagucuagcaagaacccuguagauuuucggacagagaaagaacuucagaugucaucuaauuuuguguuacuugaagcaugauauuuagcauugauauuuagcaucuucauccuugguuauuuauuuugguaaacauggguuccuuggucaguuccuuagacuacaaguuggucuucuccagacacuuaaacccauaaugagugacugucuuguguaauuauuuagaagcuagauuuuaugcaugacagaggugguugauucuuguacuguauuuccauauauauugugcuccuaaaguaggaugaggaguaauauaguugugguaaaaauagaaaagugguaugcaagagacugcaaagaggguagugaagauuggguuggggcucaaugauugaagguuaguaaaguccagguagaccagaugacugcaguuucuuccagcacugagaacuugaagucuguuuauuguucuuuugucucagcaugcaucaaaaguguacuaauuucuaccaaauucuugggcuuacugugauuuggauaucauuuguuugugauucccaaggguuuaugcucuagaaacuuucucuucagugugagguaaccuacaggaguggaccuauguguggaccuaagugcuaugcacuuggggugcuucuucagaaaggauuaaugugagucucaugcagagcaaguaaggucucuugagaguugguuauugucuaacaacaagccuggcccuugaacuccucugguuuccaccucacauuuguuuuaaaagggugccaucuaccauguugugguguagcuaaaagguccuuauagauccaugaacuuuagauuuuggaaggaagaaaagugguuggcauacuugcuuccuggcaaaguucuuccuaauuccuagacuaugcugcucaagccauacgagagccugggaccugaguugggcauacugggcuguggaauauaucuguguguuuagggccaguauagggaguuuguucugcugcuuagggagcagcccuagcugacagggugagucagagcagagcccagaauagaagccagagggcauguaugugaaggccauauauauuccagucauuaagauuguaagauuucugcauucaaugaugaaacuuuauauguguauuauuugcugacugcuuuaugaucauuuauuaguguugguugguaacagguccccaauuuagcccuauccacuuuccaggggauacuuggacccgaauccauccagaguccaggucacugcuuuaguauuugggagccuacucccaugugucuggcugucuguuccucuguccaucuguucaaccaucuaccuguccaugauagugaccuuuuguuaugcacucucucauagguagcauuccuucuuaucuucacuugccauugcugggggcauuaguggguacuagaauuuguguguugcugauaugguugcauaagcaagagcagcaucuuuauucugacuguaaguucaugaggacagagcucuuguucacaucucucuuucuguuauccagcagaguaccuaguacauucuugauguucuuaauauauaaugcaaaaugagccaacugcaagcuguguacuugaccccauggaaaguacuuuuucauaaucauuuuguuuauccuucuuguacuuuuccauguguucuuauucuaggcuaccaucuagugcauguuuacuguuauuauaagcuggucucaacacuuacacagcagauaauacucaauagcauugaauaauuugguuacaauuauucuuuuuucacagaugagaaaauugagacauaagucacacaagucucuaauucaggccacuucuuuauuucuggaacaguguuuccuagcagaacauuugugugcuggaaaggcucugucuaugugcucucugcuauaggagccaccagcccauggauaguuaguauaucuuugcaaggaagcuugugcuaaguuuuaaauuucauuuaaauuaaauuucaaaagucaccaaucucuacaaggcucuuucuaaauauuaauaacugcugauacugaaugcuuacuaugugccaaguucugcauugaccuagagacauguguugaaugcuuuaaaccucaaaacccugggugaauuaaccaaggccaggcugucuuguuuacccuauugauaaccuaucuuauaucuuacaguaaggaagugcugugacuagguucuugcucguggagaacugaccucagaauuuuuaaucagcucguuucccucuguuuuccauaugcacuacaaugaaucauugcugcaaaaaccaagaucucguugcucuaaguauuugucagcuaccaacagaauaccucuuucuccccucccccuuaucuuccugcaggggucaagucaugugcaguuuugcaaacucacuguccccaccaaaugacucauuuagauuaaagacacuuauuaccaugaggugaaguuaugucagugucacuuugaaaaaacaaaaacaaaaaaaaaaccaacaaucuucacaggauguucugucaugucuccagacaaauuaaacaaaaugagauuuauuuauuuauuuauuuauuuauuuuugugaugguuaaaauuauuuuaagguuagggugggaagaagagaaggucaaccucuguugagcugcagucucaucggguagaagagacucuugcaucucaugaguuugaugauauccccaguuccuuuacugagauggauuuaaaugugagucaguuucauugcagaccugguuacagaguagaaagcagagacacaauacuccugcauggaggugguucccacugcagucuacaccagaggucaguaguacuuuaggauacagacuugucuccaguguguugugugcuggugauagcuaugcaguaaacaggcuaauuuggaagccaugaagugacaugagguagggccaggaauucauguuaggagcagaauugggugaaaguaaucaagagagauacuugguuggagaacuagagagaugggcccaaaggaugagccccagguaagcacagcugaaauuuagauaagacuuucuggcucggagacuguaggauagggaauacuuuagauucugcgaguaaguauggggugauguaggcaagaggcucuggggaaaagcucuagacuuugauugacuaguuaaauccugauguuaauuccuccugcuaacucaaggcagucauuuagcuuucaaaggcaguuugaguauccuuuuuuccccccaucuauccaucuacccacucacccacccaucugcccacgucauccacuugccuauccauccacuuaccugguacccacacauccauguauauaguauuugaguaucuaaucuguguauggcaugaaagcuaccguaauguaaaggcaugguccguauucucagggaguucccagucuuucccugaggcacacauagguaugcauuucugaaacagcaaggggaguuuuggauuuuucuagacuuuaaagccaacauuaucauacccaugcagcuuucaauagcaacaagcagccagucaguguuuacuuuccuauuuccccucuugcuuguauugguaucuugcaugggcuauuucauuguguucauggaaucuuuauuguaucucuccugagaauagagcccuccaaguccuccuuggaccuuggcuuuguuguagacauuguagcauuagaguuaaguaugcugagcuagaagggaacuguuucacaugcaaggagcuugaaacaaggcuggaagggucaucagugaucugaagaguucccuaucuuucugugaucucagcucucuucucucugcaucuguuagucuuacagacaguagccaggcagugugagaaucaggggaaccugcagcgcuugcugaagcugaagcugaacaaugcccauuacuuaugcacacaccccaccaucaccuggagacguugagacauuccucuuguuggacugacaauuggaggucacauauuuacuuugucuuugagccaagcugcugucagguaugagcauggcagagaauucguaccuuagaacccuagagugcuuuugauaucuucaaauucaggacccgugauuuucaaccuuuugaaagcugcugcugcuucuuucuuucuuucuuucuuucuuucuuucuuucuuucuuucuuucuuuccuucuccuucuccuucuccuucuccuccuucuccuucuccuucuccuucuccuucuccuucuccuucuccuucuccuucucccuuccccuuccccuuccccuuccccuuccccuuccccuuccccuuccccuuccccuuccccuuccccuuccccuucaccuucaccuucaccuucaccuuccucuccuccuccuucucuucuccuucuccucucucucucucucucccucucucucucucucucucucucucucucucucugucucugucucugucucucucucucucucucuacaccagcuacuuauuucuuaaacuugacuggacucaagucuuuuagaagaggugauauauccagucaugaucagagugcuguuuggaagcaaguacuggugagugagaucagcaggcacugaaagaaggcaacauagcuuacucugcaacauguaucuuauugucuuaguuaacccaaugaguuauguuaaacuuacuuuagaaaagagcaggggggagacugauauagguguucagcuuaagaucaagcagcuuugugcugggugagugagauuugaucucuaauaacuugaucuuguucugugccacugugugcuauggaaagcuucgagcaguacgucacucuugaaauaaaaaaaaaaaaguguguauggggggcuaccuacucccuuacuugggcaagcacacugacugauguguuucacauuugucuauuauaagcuaacaauaguaaugagaugauggugauguucacuuuuaaucucagaaugagaggaauaggcaggaggaggauggauucaaggccacccuagguuacauagcaaacaaacaacaaaagaaacacuaaaacaaaaucaaggguuagguuuggagcucgguggagggugcuugccuaguaugcauaaaauccuggauuuagucuucaacacacacacacacacacuugugguauaauaaggauuaaaaaagauuccuaggaaaugcuuuguauaaugucauaugguaaacacuaaauacauggggcuuccaaugcagaugugcuauaaaagggucauuacucaucaguaacaucuuaagugugcuuacuucugcuaauuuugaccucgugcaggccuuuauucauuagcagacuuaccauauuaaugaaaaagagcuucuguuuuguaacaagaagugcaggcauaauaccaugcgaccacugaaaaugugaauuugagcugaaauuuggccucuugcuugacucugaccuuccugguauccagcuucaucucccauagcugugguggcaguuacugugucaagaagaagcaugauauagcuguggaggggggauacacauuucaauacuggaaaaagaagaagaaaacguaaacuucuauugcucaaggacagaacugucucaggcgacugcucaggagauauuguaaacccccuucccuggggaaugcucuguggguuguucuugaugaggucagaggcuguuuccucagagauggcaugcaucuucccagcaugcuccuagguauagugaggagagucuuccuuuguuuuguacgauguuacacauucucugcuauggccuuccagugauauugucucguuguguguggcccuuuaccuccuccacucagaaugaacucaugggagucagaggacuugacuacauggaaaugguuucacuaagaucucuucuguguuauuuauaggcaugauuacucuucucauuaccuuuucaauuagggaggaccuggcuuaaggguuuuagcagcuaaaacauuuauuggcgggugcaagaacguaggugccaggacaggugcuguggaggaggaucugagaacgaccgaccucaagccugagguaaaagagaugucuacggcagcugcaccuucuauaggugaaaggucugagguugcgcagcugauccagacccagauuagauuucuucuguggcaguaugcucucauucauuauagcugauuccuugugcauuugcagguaaauuguaggcuguguguguguuuagggugggacuaggagaauaggaguuugcaaaguugcaggucgugaucccuuuuggcagcuuggaugauggagaagguuggcauucuuggcccagguaguagcugugcuaggcuauaaaagugauauagucagcuguucucucuuugcagauuuaagugacaguaguaccaagagggggcuguggcucuugaucuuucuucacugugcagaggggaaugaguauugugggaggagaugagacaggaaggucacugcugcugcagagauacucuugggaggcuaggaagccucaucuucagcuucugagaugaagucuccagagaacgccuggaagcauggcccucacaccccagauuccuugcagaauguguguaggugugggcugugcccauggauaauaugcagcagacccgugagagcugggggcggauacagcuuauggggccacuugucccaguggaggaaccuuuccagcugauggagccagcagugaguugauauaguguugucagagcagugagcuccuucucacacagcuaucuugagaauacuauucccucugaaguuuguggcucugcuguccacugaacagcucaggacagugaauaccagagaaguuaaguggcuuuugguugccagcugguuuagcaugaggacauuggaacuccaggguuagugacuuacagauuuaugucauaggagcugcaugucucugggucccagcaaaacaaacccuuaguacucucuuauuuauuccuuuuaaguguuuugacauguuuuaucugcauaaugucuaccacguguacacuugguaccaguggaggccagaagaagucugauccacaggaacugaaguuguggaugauuaggggcugccacauggaugcugggaaccaaacccagguuaacugcaagagcacucagugaucuuuaccacugagauguuucucagcccuguccucacccuuauuucuuguccugaaaguggagacagagaagcagacauuuaucugagucauauacauuaucauaauaauuuuuuucauuuuuauuagauguuuucuucauuuacauuucaaaugcuauccccaaagaccccuaugcccuccccccuccccccgcccgcugaggcuagucauaauuuuuuugguuuaaaauguuuucuaaaauuuauauguaauaaagaauaugccaucuuaaccauuuuuaauugugcaauuaagaaguguuaaguaauucacacugcugugcacucaauuucaagaacucuuuugaucuugcaaaauugaaaagcuaugcccauuaaacauuuuccccuuucuucagccucuggcaacuaccuuccucugugauauaacuacuggaaguauaucauaagagugaggucaguuaauauguguccuuugguaauuggcugcuuucacuuaguauaaugucccguagauucauccauaugguacuguguaacaagauuuccauucauuuaaagccagaauucuguuauaagcauaauacagauaguauauuugucuuucauucauagauugauuuguguguccuuuauagaucacucaggaugguaauuuccaucuucucacuguaucuugcauauuuuacaaaugaccauaaaccaaguuuggugugaaaccccagucugcuugaugcuuauuuuagucggaaggucuuucaaagagucagugucuuaggguuuuuuuguuuuuuguuuguuuuuuuguuuauuuguuuguuugcuuuucgagacaggguuucucucuguagcccuggcuguccuggaacucacucuguagaccaagcuggccucgaacuaaaaucugccugcuucugccucucaagugcuaggauuaaagaagugcaccaccacugcccggcuaggguuuuauuuuugugaagaaacccaagagaacucuucugaaggaaagcauuuaauuugggcucacuuacaguucagagauuuaguccguuauucacauggugggaagcaugauggcacacaggcagacaugaugcuggagauguagcugagagguccacaucugguucugcaggaagagaguguugcacuagacauagcaugaacauuuuagaucucaaagccugcccccuugugaaucacugccuccaacaaugccacaucuacuccaacaaggccaccccucccaauagugacagugccuaugagccaguggggccauuuucauccaaaccgccaaagccaagaacaaauacaugagaugauauacaagagauuauucuuuuauacauuaguguauaucugaguguaugcaugugcauucuaugcaagccaguaucugcagagacaagaaaaaggugucagguuccuuggagcuagaguuguaggugguuuuugaguggcuugauguggugcugggaauaaaucuuugcaagagcagcaggaucucuuaagcacauacugaggcaucucuccagccucagggacgauacuuuguaaagaguccauugaagaaaguucuagaaauguugguugaggauguuacaggaucugauacucagcugucaguaucuuuucucuuggguauuuuuccagggcuuugcuguugggucuguguuucuccugggcuugucaguguauguaugggucagggcuugcagcauuugaugcuccuguuucuuagcuuuuacaauacaauaucuaagucaacuaccuuauaauaaugaaaaggucaguuagccuguugcuucuugucuguucaugugucacauuacaguaugaaugccacguggaauaacuguuugccucauggcagcuggaaaucaaaagcaacagacuuugaaaggccguagucucaacaguccaacuuuaagaccauguaccagauuaccuaacuuuagucuauuaggcucuaaguucuaaagguucuacccucuucugccagcuggaggucacagccuuuagcacaugggccauugcguguauuucauaucuaacauaugcuauuagggauuguauuccagcccugucucacugaaugugcugagacacauucagugcccuaagcucaguuugucaucuguagaaugaacaaagucuauacaucuuuuagucccccaaaccugaagcuuugauaggccuuaggagccugguccugucugagcuguaccaggucaagaaugcuuacguggcuccuaugaagccugagguggauaugaacccucugagccaggaagucuuucugugucccacuagcacaacuuccagaagcguuuagggguggggggaugauucacuuuguacuauuaaagaccacaguaggagguaaaccuuuagauuguucuguguuuucugcccacuguuuuaccaaaguguauuuuccuuacugccagagguccucacaguggccugguucccauaggcuccagaggcacuauucucaaagcagcaagcagucaucuaacaucaguauugugugucacagggucuaggugugaguuuacaaagucagcucuguagaagcuggcauacuucuucaugcucaggaugugacaaguguaugcugcccauguucaguaaagugguuuauagcagcaaaggcaagaucugccauaugacugcccauaauugccuucuaacccaaucaaucacuaauuucuauuuaaauaagugcuuuguuugucugggagagcccugaguccuaaugucugacauugaccucuaaaucacucugggaaagauuuaaguaagcauuucuuucucacuuuucccuggaugcacauuuaauucagcuucuccugcuccugaccacauuucuugugacuccguguccuauggggauauuuauugcuuacaucuuuugaauuguagccuuuuggggucucuguacuagcuggauaucaaaaacucauaauggauuuuucuauugccugugaggagcccaugcuucuggcagccagcuuggaauaaagggcauguaugagccaugaacagagcucccucagaguccucuguacucugcccucugaaccugacuuuaagaugugucuuuaauuuuuucugcuugcuuuuggcaaaacaagaauuggaggauggagggaauacagauagugacauaccagcucaucugacagcuagucucuugucuucucacccccgccccuuuuuauuuuuaacaauaugcacuaaggaaacaaauucagcagcuggggagguggcucaguaaauaaaguacuugcccuugugcaaacauaagaaccgaggaucuuacauagaagaugggcauggugaccaaagcuggggguccagaggcagguggauggauauguagaguuuacugguaugccaguuaguggugagcuguggacucagcaaaagccccugucugaaaaaauaugguagagauugacgaagcuacuuggcauccaaaucuggccucuauauugcaagcacugauaugaaagaaauauacugcuaugaagaacacuugguuuuuauccacaaggcccacgguuugauccuuaacaccacaaaagcaagcaaaauaccaaaagcaaauugagacauaagcugcuugggcagccugggguaugccagguaauauguaaaguguucuuacuuuuguuuucugaaauguacacagaaaccuuugcaagucaccaucgcuuggcuauguaagaaaacuugccugcucuuagagggcuaaaaguagaaauggcagccugcuccaagcucauggcucuguucuguacuucccauggguagcuuuuuuacgugggccuggaaauggguucaaugugagguucugaaggacuuucugugucugguacuguuuggugacauccaguagauuauucuguuguuacuccuuagauucagagagaugaccaagcuuccgcucagucuuuuaguuuagaucuacuaaguccccaggagggaaguggauccuuagaucugucucauagcucauucuguuggaaacaguuaugucuuuuuuucuggaggaauauguagcuaugugggagguuuacauuuucaaagcacuuugaccccugggaggugcuccuucuacugucuaguugguuucuguauuuggaacagucuugagauaucuucuauaugaaucugacuagcugucuuuguugcuaaugccccauccccuuccuaaaguuggggaccauuccuuauauaccuuucuccuuuggugcuagugcagacugacaccaccccccuucuucuuguccucacccaaacuuggcaagcagugcugaugugauggugugagguugcuucucagcauggugaagcucagcugaaucauuuugugagccuuuuagccuuuuaaguacuacaggguccggccagcaaggauuaguuacuauaagggcacaaugagcaacaaugagcaaugaggacauguauuuuugcuuuauucaaaguauaucccaagaugggugugcaacaaauagccauugaaugacuccucuuguuaaaaagcgauaugauggugugaauaugguucucaggaacugccuauaauagauguucugguucuccaggugagguucucuagagaauggauucguauaauguuuaccuaccuauaaaagggaacuuauuggguagcuggcuuucacacuuacagaagguucaagguaccauagugguugucuuacgcaagauagggugccugggaagcugguagcugacuaaguccaguagcugggagccucagggcucaggaggcugaaguagaaguucaagcguccaaaggcaucaaaccaggagccugauguccaagggcuacauaagaauacauccagaaagaugagccagaaguucccccuccuuccauguuucuguugcacguaaccugagaugauuggauggugcugccuacuucgagaguaggucuucacucuacugccccacaugcuagucuucuggaaucaccaaagguaauaguuucuuugcuaauucuuuaggcauucuccaguaccaucaaguugacacuuuacaacauaggguucuuuccaaagacauaaggcugagccccaccuugagacugaaauuaauaccaacucauuggcugggguuuagcacauauguucugaaaagaagggucugacaugauuuucuauccuuucuggaugacaggcuaugaucuuuuuugggcuuugaagucuuacugucugauuccuugucugucagguuaaggaaguagagaauggucuggucaggaaacaggguucucuuaguauucuacucuauccaucacucccaggccaguuucagugccuccugguuuagaaagaucucugaggcucuggcuggaaaucaucuucuucacagaaugucuccugugguuuuaccucucugcuucuauaauacuaguaacagcuauaugcuguuaugcuauauguagggucuugggaguaggaauguggugggaggccauacccagauagggguaaaauuauuaggaggucggaaacugcuggacccucuacacaucaguugagaagcccaggagccagcuauucacugacauugccugccuugauucccuccacucagacacagacugagguauuccuggaccuuaucagaggauuguacuaaccaggcuauccuucuaaauaaaauuauggagccugggaauuagaagggaaagucuuccucuuguggaauuguacauugugaagaugguaacugugcugauguuaguaagaauagcaccauacaacaguuuaccgaaacuuuugggugucagauacugucuuuggcuuucauauguaguacuuuuaguaacuucauaucucuuuugccagcgaggaggcuagguaaaaugaggcguucaugcccaucuuugccucuguaauaaccaagaaguuucccaggauggauugguacuagguuuucuggcuucaggaaugagguuaggugaaguagguggguauccauaaacuguggaaaaaagagguaagauagguagggugucagagaagggauucaaauuuguuauccaguuagccuuucaguccuuugagaaucccuaguaggcagugagaauggucucccaauuuagaacaggacaugucucagaaaguucuuugcuuagguaagcgugagcuaaggagcuggaccuagguccccucugccuguaauacucuggggucuugugacucaaguacuuaaguacauaccuaugguuuuagaauaaggagcccucagucauguagguagaaaguaggaacacacagcaauuugggugccauuuguacacuggaaguuggucaucuuuguaucccuggggcucuuggaauagaccccuuuccuuuguugguuuauucagagccaaguuaggcagggccuggcucuguguugaaacagauuaugauaggccucuucuugauuuucauuaauguuagaauaacuuuugaguaaucaguguuggcuagagggugugaugagugaagacaacaauguaguuacuguccucaaacuuuuaaccuugaaaguuuugccugacugucuccauggcucccugauuuaaaauccagucaucauuccccauuuucagucuucuguaaaguauaaacacacuauaaauauggcaaaggauuagaaaaaaugauaaagaaaaaaauuggguaucuaaaauguagaguagagauuucugaauaucugcaccuaauaagcacccaugugcuaauauugugagcuugcagaguagaggaccacuuuagcacaucauuucaucaaaagugagccacagauggcuugauuucauguugguuacucauguuucuggcuuuucucaugggacugcuaauuggccaguggacaucuuugcuuuucagcaagcuccugaucaugaagcagaacaggcacacaguugcuugugagggaguagggauuggggugugguggcagggugguucucugucuucuggccacauucagacaugguugguugugacugcugguaaggacugugcuuauacuuaagcugaugaaagaaugagauaagaugaaaaaaauugaaucauaucauacugggucuuuggccuuuuuuuuucuucuuuuuuuuaaagcaaaaugugggacuguggagauaguuuaguagguacaaguucuugcuguaccagccugaggaccugaauuaaaaucccaagaacccacguaaaaaaagcugggcauggcuggaguaccuguaacucuagcccagcagcuccugccaaccauccuaguauaaagaguaaacauuagguuuaguaagagacagugucucaggggagugcuagaagaagacaccccaacaucacauauaucacaggaaauucccuccucucaaugaugaaauguaaaacagugaacaguaaggauuguuugcucuccuggcaugcaaucuugguguauaaccaagaaaagugguugggacuuucuaaaagacuagauucuacaacauguacaucuaucuggaauucuaguguaugucaggagaucccugguuuacuuuuuaauuagcagcucuguauuuuucuucuccacuguucugggcacauguuugcuaauuuuuccaacuuagagcugaguaaaacaccugccccuacccuauucugaguuuacagguaaucauggccaugcugcucauacuuuuugaagagcucucacccucugaaccgucuccucagcucuauauuuuguuuaaaggaacaaaagagccuaaaggcccagcaugaaucuauuuuuucaccaacguuagccugugaaaucugcuucuuauggaguucugaucuuagaaauaguaaucuugaauuguuaaauaaauuucugaguguucauaguuauguugagggcugcuaagaguaauaauauauaacuguauagaugugagauauuuuggaaggugaguaagaauguuaaaaaugaucauauugauaaagaaagacuaagccguugcagccagaugugugucuugaagggauguaaauuugaucaagauucuagauucagcuuccagaugacaggaaccagagagggcagcaguguauguuaaauaaauacuuaugacccagauuauagugggcugggguuuuguuccaaaauaauucuugagagaaaaguguaaaaagacugaguagagcaaagguuaugcccaaaaugguuaugguccggucauuuuugaugucuaaccuaggauacauagcaacucucuucugaauaccuuugaccauuucccuuuuccacuucuuccuuuguccuugcuuucuuccuuuucuucucucuugacuuaaaaaaacaacagcagcagcagcagcagcagcaacaaaacuacauuaugugugauuugccugcauauaugucuguauaugcauguuugauaccuguggaauguggaaaaaucauuggauacagaagguggugaaacucauauugggugcugggaauggaaccuguaucuucuagaagggcagcaaguucucuuaacuacugaguuauuuuguuauuuucuucagucucugguugacauuuuuguaauaaaacuuucuaaugcaauaauguagccuaugggagcuaaucuuggcugucaacuuggcaaaucaggaaagacaggaagacacaaccacaguugagaaauuuccuccuuccaguuggccuguggguuugucuuugaggggauuuucuugacuaauguuugugggaggaccuaauccacugugagguuugcacuaccacuaugggucauagaggaaacagcugagcagaagcaggagaggaagccuguaaagccguguuccuccaugaucucugcuuugguuccugccuggagcuccugcccggacuuccauugaugauggacuauauaagcugaauaaaucuuuuccucuccaaguugguuuugauuaugguguuugucauagcaacagguuauugcgaaagagcuaugcuuuuuuguuuuuuuuguuuuguuuuguuuuguuuuuguuuuuuguuuugcaaagauugugacaguaguuggaacucagucuggaaaagucauugagugcucagaccauaacgagccuuugugggagauuugaggauaaugcugaaagaaauaaacacgaugaugccuggccuauaaaguuucaaagggaagccacggacucuuaucaagguuguuuuccugguauuuugaacuaagaaucuguggaugugaacccuuuuguguuuugcugggacaauggaagcuguuuguuugggguuggaaaacagcuaugauuaauaaggggcccauauuauugaggugcaaucuucugggaaguauuuccucagggucaucacacagaagauauggucaguaggcguggaguaagguugcuccuggagguggcgcaggacuuguugaaugauacguaggcaucuuucaugugggacaggcuugcaggaugaagcggucauuuggagcagcugaggcuuugccauuguguggcagagucagaaucucccugaagagaggcuugggaaacuaggacaaaccuuuuucuuggcucugccugauaaacaggcaaggugaggucugucacagguaauagccugaaauaguugagcuugaugugacugauguuaucugacaaugugacuuccuaauauugugcccugcacuuccuagauucugggguugggggccaggguaaagacucaaucaauaggauccagaauuuuacaguuguguuccaguccuguuuaccucuguguuuucugcauuagaacuucccccuaggauuuuguuuaaacagaaagaaguuccuacuuuaagaagaggaagaaagaaaggaaagaagaaagaaagaaagaaagaaagaggcagaaaagguagaaacuacccucugacuauauaaaggagaaaauggaagaccagagaggaaagagaaccagauucaccuaggaggcaacugccugucccagccuccuggcagcuauuucugaucuguuaccccaaucuguaggcuuuuagcuuccugcauaggcucuaugcauucugcacuccaggcugccuuuccccucuagccagaacugcugaacuccuucucugcccgaagcaugccaggaggaaaguccuuugagaaguaagugcuugcugugugcugcgagcccccacuuugcuaguuuuuagcucguggcccugcagcugugccagaucacuuccagcagaagacagccaaaaauugcaaauuugggaaaugaacagucuccuugggaguccacaugggcuggaaggcuguauauugaacauuuaaucacuuuuaaugcuuguuucaccugcuguucauccauauuugccuucaauaaaaccaagcagccuagaagagccucaggagagcccaucuuucagggccaggaacaagcaccuccagagcacagugggaauccagggcuauaaggauguucugguaaguuggaagguuuuccccuagagccagguagccaucuaggaaaggaaggggugggguaaccuagaagaauaagggaggguacucucuuuuucuuauaggcuaguguuagaccuuaaauuuacuuuguacccuaaucugcauggugagguuugcuuccacugcuaguauuuuuuuuugcuacagauuuggccugguuagaggguuggguaguggugggagaggcagucaggguggaggaaaccacuuucugugcagcuugaguuagcccugcauaaguguuggacuugugaucucaccccacuuccccugcuuacuucuucugaaauguacuuagagcuuuagaguacuaccuucagagucugguugcucagcauuaggagacuccuuagagcugagcucaggccuggcguccacccacuggaggcauuguuaacaacuuauaucuuuaacgaguacuugcuguauguuaggaguggguuccagggauggcaaagaccuaguccauacuuacagguacacacucuaauagcucuuaacaaugauaaauaagaaugacuggucaauuuuauugagucuuugcugcuugccaagcacugugcuaaugauuugccugugucucaucauuccuguacucuuuacaacaaucagaagggaaagcuuucauuaguaaucacguuuuacagauggagcauugggguuugaaaagaggacauagcuucaagaggucagggagauggcaaugagcauaggccaaagacaggaguuaugcuggacagcugucugcagaaaauauucucuccaccaauacgaugcugccuuguaugguggaaggaacuugcuguggccgauaaaccaauggggaaggagaagaaaguuggccucuugaguguuguauuuauagagaaaaacuaggagaggcuucccagaagagaugacugccuacguuuagagugcaugaccaggaguaugcuuuaaggggucagcaagaacccagaguagaaagcacaggccuguuuggagaucugaagguaacagucuaugcugggauacaaaauaggaaggaaggcauccaccaugcuggggagaacucuuaagaguagcauccaaacuaucuuccaauuccguagucacuagccaccugugacuccuuuaaugaauuaaauuaaauuacauuaaaaaucugcuuccuuggucucuguggccacaugcagugaaugacuacugaaguggagggccccuguguggaauuuuguguauuguccccagaaguucuauuggacaguacuaggcugacucauuuccguacuugucacacaucugcuaggcuucacuugcuguucccuggcugucaagaaugcaaaguuccaggggauuuguucuggugggauccuguguacugccugacuaucccugcagugggggauuggaguguguguguguguguguauucacacaugugaacaaugugcacuugcuccaaaggugaauguuagugaaauuuuuaaaacaguacuuuucaggucaauauauaaagcaaucccccaaauauaucauuuucccuguaagcuugagagagcugcuaguuucauuaaaaaggcugugguaaaucuauuuuuaauuuuauuuuuuuauuaaaaacaccuuacugcucaagaucauaaucccuaacugaauaauaggugucauuuuagaguuucaaauagccagcgcaaugcacacgcuggagcuucuuaagaaaugggauuugguacuuuacauuauuguagggacaaaaauagggcaaaaagcuuuuccuuucuacgucaaguacaagauucugacuuugcacauggugagaagccauuuagcaguauaaaagggauuuuuauuuagauaaugguaaccuuguuugauuuuacaaacuuuguuuuguaagaggaaccugacucucuuugaagcccuguaggcaguuguuaaauauuucagacuuuauuuguggccaagagauucaguuugaaagacuugugauucacuccuacauuuugaaaugauucgucacuauuuuggaaucugugauuucuguuugaguccugauucucucugucuccuuauaucuguggcaucucuugauguucuagcuuagcauucacuuuugcucuggaugggcuguggucacuuccucccagggacuuaagagaagaugguacagggcucugagaaggacaaugaugauuguucugucucguguuuggcauaaggauuacacaagaccuggucagagucauaagauagugagcuauguuuauaaaggaggaagguuuucuuuugguucucaggucagcaaugggaaaggcaugugggcuggaacaaguccuguccagguugguaaaaucaccuggcuagguuugcuccuaacucuguacugggaagcagaggacuccagccagaauccaggcuguacuauauaaccuuuaagguccaccccagcaaacugacucccuuguuuccacuucucaaagguuccacagccuccccaaacaguaccaccaucuggggagggaccaaguauuuaaacaugugacauccaaaucauaacagagaauaaagugaucaagaacaagagugcugggcauaucagaccuugucugacagggauuuacagaucauaagccauuagauuuuugucuguuuguuuuaaaggguaauuuagguugaguuuucucucuuugauggaaaaaucugcccucuaagaaacuucucaaaacuaauuuaggguaucugccagggggaggcuuggguagggauggaauuuauauaugcugcucacuucucaccuagggcugcuguaggaaugcuggauggcaaauauccaaaagcauauuagaaacaguauauuacuggauaccauugagaaaagaaaagggaaucucuuagaccauauuuuuacuuuucuugucagagaguccuaacaguuuucauucauagaucaaagcuggagugagagauuaaauuguauuauucucagcauuuuaagagcuagccuucaaaaccaguuuuauauguauacugcuaugaaauagucuuauaguuuguaaagccacaacagacuauuaauuuuuaggaccaauuuugcugucgcaaucaaaaugcuuuauugugggacuucucuuaauuugccuagacuuuaagguuuuggauguucacuuggugaauuuagaugccaauuuggugauauucuugucaaauuacuuuaaagcuggauagaauguuaaggccggucuguguggaugcaugcuuuuccuauguuaguuagcauuguuucaacccucuucgucauggaagcuguuucucugggccauggauugucccauaaugauuuuauaauccaucagugaacagaauaaacagacuccuaaauccuaugcaacagagagugcuuggacuuuguaugaauccaggucuccccugcucacucacugcagcaggugauugccaugggucaguaagggucacgguucucuacagugauguaugugccagggccucauaccuggcuggcaggcaguaaucauuuuucuucucacucgugugaauggguuaguuuaaggcaagucauucuggcuccaggggaauuaagacuuuuauuaaauaaucaauggaucccuuccagcauucaucgucucauucuuugcgugaguaaucuuguucuuaguagaugugauugaugcuuuugugaucugugggaaucuugguaugaguagcuuauucucuguugauaugcuaagaugagggcauucucucagcuccaguccuucuuucuacucagcaugugcaguacaagggaggaccaucccucaggugcccaggccagcacccuuuuccucucccaugagaugcuuuguuugucuucaugguaggccuguugucugggcuauuucugaagcugcugcuggaggacuggauguccgugcuuccuccccagcaugacauggauauuucuguucggagaguaguuuauuccuuucauuuuccucccuuccuugaugcaaauaaaagccauggggaacugucauggcaagauggaugguauuaauucuauaauacuaucagugacaucuagaagccuuccaaggagagacaggggcacuagauacuacucagaagaacugcuggcagcuagaguccaccccuuagugggaugugcuguucuagaauguuucucaauuuagcugccaaagguguuucauuaaagcaaacuauugauugauugauugacugauugauugauuuauauuugaaacagggucucauguagcucaggcucacuucaaacuuauuucauagcugagguuagacuccugagccucuugucucaaucugucuagugcugggacuuuuauacagugcuaagcaucaaacccagugcuuuuaguauguuuggcaagcauuguaccaacuaagucauaucccuagcucaaguaaacacaauaauaauaaugauaaugauaauaaauugucuauccuacuguucuacaaaugaaugaaaauagaguagaggagagucuggcagauauggucuuagcauagaauguaagagaaccuuacauucaaguugggcgauaagagagaauacuggguagugaucaagagcaggagucugcaaacugugagccacuuugccuuccugagcuuuuacauugugaacaguuucaacacugaaagaauacuauuuucaacacugaaagaauacuauuuucuaucaugaggaaaugacaaaugauuuaaauuucacugucuaccaauaaagccuugcaggcccauaacaacacauauugcaucuucuguacccaugugccuaccacuucauucagcuugcauagcuacaguugagacuguacagcaggcagagcuucaaggauuuacaaccugaccuuuuccauaauguuugcugacuccugcauggauguguggaaccuuccugcccuaaggcuacacggaaaacgaacaacauuuguucagugcuggccagggccacuaugcugcucuuucaggugacuguccccuuccuucaguuguccuuaucgacacugugcugccaccuguggaugcuagaggugggcguucucaccuguguccaguuuccuggggugggguugaccucucucuugggcucagguguucuuaguaacccucacuugcucaggaaguuuuuccgauuuacaaaggcuuuucaugucgccgccuuuguucacaguugguuuucauuuuucacauguuaucuucugcuggucuauuccuauaaguuagcccuucuuaaggguguuauggacagguauaugaguguuuguuauuacaaauucacaaucuuguugaaauuuauucuuucuucuaucucucucccccuucuccccaccuuuuccucacccccugaaaucuauucuccucucuucucuuuuccccccuuucucuccccuccccucuccuuuccacuccuucuucucaguguuacagaaaacccugugguuuuugacauggccaucacaggauuucccauguucaaacaguguugauggggccuggcugagaauuuguaccuuuugguuuaagggaguguggggguuugauuaguaauggcuuguauagaaucaugugguugaaugcuuggcuagugugaaguggcacuacuaguaggucugguuuuguuugaggaagugugucacuuggaggugagcuuugaggucuuucuuauaugcucaagcaacaucaauguggcacagucucauucugccaacuguggaugaagauguagaacucuuagcucuagcaucaugucaucagccugcacacugcugugcuuccugccguggugauaauggacugaaccucugaaacuauacgccagcccccaauuaaauguuuuuucuuauaaaaguugcugugguuauggugucucuuuacagugauaaaaaccuaacuaagacaaagaggaagacaacugauagaauguccauuucagacccuggaaggugucccuugcaguguauuaguacaagagucugaagucuacuguuacuucacuaauaugguaggguauuggcaaguaauauacagagaaugagcuauucaaaagcuagaaaccucaagacaguugaguucauucaguuagcaagaacuuuuguuccuguuaugaaugaggcacucuuuuagagaaauagaguugucuuggauauuguauuucauagugguacauauggaaacagacauagacacacacacacagagacauagauacagacagacagacauagacauauauacacagaaauauucucucucucucucucucucucucucucucucucucuccauagugaggauugaauacaaggccuugcaugcaacagucauuuacucuaccucugaaucuuagaaauaauauauuuaaaaauagaucaaugcauuggugcaaauaauccaguuggugggauuuaguagguggugauaguaggaacuggcuagucuauccaggaagucuauucaguaaaguugggaggauacccagagccucugauaaagccaucagugccaaaauaggacaggaaaggauuuuagguacugggcacaacacauauaaagcuccugagggugcaaguuuacuugaacaacaauacacuacugugaaugggcuaugggaugucacagugggacuugugggugaacacaggucagaucccacuuaauaguagagcagugacuagccugaggggugcagaucccacauuccuuuccaaggugccuuguacugccuguauauagguuuuaggcucuaacuugcuugguucuuaucaccugugguguccugggguuaagcuugcucuccucacccacucuuggccuuaguguugucccaguaaacuguguaccugagucagcaucacuaagacucucucugguaucagauccuagugacaacaagcaggaccacgcccagaccucaucuuuacacugcugguggaaugacuaacuuuucucugaugagguagauaaaugugguuguccccacuuugaaacaugccuucuguaccaacuguacauugcagggagcagcugaucuggauguacuccaguugcugacagcuuugagugguuauaggucucuguugcaggcuguaggauguaauguccuccccacaagcuuucuuuuacauauauguaugaauauacaacagucuaccuugaaaaauugcauauaugaauucagggccuugcuugugaccuuagcaacucagguuggagcagauuagauggaguuaggcaaaagaggaauggaauuaauacuaccugcugcucucaucaagagucuccucauauauaacagugauuguuccuccaaaaguaaaaaccuagggugucuaauguguaucaagugugagccaagagcucauauauccgguuucaucucaggacuacuguuuuucuggauuaaggauacuaguguaccucuucuuucuugaaagauaccaggcugaaguuucuccaugcucagugcucuggaaaacuuagcaucugacucagcucuuagcuacaaugacucuuuaggcuguugguuugcaguagugccagcaaguuuuuagcgugaauaacacauauggcaaaucccaucagacccucaaauguuauuucucaccugcaguauuguuaggcagcucagagccccaggcccugaaugucaccgggcacauuaaugaaugaagugaauauaucuugguacuuguggggcuguggaauugugaugucuucucagcuaccauuguagguaaccaguacaguuaaucacugcuaagguagcuauacacaagugggaaaauauguacaaacuagccaucauggauaccccugccacucccucucccccaugcaaaguauaauagauuauguggcugcuucucaaccacagaaguaucacacucauauaaagucuggauagacacaucauaacggcauauauuaaacaucagcuaugguuucuaugucuguuccuucugguucugugagaauuuucccuuacagugugugcucacuacaugugaguuuaucugggugaagaaaacaccauccaugucccugagcauugugauaguaugaacuagguuuggcuucuaacuucagaugauagauguauauugccuauaugcuaauggcauuauuucauucauuucuuuguugcugaggaaaacugacaugguggaaccucuugauucagugauuguagcuuuccugugcuagauauuuuucauggauuuaauaaagaggggaaaugaaagaugcuuuucccacagcaucuuucucucaaauauucacuguuauggcuuaauacauuauuauuauuauuauuauuauuauuauacaaagcaugguuuggcuuaauguuuauaguagaacacagauguugaguauauacuuguugaauacauggcagaucuuaggaguuagugacagauuuauuuugauuuccgggauccaguuuuauuccuaguagugcagaagccuguaaaggucauccagccucguggaauucuaauauuucuauaguaaaaugacagcagucaaacacuaggaccaaccucaccucucaugguacuuuaguagacccacuauggcaaaggauuauaaacccaggggcuuaagcuacagacauucauauuuucauaauucuauguccagaagaccaagauuaaggcauuggccauaggguuauguucuuaggccuuggagacaaugcuuuucuguguccucacagugaaucccuauguacucguaucuugaucucuuucuuugggauuugauuaaaguucauucuaacaagagauuuuuuuuuuacaccucucaccucuuuggagauacuuagcuacaaauacaguguaaguuuuaggaacuagacuacaccuugacacaugacuucuagugggucacacaugacuuagagaaggucaugagcgugggucuuacagaguugcugaauuaaauauauucuaacugguuaaguauuuucacaauacugggacauuuaaaagucuaaucaaugggaguauguaauuaaagguuaacauaaauucaacuaguuuuuuaggcugaaauguuauaauuuccuugaugagacaacugcuuagggguugggguugggguggaguucugguccuaaguucaucuuuccccuagaguagggcacagagaaucaucugcaauauguuggaguuuuguaaucuaugggacuuacuaaaucaucaagagcccaugucuacccaccuuggaucacauccaugucugggacauacuauaagcucugucugcuuaguucauuauuagcaguauaauagcauguagcacuuauugagcccuuacuucaccagguaugguuuccauaggggcuuguggcugggguaccagucagcaaacccagaucacccagucugccuacagaguuuggauuuggauuagggccucuacuucaggcuccucugcuuuuuaccuguggaguuccacuggguuccagagaagguaauggguggcugccagaaacuccaaauguggguagguuuuggguuuccugaguuccauggaguugccucaacguggacagcucuucuugguuugaguucugcaacggaauuccagagccacccccccccccccccaaagccaguggauuagcuggccccauguuaacuaagacuugagcuugucauggucucugcauuuuaauuucugacuuugguccccaggcuugcucauguccauuucugaucagucuugccccauaggugggauguaucuguguacucaggcuugggcuugcuagcgaggcuguuucuuugccuuauguguggaagaagcagcugccugaguguuuucuggugauaucagaaccacagcugaguaaugggcauguggccagguggccuguagcuuggccagugugacaguugcuggcaguagugguauagaaaaugcuugaucgggaaaggcccaguaucacaagagguuuuguguuaggacuguaaucagaauguucaaaggaauggugauucagaauccugaaaccugaguggaaguuaggugaaagaaagaaagccacagccgggcggugguggcacacgccuuuaaucccagcacuugggaggcagaggcaggcggauuucugaguucgaggccagccuggucuacagagugaguuccaggacagccagggcugcacagagaaacaccaucuugaaaaaacuaaaaaaaaaacaaacaaacaauacaaaacaaaagacaaaaagaacaaagaccaaaagaaugaaagccacagucagugggaacuacaagaaaggagaaaaaauggugagguaugugaagggagaagcuaguuuuaacuaaacuugucacuugguacccuggggcugauacuuggaaaugacauguuugacuggggaucaugccugcgucagacagggaggggcuguaugaguaaagcucacaaguuugggcuuagccucuuuaggacucuggccuauuuguguguguguguguguguguuuuacaagggucuggcuccauacacuugucuuuucucuaguucugugcuuguacuugggauuaugauggccuccgggcugggaggggagcugagaggagacagaaacagcuuucuuuguguguacaaaauauuauauuuacuuaaaauaaaacuacuacuucaucagcuggugcacggaaguugcggucaaccucgagaguacuucuuugggccccauaagcuaucugggacugucuggcauggugcacauuagguuuuagcacagcaaaggaagaaaaaaaagcaucacuguugcuugcugcuggccuuuucagcaucucuuuccacucucccaugacuucuccagcucuucuucucgagcaugcaguccucagccuuaguacuguguggcuggaagaccagcaagauauggucagaggcgguaugcagagaccuaaauauaaaaucuuucucaugucuuugucacuuuuuggcugugugcaugcaugaucucugccuaaauaguaaccucaauauagauuuuacuuucucagugccaaugccaucauuugcugcagccugauugucuacucucagaucaaacacugaaacccuaacccaugagaugguauauaaagaagccuugaaacaugcuugguuuagaaaaggccccagagaccuaccuaccuuacccuuucugcauacuugcaggugcuaccagauagacaauaucaugggcuagucaugaacuucucauccuaaagaacgguggggaguaaguuucuccuguucaauaacacccauucuuuuguccucuguuauggcagcugaauggaaaccuugaucaccugcaucaucaucaccaccaucaucaccaucaccaucauuuccuucuucuuuaguguuuuccuguacuagcauuauucuuuuugcuuaacauauauggacuccuuuaauucuuuuuacagccccaaauuauuuauaugucaugcccuauucuuuuuuuuuggguauaaugugccauggaaauaauuggcuucuuuuggcauguaguuuuguuuacccuagcuguugugugccuguggaggguaccucaauguggguuuuaaaggcccuuucccaucccuucucugaacuuugcugcaccaugcucuuggccauuucuguccccagacaccucccaguccacacaagaggauaccugggaaucccugaaauaugaaucuuugcauugaaacagucacuguuuaugagugcuuaaaagcaggucaccuccacguucuguggcuuuccauagauagaggcacuaguuugauugugaggaucuucucucgucuguuuugcuaguaccuucucauugaccauggcaaggcauaacuuaguacccauucuccugaucucuucaucuuucaucucuuccugcaaguugcaccaaugccuuuuuuuucuuuuuucauuuuucuuguuucuuuucuucuuuuuuuuuuuuuuuuucaaaucucuccucuguuucccauauacccaaauagcuggaacucuccaguucugucauugguucacacccuuuuuguuccauucucuggcccucucuacagggccccuuccagagcagugguuuucuagguguccauucaugcgcugcauccagauccacagaaccugaaguugggauggcucagggaaccucuuagcaaaugcccauggguugccccuauugcucugagagugagaaccucugagcccgacaauucagacagcuuccuucuagaucugucuucagugcucucugcaauuugucagcugccuguuuugguuuuuuguuguugguuuuuuuguuuguuuguuuguuuguuuuuugggauuuuuuuuucuguuugaucuauuuucuuuuuucuuuuaauuuuuuuaucauuuuuaaaaauuagguauuuauuucauuuacauuuccaaugcuaucccaaagguuccccacucccccacccacccacucccacuucuuggcccuggcguuccccuguauugaggcauauaaaguuugcacaaccaaugggccucucuuuccacugauggccgacuaggccaucuucugauacauaugcagcuagagacacgagcuccgggggguacugguuaguucauauuguuguuccaccuauaggguugcagauccccccaacucuguuuuaaaagaauaucucuucccaggcucuuuguucuucccacuucuguggcucauacaggccacuguggggcaggccugaguucaugucuguuguauaggagugaauuagcaccaucuugauuucucccgucuccucuuuugggauuacuuagaaguuuucuuguguguguuuuguuuguuuguuuucuguuuguuuuuucuuuguuuuaaaccauauccuuuagagaugugauuuaucuuaugccgucacugccaauaauuuauauauagcaggggagggaauaauauucuuuaaaacaaacucaaguguuuugggauaagcuguguauauucaagaaacuuuccuuuucuuuuucuuuucuuuuucuuuuucuuuuucuuuuucuuuuucuuuuucuuuuuugcaaggauggcucuucugcauaauccugggcaugacugucaucgcugguagaaugagcugauuuccaaggccacuucuaguuagcaauucuaggucucucauucaacuguuuggaaaggcugcuauuuugggaggcucaaaauacuagguucugguuccuagauuuuuuuuuuaaguauuagcuuauuuggaaguuuacaaagauguuugcacauguaauaaauuuaaugauuuuugagauaaagaaauaauugugaguuaucaccuagguuagucuuaaagguuuucuuuuuuuuuuuuuuccauuuuuuauuagguauuuagcucauuuacauuuccaaugcuauaccaaaagucccccuuacccacccacccccacuccccuacccacccacucccccccuuuggcccuggcguuccccuguaccggggcacacaaagucugcguguccaaugggccucacggagcuccaguggcgcaaucgguuagcgcgcgguacuuaaagguuuucucauagaguuuuuaauagaaagucauaggggauugaacacauagaaggggaaagggugggcuggagcgauggcuuagcgcuuaggagcacugacuuccagaggucaugaauucaauucccagcaaccacauggugccucacaaccaucuguaaugaaaucugauagccccuucuggugugucugaagagaacaacaguguacucacauaaaauaaaugaauaaaaucuugaaaaaaaaaggggggaaaggucuauaugccuacuagacaacauuggauaccucugcauucaauauccuggauggaaugucuaucugcccuuagcacuggggcucaugaguguaugaugggagggacauaguuccugagcccuauuguucguagucaggcucuggccauucccucaaugucuuuucugucuuccuuuacccaguugcagcauuucuguucacuguguccaucuguuguucuaucuugcuugcauaucuauaucuacaguuuguuuuuggcaauugcagcuggaaacuuuaguggcuuccaaugauggagucaggauggaugggugauggguacaaacauggugaaccuuauacaucagguuuuguaaccacuucauaacuggggauuugauggccacugacauccuggcaugaaaaaaaugcuaucuucaguguauucuuuaccaaguuuguuccucguaguagcauggucauuuggugucucugcauagauuucuauagcaaaagccaccauucucugcuuaagacuugaggauugccugggaggcuuuguauugcucauuuaaaucaccagcuacuaaaaucacaacugguaacauuugaagacucauuucuggaggugacugguucucuuuccccugccuuguauuuaggaaaacaaagaccaaacaugcugucuccaugaugauguauaguaaacuuaaacuugacuuaugauggcaacucacuuuuuucuuugcccuuuaaaacucugccaugcuguguugguguaccauagcucucauuuaacuucauaaacuaacauauauugagguaauacugugugcccagguccugcuaugaacacuuuugcuaaauuccaucacuuggcucucauuccaacaugaugcuauuauuaguagaaaguauuuagacuuuuuaauuggcuagaccuuuaauuucuacagcuuguuaaauuuaauccuuaugugugaagugggaaucauauggguucagcauaagucuugaauggaugcuuauaagugaaaggaaaaaauaaauggcuagauaaguuagggacucaacgaaguacacguaauuaaaaaagguuggccaauaaaauguuagcuacgcccaggggccuggcuugggcuuauugaaagcauguggcugccuuuugguaguaucauuuguucaucugagaaaugaaguuugccuuuaagugccguugucaagguuaaaugaaauaaugcuguguaugagguucaaggauaguuuagguagaguuugugacuaccaagaguucaagauuugggaacuuaauccccaauucugugagguuggggguggagcuuuaaaagguggguuguagaaagagcuuuuaguucacugggagugugaccguggaaugguucaaggugccucuguggaacuccugagcucucuggcuuucuguuugaacaugugaucugucuguucucacacugcuguccaucuuuaguaaaucuguaaaucuagcagggcuauaaaucuccagagcugcaaaccaaguaaaccuggugguguuguuggugaucugguguuguuuugggugaucuguugcuguuuuugguggugguuuuuuuuuuuuuucucuuuuuucuuuuuugguguuuuguuuguuuuuuaagaguuaucuggccgggcgugguggcgcaugccuuuaaucacagcacucgggaggcagaggcagacggauuucugaguucaaggccagccuggucuacagagugaguuccaggacagccagggcuacacagagaaacccugucucggaaaaaaaaaaaaaaaaaccaaacaaacaaacaacaacaacaacaacaaaaagcuaucugcccaaaauauucuguugcagugaaaguauaaguaccugacccagugcccagaaugaugccuugagauugaaggcuauucaaggaaugguagcgguuauuaauagcuguuaacagggcaggcaaggaacauagagaacgugaauguucugggguuagccuuagaagucuuacccuugagaaaagggugacacagaggcauggaaugcauaugacucaguuuggucaacgguguguugcccuagaaggcagcagaaagaacuuuauccacaaagagucuuucuggaaaguucuuugcugugucaggggaggagaauacaagggucagcagccaguggcaugcacgugcacuugugcacacuuauaccaucugggggaugugucauugguucaguccuuagaauuggaagacaacaaccaggaaaacauuaugacgugagacuuauuugauggaaugggugaagcucuguucugaggggauggaugguuucaucuuuauucucaguuauguguuccauccccaauugugaacuuuggaaugcuguuguaauuuuucauuuuuuuuuucuguauguagugagaacauuaacuuagaugaugauuaauggcuuauacuaugcaccuggcaguguacuaggucuuaggcagacacaaagaaagcacaucgucuguauccuuacacagcugacaguuccagugggcacaggaaaguuagccaggaguaacgucuguauccuuacacagcugacaguuccagugggcacagggaaguuagccaggaguaacgucuguauccuuacacagcugacaguuccagugggcacagggaaguuagccaggaguaacaggcuuaauaugguacugugaaaauguuuguacauaaugaagucacuugcuagugcaaucacaguuuuguuuuguuuuguuuuguuuuuaauagccaagauguaugauaugguccggguaaaagcuuuugauuacuuaauaauuugaaagccucuuggcagaagccaugugugugugugugucuguguguguguguguguguguguguguacacaugcuuauaugccuguggagcuacauuaguagucaaccuugaguaugcguccuuauagguccagcugaaauuaauuaccccauuuuccuaaguuggauugucuuccagauuguuuuggaguguggggaucaucaaccaaugaaaguauuuacuaagcauacauauuccaagggaaucagggaaaccuuucuuggcauggggauguaaaacaaaaauaucaaugagggacagucugcagccuuagccacacaaguuaugaaagcauuuagaagauagaugauccacucgauucuugaggggucauggcugagccugugauuuugcuguaucguuggguaugggccuguauacuggaggcuuuccacagauuucacuggccuggccaggugcgagaguucaugcauaggagagcaagugcgaguagggaggcaaagucguuuccaccacuucugcauucucgcacaccuuuaauccuucuggauaggauucuaauauacagucuugggguaggucagggucugacaguagguacuucucauuggcuuggucugggagcuuugagaaaaccuuauuugcaugugggaggacuuggugcugcuccuauaugacugauggcugcacaccucucuggcagggguggggggugugggaggcuguagcuucaacaggagccaagggcccaaggaguauggccgaacaccugccauuccuugcuggugacagucaccugcagggucucugggucuaagccugagcuggaccugggaccaggcugccuaucacagcucacugccccacacuuggguaucuuggacaaguuucugggcuaucugauccuaaguaucuaauuaaacagcuacauaaaaagcuaugaacauguuugugaugagccaucaguuuugguuuguggaacauggaccaguauuacuaccugcaugucacgcagacaugugauugacaacuaaaggggaaaggauggggaaagaaaaauggaaaugucaguuuucuuaggcaccuuuguugagcuuugguaugucuccacuguagguuuuccacauggaugagguaggagguagcuugcugccuugcacccaaaccaggaacuaucuaguguacccgcuacgacuuccucccucuuuguccacuuagaaaagacuugcuguuaugaucuuaaucggaauuauucccaacuggauuaugcuuuggauguucagucucuagcuugagauguuuugaagcauaggagccuuuagaagguggagccugagugguggaagugauucacuagggacagaccguugaacaucaccgcuugccuugcuucuaaccuguauccugucuuuccugucuggcauugugugaagaguguccaccauauacucccauugccgugagcuaaaauacaguuuuauucccuuaaauuguuucucagguauuuuaaucacaaagaugcagaaguaauuauuacucuauagagaaggugaguaaugagugacagaauccagcugucuuggaacagcagacuaugagcaaguaagcagagacauugaguuuuggucuuuauauguguacugaagaaauggggaauagucauauggaaaaagucccuguggaagggacugcaaggaggaacauguaguaacucaagggcaguuacaugagcagucuugucuucauuuccuaggugagaaacaaggcagaggguucuaaaaugaguaccugaccugaagcccuuaugagauagguccuucuuccauggauugaagcugacuuuuaucauccugugacccccaccccacaacuucuccaucugucauaguuggauaauuaucuuguccuaccuuucugcugaccccuccauaauauugaccuaguauggaaguguuaaaggauaaguaauaaaaaugacaaugaagcauuugugaacagaaaucauccugcugcaugcuaacagagagaguccaucugauaugagagggcagauuuauuaggcagcuguuuagcaaucauguaucuucugaccccagcuuaacaaggcagcugaguauaguuccagcuggacuuuugaucuguugucuugcuuggucucugguauguaacccugagauuauuugaaaggccuguuacauugugaauuuuggcuuguuucacagucacagaaauggugggucugcacaaaggaucaucugucuaagaaaggagagacagaugagugacuaaguucugccagugguagugacaccugagacagauacccaaacaugaaguuuguagaucuuuagcucaggcggaagagagagggagacagcucaaugaaguguccauaaauagugacaucagacagaauuccaaaccuagugcagaacaaggccugugagcuugaacucuggaacugcuuucugguugguagacguuggacuuauuauuucauccuuuucuggcuuuacaguggagugaccagacacacugccacucucuagggcuauugagagcauaaaaugaauuaauauaugcagagggcuugagagagcaucaguucuaugaauguaugugugaguaccugccaggauaugcaaagagugggccuuucaguaaggcugaggguaaauaccacuuuaugagaaacuuguaugacuaacaaaggagcagucuagggaggcuaaugagccuccaguguacauuuggcuacacauucaugcuuggaugggcacauagaugauauauguaccuauguguaugugagagguacacacacacacacacacacacacacacacaguguuggaccuccagggauagguuuuauuggaguaaagauaaauugaagagaagagcuugauuuuugauauagaucuagguagaaaaguuuaacaguuagaucagacuaccuuuccaugcagagccuucaggauauugagcccacuuauaugacaaugauuggaggccuaugacauguucaguaucuguuuugcugucugucuguccaugcauuucaaaguaucuacugacaucucaaaauggguugcucaucuaccuuuccaauucguucuuguaacuaacucccagugugacacugguauugcaaaauggugccuuugggagggaagcauagauaagagccauugagauuaugaucagaacucucagacaacagacacaggagagcuccuacacucuuuuaacuguguaaagacacaggguaaaaaugcgucuguaaacugacccucaggagaccuuaguaccuugauauuagccuuucagucuuuagaacugggaccaagaaaugucugucuguguucuaguuacccaggcuguggugcuuuguucagcagccugagugguccaagauacuaucugugucuuugauaaaucuaagguagcugcugagaaugaaagcagucaugaaaaaucuggacacugcccugaauugcucaaaggugauuuuuuuucuuccucuaccugcuucucauuucuuaucucaaaagccacaggggucacuggcucagccuggccaugagcugucauuacuuggaccuguucuguuugugaaacagugcaggcaacugaacaccaggccauaucuuugugugcucacuuaaugauaaaauugaaugcagaagaggaaaaguuugcagauaauuggacucaggaggguugccugcuuuuggaguugaugagcaguugauagucucauaagaagugcuuaugaugaucuacaucauaagcugcccaaucccugacuucccaagcuccucucugaggacuaaucugaugagcaacccuucauugguugcugcagaagcaagaugcugaacauaacccaggacacugcuuaugcauacaauggaaacaccuuccuguguugucugggggauuucacagaaaaguaguagucugugugaaauuuuuucuucucuugguuagcuaguaucuuuccugaaguugggaaccuauguguggggaccauggaugcagggccugcauuuugcacaucacaaauucucaagaauggagguuggaugcaagaauuuuuuguauuguggcagacacugucaaagcauuugucauaaaauggaccagugcuacauggcacauuuccauugauggcauucuccugacacagagaaaggaacauaauugggaaaugggcaauauucacagagcaauuacugagccuguuaaugagguuugcaugaaggauuccagggaauuaaugaagaacaagaauuuuggcauuuauguuggacagcuggacagcuugauaagggugcagaugagaguacccuuggcauggaugaaggcugugagacauucuagcuucuucuaauccauucuucaggcaguagguuugcaucuuccuugguuuaugccucaauguauagccagcagcaaauuccuuccuuuuuuucuuagguguuccuauuagggauaugaugaugcugggcagaauauuaaaagcaguaagggaucagaguuuaaaaucacagcccauacuuugaugucucugugucgcuuggauauauuaugaagccaccaggauugacaguuucuuguagucaugagccauugugaagguuaaauagaauaguugacaggaaaggacauuauggacaugugagauccacuaaacagaguccuccagagacacacagaacuagcgagauguuacagauaauggagugucugucuuuuucauugagaugcauuucauguaugcagcaaaaugcgggguccuguuuuugauguauucagucuguuagucuaugucuuaguauuggggaauugaguccauugauauuaagagauauuaaggaauaaugauuguuuccucauuccugguuguuuuuguuuuuugaaauacgguagaauuauauuuguguggcuaucuucuuuuggguuuguugaaagauuacuuucuugcuuuuucuaguauguaguuucccucuuuguguuggaguuuuccaucuauuauccuuuguagaacuggauuuguugagagauaguguguaaauuugguuuugucauagaauaucaugguuucuccaucuaugguaauugagaguuuugcuggguauaguagucugggcugggauuuauguucucguagggucuguauaauaucugcccaggaucuucuggcuuuuauagucucuggugagaagucugguguaauucugauaggucugccuuuauauguuacuugaucuuuucccuuacugcuuuuaauauucuuuguuuugugcauuugauguuuugauuauuaagugaugggaggaauuucuuuucugguccaaucuauuuggaguucuguagacuucuuguauauuuaugggcaucucuuuccuuaggauagggaaguuuucuucuauaauuuuguugaagauacuuacuggaccuuuaaguuggaaaucuucacucucuuuuauaccuacuaugcuuugguuuggccuucucauuguguccuggauuuccuggauguuuuggguuaggagcuuuuugcauuuugcauuuuuuuuuauuguuuugucaauguuuucuuuggagucuuuagcaccugagauucucacuugguuucuauguccugauggaucugggcaggucccuccuccgccagaaauuugaauagaaguuguagugucaccuguacucucaugugugucagcacucuugggauaccagcucacuugugguggaaccuggguauguagagcucuggcacaaggucagcuccaggagcugauggaauuucgaagauaaccagggaaauuaaacagauuuacauauuuuuugcuuuuucacuuauuuuuguccucaaguaagcuuuuauguuuugaaggacagaugguucuuguuuuaucucuguuucacugugcagcauaggucugauauguuuuugggguacaguacuuauuuguugaggagugaauaaacugugaaaaaaugucuuacuccguguuguccucuggccuggacagcuuuugaggcuugacugugcuuacagaauugagugcuucacacaaauggaggcucaguaaugagccaauuccucaaggaucugauggauggaccaguggcucuauguuuccugugccuacagcauaguauaucagagaugaauguucaaugggaugagaccucuccaguggcagugcacccuggauagauacauuaggcucugguuuagagcuacaguuucucuagauccuugaauggagagaaaagacaccacaguaccagagagaaagacaagcuuauaccaggaucugagagauauaugaguaaaggauaugaaauccccaaaggaauauugucaaaauauaaccaagagaccaucaugaauuaugagcaggugagaagccacacacacacauacacacagaaacaacagaggagaauuuaagacuguaguuagcacuuaguaagggcuuuguccuccauccaacuaucugguacauguucuuuggacuuuagguauuaaguguccuugagugugaauaaaaauaagucuuauguaucuauaaauauacacuguuaaauguucuuugcauuuguccaccugcauuaaaucuaccaaaaugguguugaaagucuuuuuucaaugacauccuuuuguaugcuagguaaaaaucucagagucacugucuuugugucacuuuuguacucuguuacuuggugaggguuuuguaccugacauauccugugacauuuuacuccacacagucauuaggugugguguggaagauuggacuaaucuaugacuugguauccuccuuugucuccgcagccaucauucucucaucgcugcgguuuucuaaaauuugcaccagcuccugagaucacuauguaaucguuauugucacucucccacuaccacaccccccaguucuaaaauagaccuaaauaaguuagcaguuucuuucccuagcccuacuugguaccaugaucgccaagccacaguucuucuucugucuaaucccuucauauucuuuuguuuucaauaugugggaguccuuuugucccuuggaagcccuaggaacuucuaaucaucaaauaucuauucaucuuucuuuaagacucaggcuuuguguggaguucaguuccuuggcaaguauaaccucauagcuguggggaugguuggaccccacagcacuccuaucugucauaccauggagauuuuuuucagcaggaaccaugaguuccccacaagggagcuaaguccaugcaugccuuuauuugcauugcuaaauuaugcuuuauuaaugugugugauuguacugaugcucaggcuacugugcuaaugacugauaauugccuuaauaagcuauuuguaagaaauacaguaauaucaguuguaaugaaaccagaccuugucacagcugguaugauaauagcccuuugacugauuuggagagcagccuguagauuccuuccacaguggaagggcucagagugaugcaugacuuuuugggccccauuuaccucucccccauuuacuuguuaaccauguauggaucaguauugagacuaguuccuggugcagagacagauuccgcaaccauacaagccccacaacuacucacaacuacuguccucuucuucaaguuauuuguggcucugcuacauacugcuuucuugguuguagcauaguuagguaccugcugugaggaccauuucagaucacuauggaagagacacacugguucacaaagcuucuuuuauuaucuggaaucauauaucauugucaguaauggggaaaccaccauuuugccagcuugcccguacaugucucugaccuuauaaugcgguucuacacaguccacagggagacuuuaucugaggcucagagagcauuauuacauguucuuggauucagugugucccugguucaaauccuaaccaucacauacuggcuguggaaguuuggucgagauaaauccucucagagccagucucuucacucacaacuuaaaaaaggcaaggcuuuaguaacauuugcauuggaaagcauuaugauucuguugcaaucaguguuggcuucuggucauuuuuccuaaugcagauuauuuuagagugagaauuugucugucuguuguauguaggcaaugguuggucauaccuguuacccuccuguauaauagacacaccaucaugggacuacguuuuauucuuguauuuuuugagauuacaauacaauuacauuauuucccuuucuuuuccccauuccaagcccuccuugugcucuuuacaauuuuuggccuacuugcucauuaauuauuauuauuauuauuauaugcauauauguauauguaugugcauauguauucccuaaguaaaacuuacucagcccauguauauaugcuuuuaagggcugagcauucgguauuagauaaucaauagcuauguguguucuuuucugggaaaaacuuucuucaugagauuguugagugacauauuucuaguggaauuuuauuuauucuucaauuuuaauuuguuuuaaaaacaaauuuauuauuuuuuuucauuuuuaacuuuuuuuaaaauuuauuacauauuuuccucaauuacauuuccacugcuaucccaaaagucccccaaaaccuccccccaacuucccuacccacccauucccauuuuuuuggcccuggcauuccccuguacuggggcauauaaaguuuguguguccaaugggccucucuuuccagugauggccgacuaggccaucuuuugauacauauguagcuagagucaagagccccuggguacugguuaguucauuacguuguuccaucuauaggguugaagaucccuuuagcuccuuagguacuuucucuaguuccuccauugggagcccugugauccaucuaauagcugacugugaucauccacuucuguguuugcuaggccccggcauagucucucaggagacagcuauaucuggguccuuucagcaaaaucuugcuaguguaugcaauggugucagcauuuggaagcugauuaugggguggaucccuagauauguaagucucuagaugguccauccuuuugucacagcuccaaacuuugucucuguaacuccuuccauggguguuuuauucccaauucugagaaggggcacaguguccacacuuuggucuucauucaccuagaguuucaugcauuuggcaaauuguaucuuauaucuuggauaaccuaaguuuugggcuaauauccacuuaucagugaguacauauugugugcguuccuuugugauuggguuaccucgcucaggaugaugcccuccaggucaauccagucgccuaggaauuucauaaauucauucuuuuuaauagcugaguaguacuccauuguguaaauguaccacauuuucuguaucuauuccacuguugaggggcaucuggguucuuuccagcuucuggcuauuauauaaggcugcuauuaacauaguggagcauguguccuucauaccgauugggacaucuucuggauauaugcccagaagagguauugcuggauccuccuguaguacuauguccaauuuucuaaggaaccgccagacugauuuccagagugguuguacaagcaugcaaucccaccaacaauggaggaguguuccucuuucuccacauccucgccagcaucugcugucaccugaauuuuugaucuuagccauucugacuggugugagguaaaaucucaggguuguuuugauuugcauuucccugaugauuaaugauguugaacauuuuuucaggugcuucucugccauucgguauuccucgggugagaauucuuuguucagcucugagccccauuuuuuaaugggguuauuugauuuucuggaguccaccuucuugaguucuuuauaaauauuggauauuaguccccuaucugauuuaggauagguaaagauccuuucccaaucuguugguggucucauuguuuuugucuuauugacaguaucuuuugcauggcagaagcuuugcaguuucaugaggucccauucgucaauucucgaucugacagcacaagccauugcuguucuauucaggaauuuuuccccuaugcccauaucuucgagucuuuucaccacuuucuccucuauaaguuucagugucucugguuuuauguuaaguuccuugauccacuuagauuugaccuuaguacaaggagauaggaauggaucaauuugcauucuucuacaugauaacaaccaguugugccagcaccauuuguugaaaaugcugucuuucuuccacagguuugucgaagaucaaguggccauagguguguggguucauuucugggucuucaauucuauuccauuggucuacuugucugucacuauaccacuaccaugcaguuuuuaucacaauugcucuguaguacagcuuuaggucaggcauggugauuccaccagagguucuuuuauccuugagaagaguuuuugcuauccuagguuuuuuguuauuccagacgaauuugcaaauugcuccuuccaguucguugaagaauugaguuggaauuuugauggggauugcauugaaucuguagauugcuuuuggcaagauagccauuuuuacaauguugauccugccaauccaugagcaugggagaucuuuccaucuucugagaucuucuuuaauuucuuucuucagagucuugaaguucuaaucauacagaucuuucacuuccuuaguuagagucauaucaagauauuuuauauuauuugugacuauugagaaggguguuguuuccauaauuucuuucucagccuguuuauucuuuguguagagaaaggccauugacuuguuugaguuaauuuuauauccugcuacuucaccgaagcuguuuaucaguuuuaggaguucucugguggaauuuuuagggucacuuauauauacuaucauaucaucugcaaaaagugauauuuugacuuccucuuuuccaauuuguauccccuugaucuccuuuuguuguugaauugcucuggcuaggacuucaauuacaauguugaauagguaugaagagaguggacagccuugucuagucccugauuuuagugggauugcuucaagcuugucaccauuuacuuugauguuggcuacugguuugcuguauauugcuuugaucaugguuagguaagggccuugaauuccugaucuuuccaagacuuuuaucaugaauggguguuggaucuugucaaaugcuuuuuccgcaucuaaugagaugaucaugugguuuuugucuuugaguuuguuuauauaauggauuucguugauggauuuccauauauuaaaccauaccugcaucccugaaauaaaaccuacuuggucaggauggaugauugcuuuaauguguucuuggauuugguuaucgagaauuuuauugaguauuuuugcauugauauucauaagggaaauuggucugaaguucucuaucuuuguuggaucuuucuaugguuuagguaucagaguaauuguggcuucauagaaugaguuggguagaguuccuucuacuucuauuuugugaaauaguuugugcagaacugaaauuagaucuucuuugaaggucugguagaacucugcacuaaacccaucugguccugggcuucuuuuggcugggagacuauuaaugacugcuucuauuucuuuaggggauaugggacuguuuagaucguuaauuugauucugauuuaacuuugguaccugguaucugucuagaaauuuguccauuucguccagguuuuccaguuuuguugaguauagccuuuuguagaaggaucugaugguguuuuggauuucuucaggaucuguuguuaugucucccuuuucauuucugauuuuguuaauuaggauguggucccugugcccucuggugagucuagcuaaggguuuucucaaagaacuaacuacuuguuugguuaauucuuuaaauaguucuucuuguuuccacuugguugauuucaccccggaguuugauuauuuccugcugucuacuccucuugggugaauuuucuucccuuuuuucuagagcuuuuagauguguugucaagcugcuagugugugcucuuuccagugucuuuuuggaggcacucagagcuaugaguuucccucuuagaaaugcuuucauugugucccauaguuuggguauauuguggcuucauuuucauuaaacucuaaaaagucuugaauuucuuucuuuauuccuuccuugaccaaggugucauuaagaagaguguuguucaguuuccacgugaauguuggcuuuccauuauuuauguguuauugaagaucagccuuaguccaugguggucugauaggaugcaugggacaauuucaauauuuuuguaucuguugaggccuguuuugugaccaauuauauggucaacuuuggagaaggucccaugaggugcugagaagaagguauauccuuuuguuuuaggauaaaauguucuguagauaucuguuaaguccauuuguuucauaacuucuguuagguucacugugucccuguuugguuucuguuuccaugaucuguccauugaugaaagugguguguugaagucucccacuauuauugugugaggugcaaugugugcuuugagcuuuacuaaugugucuuuaaugaauguggcugcccuugcauuuggagcauagguauucaggaauugagaguuccucuugaaggauuuuaccuuuuaugaauaugaagugucccuccuugucuuuuuugauaacuuuggguuggaagucgauuuuauucgauauuagaauggcuacuccagcuuguuucuucagaccguuugcuuggaaaauuguuuuccagccuuucacucugagguagugucuucuuuuucccugagauggguuuccuguaagcagcagaauguugguuccuguuuguguaaccagucuguuagucuaugucuuuuuauuggggaauugaguccauugauauuaagagauauuaaggaaaaguaauuguugcuuccuuuuauuuuuguuguuagaguuggcauucuguucuuguggcugucuucuuuuugguuuguugagggauuacuuucuuacuuguucuagggcgugauuucuguccuuguauugcuucuuuucuguuauuauccuuugaagggcuggauucguggaaagauauugugugaauuugguuuugucguggaauacuuugguuucuccaucuaugguaauugagaguuuggccggguauuauaguagccugggcuggcauuuguguucucuuagugucuguauaacaucuguccaggcucuucuggcuuucauagucucuggugaaaagucugguguaauucugauaggccuuccuuuauauguuacuugaccuuucucccuuacugcuuuuaauauucuaucuuuauuuagugcauuuguuguucugauuauuaugugucgggaggaauuucuuuucugguccagucuauuuggaguucuguaggcuucuuguaugaucauaggcaucucuuuuuuuauguuugggaaguuuucuucuauuauuuuguugaagauauuagcuggcccuuuaaguugaaaaucuucauucucaucaauuccuauuauccguagguuuggucuucucauuguguccuggauuaccuggaguuaggauccuuuugcauuuuguauuuucuuugacuguugugucgauguucucuauggaaucuucugcaccugagauucucucuuccauuucuuguauucuguugcugaugcucgcaucuaugguuccagaucucuuuccuaggguuucuaucuccagcguugccucgcuuuggguuuucuuuauugugucugcuuccccuuuuaguucuaguaugguuuuguucauuuccaucaccuguuuggauguguuuuccuguuuuucuuuaacgauuucuaccuguuuggcuguguuuuccugcuuuucuuuaagggccuguaacucuuuagcagugcucuccuguaauucuuuaagugacuuaugaaaguccuucuugauguccucuaucauuaucaugagaaauguuuuuaaaucugggucuagauuuucgguuguguuggagugcccaggacuagguggggugggagugcugcauucugaugauagugaguggucuugauuucuguuaguaggauucuuauguuugccuuucgccaucugguauucuccggagcugugcaggauacacuuggcgggguccuggaaccaagaugucugugcaggauacauuuggcagggucccggaaccaagaugucugcugccgaugcucaggcaaagugcucccacacugggcagaucccuauccucagaagucuuaagaucccguggugggugcuguggguagcuggcgggugucagccgacucugagcccuagcuacccuggugcugcucggaccgaaaggggcuugugccccuacucaguccggguuuucugccucccuaacuaaugcagucucaggucccgcgugauuggauuggagcagauguuguguuccacucaccagaagucuuaagaucgcgugguggguguuguggguagcugguggguaucagccgacucuguacccuagcuaccccggugcagcucagaccggaauggcacuaauuuauuuuuucaauugacagauaaaucauguuuuugucauguauaauaaacauguuuugacauguuuguguauuaaaggcuucuucaguguagcuacuuaacaaguauauuauuuuacaucauccucauacuauucauucucuugauaucuuuuuaagaauacagugcauucuuggucuugcaaacuuuauaugccccaguacaagggaaugccagggccaaaaagugggggugggucgguaggggagcagggcacgggggaggguacagggaacuuucgagauagcauuugaaauguaaauaaagaaaauaucuaauaauaguaauaaaaaagaauacagugcauugagcaugcccaggaucuuagaaucaccagugaguagaacgcaacauguguucaacaccacugggaauaauugggaccagcaggagcagggacacaggaacccuaccugaccugugaaaagggagacauaacaaccaggaacuauggaaauucaagaaaucaucagagccuacuacaaaaguuuauucuuaacuaaauaggaaagucuggaugaaauggacaauuuucuagacacauacaagcugccaaaguuaaaacaggaucagguaaaccaucuaaacagucccauaacccacccaucuguucaucacucacucacucgcgcacucagucacucacucauucacucauucacucacaugcacucuguuuacuuuggucaugaauuauucuuagacauuggaauugugaugaaugaauguugucauaaucuuaauucuuggaaggaacugugaaagaagacagauacaaaaggcugcaaauugucugaucccguuuguaagaugcacuuagaauaggugauaaucuacagaagcugauuuucauauuggaagcuggggugagugugaaaauaaauggcuagcaucuggaggucuuaauuugguaaaguagaauuuuugagcuugaauagauguaguuccauagcauugugaguacacuacaugucucuguucucuuuuaaagucuuuauuuccucugacuuucaauuuauuaguuuuuaguagcuuuguuuuguuuugagcuauguagucuugguuguccuggaacuaucuguguaugccagcuagccuugaacucacagagaucugccugccucugccugccucugccugccucugccugccucugccugcuaagugcuagaguuaaaggcaugugccuguaauauuuauuuuuaaaauagcaaaauauuccagugaauggagauaaacaggagcuaaaguuaacauugacaguaagaaaauuuuaaagugcaaagauugacucaugcuaugcaaaauucugaauuuuuuguuuuuccuucuaguacuaggaauugaauccaggcccuuuuauaugccaagcaagcucucuaccacuaaacuauaucuccaaaccauucuuuugcuuuucauuucacaaagucuuacuaaauuguccaugcaaaucuugaaccuguuuccuauccagguagaucuugaauaucauucuccugccucaccaagcaaggugauuuagaugaggaccugcaagauccucauuugagacccaaaguaaguaacugugugaggaggguauguccacucaguuugggcgugugugaggagagaagaagcauuuuugcuaccagacccaaggugcuuuuguccaaauuccagaaagaaaccuccagaaaggcaugaccauuugauugcugagcuucagaaaaugguauagccacuggguuucaauucauccuacaggagauguugcaaauccuucccauagcccagcugcuaagagccuagcagagagauaauucugggugggguuuuuacuuugaaugacuuggaagagccauugcaagugguguggaagacaagcagaggggaggaauguugccugcuuuucaaaacaaucuuuuugacuauuaauuugagaagggaucauggaauaugugguauuaggaaccaaggauggagagcuggagagauggcucaggguuuaagagcacugacugcucuugcaaagguccugaguucaauucccaggaaccacaugguggcucauaaccaucuguaauggggauccuaugccuuuuucuggugugucugaagacagugacaguguacucacauacaggaaucagggguaggagaugcuggugcuuugaaccacaaggacacuggcaagaaaaaagugggaagucaucagaacacuagcauguuuucagguaaaaucaucugguuuguagguacugcaauguggagacuaacaaagggaggugucaaaaaggaaucugguuucuuauuugagaugcuagaaguagaugugggggcaggguuggggggggcaauagaaucccauuuacucuaaugaggagaauugcuaauguucuucucccagaguaaauggcuugcaaacuggcauuaggaguuugauuucagucuuauugaguuagugguggcuuuuagacauauccaaaugguuguauuaugcugggaaacuggacauaagccagcagcucuggagcaaggugacggugaguaauacagacuugugggguugccaacauucaaaugacaucaaagauuaugagccugaugaaauuagcugaaggaaguauauccguagaagggagcaugcugaauuugauugcaaaaaaaggccaagugaugggugggacaauggggcuuaauuuaaucccuuuuaaaagguagguguguguguguguguguuucucuauguuuuugagaugguauucuuucacugaagcagagcuugcuguuucaguuagacuugaugggcagaaaggccuugcaauuuccuuaucucagucccccaaccagcgcaaggauuacagaugcaugcgcugugucugucuuuccaugguguguggaaugcaaacucaaguucucaugcgugagucuaagucgguccuucaaacuaagauuugaaaauuguaaacauagaucugcagucuugcaucugguaaaaauaaaguacuuugcuacacacaaacauaugaaguacuucaugcauggggggguggggggaggcguugagggggagagaaguuucugcugugcaaagcagcagugagcugggcugugaggucagggaguuaugcuuuucuuauuuguaucccaaguugugugguuuagauaaguguccaucagaaguccauguggcaaaugacauuuugcucaauuuuugagagauguuggagacuuaaggaaauggagccucaugggaauaaguuagguuaaugggaauuuggucuugaaggacauaggugggacuuuggucacuuuuuuuauuuucuauccuucuuccaugagauaagaagcuguaugccaagacaaaguuucugucuuuuuacauuauauccaguauuuuaucacaguaauagaagacugacugacacaagcaagagaccaacauaucaucugguauucagaaaguacccaaaaaaggguguagccacuggguuucaauuaauccuacaggagagguugcaaauccuucccauagaccugcugcuaagagccuaacagagagagaauucuggguggaguuuuuacuuugaaugacuuggaagagccauugcaagugguguggaagacaagcagaggagaaaauaauacguuugugaaaugacagaguaaucaggcuccccucugagccugaagacuaauguggaaaaaugugauucauuauuuuaucacuggcucaucguuugaaccaagauagcauaguguccugacuucugucuucagaaagauguuugaacaugauugaggccaucuucuggaaauaugaacuuucucagaccugauagaacuggcucacugcaccauugcuguuugcuuuugggagucugcagacuugccauaugucagauaaaggaggccuaccucuccagugcucucucuauccacccagguuuucauacaugucauuguugacugcuggaggaauuaaaugcaucuugugugacacuacuggagaggacccuuagcugaaccucauuuccucuuaaucucaccuuacauauuguuucccuuugcagaugcugcuuguugucauuuugccauaauuagucacagccaugacuagcuaugugcuaagucucugaguuuuauuagugaauuaccaagccugaggguggucuugcacucuucagucauaguuccucugcuuuuggccguuuacuuuguuaaacaaucagucauagcaccuuacagaccuauggauuccauuaacauuuacuggguuucaacaauguacuuuccacugguaaagcugcucaaacucuaggagaaguugcauguauuuuucauguuacaccaccaaauccuuccagaauuaacuggaagacacucccaauuauaagaugcuauggaagcucuauagaugauugacaucuagacuaauaagcauucuaauuaggaagagagggugugaggcuaaggcagcagacuccugagaauguucagaagaaugaaguucuauacuuuucugacaaagugguauuguugagcaagcugaacuuauacugccuacuuggauuuccagaagugacuuuaagguaucaguagacauuucucuuuccugacaucuucauucuuaguuuucaucaggcuauauauuccucuuccugucuuccuauccauauagcugucuguuuacccacugaaccaccugacuugccauuccuccagcugucuaccugucuacacauucccacccaagcucccauucauuuagcugucuucccacccauuuccucaugcuaccuucucacccacccaucugaucuacccagcugcuauuuacuauuuucccauuuauccaauuacuuuuaucuacccaaacuuucauccaucuucccaguuaucaaguuguaaauuuuucuacccacugacugacucaucuuaauaucccuauuuuuccauaggucuguucauccaucucucuccucucccucccucugccccucccccucccucuccccucccucucucucucucccucccuccuucccucucucuucucuuucuuuuucuuuuuucucuccuucuuuccuuucucccucccucccucccucccucccuuccuuccuuccuuccuuccuuccuuccuuaucccuuaucaucccuaauucacauccuauccuuuucauauucauccauuucuuguucuucugucuacccacauauuugcucuucuuccuuucuguguaguuaucuauauuccuauugauccacucauuuucacaucuuucuaguugucuauuugucuccugauuucauucuccuguccaucuaaucauccauccaccagucuauccuuucaccuacccuucuuucucuuagucuggucaucuaacuaaccacuuagccuuccaucuuuuuauccuuucacuugucuaucuguauacccaucuaccuuuacuuuucuuccauuugucugccuguuuaaccguuuaccuguccauucacccaacauugcuauguaauuaguuacauuaaugaaccuugauuauauuuaggaaauacuguauaggugcuagggucaguugguugcuaggcgucccuguuaugaucuacagaggaauagauagucaugagcauuuccucucagauagaagguuauagguaugacacuguauauauacacaaacaaaugaaugacuaguuaacucuaccauaugucuaaagagauuaucuccacaaggggauuagggaaagagauccaauuuguuucucccuucauugcuuuuaaguaaaggagggggaaggaaaccucugcugcagugguuucccaaagcuuacuuuaaaauauuccuuuaauugagcuucaagaugucucuguuacaccguaguauacaguugggguuggaaccauacccaaggcaaguggcaauugcccuaauucaccugcagguucuaaggagaagacaucuuccccaaaggauaaugggagcagagucuucccuagggcauagcuagcaguccagugccacugacuuugcuguggguauacguguuuaugauugggagguauaggaaccagauuacccucuucagauuuggcuuuaauguaaggucaaaugguuuuuuguuacugauaucuuugagaauguugaccugacuccuuugccugaagaaucuauuaaucuauuaaucacacaccaagucauucauuauuuccaaaguuaauuaaauauuagggguuuccuccuaggauuccucuggguagucugagcaacaaaaggcuuuacuuucacaagugaguagugauaacaguggggaaccauggauaucagguauugcuucgaaugcuguugaaagacccccgaagggagacccucacucaagccucgggacagccgcggacccaagaagacacugagaccgaacucaaaauguugaaggcaagauuuaauaaagcagcagcaugaaagcacauagaccagagcucuggggucgaaacucauacaccuagugguguagaggagaaucgacgaccagccaaauuuuucacaggcuuauauaggaaaacucaaggcgggagagcgggguagggaaaguacaaguuuacauaacuaagggguucugccaagggacaagggguucugccaagggauucuacguaacuaaggggucauguccuauuauuuggcaauguacccgguuuauucugagguuguuccaggaggcccuuaucucaaaaauguucuuggaacagucuuuaguugggaggguucgaacucuagggugaggaguucaggaaugcauucuagggugaagaguucaggaguguucugggaacacucucuagauggaaggggucgaguucuggggugaggaagaguucaguaacuuuuauucuucauuccccacucuuuuuaggaaauagcucuaaucuuagagcgaguuuucaaccuccugaaggacccgauauuguugccuuaguaccauaaccuguacugcauuuauccuuucucuaauaaaagcuacuaacuuauuaaggaugcaggggccaaaaguaagcaaaagcauaagaguaaucaaagguccugcuaugguggagaggagaguggugagccaaggggacuuauuaaaccagcuuucgaaccauccuuguuggcuuucucuuucucuuuuacguauaucuaggcguucucuaaguuuggccauagaaucuuugauuacuccugaauggucaacauaaaaacaacauucuucuuuuagggcagcacagaguccuccuucuuuaaggaauaauaagucuaauccccuuccuuucuguagcaccacuucggacagggaaguuaaagauucuucuaauuugguuauagacuguucuauaguucuaagaucaacauccauagcugcacguaguucuucauaguauuggggggucuuaauuaaggcagcgguuccuguaccuacuccagccgcuacuccuaauccuaauagaacugccaaaguuaggguaacgggcucucuucuccagcggacccaaugcucaaauuugucuaaaaaggagcuaucaucaugauacaggagucuaggaauaagcugaaccaaaaugcagaaaucuuuggaacuauuaaaaacagacauagacacacaaggagugagaccgguauugcaagcccauacugugucuaaggggggcacuagauacugaccacuuuugcuagacuggauguucugggucugauuacagaggugcccuuuauccugagguaccuggcccaaacaaagcccucuuccugaaacugcugccagagucaacuuucuguuuucuccccaaagacauugagaaugaucugaaguaauauuauaaguccugaucugagcuauuccuucauaauaaggggggcuagagguauagcauaaccagcaugauugagucauauuaggguuaguucuauuuaaagcuaaaaaagcucccuggaguagacugaccagacgguccucuguaccuaggggcgguggggaagccaagguaggcuuuaugaggggaguauuagucccuagggaggguaccacuauguugggcuguggaguugguggagcugguacggcugggaccuuugggggagccgguacgacuggggggcccuguucuauaaggaccuuguugggcccaacaggugucaccgccaggucucucacugucagccugaucgugaaaaugagcccaggaucucuuaguggaagguauacucgccaaccccaccuauuuccuuuaagccaacuuagacgguguuguuucccuuucucggugaacuuuauaaguagaggguugcaguauuuaccuuugcaugguccuggggggcuguuuuuaaaagcgcacccauucucuggauauuuauagggguuucuuucuccuucguuugaccuaucauagccacuuccucguuuuaccgugauuaggucccagucagaggagggcuuccaguaagcuuccccugucguuucacauguccauuuaccacaaaaguaaucugaugccccuccacauucucguugaagccuuuugcucugacccugaccagggcaaacauaaaauugugcagcucuaagauuagcucgguaaaacugccccgaacaccaauaugugcucccuaucccguuugggacacaccgcucuucaggggguggguuacuaagaucgguaugaucagggaggucccauuugguggauccugccacuaacuuacagaugucaggugugagaucaggccaccaaguccagaggggauggacugcagugguugcccacacaauguuucccuccucauuaagcacuucccaagacuguugaauuggagcaugaggguuaugguucccuaggcucaggguggcgccugcggcacaaacgaagcuuaagaggauugucaguggcugccacuguccaauugucuucaugguuuucuucaucuugacuugcggcccucuugacgugggaggcguggauccaggaggcaaucccgucgacuuuuaccgcaguagggguugucaguaacaccaaauagggucccuuccacuguggcucgaggcugccgguucgaugccgucugaccaagacuuuaucuccaacucggaacccgugggguacugcgguggucccugggguauaggcugccuucaguuggucccaaaucuggguccuaaucacuucuagggccuuuaaaugaauaagcaaagaggaggguaagacagggucagagccggaaaccaauguuccaccagcuuccauuaaagggggagguccuccauacagaacuucaaaaggagugagcccgaaacguccagggguguuucgggcucggaagagcgcaagaggaaggagagccacccagucuuucccgccggucucaauggcuaauuuagucaaggucucuuuuaagguccuauucauccucucuaccuguccugagcuuugagggcgguaagcacaguguaauuuccaaucgaugcccaacugaguggccaagcccugacuuaccugggcaacaaaggcugguccauuaucggaccugauuaccuuagggauuccaaaucuuggcaggauuucuucaaggaucuucuuggccacaaucugggcagucucaguuuuagugggaaacgccucaacccauccugaaaaagugucuacaaauacuaacagauacuuguuaccauacauuccagguuuaacuucaguaaaaucuaccucccaauacacuccaggacggucuccccguugucucuuuccagguucuuuguaggcuuuagucgcauuagugaaugcacaugguuugcaggagucuauaaucuuuugagccacugacuucagguuggggacuugguaucgggaauucuuaauuagucucaucauuuuuucaacucccaggugggugaauugguguaguccuuucacaaauuuuauuccuucuucgggagucaauucuauuuucccuucaaaaaaguaugggaggggaucacugguccacaauagcucuuuuauguuauaccucucauccucagggcuuuuggguggaucaccuuuuucaguuaagaucauggccccuugagcaacuuguuuugccacugagucugccauucgguugcccuuggccaccaagucuucuccucuuugguggccggggcaguggaugauggcuaccuucuuaggugcauguauggcuuccaacagggccagaauuucuucuuuguuuuuaaugucuuuaccagccgaagucaauagcccucgcugccuguagauggccccauggaugugugcgguagcaaaagcauagcggcugucaguguagauguuaacgaucuuaccuuuagccucucggagggcuuguauaagugcuauaaguucagccuuuugugccgauguuccuucaggcaaagcgcuugcccaaauuaccuuuuucccguccaccaccgcagcuccagccuuucgcuuccccucuaucaggaaacugcugccauccguauaccaacugggagcuccaggccaggguuggucagucaggucucuucuggucccagucucuucagcgaggaugucuguacauugauguacugggacggaaucauuuguuagagggagaaggguagcuggguugaggauggcagggggcgcaaagguuacacgcucauuuagcagcaagcucugauagugugucauucgggcauuugucauccaucugucagguggcugccgcacgauacuuuccaaggcaugaggggccacaacagucaccuguugucccauugucaauuugucagcaucuuugaucagcagggccauugccgcaauagcuuucaggcaugugggccauccacuagcaacgggaucuaauuucuuugacaaauaggcuacaggucucuuccagggucccagugcuugugucaacacuccccuggcuacacccgcucucucguccacauauaggacgaaaggcuuagucaagucugguaaugcuagcgcgggggcagucauuagagacgacuugauagccucaaaagcucuuuggugcucuucuuuccacucaaaaggaaacccuuccuuagucaaaggauauagaggugcugcuaggguugcaaagccuggaauccagagucuacaaaagccagcaguccccagaaacucacguaccugccgugggguaguuggcgaugggaucaucauaacagucuucuuccgggccucugugagccaucuuuugcccccucggaggguauaccccagguagguuaccucaguuugacaaauuugugccuucuuagccgaaacucgauaccccaagucacucaguucugcaaggagccucucaguucccuggugacacagcuccuucgaggccgccgcgaccaagagaucauccacauacuguaguaggguaagcugaggguuucgagcacgaaaaggcgcgagaucccgauggagggccucgucaaacagggugggggaauuuuugaaccccugugguagccuaguccagguuaguugaccagucuguccgcccucugggucccuccauucaaaggcaaacaggagcugacucuuagggugcaagcgcaggcaaaagaaggcaucuuuuaaguccaagacuguauaccauguucucucaggugggagagagcuuaauaaauuguauggguucgggacuguggggugaauguccaggacccuuuuguuaacuucccggaggucuugcacugggcgauagucauuggucccugguuuucgaaccggcagaagugguguauuccagggggacugacaggccacuaaaacuccuuggucuagcaaccucuggauaugaggccggaugcccucccuagcuuccuugcucaugggguauugucuuaccgagauggggguggcaucagcuuuaaguucuaccacaaccggaggcacuuguuuagccaaccccauuccugcuuguucugcccagacauuggggaacgcaguuagccagccugaagagacugcauuuuuggguugcucuucaugcaaccgauauucuuccucuguguugaggacaaggcaggcaacgggggcuuuuccccagcuuacuugugggccuucugaaguaaauuggacuugagccuuuaguuugguuagcagaucgcgccccaagaggggagcaggacacucagguaucaccaggaaggaaugagucacuauguucuuguuuaucuguagggcucguucggucguccagggguaaaauuuacuaccaguggcuccaaucaccauggucuuuuuagagccuagcuugccuagggggcuagugaguacugaaugcucugcuccggugucuaucaggaaguugacgggaguccccuccacggacaaaguuacccuaggcucagggagggggucugagccccgacuucccuaaucaucuucuagggucaggaccuuggaucgcucccguuuuuuagggcaaucucuagcccaguguccuuucucuuugcaauaggugcauuggucuuuuuccagugguaucuuucugucaccuggcgguuucacugcccuguugcccaggagcccuauuuuaccuuuuccugacugucuaucauuuacaacugcggccaaaauuuuacucaaauuucucuccugaaauccccgucuauuuucccucuccuccauuucuuucuucucucucuccugccucucuucuucuguuucccucuuaugauagacuuucucugcuucuuuuacuaaaucuuggagcguaugaucuuggagccccuccagccuuugcagcuuuuucuuaaugucgggaacggacugaccaaugaaggccauggcuacagcggcucucugccccucugacaaggggucaaaagggguguaccuccuauaugccuccauuagacgcucaaggaagacugagggugguucagucugccccugcaagaccucucuuaccuuagccaaauuggugggccgucuagcggcuccucugagaccugccacuagagucuggcgauagacaaggaggcguccccuaccuucugcgguguuguagucccaguuggggcgguucaaggggaaagccucguccacgagguuagggagggcagugggugugccguccucucccagaacauuuuuucucgccuccaucaggauucuuucucuuuccucugugguaaaaagaaccugcaaaagcugcugacaaucaucccaaguggguugaugggagaacauaagugacucaaggagcccaguaagcccagagggguucucugagaaaggagggugguuaguuuuccaauuauauaaaucagaagaggaaaaaggccaguacuguaaaggaaugagaucauuggguccuggcgcuggcccucccacaugugcucuaagugguaaggcaacuguugaauccggccccccuuccuccccggggcuucggccucgucggcuccgagucccccccgccggucccugagccccucucgcuauuggucccugugguggggcggcugcagguggcugcuggggcaggggauaagggggagguugggaguccauccagaggaggucgucaaucucuggauaaaucuuggggggagcugacgggcuggacuuuccggcugcaucagacugggcaaccgcgaccgucaguuucgaagaauuugggguccaaggcuugacccacggaggugggaauuggacgagauucugccaggucacaauguaggggaucugaucagggugacccccuuccuccugaaaaacaauucgccugacggcggcgauuagugauaagucaaaagcaccuucugguggccagcccacuccaaacgucggccacucggaggugcaaaaggucugccacggacccuuucugaccuccaccgacugguugugggcucugacccgcaccuccuuccaaugcuccagaguuagagaaaggggaguggacacagauugucccauuuccagaacaauaguagacacaacaagagcgaacacgagacuaagacaaaaaagaaaccaaaagcggcggcgacuucgcgucgaccacaagcaacucagagaaucagauggcuuuucuaaggccggccgauugagacccucugcacgaggugggacucgaacccacgaucucgcaacaaggcacgaggugggacucgaacccacgaucucgcaaccccagauggucucuuggccuccaaagggguccaccaggcgucccugguccuccccuguuccuccugggacgucucccagggcgaacggacggcggacaccuggacacgucuauccuuauccaccccgcguucccucucggagcgcagucucacugagcguccgcaaaaccgaaacugcgaucgcaccaaacuuagaaacagaacagagacaccaaaccaagacaggucaaagaaucuuaccuuaaagugggucuagggucucuggguggucgcacugaucccggacgagcccccaaaugaaagacccccgaagggagacccucacucaagccucgggacagccgcggacccaagaagacacugagaccgaacucaaaauguugaaggcaagauuuaauaaagcagcagcaugaaagcacauagaccagagcucuggggucgaaacucauacaccuagugguguagaggagaaucgacgaccagccaaauuuuucacaggcuuauauaggaaaacucaaggggggagagcgggguagggaaaguacaaguuuacauaacuaagggguucugccaagggacaagggguucugccaagggauucuacguaacuaaggggucauguccuauuauuuggcaauguacccgguucauucugagguuguuccaggaggcccuuaucucaaaaauguucuuggaacagucuuuaguugggaggguucgaacucuagggugaggaguucaggaaugcauucuagggugaagaguucaggaguguucugggaacacucucuagauggaaggggucgaguucuggggugaggaagaguucaguaacuuuuauucuucacuguaccuugcuguacuuggauuaacucuuuaccucuuauaguaucagauacauauucuuguuacuucccccuuuagaacacagcauugagacaugagguaugugugagauuauuuccccaaguaccuuuacuaauacuuucucuuuugagaguaauaagaguucaguugauaaaaugaaaugaacagacugcaauuaaucauaguuuguuacacugcuuugauuccguuacggugaugaaaaaguauguuaaacuaacuagagggauaagucugaugccuuauaggagauuccuuuuuaggauaugcaaaaaucacuacaaauucaacaauaagaaaccaaauacuacaguuggaaaauggguaaaaggcaagucaagagagaaaauaugugcauuacaaacaagcauuuuuaaacguagucauggaccuugagaaauacacguaauuuguaaagagcuuuucuacauccucaauagaaugcuuacagaugaaaguacugggagugccuuauguugagguugcacagaaguuacauguuugggguagaugagaaaacuuauuugccauauugaacaucuguaugaugaguccuuaaguuuacuuaucauaugauauggcaauuccaguacugaacauuuaucuugggagaauaaaauuuaugucuauauuucuuuauuggauuucugcuuguaagaacaaaaaauuguaaguaacucauauauccuuccucagguaaaugaggaaguguauccgaguggaucuacucagggaggcaacaauguuugagaaauucagggaugggcucuuaggacagccugcuaagagaaauaaucucauucuaauacauauuaucucauaggacaggguuguagaguguaagaacguauuggugggguagggguagggcagugggcagagcuggguauauauguaacacaguagaaugaggucauuucuuuuccuguugauuugguucauacugaggaucaaacccagggccuuugcacaugcuaaguaagaauaugaguaauauaucaaauccgagucauuguguugcugaugcuaauccucuguuuugaacauuaguaucaucucauaauguaagaugaaggguacuugugaccacucugcuauuuuuggaccuccuugugaaucuaccauuaugucagagauaaacauauaguugaaaacuauaccuagauaauuauguaacauagaaagcauuggauaggauccuugccugucaaagggugacaagguuauccugcccacucuauugcgaaauagagugagugagccaggcaugguuccgagccaucugaaacaacacaaagcaugauuuuuacauauuuucuucuuucuuaguugcaggcuaagucuagcugacugcauauaccugaugaauucaaaacucagcaaaagcuaguauaguguauacgucaaaucccagcuugugcagcuuuaaugagggaaaggacacuacuuuccuuuuccauaaauaaaucuguagagaauucugucucugugucaccaguacuuucucuucuguuucuuuauuuugcugacuuacauugguagcucuucauauguaauuuacaagcagaaucaccccuguuugcuaguuaguugaucuccuguuauugguucucacugcauggauuauauaccuuuguuuccuuccaguagugccuggguuauguggcuccaaaaguguuucuggaaugagaagacucaggugaugggaggcucucccaugggugcuuagugcaugacaucuugugggcagacgugccccacucugugagauuacaggggcuucucugcuguaucacuuguuucuggggacauucugcaaggggcugggcauaucacuguuucuccgcccaggcaggcuuucaguaguguucuagaaaaaaagaagaccucaucaaucuggaggaaugauaauugauuaaagagguuuccaguccaccuaugcaaaccauuuggaauucacuguucuucaucccaagggucauggagguugcuguuuuuaauugagucacaugguguuaggugggauguaugauuccuguugucacagagugcuuucgacuuuacuguggugacuaugggucucaccucaguuuguuguguucccaugguugccuccaugaaggacuugugaauauccuagggucugcauuuguagcaauaucauggacccauugaaacuguguaaagcuguucagugugcagggauaugaaugauuaugccauuuccuucagguuagaccuuagaaaaaugugugaagcucccacauccugugauguagcagcaguuaguaugaggcauaucugcaugagguuggggauacagagccacaugucagaggaaugcaggaaaggagggagauugguaucuuuugauuaucauucguugacugauaccuguugaaaauuuaggggggcacuucuuccaucaguucucccuuguaaacuaguuuuccuuuccacucccaccccuccauuaauuauuauuuuauguguagaaguuuauguguauuugacuggguguaugucucuguacugcaugcaugccuaaugcccucagaggucagaagaagacuuuuucuagaguugcaggugguugugaacugucccguggaugcugggaaucaaaccaagguccuguggaagagcagucagugcucuuaauuacuaagccaucucucuagaccugacuuuuuauuguaaguucauuuugacaugagugcacugugccucuuguauguaacuuugaagucaauuucagacauuaucaaauuuuugaucauuuaaaaaauuuucgucuuauguaguaaguaaugcaacacauggaggauuaagauuguacuuagggucccuauuuuguagacagacauacuaauuugaguucagagcaggcuguucaugauuuucuagaaucacauuuguaaauggggaaaauagaauaacacucaucaguuuuaucuuguuuuucuccuuuaugaguuuuauaacaaccuuaugggaacggaggauccuggacccagaguccuggugucagaguauaucuuacauguuggucaggagcagauuggugaaugccacuuauggaguaugcuggaagcucauuuuaauuggcgucuccagcgguggagcugaccucagcuggggcugaaugaggcucucuuuuuuauccugcaguuuucugggcuuuguccucuccagugugcuugucaucugcuauccaucuucagcucuguucuuaauuggagcagcacagacacaucccccugaaucaguggcagaggcuggagacuuugaugacacugauaguauaaguuuacugcaaccacagggucaugcaguuucugaaacccugacuaauggguaauguggucuuuuuggaagaggaaguuggaggcagugcucauuuguaagagauccagcaguaguuuuaucuucugugguguuacccaaagacagggaaagagagaucuguggcuuccugacugugcaggcucucgggugauggaugacauggcugcaaggcccccuuuucuccucuuucugcugucccuucuuauuugggagacucuuuugacucuuuucucaccugucucuguuuccuuggcauuuuccaagcucuucuacaagggggacuuuccugguuucuuucucugguuucuuugauuauauuguuuugcuguuaugaucucacucaaaaacaaaaacaaaaacaaugcccucaacugccuuuguuuauaucuuauagguuuauuuuguuuuucuuauacgaguucuuauuuuauuccuucaaaauuuuuuuuuuaauguuucuucuuucccuuauagaucuggggcuuggauugauccuauagccaucaguuucuuuagucugugugauuggcauccucugguagggauggguugaggcuaggaggaaguuguauucccacugucaccccaggcuucugucuuaacuucucucugaccuuauggauccuugcacuuugguauucuagucaucauugaagccaccucucaucaaaugguaaguagcucacucuuguauauaucuguacaaaugaauaucuuuguaguauuggaguagaauauauucucauaaauauguauuaaguuacuaaagucauagaacccuugugugcuacauacaguuauugucuuauuuuauacaacaagaaaucaaggccuagggauagcaacugugucauacaaucacauagcuaagaaagaauggagagagaguuugaacacagucucuuacuccaauggagaguuugaacgcaaacagucucuuauuccagacucuacauuuuuaacccuacaucugccauucucucucucucucucucucucucucucucucucucucuguuuauaaaacucuuuuacauaaaagcacaauucuuacucagagaauuaauaagauugaguuuaaucuggagucagauguuagugacuggcccaggaacacagcuucagguaacuccaaaucucauuuccaucaugucaauaguuuuaugaaaguuuuauuaauauaaagagcgaaguaauaaaucaaggcacuuuuaaugcauuggugaaaacauuagguggucagauuacagcaacauagggaaauccccauuauaggccccagaugcucugugguggcauuccuaccauaugccaggaggaagcuggugguuuguuaauacaucaaaaacuucucccuguuaaucccaaggguguuagaguaaaggugcagagguggguaaggaaugucuuucaaagggacuaaggauugccaggauaauuauaacuaggcuuguuccaaacucuccacaaucauugaaguuuuccucaguuaauccgccuugcagaaugcucccuguaaggugagauguuuuguuuucuugaaacuguuuuucaaaaucuucauauacuccuauuccagcuccccaugcaagucuagucaugacuauauauucuauuuuuuccuuccuagggagacccuuccaucucuccuagucuuuaaacuaggagauggaauuaagaggggagucagaggaaguacagggagacacagcuaaaauuaagggccuuuugagggguauggaaauccaauacaguagaauuuucauaaaauaugcauaaggauaucugaauggaaugccaaaugacaaggagauggagagaucucuuguucccaaaugaaguuuucaguucugggaauaaauuacaucuacuugauuuguuggccauuggggccuccuagggccuucaaacagucaaggcuauuugguugccucugcaaacugauaguaaggcccuacuguuaaagacauaccuacacaagucaaugaacaagaaguuguaaugacaaaggauaaacaggcugaggaagaaauuagggaaacaacacccuucucaauagucacaaacaguauaaacuacauugaugugacucuaacuaaggaagugaaagaucucuaugauaagaacuucaagucucugaagaaagaaauuaaagaagaucucagaagauggaaagaucucccauggucauggauuggcaggaucaauauaguaaaaauggcuaucuugccaaaagcaaucuacagauacaaugcaauccccaucaaaauuccaacucaauucuucaacgaauuagaaaggacaaucugcaaauucaucuggaauaacaaaaaaccuaggauagcaacucuucucaaggauaaaagaaccucugguggaaucaccaugccugaccuaaagcuguacuacagagcaauugugauaaaaacugcaugauagugguauagugacagagaaguagaccaguggaauagaauugaagacccagaaaugaacccacacaucuauggucacuugaucuuugacaagggagcaaaaaccauccaguggaaaaaagacagcaucuucaacaaaucgugcuggcacaacuggcaguuaucauguagaagaaugcgaaucgauccauuccuaucuccuuguacuaaggucaaaucuaaguggauuaaggaacuccacauaaaaccagagacacugaaacuuauagaggagaaaguagggaaaagccucgaagauauggguagaggggaaaaauuccugaauagaacagcaauggcuugugcuggaagaucaagaaucuacaaaugggaccuaauaaaauugcaaagcuucugcaaggcaaaagacacugucaauaagacaaaaaggccaccaacagauugggaaaggaucuuuaccuauccuaaaucagauaggggacuaauauccaauauuuauaaagaacucaagaagguggacuccagaaaaucuaauaaccccauuaaaaaauggggcucagagcugaacaaagaauucucaccugaggaauacugaaugacagagaagcaccugaaaaaauguucaacauccuuaaucaucagggaaaugcaaaucaaaacaacccugagauuuuaccucacaccagucagaauggcuaagaucaaaaauucaggugacagcagaugcuggcgaggauguggagaaagaggaacacuccuccauuguuggagggauugcaugcuuguacaaccacucuggaaaucagucugucgguucuuuagaaaauuggacauaguacuaccagaggauccagcaauaccucuccuggguauauauccagaagaugucccaaucgguaagaaggacacaugcuccacuauguucauagcagccuuauuuauaauagccagaagcuggaaagaacccagaugccccuuaaaagagaaauggauacagaaaaugugguacauuuacacaauggaguacuacucagcuauuaaaaagaaugaauuuaugaaauuccuaggcaaauggauggaccuggagggcaucauccugagugagguaacccaaucacaaaggaacucacacaauauguacucacugauaaguggauauuagcccagaaacuuaggauacccaagauauaagauacaauuugcuaaacgcaugaaacucaagaagaaugaagaccaaaguguggacacuuugccccuucuuagaauugggaacaaaacacccauggaaggaguuuggacaaaguuuggagcugugacgaaaggauggaccaucuagagccugccauauccaggauuccaucccauaaucagcuuccaaacgcugacaccauugcauacacuagcaagauuuuaucgaaaggacccagauauagcugucucuugugagacucugccggggccuagcaaacacaaaaguggaugcucacagucagcuauuggauggaucacaggguucccaauggaggagcuagagaaaguacccaaggagcuaaagggaucugcaacccuauagguggaacaacauuaugaacuaaccaguaccccggagcucuugacucuagcugcauauguaucaaaagauggccuagucggccaucacuggaaagagaggcccauuggacuuguaaacuuuauaugccccauuacaggagaacgccagggccaaaaaaugggaguggguggguaggggagugggugggagguuaugggggacauuugggauagcauuggaaauauaaaugaggaaaauaccuaauaaaaguauauaaaaaaaaaaagaaguugugaugauaccuaaauagagccuucaugccuguugaccaguuuuccugguauuggaagguacucugugcaguaccaaagcagaaaggaaaguaucaguccagcuacaaacccuuugagcuacaguggugaccugccugcaagaugcacuagugcaguaguugcacaaacuuaugggaguaaccaaccaguaucugacugaauuuaaggcccaccccugguauggaauccauuuuuaacacugcucugguagacaagaaccugagacuagauaggccagggaccuaggagcaaaccaaauacuaaugauaugcucaaguguacuggcuaguuuugugucaacuugacacaggcugaaguuaucacagagaaaggagcuucaguuggggaaaugccuccacgagauccagcugcaaggcauuuucucaauuaaugaucaaggggggagguccccuuguggguggugccaucucugggcugguagucuugguucuauaagagagcaggcugagcaagccagggaaagcaagccaguaaggaacauccccccauggccucugcaccagcuccugcuuccugaccugcuugaguuccaguccugacuuccuuggggaugaacagcagcauggaaguguaagccgaauaaacccuuuccuccccaacuugcuucuuggucaugauguuuuguccaggaauagaaaccgagacuaagauacucaaggaacaucuuuaaauaacgucuugcucagccaucaucagagaugcuucuuccugcaauagaugagcauaaacacagaggcucauagccagacaaugugcagacagugagagaccuuggaacacucaauuauaaauggggugucucuaucaaauucucccucuacuccauugggcucacagaacccuuuggaaggggaggcagaaagacuguaagaacuagagggcauagagaauaccaaggacacaagaucuucuaaauacaucagguacugaugcucauaugaacuuccaaaaacugugucagugugugcaaggccugcaugagucuaagccagaaggaguuccagugcugagaggagaagacacagccgacaucccuaauucacaagcuaucuucaguugauaacuacuuguaaaugaaaaauuaguuuucuucuauggugucucauuggcuauacaaacuagucuuaagggcaguccucaugcccagcagucaaugccaacacuuacaaacuuaauggcauuugcaguuuuggaaguucguugucucaugauucuuucuuugggcuuuuuuuuuuucuuuuucuuuaaaaaaaacuuuaugugucguuuuuguauauagguuuuugguuuuguguuuuuauggaauuuucuuugugcaaauauaugagucucuacacauauguuucuugugcugugucuuugguucauuuucuucuguuugguuugucguauucugguuuguguauauuuuguuuuaucucaugguuuuauuauuuuuaacugucuuguuuucuuuuuuaaaaagauuuauugauuuuauuuauaugaguacacuguagcugucuucagauacacagcagaagagggcaucaaauccaauuacagauguuugugagccaccaugugguugcugggaacugaacuuaggacauuuggaagagcagucaguguucuuaaucacucagucaucucuucagccccgaugccuuguuuuuuaaggagagaaaaugagaguugggaaggaccugggaagaguugggggaaagggaaaccuuaauuaaaauauauuauaugaaagaaaaucuguuuucaauauaagaaaaauagaaauaaaacaaaacaaaaacuccauguaaguaugcauauggagcugugguuacuauagugaucaaauuucuuaaaucuguacauguagaugaaguagaucuccuuauguaauuguagcaaaugggguaugggaugaaguauugaugguccaccaugcauuguacucggucgcaagugcugaagucauucugugaugagcuuuuagcaaccuuguaauuuggcucugcugcuuaagcaguuaggugaagaagcugagguuuaagauuaacugauuuuugucagauuaugcaauuugugaagauucaaaccuuguaaaagaccaauucucuuagacuaggaugaacaaaagcuguuacuagcccuaaaaccccauguucccuugaggcagacagggcuuguguugucuguccuuggucagucagccucacauauauuuuggccucauuuuauaugauuaauauucucacuugcucucagagucuucccauauuggacacucagggcuguaguugguaguuguagaugaagaaaccgaguguagagaauuuguccacauggaguuggaauucugaucuguguuuuaacuggcuccucuuacuuucacugccucuccauccugagagcaauuugccuaagagcacauuuguaggcugaaguccucuaugucccagacugagccuucuggacagcugggauggcuggucccugagucccccucccccaucuuccaacuaagcuaccaacuucauguggucuagagacuggggauagacuguucuuuauuaacauuuucaauuauucacaaguuaauauaucgacaucauguggguccuagaagcuucuggauuuuucaauagggagugggcaucucaucaaacauaaacauauuuucuucagguucagagccuuauaauaaaggagcccugauuuugccucagcaguaguaaauuuaauuuuucuucauguugcagcauacagagaggccuuauagaaaaacuggaaaaugaaauacagagaaaggaaaagaaaaccauuguagccuauuccuucuuuauuagaguucuuuauuuuuuagguucauuugaaugaaagccaguguucucaaccccuuccccauuuuuaugacugugacagguaaguagugaaaggagugucuuuaaaauagggcuugggcuugccucgcuuaaggcagaggaccauauuuccaagaagucaaaaaguuuguggauuagcaggugucuuuugcaggcuguagccagggagaagggcuugccgugugucuggggguggggggguuggaggaacacugaaaaugacaguggccaucaccauucuuguccaagagcuaaucuuuuugugcaucuugugggugugugauguaugcacagaguauguguggguacaagucugaggagggugcugggugucugcuguuacuugccaauauauucuuuugagacaggguuucucacugaaccuaaaguuccuguuucaccuaggcugauagugaggucacuaggaugaccagccugucuccaucccccuaauuuucagguuauagaaagauacauccagaagcaaguuuuuuugcuuuuuguuuuuuguuuuuuguuguuuuuuuuuaacuuggauacuggggcuuugaacucagauccucuuguguucacagcaagugcuuuuauccaucucuucaguuccagaagcugauuuucugaguguagaucguagugcaucuugugggugugugauguaugcacagaguauguguggguacaagucugaggagggugcugggugucugcuguuacuugccaauauauucuuuugagacaggguuucaaaagugaaccucacuccugaccuaaauuuguuucagguuugaggauggcagcugguuacuuuaagggcuuucacuuccuacacugcuaauauaagaaagagaaagagcuuuaaguccuuuuguaaauagauaacucggguuguaggaagccaugguuccguguuucucagggcuuucuuugccuuugucuugguggauauuguguauauuaagcagaaguugagacugucuuuucugcuugaauccuggagaagacuggucuccuaucagccuuaggauuuuggcuaaauccuuuucuauuucagucaggauauuuuuaacauuacaacauuuuucugacccuaggugaugggggugggggacggacugauguuaguuuuagagcauuuuuucuaguuuuuguuugggaagcuagugggaauagugacgcuauauugugcagucaucucugaaaugccuguguauacagcucauuaaucuuucuggcaccacagaagagcauggcccaucccugauccuuggucucagucuacucugaccacauuuaccaucuuggguacuuucggugcuaagguuauucaugguuauuaaaggagacuguucuuggcuuagaguggauguucuguguuagugucuuuccaagcuuuccucaacuuccuucccguuucccuucuucuucccuuuuccuacuucccuucaacucucuacagccacccguuuccccuuucagcaaugucauuuaccaguccuggaucucaucaauucagcuaaauggacuuuuuagugugcuacauagaucuagccgucucugcccccuagugcuaggauuauagaaggcaugagcuaagauucccaauuacuaaagccuuccuccuccuuuucucuaugugggcacuagggauccaaacuuggcucuucauucuugugaggcaaacacuguagaaacugaacuguuucucucuuuucuccuuauggguguaguuuuagaaaguuccugaauuucucuuuucuaagaacgggaaaaauguuaccuagggaagggauagggaggcagugguauggaccagucgagggccuggcaacugauugcuccgacaguggccauuaacuuucaacaaaaguuuagaagggacuuucaaacuauagcagauagcuuugauuuuuguuuuuguaucaucucuccuuuuagagauucccccggacaugucuuguaacgucugguuucuaaucccagaauaucuguacccaggguguugugcaugcugucucaguaagacugauuuaggagcagaugucagggugucugaacuucaguucuaccacuggcuaguagggaacauuagacucuucagguugcuuuuuuggcuuccuuaaucagauggaaauagggacaguuuccaugaaaucugccuauggauguuugaguaaugaguaugauuauuuuauaaccuuuauugagucagaugacauuacuauuaagaugacacaaauaagaucauauuuuucuaggaaaaauaaugguaguuguaaguaggaaucugaguuguagcauuuguagcccugauggcaguaaugguagcccccaugguaguagcuggugaauguggguccucauaaugggccuuuggcuugcuggccaaagaaguugaaggguuuuccuugaaauggucugugcuguguuguagcacuuucccuagauacuuuucuucugaaugcagucagcccaugcuaaaaugucuucucaauagcaaaauuuccaacaauaaaauuaaaccaaggauauauaacaauguuauagaaaaguuuguaaaguaguauuucucuuccuuccccaguagaaaagaguaaaugucauuuaagcuuuguauuacaugacuuacuuucccucugugucauacagaagucacugauguauaaggucaaguuuacugccaggauucaaggccacaaugucuuguucccuccuucccagaccugguucucacuguuaauuuuuuauuauuauuauuauuauuauuauuauuauuauuauuauuauuauuacagcuguuuggucuuaugugccuaaacuacuuggugaagauuugaaagugacugcaggcuuuuccauggaugucacauagauguuuuuauuucaguuauugauugcaucaaucaugagaauuucucauuuucuccuagggaaaaaaaaaagaguuauuuucucauuucaaauucucccuaacuaacauaaauuauaauauaagguuugcauucuuuauguucucuuaaggaaauuuuauuuauagcuuauuguuuuggauagacuuuacugauguucaccuugaaaggacaugugccuacaggcauuuugagcauggggaguagcaugggggugggagauguuaaaaguucugaaguuaucuaaauaaauauucugccucuguauuuuucugaacacaaaaugcacagcagccaccauuccuagaaacauaugccaauuguagcuuacauuuugcugaauuugagaagcugguauggccgacaaucagaugcucagaaugaggacuuuaaaaaugucuuugugacagguuggacacacuuaaaccuuggucgaguuucagagaggcgcaacuuggucuuucaucauaaauuugaaggcaaaaagauacauggaaaucucuagguaguaugaauuguuaagucuuucuguugaguuacagauacugaaagggaaaaaaaaaaucuuagaugucuuuuuauucccuuaacaaauacuuccuugcuuuugaagcaguugaaguguagugcacuggagcuuaaaaugucuuggguauagaguaaaaagacuugguuuaaauucuaugcccuugcaugauccagcgaaagaaacuuucucucugcaaauagucacucagugucuugggaggugcaugucucaauguugagccaaguacauauuugcaggugcuguagcauguacauuucuacauaugguggcaggugcauuuucaggugccaaaguagguacauuuccaggugcuauggcagguguauuuuggaaugcugugguggcuauauguccagguaccuuacuuacuaaguuguaagacagaugcaguggauacagacaguaacuagcuacucacuggauuccugcucccuuggcagaauuucaucaacuccuaaaucuuuccuuccaguguugggcugcagccucuuacaagaccuuacaauuuucugaaauacuuauguuccuuagacauugauacucucuacaaauaucaggcuacuaaaggaacuauuccuugcaaaagcuagcuagccacuguugccagcucagaguugacaguucuuagcccccaccucacagugauagaaguugcaaggacuuaucugcaccaugcugagacaaaguggugaaaugggagacucacuuucucauugaggccuuugcuuugaguuauaaagauuuuucuuuucucucucuuccuuugcguuuuuugaggcugggucuauauagucuuggcugucuuggaacuccauaagaauuacacacacacacacacacacacacacacacacacacacacacacacacacacgguuggccucaaacccacuaagauauaccugccucccaaaugcuaugauuaaaggcaugaaccaucauucccagcaagauauaaaacauuuucaaaacugaccuaaguaucugguuuucucuagguggagcugagcuguauacaacgugugaaggcuuuccucaagucuggaaaaaguucagaaaagcauucuucauaauuauucuuauauagguuuuaaauguguauuguuuuauagcugggucaaagcagaaauuugaaaaucuagaacugaaaggacacauuaaaaaaaauguuugcaugucagcuugaccuguuuucauggaaguugugggaagcagaaaguuugccugcucagugucuugcugggauuaaggucacggauaggauuuaggucaccagucuaacugcugcuuacccucacuucccuagugcuuuuccagugacuugauugcauugacuaguaaauuagaaauuuuaaagauuuuuccauaauuccuguuucgaaucuagcagaagauacaaguaguuucuuuucuuuggaaacuaaaauguguuuuuuauucaucugacuggaaggcagcgucucuccucuucugcuggaguucaccacauagaaacaaaaccagaugacaaauggauaacccuccagaaaaagucaaguugugcuguagguggcuaugguacugaaagguuuccugcauggugaggcaauugagcugggugagacccagagggcaaugcuaauuaagcagauaaagcagguaaagaucuggaaggaauacaaugcucagauacccucugaggcaguagggaaaggguccucugauucuuuucuaccuuuucauuaccacuccccaggagccucucccugcuggggggagucugagauggaagaccaagggcugugaaguaggaaauauaaugaauucuucaaaagagaguugcccuuuggccucagagacaguaauggacaucacuuuccuagcuguacgugggaguuauugggagagauucauauugugacugcuuuauuguccaauuaauacauuuggaucugagucuuuguguucuccuacaucauaaaaggaguguaucaggaaaaauacagauuagugaucugcuaacaugggccuuguuaggacauggaagucuaccucugcucccuugacuuccuagauauugagccucccuuaagaucaucucauuacuuaaugaacgugacuuauauaauuuaaaagcauuuuuuccuacuuacuagauuaaaaaauaaaaauaauaaugcaguuguaagacuugguuuccaggcacuguauuggugccugugacuuacaacugggcauacuuuaaacaguuuggaaagucucuucaguguuugacuucuuucuuuaccuacacugguuaugaggacgucuacggcaugucuguaaauauuuccucuuuguuugcuuggaaguaguguacaaauuagauuagcauuucuuuucuuuugacaacuggcauucuccuuuuuaaguggcuuugacaagcaucagggccagauuaugaaaucaccaggugacccuuauguucaucaacugaaaugaaguuggaaaauugagcucuuaucuggcagacaaacucauuuuguuugacaaagggccuaaagguauuuguggaccugaacagacugucaggcuccuaauccagguggcccugcgauuagugaacacacuguuguugaugucccuuucuuuuugucugauugauuagguagaagcuuaagaaccucuuuucucgguaucuugggugcccagugucuaggcugucagcaugucauccaaggcaugcuuuagaugcuggagaaaucacuguuguagagaauucaaaguucuggcuucauaggggagcaggcuuaaucaucagauagagauugaccaaucacaggauaaagagcucuuguuugacaggguuggaaccagauuucagagauuuucagauuuggggauauuugcauauaaacagugaagucuccauugugggggagucuaaggaggaggugaggaggugaauuuauauuuuggugcuuuguacauacuauauacauauagccuacagguaaguuuuguaguaauucucuuccugauacaaaggcagguuaucacaccaacacucauauuuuuaagcauuugggauauuuggauuaggauguuucaucuguguauagcaaguaucuuuauagucugaugcuguauacaucuguuuucugauuccugaaggaaaugauuaaaaguaaaaugauuugcauauauguuuauuuuuaugcauacagaugcuacuuauauuauaucuaguauauacuauguacuauauggaucuauaaaguucacugcuugcauguaccuauuaauuaugugugcaugucuguaugacuuaaagaucauauccauaaagaguuuacagucuuguuuccucuuuucuaguuuuaugguuucuuucucauuucuucucuuuuuuauguauguguguguauguguauguuuguacauggguuuaucugugcagagcucaugugugcauguguuuggaggucagaaucccaucucagauguuccucuggagccaucacuguuuuugcguguuuguuugcuuuuuguaagaacagaucucucacuggguuuugggucucaccacuccaguucagguaacuggucagugagccauagggaucugccuguuugcuuccccagcacugugauuacaaagaugaaguauugugcuaggcuucucuucccaugguauuggcaucaaacucugcuccacauacuuguauggcaagugauuuuccuggcugagccauuuccuuagccauauuucugugcuuucugacuauaauauuuuaaaugcuuuuuauauacuauccuuuaacacuguguuagcauacugaauauucaagaaaauggauuucauuuuauuuucauccauguauguaaguaugcuuuaaucacacccucuucuugccgcccuuuucccuggccucuuuuucucaaauauagacucaaagguucuugaagacuuuuucuuccuuugaucuugaaugagugcuuucaaauauaaugaaugaaauucucaaagaauuaacaaaauauauuuuaaaagauguacucccuccaaaauaucuuuuaaaaaucagaguuaauuugcuaauuuugcuauuucugagucagaaauagcaaaugaagaacucaaaaccuuagauuuuagauucauuucauuugcauucuggaaaacuggucaggacauuucuuugugagucuguuuucccaccugcauaaguaauuuuggaugggaggaguucccauacccagcucacuuugagaccugguguaaucaucuugcagucuucagucuguuucaugaauauguccaggcgcugucagugguaauuuacagcacuuggcugcuugcucucacccucacggcugauguugcuuucuauauuuaguuucaguguucuauaugaguaugccaaucaauaaugcauauacuguguauauuuacuucuguugguaugcuguguacuuguguaaaagaguggggcgguuccaggcaugaaucccugaagacuacuaagacaguuuuugcaaaucacuguaaugcuaaucacuugggccaguguuuggcacaugggaaagacuuggaugccauugcugugugaggugaauuuuggcuccccgggcugaguccuugaaauuuguucauguaaaauuuguucaaugacuugucccgugugaccucagcuagaagugcccuugguaauuguuuggagcuggaucucugauacucucuugucuuuccugcuuugccuuuacugguuuguagaacauuucagaguaaaauuguagauuugaaaagaaaugcucauauccaguuauccaccccguaaucagcuuccaaacgcugacaccauugcaaacacuagcaagauuuugcugaaaggacccagauauagcugucucuugugagacuaugccggggccuagcaaacacagaaguggaugcucacagucagcuauuggauggaucacaggguucccaauggaggagcuagagaaagcacccaaggaacuaaagggaucugcaauagguggaacaacauuaugaacuaaccaguacccaggagcucuugacucuagcugcauauguaucaaaagauggccuaguccgccaucacuggaaagagaggcccuuuggacacacaaacuuuauaugccucaguacaggggaacgccagggccaaaaaaaugggaauggguggguagggaagugggggggagguuaugggggacuuuugggauagcauuggaaauguaauugaggaaaauacguaauaaauaaaaaaaagaaaagaaaagaaaagaaaagcaaaugcugcaaaaggagcuguuuaccuuauccucuucucuucaaguagucagggguaucaaacaacaucuaaaggaagacaguuauuggaaaccaaaccuuuuauuaauuuucaaagucagcaaaauuaugauggacagguggguguauuauuacagcucuuauguucuccacacagucuuauaacuaaugagcuagcacuuauuaaagagguuguugacugggccucaucugucuguguggcaugagugagauauuacugaaaaaaaaauugauguuucuuuggaaaucagcaugauugaggcuccauuucugacuuugaagguagcagaagacagcuagugcuugcucagcucugagaaaagucuggaauugcucuaaaucaugcauagcucugcagaagaguggcuuauauuucuggauccuuucuggaagggaaaugcaagugcucaggcuggggugccagagaucuauuuauauagccuccugcugaauuuggaugccaaagccuaaagaagaggagugucuagucaggccacaggguguggugguggcugagugcuccugaagacugccucguguuucuucuuccuuuggaguauuagagggaauuuggguaaucuuucugagcccccuuccucccuccauccacucuucagcugcccaagucguuccugcccuccaugagcaggugacucaauguaauuuaaaucuccaucuuucuuuucaccucugggucccccuuccuucacuucucuccuccccuucccucucuccuucucuuuauuauggggguuuuccuccuugcuauugguauguaguagugaauaguuaauccauguugguuccuuguguguucacugcuccugcccaagagcucuggauucacaaaugaaacacacacacacacacacacacacacacacacacacacucgccagcuaauuuugauaugcuuugauuaguucaguggugugggcacuucuaaaccuccccaaagcuaucauauacuccccuccaauauuccugaguuaacaucuuuuaaaaucuauauuuuauaucugcucccucagacucaaucugggaaaugaccuauagggccacuuuccuggaaucucauguuuucgggcuuuuaagucuguucuccuugcucccucgucauggcaauucugucuguccuuucuuggucccuuguccacaaaauccuuucuccaucucccugcccagccauuggcuauauugcaauucuuuauuaccaaucaaagucagcugggggcaggagcccucagcaacuggaaguguggcuuuugggagcugaauuaauacaaagaauuagaacuaaccaccaacacauugguauaauguuacagguaaagauacccccccccccaauugcauuuuauuuggaauuaggacuguacuuauugaaucuaauaguaauauaaauuauuaucuguauuauaauaggaauuauucaauucagcaauugaauacaauguucauguugugcauaugaagauguaauuacuuaaaugaaguaguacuggguuaggcucaaauuuuggucgagagcuaaagagacacaggcuugaacacaaagcgggugugaguaaacugccagcagcugaacagaggccuggggcagggcuuccucuagcacuuuuggucaggaaugguuugcucaaaccaugaucuugaaguucuagccucuugagcugagauaaacuguuuuucaagcaucccacaugaagcacuaagggaugcugcuuguaacacuaugguacagauugauuagagacuguuaugugcucagaauuaguguuuuauuguacacauagaguuuucuacuagaaacgcauguagauguagaagcacaaggguucacuaauagaaaacaaagacuuguaagggucuggagagagagcucaguugguaaaguacaugccauacaaauaugaggaccugaguucaacacccagaaucuaugugaaaaugucuauaauuccagggcugaggagaaauaguuagguaggucucuauuuuguaugauagggccuggaguacuuagugaguucuagguuagugagaaacccugugugaauaaacaagguagacaacaucugagaaaugauuuuuuuuaagguaaaccucucauuucugcagacgugcacccacaugcaccccaguacacagacacaacauauacagaaacaggaaagacauuuaauauguuccuucuucuauuucucuguauuaguauauuuuaacauuaugauauauuagagugauugauucuuugaaguggcucuuugcauugcugacuggaguuucauuaaaacuuauuuaaguugggguggaaagauggcuccacaaguauuugaugcucuuggagaggacccagacuuaguucccaguacccaccuaauggcucaguacguuuguaacuccaguucuagaggaucuuacacauuauuauagccucugggggcacuguacguauaugaggcacaugcauaccugcaggcaaaacacuugcacacauuuaaaacaauaauuuaagaaguuuugauuuugagaguaggaaagaauuugcagugauucccaaaauggcccuaaacauuaaucugccauuuuugugguauauuugaaacaaauauuuuuguucuuuuuuuaaaaauuuacugauuuauuguguauauuacugcaggccagaagagggcaccagaucucacuauagaugguuaugagcaaccacgugguugcugggaauugaacucaggaccuuuggaagagcagcuagugcucuuaaccugugagccaucucuccagucccuauuuuuauuucuuuaugugguguuucugaaacaaauauuguuagcauugacaauuacaaaaucaaaauaugaaucaacucuaaaagguauggaagauuuuauauauccuacauuaucaacuauuuaaucaagaccuaacucuguuuaaaaauaagcacuuagccacauagccagcguuggcuacaucacuuauguuacaguuucuagaaauuuuaauucaucaacagcaaugaagacaacuucauuguagagugaagggcuuuugauuuuaauaauuuugacaaaauuuuaagcaagugguuaggcagauguuaauagccauuuuauucacuuuaagaggugggggaugucucaaauaugacaucauucgagugaguggacaguagaauaugauauguacacaugguagacucuugacuagucagagagaaugcuaugccaguccauguuagaacaucgauggguaugcauaugugcugucugaaaagagcuagucacaaaaggucaugugcuaacugaugccccuuguaugagauacucagaauugauaaaucuauggagacaaaaggaaaagugaugguuuucagggaaggcgagaugaauguaaugauuacuuugaaaugucagcuugcugcaaccuagaaucgucuggaauaaaccuaaaggacagacugccuagauccaguuagucugugggcacguuugggggagguugucuugaugguuaauugaugugggaagaacgagcuuguuuugggugguaccauuccaugggcaggcaguccugaaauuuaaagggcaagaggaagcagggugaaagcaacagaaguagguaguuuggguguauuuguuucuacucuugacuagagaugugauuggcuucuugaguuccuacauugauuuccccucaguaauugacugugguuuuaaauugcaagccaauuaaacuuuuccucucugaguugcauuuagucaguauguuuuaucuugagaacgagaauuaaauuaacauauagagaaguaugaaauuguugaaggaucuuuucucgaacuaaugaaucauauuuggaaccaaagguggugcuuaugcaacacaacagguauacuaagcuucaugggguuguauauuaaaaguaccuuauggugucaucacuccucccuugcuaaggacuugccaggaguccuugcauggagaaugcuauugcuuuaagaugaguccagacuuaaagaggccccguccuucagcacaggacuggccacuaauagacuagauagaucuuuaucuuagagaaucucuauuaagcaagagaaugaucauggaggaggaguucuauuagaugucuuuagaaauguauccucugaucaucacauuuuuuuucaucuuuuaagucacagauaguaucagucauauuuuguauuuaaacugucuucccauaagcuggugccuugagacuuucccucagcuggugguacuccuuuggaagauuguggacucucuaggaaaugaggcccggcugauagaaggggaucaggagaacucaaccuuagaagaugucugauccaugcuucuggcuccucugugugcuuaccaauccacuguuauguguggagccuuuuuggcauaaccacaauguucuuaauucuuucaugucuguaaugaggacagauccugcccucaguccuagauauuuauaguuuuccucaccauggaccuuucuccuuuucuuugcuuucugaaauuaugcugcucuguggugcugcugagauguuuucuccggaacuuuuauugucccugacuugugucugugcaucuguccauuuuuucuuaaagcuccuaaacaauaugguuucgaauguauugagcucuuuaucuccaguacaggcccagcacuggacuagaaaacacugagccaggcgugucauccgacuguggauguggaugagugacaaaagaaauaguggcuuucuuuauacccaucagcccauggggaucauuauuuccaaaggccauggaauccagucaacuagagacucugccagucagacaccaggaacuccuucaacugucaggaaugcuaaaguguuucuuuucuucuuuguggcaacccuuguucaaagcuuuuagguauuacuccagaagaaugaaaaugugaggccugccugcuuaaacacccucuuccagaaugggaaaaaaaaaucaagaauaaagaccaaaacauuccugggccuuugaguagggacugauuaaacauagacauguagaaaaaccccuaaaacuccacuuuccuggagcuacagucugaugcugggauaagguucugugcuuggagagacuguuuacauuagaggucuguuuggugguacauuguugaaagagauuaacauuagaaauggauguuuuuauuucuuugagccuguuuaacuuaugucaucacagaaauguauuucuguaccagaauuuaguauucaugcugucugacucagauaacuguacuucuugccccaacaaaacacaacccaggcuauacaaagugacaaaucuagcccaggggaggguacuuuagaggaaagacaagugaggaguuaaguuuucuguacauguauucaucugaagcauccuuugaucgucccuaugagggaaggaucuuccugaaguaguaacaccuuggacuaggacuguucauuucuguccagucugcauuuuuuccgaaaaauuuccuuguuguaggucugucugaacugugccauauaagguguuccuaagcagccuugaucucuacucacuggguucucuuuccuaaucugaccaucaaaguugucuuaagaugcugucugaugucauuuugagggaggaauuagaaccacaucccaaucaagaacaauguguggauaaaaaguaguuagcauggggaagucuagcaugcaggccgggcagcauuugggaagggagggaagagggaaacaacacaucuucuauaugccuggucauugagucccagugccuuucuguauaaguggagucuuauaggugggucauaaagucaaugaauuaggaccaugugcauaugccaacagguauauauaucacacuugucuagugguuucuucuuuccugagcucucacauaacuacuucuguuuugacuucuacugcugcuguuuaucuagcuuacauugcuagagucuucuggauccucugcuuuaacuccacggcuaucuguacuuacacuuuccucuuucuauacucuagcaugaaggcuuaggacaucccggaacacuacucugcagcacgcuggcugugagccauggcuacugaacucugaaaaugugcccuugauauaagcaaagagcauagauaaagaaaaggauguaaaacaauguguggaaauuauucauauuuauuguauauuaaaaugauaaguuuugaauauaccugaugagguaaaaacuauuuacaauuauaauuuucucccauuuuauuuuuaucccccacugccagccucuuuucaaggaauguaggaaagagaguggguuuuccaagagaaguuaucucaucccaggaagagucauuucuuaguauuaaauauugagauguaguuuucugugcucccaguugguccacagcccauacauuccaagacacaagugcaugccuuagagaauggauagcacaaaucccauguguauuuucccuguuacacauagagcuauggcgguuucuaauuuguaaaauguguaguaguagaagaacaacaauggccaggaguggcagaacaguuacagccaucuauuacgauaaaaguuuuguggauauggccucucuccuucgucugucuuuggaugugagauaauacaaugccuguauaaugagauggaguaaagugagugacagcauugugacugagcaguagccuaccacuuaaggauuguuugaacaaagcccuguguuaccauggaaaucaggaucccuucuuuguauucuugucuccuuaauaagaaaauuuaaaaacugacucgguagaaagguagagcaccauuugauuagaaacaacaugacaggcaagcuguaaauuucaggagugucuaggaugaggguuauggagaacaggaagagacagggucaugucuuuugagcuaggccuccauguugagcaguacagguaagcaagcagcugcaagaugaaagacggauuauuucauagagggugaaaaagccuaacguuagggaaagcaggcuuaggaaagagauaaaaaaaaggaaaaggaaaagaaaugagguucuuuugcauuacagcucagaaagcaggcugacuuaacagaacuguguggccuuggcuuuguaauuucaccaaggcuaggcauucugggaaggaaaacuacauccuuuuuaaggggugauuaucucuuuagcauggcagucuuucugagggaugaucccuuggccagaugacugauaggcccaaguagauuaacuuuuaaugaauauuucuuucauuuuuaagugugugugugugugugugugugugugugugugugugugugugugugcacaugcacaagcucauauccaugugagugcaggaguccugaauaagguguugcagcuccuggagcugaacucuuagcugguugaauguggaugcauguaacugaauucaggucuucuguaagagccaugcaaaacugcuuugcuaucucuccacgcccuaacuagacuaacagcuuuagggauuagacaguagugugaauugugcuaaucuuggggccaaucugaaaguuaugacucuacccaaggccagagguagauuuuacuccuuugaccaagaggaauggguuuucuuuaaugggccucaacagagccuuguuaucccuaguguccuuuaauaauaugguaacuguaccagauaaagauuggagagucuaacaucaguaggauauggguugacauaggugaauagacacaaucuauuuccaucaugaauauccagagauucaguuccaaagcuguucaccaaaagagauuaaugcccagaauggaauuacauuauuuucaucuugaugcaggcagaaguuuagagacaagagauaaggaaccagagaccugcucuggcacuccuggccucuagcgcagacauuccugagacuguugcuuuaaaccagccagucagagaucagagagaacuagcaaguggugagcuuguaauucaucaguaagucucagaggcugaaaacauucuagguguagauaagaugauagggaggcuagaagcugccaggacuaggcccaagucaggagacugaggcaauaauccuuggagacaacaauuacuccaggagaaugaaaguuacaaguuuuucugucugaacuaaacuagucucugucuccuggcgucacugcuaagauucucucuugauugaucuaauaacugagacauuugguaguugacuaacagacagguagcauauacucaggauuccaggauuauucauauaaaucuuggaguaggauggaauggcuugggaguucaucacaucacugagauauaucauguuaggguuuuacugcugugaacagacaccaccaugaccaagacaaguccuauaaaggacaacauuuaauuggggcuggcuuccagggucagagguucaauccauuaccaucaagacagaaacauggcgacauucaggcaggcauaguggaggcagagcugagacuucuacaucuucaucugaaggcugcuagcagaauaguggcucccagacaguuaggacaaggguauuaaagcccacacccacaaggccauaccuacuccaacaagguuacacuugucaacagugucaaaccaucacaacuacuuuguagaauuuuccauuugauaucuuuaaaccacauuuuaaucccuugugacaaggaaguggaguaaguauaauaacugaguuuuuucacagggcagucucuuuuuaaacaaugaguauaguugguuuauagagaguaguaacauacaaaugaugaauucagagggguuucuacuucucuucuccaggugaaauaacauuuuuuccacuuuaguaauuuucccucuacuaagaaguugccaggaggcagcuguacagcccacaacucauauuguuuauucccuccugauucacagcuaucagagcaagaagucauucauuucuuucuagcucuagaauuuguuuguguaagugguuaaaauacaaccaaucaauuuuaaucuuaaucccucagugucucacauuauuuccccuucaguguauuuuuuaguucauugguucucccccuggauccuuuuagcugcacuugaauugccauggacucucacaucaaacugcugagggcacaggauaucuuaauggcuuugccaggguagcuaucaggugcaagccagcacuugaaccacaccucuagacuccugugccuugugaaagcuuuugcuaaaugcagaucagucuuaugcuuugcuuuuuguauggcagagacaagauggguggaauucucaguugagagugaauauguuugagccacagaugugaagaaaaauaggugaagagaaacuugguuggaagccaagggagaccauuguuguugaccugagauaucacagugguuccgcauagccagagaucuagauuaaagagcaggaucaaggcaaacuaaucuggagggcuagagcccugaauggccuauacaacacaaggacuaccuggguuucaguguuuauucuaugcauauuguaugugcauuuaggcugaggacuaucugcaggaggagauacuauaggcuguaauguacacauuauccagacuuaauguuaauugugagacacuuguguucuuuccugcaggcagagaacaaaagaaaauuaccaaaauaaacuuugcuccugaccuuccaugauauggagagugucugaggggugcaucauugcugaaagggucuucuugagggacucugcaaauuuucuuucuuauauuacacaacugguuagcagacuucaguuuuaaaaaggacacauuuaaauaauccuagacuagacaggcggguuucugaguuugaggcuagccuggucuacagagugaguuccaggacagccagggcuauacagagaaacccugucuagaaaaaaaaaaaaaaaaagaauccuagacuaaguacaagcuaugugucugagggcacauuccuuuauguguucagcaagugucauacauugcugccuggguccacagguauugugcuggcuagguuuaugucagcuugacauaagcuaaagucaggaggagauggaugucuuggaacuuucugugaaaaccagauuagccuccaacucagagaucugccugccucugucuccugagugcugcaaccaaaggccugugccagcacaucaaacccuaaauuuuucuuuaauuccuuuacccaaauuggaagcuuagcuaaguaggguguugcccuaaggucaccacuuccuuuauuuaacaucagccuuaaaaaaaaaaaaaaaaauuccugauguuccuuuucuccucaaacuguacauuuuguguuuuuccuugauuagcuugcuuauuuucauaauggauuugcaaaaucaugaccaguaauaaccacucaacagucaauauaaggcugucuggaauuuaucucugccaaagcuacuaauccaaaaacuuuucaauuuagccucaggcaaacaaacaaacaaacaaacaacacacacacuuuuuauuuuuggacaagagcauacagcauccacauucuuuaccaaaauauuacaagaaugguugcuaggucauguacuacuauucuucuuccuugaaaccucuugaacuaguucaagucacucuaagcaucacugucuuucucucuucugccaguaugaccauuaaauccagcuuaaagcauuuaacucuuuuccuaauccaaagccccaaagccugcauucccccaaagagcacagucagguguaucacagcaauaucccaguccuugguaccaacuucugucauagucagugcccuguuuuuguuaagguacaccaucaccacagcaacuuuuguuuuggaaagcauuuaauucgggaugacuuacuauucagagguuuaguccauuauucucaugaugagaagcauggcagcauccaggcagacagagugcuagagagguagcuaagauuucuacagcaggaacagcaggcagcaagacugugagugugugucugucugugucugugucuauguuuaauaugucaauaucaugggcucucuacuucauccucaucaacuuuguuuucuuuuaacccaucacugccauuucccccugguuuaaagaucauuuaucccaguccaaguugguuagcucuugucaguucucaagauaauuucuaucuuuucuguguccaccacaauaggggacuauguagacaguuccaacugagauaaucauaaauucuuggcugaccaugguacaguuucaacagguuauguugugaccuaaccaagcugccuggcuuuaagcguggucuucauucugccccgggugccuuucgugguccucucugugaggagcacagaaaccgccugccaguugacuguacaugguucaucaguggucguauaaguuucaauugucacauuugggcgaaucauauuguuuaauuaguccuuguauucuuugaagucagcuuauguccuaguuugauagcauaccagguuaguacuuuuauaauagaugcuagcuaacugcuccuuuaaguguguaugggugucucugucuuucucuuucucuuucucuuucucuuucucuuucucuuucucuuucucuuucucuuucucuuucucuuucucuuucucuuucucuuucucuuucucuuccucuuucucuuucucucucucucccucucucucuuuuucucucacucaaucucucucucucuuuuucucacucaaucucucucucucucccugugugugacagaguuagaucccuuguauaucucaucauuuauuuaagugucucaguuuugacauguacaaaguaaagcaucauuuaucguccaugagccagggaaucuauucuuaggaucuaugggauauuucuuuuuuuuuuuuuuucuuguuuuccuccaucugcuugcucaucacaaugguauuuagcucuguuucuuuguuuucccuuccagaaaguauuaugagggaugcugaggaauucuugcucugcacagagacaccacauugaaauuagagauuggcacuucugagaggaugcugggaaucugcagagggagaaggaaauuccuggcugccucuuugacucuacucugcauaccagccaucaccuggauuuacuuguuugcugggagcuuugaagguaagaacaaaaaccaaguaaaaggaaaugggggaggguaagggaccagguuguuacagaggccuagaaagagccuggaagcccuaguguuccuugugugaaauacugaauuacuguugcccgucaugauaaaugacuuuuagcaucccagagguauuuagcgcaagucagcaaggugaggauugaaauaaaaaacuagacucuaaaauauaaguuucuuuaguggcagggagcagguauacaaauguucaaagccuguuuggucacaugacuucuguguaaacacagggagaagguugaaccuuggugaguggcuugacuuuccuuaagcuagauauuucauuuauugauccacauagucauuuguuuguucacacauugaaugguuucuugcuggugacaucgucaguaaauccggugcugagaauucaaagauaacagaucuagacauacacugucuccugagggagacagacagguuaaucaccacagucgugagaugguaguguacugggggagagguuuguaggcgcagucaggcuguagcugugcaugaaagaugauccuucaaacuggcaagagagcuuggggauggggcauaggaauugccuucccugcacaauuaaaagcaaaugaucauugcugccacuauccaaaaaugaacaggaaauacaagacucauuauuuuuuucagucagcaauuuugaauguaguauagugucuugauuguuggugacugugucucaguuucaggaauggaggcaaugguaguauagauguguagacuuccuuuuuaaauuugcuccacacuugaguuggggggugggggacuuauauaacaaucugacucaacaaagcugguacuguguuuuugaacauuuccuuugugcauaauuuuauugacaucucaaggcuaccuuuuaauuaggcacuuggguccacauuucgagcuuguguuagugagguugaauauaaagaugacacuugcugaacagggaugauuguucuuuauuuaaagauuuuguuauuuuuaauuauguguguguaugucugcauaugaguuugugcacaugagugcaccugagugcagaugcucagaggccagagaugucagauaccugggagcuagaguuacagacuauugugagcugccuaauguaggugcugggaaccaaacuugauccugaaccuuagaauggagaugauucuaaaugccaauccugugguaggggcacagugucacacccuugucacucuccccuuccucuuagucauaucacuggacuuuucagauuucauuuaaacagcugaguagguuaaacuacucuggcagugauggacuccuuucuguaccuggaaguuggugaguugaugguaauucucacaaagcuagcagaaaaguuuucucaucucagucagcaugagaggggccuguaacagaaacagaggcacccaacgcuaguucacuucuugacauaaaaacaugacuggacguggcagcugugccuaaaguuccaguacucuggauccugaguagaaaucaaaagaacuuuugaguuccagccuagcaucacuuaacauaaugauacuuuuauaaaaacaaacccugccacaaaccacagcagagcagagcagaaugcaacauggcacagcacagcaaagaaaaauaauaauaaaagggaaaacgggcuuuuggcaauacagcaaaacugcuaguaauaauagcauaauaaucugggaagggauagaaaggagaguuaggguacaugugaucaauauauauuaaaaggcaaugaugacauugacaauauaaacaacugguauuguuaccauuucuguguggcauacauuguacagaaucuuuuucuuuuuaaacaacgaauuacuuauaguucagugaauguuacuguucuaaaaguggaaagcaugcaguguaaaagcuuuauuuaccuggccaacacauccucucagccagucuggauggagaacagcuuagcuucaagaacuuaagguuuuauuuugauacuguacuguagaccggggcuuuggggaaguauuggaguuuaucgaggaauuguacuagauaccacauggucuuuauacaguaagguuguagaauuuuguuucaauuuuuaaaaauuauucuuugaccauuuuaugcuuguguauaauuuuaugcuucaucucucuacgcuccuguauuguccaggcaucuccaguagcccccaucucuucucaccaagucuucaucccacuuacaucuguuguugugcuuuuacuucauaauguccugggcugucauaagcauggaugggugcaaagcuguccaccagagcaugguaacucaccaaaggcugcuuuggugacaauaaugaucucaucuccucuauagaguaguuuuccucugucauuagcugcacucugugguggccccaugagccccucccucaacuaugaaugaguuuacuuauucagucuuauguagacucugcguaggcaguuguagcuguuaucaauucaugaguuucauggcuauggcaugcccauaagacuguuguucaugguccuuuucucuauucuucagcuguuagguucuuucuaaucccucuugugugacauuccuugauaauugugagggauaguauggaugcccuguuuaaugcugaacacucaauaaucacuuguccucaauacccuucccauccaugagucugggccuuaauugccauucacuuaugcuacugaaccccuuucuuuucaaguugguaccauaacaugcaaggucuaacacuggggaauacaacuauagaauuuugguuuaugcucaguggcauaaaucagucugaacugauuugggggaaaauaauuuauuaaugaaaugguuuagugauuaccaauuugacaagaucaagaaucaucuagggggcaaaccucuagaugugucugugagggaguuccuaggaagacucacucacccuuaaugugggugguccaguccaggagcugggaucuugggaugaauaaacaaggagaaagcaagcuuagcaccagcauucauaucuuucuacuuguucuuauucaaagugaccagccuccuuugacuccugcugccaugucucucugccaugguagcacuagguaaagugauccaugcuaagcccuuccuuccuuagguuguuuuuugucacauguuuggccacagcaauaagaaaaguaaauaauauaagugguuauacugaguuaacgaccaucuaggcuaugggcaggguuaggucagguugcucggauaucguuuguuggcuagaucuuucuacauuucuuuggaucucugcauuggcuucuuuacagagaucucuuccuacauggaugacauuugggacuugcauccuguccuucucuuccucuuaauuccagagcauugccucucgcuggauuaccuuuggguacuuaauuugaaaccacagcauaaaaaauacacucacuguauucagaggcuagagaagauuuugacacuugacggaguuguugagauggcucagagguuaagagcacuggcugcucuuccagagguucugaguucaauucccagcaaugacauauaucaugaccaucuauaaaagcaucuuaugcccucuucagaauuuggguauauauuucaucagagcauucauacauuaaacaaacaaauaacuaaaaauaaaaaaaaaauaauuuggcacuuuaacuguguaguauauuuuuucuggucacauacugguaaggaauacauccccuaauggcaaagagaagaucuaaguuguggacagcuuguggcugucuguauuuauaauuugguaucagcuuaaagacccauuagaaguaucaaaauaccuggucaaacuauagcuaaugaagugccuagaguccuugccauaaugauuuucaagacuguuaaggaaauuuagagaaaugggagaauaaagguaauauuuaguuuggguguugugcuguacuugucuguauauuauuuaagaguaaacuugaaucucugacucacaacugcauucauugggugcuaaguggcaugagcacacacagcagcaaaaauaucuaagccgaguggugaagacuaagggucugcacuuucuaagcacugguagccuguagcauuuauuucuaggcuuugcacuauaagaauagccuauagacaagucagcaugcaagacauaggugaaagucauuguccccucuacuugguuauauaagaagcagugaaaggaguuugggauguuacccuggagacacagaggcucagggugacaggaucagauucagcagucagagcugucacugggacacaaaauaaggacagcuccauagcucccaacuuuugccagggacauggccagaagucagaugucaacucccucauaacaaagauugcuuugugcaugauuguaaugauuguaauccucaggaaggaugugagaugucuccagguaagauguaaaagcagaaguucauugugguaagauaauggugaucaucuaggaggaucuucagcugacacugagaucucuagacuccagagggaucugaguggccacuaaggaucaagucaucucuccaugauacacgcugucuauugccuuuuaaggagguucuguacauacauauguucuuucucaguugucaaucaucacaaugccccuuacaccccacugacugauacccuuaaggcuuuggcuuuuucguggcuagugccauaaauaacagaguguugcugcauggauuuguggaaaaaaugguucauauuuucagugggcuuguuuauuuuuucaacuguggauaauuucaaugcaaugggucucgugagaguggagcucagaaucuccucugagcugcagauacucuugaugcuaagguuuaguggucuuauuaguuaauugauuaccugaaggcgcacaaugggacuaaaguacugaacagaaucaggcaucccagacugugaaguaagcccaggcaagcauagcugacuucuuggaucauggucccuuguucccugagcuuuagucuccuuuacaugaaauaauauugucaaaugaaacacacugguuggcauacuaacauaaacaugaguucuacuggaagucugacauaacugauuuggaagcaacuaaagucuuucuaauuaggaagagcuauaaauggaaaaguaggcacuuuuuccauuguaugcuuguauggauggaacuaggauccguacauauacuuuaugucauuaagaagugacucauuagagagagaaugccaguuuuaaccaucaggucaccaggugaggagcucuucauugcaggaguccuuugaagcaugagaaguaggcuaugaaggaaaaugcuaacgggggaggggggguaggggguuuuguuuguuuuguuuuuguuauuuaacccuuagguucuuaaucucuuauuucacacugcuaauuuucauuucuuccucuaccuugggagcuagcaucuccaacucuugucugucuugacuugcucuuuggcauagucacugucccucccauagucacuguuccuucauagccuggcuuaugcuguuaguugucuguacacucugcucuuucuucaagacacuuucauccucucuuugccuucucaguccaccugacuaauaucuuuggaucucagccucagggcucacgacuuuccauuaggcugcauguuccccuuccuugcucugcuucccauucuuacucagagcuucuuguuucccuucuuguccucaagugacucuauuguugacaucuagcagcuauuacaguaucaggagaggaguuggucuucaggcuuacugucaguguucacauguuugcuaagcagaggggugaguauacccacacuccucuagcucugaguccuggcagaucucaccucuguuuucuugucaaacuucugaccauuacaaugauccugauauuucuuccuuuccccugaaauuuaccauuuuuguguucauugguguucugcugcuucauugagcuccuuguuucuuaggcuucauuguguuuuuucuguucuguguguagcucuuugcccauagacaucuucucaaacugugccuucaguguccauguuuguugucguuucugcccaauggcugcccuauguggagacacugugaucagcauagaacaaguagcauuugcuccucugagaucucugccauuaugugucucucaguuccuuguaggaaaggccuguugaucucaucaucuuauuaccagugcccaguccaauguuaacucuuuaugaguccuuaauaauuauuuuuuuagaaggauucuucuuuucacacauuuacuacaguauuucauuuuccuuuuuuuuuuuuuuuuuuuuuuuuuuuuuuuuuuuuuuuuuugaggcaaggucucauguaucugaggcuaaccaugaacuugcuguggauucaagaaugccauugaacuccugaccuuccucccuggaguuaggauggauuuuguguagaauucucaagccuggggaaagggauaggagcuccugguuccuggugcugugaacaucucugauucugagaucccauugcacagcucuacagucucuuucaauaugguggugaugccaacuuuuggacuugagugguaauguccaagcacaccuucauuuuaauugaaaccauuuugcuauuuucccccagauccaucuucccucaugggccugguggauuuuauuugcaguugugguuuuucuuuucugcacuccaggggcagauagauguucagcucuuggugaacugacaucauauggaagaaagagacuuuuaggcauucauuaugaugccugugauaaccuauaacaagcucaguguaaaugcuucccuugaccagagagucaggacaagugaggguuguggguguuacuugaaggcagauccuucaagagcauaaaagguccaguucauguauaagcagugucuugaacuuguauaguuacauuuauuucugagcugauuucagcuuguacucauacuuugcauuccuaaauccucuguugacugcuccuucuauucuuauugaagcaaaagccuaccagcugaauguguuuggcagcuaucccaguaaauuucaacagaaaggaaaaggguccaggcauuugaccauuuuacagaguugcaaugaaaacuaagaauuguaaaguuggaacacauagaccaugagauagggggcauggaguguagacaagaguuugcccaacugugccugauuacucagcuagauguucagggcccauccuucagcccagggauccugccagcuuuuucugaaucuagaauacacagacauggcuuuacucuucccuggggcuagucucuguggcagguuugauagcagcaaaguccauuuuggccuuccaacuaauggcccaaauguaucaguucuuaaggauauuauggguuauaugaaaauagaaugucaaaugcaaagugaaauggaaaguguaauauaaaaggugcauugauaauuuuuguuaauucaagaaucaagcuaguagacaauaggaaugugcugagauuaagcaaaaucuuccaaagauuuccgaaugugaaaauauaugaauggugauaagcagauuccagucugcagaacccauagugaacuugcaggugccuuaagcuaagaaagcuuaagcucauuaagggagauugaguuccaccauuuuauggguuaugagaugguugcugagaugaucucugcuuuuucuauucccaguuuugaucuuaaaaugacauuagcccuguuguaggguagagaaaugaccuugaauauuuauuguauuuccugaaggauccuuggaucccaauggaauuagaaagccugguuucuaugauuauagugccugccuuauucaugguuucaguuacucccaagaaaccauuugaaaauauuugauaggccauacuaucaguauaccauaaguucucaacacucaagagacagagacagguggauauuucugaguuccaggcaagucagggcuacauguugauacuagacaucaucaguuuugaaguguauaacagugugucccucuuugguuugcccuaccaaggaugaguaccauucuuugguugucaguauccauauuguauauauuauccacucauuaaucagaagucuugguuauuugacuguugaagaaucacacagccauuguucaguaaauucuuuuuuuuuuuuaagauuuauuuauugcauguaugugaguacauugucacugucuucagacacacaucggaucccuauuacagaugguugugagccaccaugugguugcugggaauugaacucaggaccucuggaagagcagucagugcucuuaaccacugagacaucucuccagccccuguucaguucauucuaauugugcguaauaauguuccaaacaggacucgugaugcugccaguuuggauaggcuagaggaaagcuuggaagugcugccuuuaaccugacauugcugauguuauacaguaagaaugaaauuguagagaaggaaaaagagggguaugcuaguucuccuguccaugaaauuguagagaaggagaaagagggguaugcuagcuuuuacaacauacucauuuuguucucaaacugcaaaaguuaugggaaguacugagcuaaguugaaaaaggcauugacuuuguguaugcauguauaggaaaaaccacaguaguuucaagcuugauuguuguguguacaguuccaguauaaaaacuauacagaugugucacuuugggauaauuuacuaaguauuuugcacuugaaguaaucacuuuucuguguauguuuuuuguuuguuuuaaaagcaugugaaucaggcacucacuugucuggcaaguguuugaugaucugaguuugcaucaccagaaugcacaucaaacacugguuagugguacacauuuaugaucuaguugugcucacaugggagucagagauaggcagagcucucugggcagguauuggcuaacuucuugcccagugagagacccuuucuaaaagguggaagaaacucgaggaaagcauaaggaaauuguucgcugacauccacagagauaugugcauacauguaacacccuucacauacauacacacacacagagacacagagagacacacagagagagagagagacagagagacagagacagagacagagagacagagagaaacacagaguugagauaguuaaguacauaguugaauuugaagugauuuuuauucuucaagaugagaaggauuuuauugaccuuuggaauuuaugagccugugucacuguuuaacuuugaaauucaaaugcucuuuaaguguggaacuuucuuuggagauugauauucaacauuucuguucuaaccacacacccucuguuccuucuugauaugcauuauuaccacucugaggauuugaucacaggguugacuuccagaucugcaguuuguuccuaaaaccuuacuucugaauggauguucuuaucaauucuaaaugagaccaguauuucuaccagcaaugguauccuuucccuuaguaguagaacaaugguacugucugacaucagcauuaagcuguauuuguuaauacguguugcuaugugcauaagucaguaaacacacauuugucugggaaagaaagcacauucuacugcagaggauaugagaacuugagaagaaaggacacuguucaaccgcuggacaucagaaugauaguaaccuuuuccaucucugguucagcaagcaggguuugccugccaaugguccacaauaguguugaguuuggucugaccacuguuuucaucauuuuaaaaaacugauuacaagugguuaaauguugagaaauuacuaauagaacucaggauguauggcauuccuuuuaccaaaaaggaaacaauaacaaaaauggauagagcuaacaaaccuauacccaccaugguugcagccaucagcuggaauugaaugguagcucucucuuugaggguguuggaugcucuagcuuaugaaugacuccucugucauucucugagcuaucccuaacucuuuauaaauauuucucuccucugucacucucugaguuaucccugacucuuguuuuauguacagcagaauucagguaaacgaucuuugguaucugguugacauugccuggcuacuucaguuagccucuaagcuugaaacuuuuugguuuacuguuugucugguucuggccuauaggcauuccaugaaguaucucauuuauuccucaaggaacuucuacuuuguagaggaauauacugaggcucagggcuguugaaguguuugaccacagcaacuagugaguagagaggacuuugaccuugucuaaaaagauccugcaugcuccgguaucugaaggacuugaugcauagaagcaacuggaagaugucauuucaaagucauuauugucaaguuucaaacaaggacaagacauguuauauggggcuauuuuggugcaaacgcagaccauguucuauggcuagcaaauuauuuuaagccaacagcagaagcagaaaauucaauuauuccuuuaaugaaauuugcacuuuguuucugcuggggacucauacaauuaagugcagaaaaagacauuaggaaucauccaggcaggccagcaaacuggacagaugagacccuaccagggcuuuuagaugguugagguaaaugugguucagaaggacagcaggaccugaguuuggauuagugauacuuuuccccucauacagugacagugcacaagaugcucaucucuguagccauacaguuguauguaaaguuugcauaauccacgagcugugcaacagugggcauuugacaaaacuucagcuuuauuuucccuucuugugcuucugugaaaggcaagaaaguauagacucauggaauauauaccaugguacuggggaagagauugacagaaggggcgggaguuuacccugaaaauuggaauaggaaaaauaguuuauugaguauacugcaaaggauaacaaggugaaugguaacuaaagaaggcaugcauggaucucucucucucucucuugcucucccucuuccucuuuuccgugucuguguguguguguguguguguguguguguguuugugcgcacacaugcaauagaguaaauuucauuaugugcaauuucuagcauguaauuuguuuuguguucaagaauagaguccagauuggcaaguguacaguuuagguaaguuagcauaagguauagagucuuauaguggguaccaguuuuugguuuuguuuuuguuuuucuaguccuuuauuaauggccuuuccuccacacuauguuaacccagcuaguacaauuagcuuuuguuuugcaugugaguaaauagccccucugggccuuugugcuuaccaaacugcugccucaugagcuuucuugugaccugguuguagcuugucauuacuguugucaccugugucucugccaguucuuuaaccuuuaguaaaaaugaaggcagaauuaggcuugcugucuccuucauucauuccuacccauuuauauuuccacacccuguuagcacucccuugaagaagaggguuggggaggaccugagacacuguaccuguugucauuuauguccuuucggccauuugugggccaagugaccauguuuggagaaaaguaaauuacucuaauuaagggaccagcugugugagaacuuuagagaaugauagaaagucuguuggggcugugacugggucgacauaucugguuuucguccccaugcugcccuggaaaugcugugcagccuaucuuaccuguaaucuccaccuccuaaaccaaaagugcugcucacuacuugacaggaaacgagagagcuccaugccucacagagcguagucccagcaucauuucagaucuaguggcuccauugaacccaugcucccaagcaaaucugccucaacuagucaacaaauuagagguaagaguccugggggaaugccagauuucucuuugcagacuguggccuuuagagcauggcuguucugcucuguggcuccugcagagggcacuacugaccccauuucauagaaaucugaauuuccugaauggagcacagccagugaugguagucagagcuugaugugauagaagcauuuugcuggcccuguuagugccauugagcucauuuagugaugugcuauugaauaugggcuucccuguucauauggaaggacacuccuugccauccauuagggauggagaauaaccauuucugaugcagcuacuaagcuucagaacuaugagguggaucucccaagauuauucauuuaacaagcacagccaggcaucacuguaggaccuggugcuagaaacuucacaccccagagugucccuauuucucaugaaauuuaucuacuagcggaugcaggaagaugaaguguugucugcugucugccaagagggcaaagcagaacuggaauaaauaggcuucccgggacuaguguccagaugauagugccaagaguuagugucacagcucucaaaagagaggugaggagguuugggcagccugugccggacaaguagcugagguuucccuacaaggauggugccaguuacaccaguggcaggggcaugagccugcucagccaggagaggccaagauccagcaaugaaugguuugggagagagaacucuuccccaaguguuacagcucagucaaacagccacucucagacuagccucagugaaauaacuugugggcuuuauuccauguggguagggacuguauauaacauugaggaguagggugggauuuaggagcagguguuuccuauuggcucagauugagauguuuguggugcucuauuugcauagggaaggccuccagguguuuuuccuauaugagugacugccauggucuucucacugggaugucaugauuacauguuccagaggagguacagaaauggguaggaaguggcuagacuccugcugaucucaagucuaugagauuuccagggucugaccucacucaaucuuaccaguucuuuucucuggugucauggcccaccugcaucccagugaggcauggacauauucaugguauacugaauaguaagacaacagugguaucuaaaccaugguggcaagaugaaggaccaguggcauggugaaggccaggucaggcaugagaaugggcaguacugcuuuaauaggauggacaggucgcaugucggaagaaccagguagaaaugagagaccaaucauguagcuggaaggaauagcagaguguuuuguuuguuccccugugggagggcugguggcuaaugagaagagguuaaggagugguaugagcccagacaauggaaggccacaugcagagcuggacugugcccuccuuguccuugccucuccacacaaagcuucuuccuuuguagccaguaguuggcuucugcugcugugcguagguaagaauuugaggcagcccuguccuauaaggagaccaucuagaucucugguuccugcauuuccugaaugagaauauccugggacauuugccuauuuuauuuacuuccacccacccugggcacugaggacaaaucaaguguucuguuauccuuguuuucuggcuagcuggugaauaugcuuuuggguagguuauugugauuccccucccuaucccagccucuuggcuuugcaugccauucugaucagcaaaaagaugucuucacugauugagugccugcuugccucaccauugaugccucagucuaucucaccucugccugcagaaccuuggucuucacugagacucuuuagcuuguaaaugguuuguacuuuucuguuaaugauuuacucuauauaauucuuuuguuuuguuugguuugguuugguuugguuuuucgagacaggguuucucuguauagcccuggcugucuuggaacucacuuuguagacccggcuggccuucgaacucagaaauccgccugccucugccuccugagugcugggauuaaaggugugugccaccacgccuggcacucuauauaauucuuaauggcuaucuucagagccuuugaaagacuaaagugacaugucuucuuaaugcaaggcaugacuguuguuuacucuugaguccaacauguucauguggugaccaccacuguccuuugguggccgcagaguauugauuccucaguggccccuccuccucuacugaaguuccauuucucacaugaaauggcacaguauuugcuauaaccuacguuugucccaccauagucuuuaagucaccccccuaaagacuuauaauaaauaguaucuaauauaagguaaauacuaaaauuagugguuguuagacugcacuauuuaggggggaaugaugagaaaauaaagucugugcauuuucauacguagcaauuuuuucaguauuuuuuuuaaggcuuugauuaaauuuguugacaaggaagccauaacucuauaagaccaacucugcuuacuuuccucagucauuuuaagguccuuuaucuggcccaaugucuggaauugaaauugaauagaugucagaguaccagaaauauaaaaaugguaucaucaggguuagggauguggcuuaguugguacagcacuugccauggaagcaugaggaacuacuuauaaaccccagcaccuaacccaugugaaaauccagguuuagacauguguaucugcuacucuugugaugaagauggagguagaaauagguuaauuccugcaccuuacuggccaaauggccagucuagccaaauugauaagcucuggguucaaugaaagauccuuucucaaaaaaaaaaaaaaaaaaaaaaaaaaaaaaaaaaaaagaaagaaagaaaagaaaagaaaagaaaagaaaaggaaagaaaaaggaaaauaguaacugaagaagauaucugguaaugaccucuggccuccaugaacauguguaccugaauucacagcagcaaacucauaaacauguacauacagacacacaagacacacacagaaucaccaacuuuauccauagaacaucaagcaccaagucuuuggcuugccuccacuuuauuuuucacaguugcccuguaaggcccagacacauucuuauuuagcaaccagaaauggaagcaguaacugauucauguuugagagcuagagaguagggugcuaauauuuaaacagggcuguugcaucuauuauagucugucuuggguucuuugacuuccuaaauggguuagauucuaaaccucaccucucuuugauguaagaucucucccacuugcuuuguuauccauagagguugggacaauuagcuauuucccuguaugucaccuugaauggaaaauguccuuauccaaaguucuucaggagagcuguauuuuuuuuucaacuugcaaguuuucagacuuacauuuuggaauucuauggcauguaaccuucuccaaucaaugacuacagccagucuuuggagagagacagggacuuugaagaauguugauaaucuuuccuuucccaacuuuacaaggagccaggcagugauugucauuucccagaaggcuacggcgauaugaaugugugacccacacagagcacuguguggguaguuggauuccuacauuguucagauuuuucaguucugaaguaaccguaggcaguggguacacaugggagccuguucagaggaagcuaauaaagagauaggucucgagacacagacaucuuacccacagauuaauuucauguuuuggauaaacacucagaggugaguggcaugacauggauaaguaagccucucuaugcugugcuucacucucccagacucuucucauggauagaccugcucuaagggcuuuuugaugaauaggaaggcaucucuuuuucucucuggucuaggcuuugauauagauugucuuucuuaacagauuuuuuuuggaagaugauaaucagauaaagagaccaauguauuauguacuugcuuugcucuuuuacuugauuccuuguaggugaaauaucugguggccuguagguuuugagcccacacauucuuccuauguuuacuguaggacaauaaaguugacccauggugagucucuguugcauaugccuuucugagugauugcacuguguguugcuuggucaggcacuagcaucaccacacccaaacccacaacccuguuguagaugcaguacuggguguugguugaacuaggccuagguugcagcuagugggcaucugaccuggagucugaacucuuuuccaccauaaggccugccacuuccugaccugcuugugacugacugcucuugugccccuucccauaauagaguaaccggugugugguuucuucccugugaugagcguccugugggucaucaggagacagaugaacaagauacugucaugggacugagauggcauagagauagagaagugacagugaacugauucugccaugaaaacacagcaugggauuuugcauggcuggaagacagaaaagggcugcucagagaaguugaucauccaucucagccucgaaaggggaaccuaagagaaaugaugaugagacuugccaggagcaaaacaccacuggcaggaggaggacuagaaagugaucuguggauguuggguguccauauucugcugcucauugaugaggacugucaggcuuuugggaauggaaacauaaggaugucuaaccaggccauuaugguggugccuauuuucuugugugaaccgaaaacuuccuggucauuuucacuuuuguacuuuuucacuuuuucauuccauguaagauggaaacaaccugaagccugacugacuucaggguaguuggaaccuugaguccauuucagauaaagguucauauagacauugaaugaaugaggacauuagugugguguggggggaacauacauugucuaugaauuauuuuauguauauggauauucugcuugcauaugauguauauggacuacaugugugucugguugcuggugcccccagaagcaaggagagaggucagauuuccugaaacugggauuacaacuacuugugaaccauuacauaggcacugagaauugagcccagguccucuggaagaacagccugugcucguaaucccucaacuaucucuccagcccugagcuccagcuaguuuuaaauccuguauguagcaacugaugacuuaaaauuccugauuuucuugucuuuaccuuccaaguucgugaauuacauaaacaugccaccauacugccacaacugguuuuauucaguucugggaauagaacccagggcuugaugcaugcuaggcaagugcuugaccaacuaaagucauccuagucugaagcuuuuguuuuuguguuucuucagugugaguucuuagacaaagauuuugauacuuugacauuacuaacaccuaugauuagggccuucaccauuacccuaagaaguuauacauucuuggauguugugguucccuuuggguacucuuaucucuauuuuucuucuccaugaucauuguauaauuguuaauuaagcacuguuuaugcuugauaguagauuagagugugagaaacccaguuaagauuaagccaugacuccugaccucaaagaaacuguccucuugauggucuuaagugauaauagccacuguccacuuguucauucugaguuuaaugggucuguggaggaccacaguugaggauugaagauuggcaaauggguaaggggugacagacugagagcagcacucucuacaagagacucacaauugcaaucuaaaaugcccccucuaaugaaaguguucggugaacaggaggaggaagacuuagccaucuggagacaucaaaggaagaaggaggaaguuauguuguagguagucuucacacaugguauagaauagucuaggcagaggaggcaucccagaguucugccauugguuauaaugaggagguuaugguggggggccugagaucauugaaugauaguagguauggccucagagaccagcauguuuaauuaaccaggcugggugaucuuacuagaaacugaagcaaaaucgaaaaccuguuguguucaguguugggcugcagcaaacagcccccuguaagguuucugagccuuccagaaacccuauaccuucaguauuucugaauaucccuuuaugcuucuguacuuugauucucaaggucucucaucccaccccccaccucccuacaugccuccaucuuugacuuucagugauucuguauuaauaguaguaauuaagcugucucaucucauuggggaagauacauacuucuucaucaggcucagggauaagcuugauuaguuucucuucucacccuccugcugccugugagaagcuccagguugcuacacccaugucugugagaagcuaaggaaucugcuucuguggauaccuucacaucauuuacuucucucacuuacuuaguggaaucuuuccugcugucacucaggaccagugagagucaagagaggaaagggcgaggacagguuucuucaacaaaaacucugccuucauugucuucugucauuguaagcccuagauaggaccacaaguggaaaggaaugaggcuacuuaguguaugaaaucccuugcagaaagcacccagguucuggggugcucuuaucacacacuguguccaugacugucuguaaacagagcauguaggauguggaguaucaggagguaggaggcagggaggcuuagagauuagcuagaaaauuaggauggagggagauagccugaaagcaugguaucuauucucacauuaguccuacuuguuugaaccaacugucagcaauaguuuaucauccauggaguguggauagauguuaagcuugcugcugcacagcacauuagacaugcuguuccauuuaacucuccgagaaauuugccaggaacacacaugccccugucacauuugguagaugcuaaaguugaagucuaaggaacucaagaagcccugcugagguugcauaguuuucuagggugggauacuuauucugccuucacuuuccuuugguugugcuuugcucagaguaccuaggaugucuuggauaauuuguuaauaaaacuggaugcuuuuuagaaugcaagauacucuaaaugaauguguccaacguggcggcaggaguaaacaggaucugauucaggguaauugagaaagucaauugauuucuaacuucugcuacaccccaggacaggguaguguugccaaguuccucuucaaaaugagccuucuccucuauccacucaccuuucuucccugugugggucaucugaguuuccuggugccuugauagauuuacaauugugugcuacagugaucuucaugaguuuauuuccaucagccacuguccuucugcucagcagccuucaucuccaaacuauccagaggagcauuaacccauauucagcccaaauuaccucuggaggauuaacucccuccauuccaaaacuauuaagagaaacaucuuucugaacuuuucuucauucuuauauuaccccuggaggaucaaucucuucgcuaugucuuuuagccugugaauacuccuggcuuggagaaaaggcucuuuuucuuucaauuggcuuaauuugcauaccacuagcaaucuucuuacucugagggauccaugagacauuaaguuaccugaaaaugacauuagugcuaagaauccaauuuuauuaucugaaauacaagcuuuauuguaaagaaccacauagccuccuacucaccuccacacuaagucuggaggcccuuuauguuuaugacaggucaucuuacauuauaguagucugaaagacauguuuaugugguuucccccuuaucuggcuguagguauauacuuuaauucucacuguggccuagauucugaaucuacccaguuccuuguuuaucauugucuuuaacacugcaaguauuauaugcccuuaauacuguuuagcucuuugccuuuuagccccuaugguacuauucucucaggaauccucuccccuugaacuugaaccuuuuucuuugugucccugcugguguuaaaacugucccaaauaaugugacaguauccuuucuguuuugcacagccguguuggggauagagaauauccuucaagaacaaacacugagcaagguuuguggcaauccauaugugaaguuccuuuuguuauugcuaagcauugagaagguggugcagugucuguguuugguguauaucuucccgguuuaacccuguuucuccuugcaggacaacuaggcagcugacagcugacauuucaaacugcugccuguuucaauguguuuacuuacuugggguguaauauagcucuguaugaggaaggaggaagagccucguugacccgugcacuuccagguggaauacacaugggaaauuuggccauacagccuguuucugaguccaggcauguccaggacccaucauguagucgugacgacugguuccucccuccuuccuagaaucugcaaacuaaaguggcuuggagcacuugagccaauucuauauggauuguuuuacacuauaaggagguaacuuacaauggaucagaagucuaaauaucaaagcuaaaacugucagaccuaagaaaaaagcccaacuucuugagacuuuugauaugcucaugguuucuuagacaugauacuguggucuuccuauuacuuugugacaagccaauaauuucuucaaguuuguccuccuauaccuuugucauuuguuuaucauacugaauauauuaaaauuuauccacuucuguuugucucuguuaauauucugggauuguugagguuucuauuauauagucuuaaggucuauugguaugucugucaguuaggaaagaaggaaggacaaaagguaaagggaggaaggaaagaaaguaauaagggagauggauagauggaauggauggaugguagguaguuagguggaugaaugaguagauguauaaaugaaugggauggguaguuagaucaauaaguagaugaacaauauaugaaugaguuaauggguagguagaugaauguauacauuguaugggcaaguggauaacugauuagauagaugaguugaauggguagguaaauggauaguuggauagauggauaggugaauggaugguuaggcauauacauagauggauggauggauggauggauggauggauggucaacaaccagucauucuccuuagguuucucaauucuaagagagaaaaggcaacuugcaucaauaauccaguuuugaaaagcaaacuaauauuugaaagauauauuugucaucucuguuggaauccgucuuugacaagcaaccacaggcauguguuuuccugugcaaauaacugugaauauguuaaaagguucaccaguguuuaaguguauugaguuaauguggucauuuugagugcuaaguguguuguggauuuuaagcugcucaucaccucucuaauuccauaguuguaucaucuaaagaaauaugggguauauuaagaauagaagaguuccuuuauaucaaagagucugggaccaggaauuaaauuacuguaguuugccaucuacugcuguaugacuuuuauugauuuauccuuacaagcagucaacuaagauaugagugccagcauugcucuuuuacuguugagaaugaagagugcacaggcaaaagcaaucaguucugcucuuaagggccuucagaaucuugaggcaucaugggagaacuaugaauaaaaccaaauucagguguagaacggugugauggagccuggcaaagaguguccugcaaacacagacugucaugcuuacuccaaaaagagucaucaggaaaagcuuagauaggaggugguauccacacaagaaauaaauuugauuuuccacugguacaguuguaggugguauugucaacauacaggaaagcauguguaaaggucaugagaccgguauggcaggucagccuccuggcaguggaggcugagauugauggcagccaaaccaacucuaagagugugggcucuguagguggcuacuguuaucugaauauaaagacucuaguguuuacacagauguaauaauaucuuucuccaucuuccuucauggcccuuucccucuccuucuuucccuuccuuuuuuuccccccaucucucccucuuugaauuucucccucucccaccuuuccucugugaaaggucuuggucuuucaucucuccuuacccacuaauuguagugcaugugccuguguccuucaccaggcugagcacaggcaugcggcagauucaguaggagaaucagacaaguuccugaggcuuuggaaagaugaagacacuuuagauucucugcuagcagcucaaucuagucacaauacuccagaccaccagccaacuacuacuccuuuagcauaugcuggccagccuuggggucuuuacacacuauuuguucuuuuccuuuccagaccuauauaugauucuccacccugcucugugcccucagccggaccuggguggaggauauccaccagcugucuggcuuccagcuuccuguggggaggauccuggcaggagagcaaugagagggaaggaagggaggcugggcuuuucuuccauucuucuugccuauggucaagaauggcucaugcugggcaguggugaugcaugccuuuaaucccagcacuugggaggcagaggcagguggauuucugaguuugaggccagccugcucuacaaagugaguuccaggacagccagagauacacagagaaacccugucucaaaaaaaaaaaaaaaaaagaguggcucuuccugaacaauuucagagcuccaggagauaucaugcaguuuguagaaacucuacuuucuucuuaaugaauuuauugguacauagauaaggugauuucagaagacaccguauaagaaacagaagccaagcaugugacugcuuuaucauuuucauguagacaaauaucacccugacacaaugacauuaagaagauuaauuauugauucucuaacucuauccaaugcugccucauuuuuuuucuuuucagcacuuuguugaggcaagauuggcauaggaaaagaugguuugggagauaaauauagcaccauaaaaugcuuguuuuaaucugugauccaucaccugcaauaguugucuuuucccuuccuuguuuauuauuguuauuauuuugagauaaaaagcacuuaacaaguuuuaagucucagcauguuucuuuuuuuuuauuauuuuauuggauauuuuauuuauuuacauuucaaauuauccccuuuccugauuuccccuccagaaacccccuaucccaucccuccucccccugcuucuaugagggugcucccccacccacuuauccacucccaccucccgacccugccauuccccuacacuggggcauccagccuucacaggaccaaggguuucucaucucaucaaugccugauaagaccaucuugugcuauauaugcggcuggagccaugggucccuacauguguacucuuugguugguaguuuagucccugggagcucuggguggucugguugguugauauuguuguucuuccuauggguugcaaaccccuucagcuccuucagaacuuucccuagcuccugcauuggggaacccgugcucaguccaaugguuggcuguuucuccaugugggacagagugcuauuggcuguagucagugugcugugcugcagcucucaaagugcucuuugcuacaaaacuaugacucugcaaggaguucuucccucccuuguucucaucucccaaccucuggcuacugccauucccauucuacucucucuucagguugcucaguuguaguaugcugcuuuuccugucagaacucuggcggauaccccuagguauuuacauuucuugguuuuguucucuagaucuccaaauucugauaaauauuauugucuugccaagucuucuuuaaucacugugucuaaaaaugcaaagccaucaccauuucuuaucacccaucccugguucuugaaacagaguggcauggaaccuugaacugauuauccuaccuccaccucccaaaugcugggauuaugggcauuggcuacuacaaccugcuaccuacccaccuauccacccagccacccagcuucccuaacuaccucucucuauuuuugauuucauucccuucuacuuuuuguuguuguugcuugcuuccuuccucccucccucccucccucccucccucccuuccuuccucccucccuuccuucuucccuuucuuucucucuuucuuccugucuuucuucuuacugucuuccugccugagugcuugaauuauaaucuugcaccaugccugguucuugcuacuuuuaaauagguuauauauguaaucguuauauauguuacucugugucuuccugggucucugucucuuucuuucucuaucucuggcugucucacacaaaucugucucuuugucuuugucuuuuaucucucucucucucucuuucucucucuuucucucacacacagagggggagagaggggcaccuacacaugugggcacacacaaucuuuuaagaccaaggagcuuacuugcaauauacccaucaggagaauguuaucuucaugaugcccuuuaaugggucagcaaagugauauucaaacuuccacauaccuuuagggaccuauauacugcagcucauuuguuuccugugacauuccuucucaggaggcagaaacagugguauguauuagcuuugaggaacuuaggcucauaauagggguaggucuuuuguccacccugcucugaguuccugcuguggauuauccuaguuuucaucauccucugcugcuugggaguggacuuugaagguaacagguauaccugcucuuugguaucagagucauuuugagguguaaucagugcaguuccugugcuacuaugcaggagaguaucauguggaaauagucugaugggacccacuccacuugaucauuuggguggucuauuucugucauuuguguugaugauauuuuauaucucccgaaaggcuagugcuuaccucaguugucccuucugucacagaaagggaccauauucaguucauuucuccucccaugcuguuggagaaaccuguguucucugauuacaguuaguauucucugucaagucuuaguuaaucauuuucucccucuccccacugcagugcacacagcugcuuagucugcaguuugguguuccauacucauauauuuuaauuguaauucauaucacuuugaggaagacaaggauuaaaguuuauauuauaaaugaagugugcauuaucucuacugugcuacauucaguuuacccuugaucuaccuggaucuuguuacuuuuauuuuaugaauaaggccagacaauaaacaugaguaggccaaugauucucuagaaccuuccuaauacugcuacucuuuauuacaguuccucauauugugauggucccuuacuauaaaauuauuuuguugcuacuuuguaacuuuaauuuugcuaguguuaugaauuauaauguaaauauuugauauggaggauaucugaugugugaccuccaaagguguugugaccuacaaauugagaacgucuacuuuaggcaaagcuuagauaacuggccagcuuagacacuguuuguccaucagucuaucugucuguucaucuaucuacuugccuaccuauuuacccaauaccuacuuaccuauuuagcuuuuuuauauauacaucuaucuaccauauauggaccuacccuucaauuuaucucucucccauucucaucuuccuguacuuugcuaccuagguuguuacuuaguaugaacucuugggcuaaguuaauaucgcaagggauauuuuucucacauggaaaauguaccauguuauaaagauagcacaagcaguaauucccaugcuugacaguagacauuugggccuuugcaauguuuugaugggaguagggugaagaggggggucuuuaaugaucacacacuguuugauaguuuuugcuaccuacuagaguccaacuuuaucccuuuaccaaguugagacacuaaggaugucuguagacauuacuacauuaccaaaccugagacugcuggcacagaauaaacagguacuggguaugcuaagcacaugguauuauuauuauccugcaguuuuuagccucggguaugucuucauucguccuugcacaguacuaaccugagagacauuagaggucugauaacuaguagcuaucuucuuauuaagauucucaugagacugggaagucacucaccucugccugggcaucaaggcuguucuggaacuuuuguuuuguuauaaauagagcaaaaggagaaagcuaggcagacuugugaaggucauuacucuuaggccuuuucuuauguugacaacccccacccuuguauuacuguaaaaccagcaauagagagaggccacauugugaauuggacuuugguucugguaaacccuugccuaggaaagucaggccaacuggcauuuugagcuggcacuuuuggacccuuacuguugcauuucuaugccaaccuuaucuuccucagaguagaucaggcagaucgucaacccuuccuauaguuauaccuuuagaaacacagccuuuuuucuuaacacaugcugugccauauaauaaagcauaccagcagguuucagcagaccugaacuuggccuuguaggacauuccagaucucugcuccuccucuccaucccuugguccuauaacugucaggcuccuuaauaugaucacuucuucagcuccuucucauaguuuaguggaggagguucuaggugauaccaacauuuaccuacauucuugagcuaauucuaucauuggcuauaaguccagcugaggauaguuugagggccugaaaucuaacucacuuaaaguucuguuccugaaagccaggagugcacucaucuaccucugacugcauaguaucucuggccuuguuuagaaagaucuaucauuguuuuuuuguuuuuuguuuuuuuuccauuauuagauuauuuauauuucaaauacuuuccccuuuccaggucucuccugcagaaauccccuaucccaucccuccucccucugccucugugagggugcuuccccacccagccacccauucccaucuuccuguccucguauuccccgacacuggggcacugaaugcccucaggcccaaggaccucuuuccccacugaugucuaacaaggccauccucugccacauauguggccagcccuauggguaccuccaugugucgucuuugguugguaguccaguccccuguagcucaggguaggggggguugucuggccuaggcugcaaaacccucagcuccuucagucccuucuucaaccccuccauuguggaccccacacucaguccaaugauuggcugugagcauuugccucuguauuugucagacugugacagagccucucaggagacagccauaucaggcuuccaucagcaagcacuuacugguguacacaauagcauccagauuugguggcugcuguauaugggauagauccccagguggggcagucucuggauggccuuuccuucagucucugcuccacacuuucccuccauauuugcuccugugaguauuuuguucccucuucuaagaaguacugaagcauucccacuuuggucuuccuucuucuuaggcuucauaugguccaugaauugaaucuuggguauuccagacuuuugggcuaauauccacuuaucagugaguacauaccauguguggucuuuugugacugaguuacgacacucaggauguuauuuucaaguuccauccauuugccugcaaauuucaugaagucauuuuuuauaauagcugaguaguauuccauuguauaaauguaccauauuuucuguauccauuucucugucgagggacaucuggguucuucccagcuccuagcuauuauaaauaaggcugcuaugaacauaguggagcauguguccuuauuacauguuggagcaucuucugaguauaugcccaggagugcuauaguucguuccucagguaguauuauguccaauuuucugaggaacugccagacugauuuccagagggguuguaccagcuugcaaucccaauagcaauagaggaguguuccucuuucuccacauccucaccaauaucugcugucaccugaguuuuugauauuagccauucuugcugguguaaaguguaaucucaggguuguuuugauuugcacuucucugaugacuaaggauguugaacauuucuuuaggugcuucucgcccauuuguuauuccucaguugagaauucucugauuagcucuguuccccauuuuaaaauaggauuauuugguucucuggagucuaacuuguugaguucuuaguauauauuggauauuagcccuuuaucggaugugagacugguaaagaucuuuucccaaucuauugguugcuguuuuguuuuauugacagugauuuuugccuuacagagacuuugcaauuuuaugaguucccauuugucauuugggaacuaguaacagaaacuccaacacagauuggcuuaaguuugccagaauuugucuuauacaaggacaguguggaggugaguagugguuggcauugguuuauagccucauucaucuccucucagugccuuugccuucuucccacauuugccauguaucuucaggaaagcaagcauuggacaaagguaaaauaauagagccgagacugcaacuauauauuuaccaacacaauacaugcauaccuaacuuaaacuuuauuguauacccuaagcauuaccugaguccuaaaaguguuauucaucugaaauucaaaucugauagaacauauuacaguuuuauuccuuaaaucugacaacuccaagauauaaucuuaacuucaugaaacuagaguuuauagguuucuuuccacuuuauagagccagggcuucauguuaugaucacauguaagcacauggggugagguaaagaauucaauauggauugugaaaaaagcuggaauaauuaaucuaguggggaacaugaaauugaaauuaguaguuaguaauggagaauuaacuuaaaauuaaauguacucaauauuguuuguaggcuccuuggagauuuuuuuaguguugguuuuagaacaguaagaggaaagccaguuauaagucagccagcaucaauaucugacauuuuaguuaucccugcugugauccugcuacccacuauggucugggaggcacuauuguagacacuggggugaacucuggaagccuucgugauauuauauauaucuuuuguguauauaugugugcccacguccguccguccgccugucuauccguguguguguguguguguguguguguguguguaaguacugguacauauaugugugaguguaugaagguccagggcugauaucugucuuccucaauuucauuauaccuuguauauuuagaaacagucucuagcuaaacacagagcuuaccauauuuugucuagucaugggagcuaguuuauuucagggauucucugucuguuucacaugugcugggauuaucauagcugggauacuguucccaccuagcuuuuauaugggugcuggggauuucaaucugguccucauguuuguacaccaaguacugugcuuaccuagccuucuuuccaaugacuaugccacauuuucuucauguauucuucugucaggaggcauuugucucacaucuuggcuguuguaaguaaugcuauaauaguucuaaaucugaaaacaugaguuuaaucccuaggaccaagaugggguaagguguuaauccugagauucacaagagaaaaaccauuucuaccauuuugagccaaauuuggagcaaacugugcugacuaggauggacuuuugccagaacuacuccuugaagcagagugucuuuacugccggugggcucucccaccagagaguacugucaucuuagacacuucuguuucagggcuuugcuccugugaugggucuguuuucaccugccuguaauucuuuuggaaggaccacuauuccagcugaagcuggcuuucugacaaauuuaagagcaucaaucaaggaugcuacuaggucauauuagcaaaguucuccagaugcaaaugccuaauguugaaucuuggcuuaguuucuccuccuuggugaugauaucauucaauucucugggccucuauuuccuuaaguauaaaauucucaccaugcaccaagaagcaaauauuagcccaagguuucauuuucaaaacccauaguucagccugcuaauuuggcucaguuagugucuucugagcaagcaucaagaugugaguucugaucuucagaguucauauaaaacaggagcauaaguuuguuugcauauguaacucuauuuaggaaagggggguccugggcucacuggcuagccagucuagcuaaucauaaagucccagauucaguaggaauuucuuuugaaaacaaaggugagauugcuagagaaagacccaagacauugacuucugaccugugcacauacacauauacccgaagauauauaaagauaaaauaacccucuguuucuccuuucuuuucucuacuguguacucuuuucucacugcacgggucuuaugacugugagcuguacucauuuuuccuaaacagcauuccaugaacuaguucucucuggacagcccaacugauuccucugcaauaauauaaacaacuucauuccuguuucuagaauaccuuggauaccuguacuccaucccuuguuuuaggacacaucaaaaugaaagaaugaugaauuccaaguaaagaaggguaugcagucacuuguuuaggucuguaucuuugagaaugaccaaggcagucagcucuuacaacgucuuacaaguauggccauuucuuguuucaggacaucauggcauggagguagaccaagagucucucuucugaccuguccccuuuuccucacuuguggaaacuguugagucucugcaggauuuaacugggguuagacauuccucuguacucauuuaccuguaauaccuggugugcccauagaugcacugaucuaauagagugcccuguacauaguagagauaccaucagagaggacuagucauuucacaguggggguuucugaacuacaguguaucagucuaagugugccaggguccagcccuggcgugggguucuucuuucuuguccguucuucuugaggccacggaggguaaaacuuggucuuaugaaauucgggcuuaagacuuugucuuaugagauauuuaagcuugucucaugguaagccugccugcucucucugcucucugcagcgucuuuuuuuuuuuuccucuuucccucugcauucugauauugcucucuugguuuuuuuuuuuuuauuucuucauuuuauuuuuuuauuuuuuuuauguuuuuuuccauuuuuuauuagguaucucuugguuuuuuauguuaccuguaauuucuaaguuauucuacucuguauucuuuuucuaaucuuauucucuccuccugcucugaagauacaacaauguucuuacucucaaugccuuuucucccaaagcuaugccuauauuucuaaguucuucuugaauucaauucugucuaaaaaguguucugucuaaaaacuucucagcucaguuccuucucacagcucaauucuucuaagcucuguucugacucuucuuauuuuccucagcacucaaacaucuuucagaauacaugaucacauguuacaauguucaucacaaguucacucaaaaaaucaaaucauaaauuaaaauagaaguuaacaacagagaauguuuacaugcauauccauuaggacuaguuaucuggcuaaacauccaucaccugucucagcuccacagguucccugaagguuuaaaaccauaacuaaguugugagugaaguuuuguauagauaaacccagucaauauuuuaucuuauauccuagcaccuauaauaaaucauuaguucccuuucuaugaccuucgauuaauuguuuuacacccucuuggaaugugcuuugaguaggagaaaguaugguuacaaucuaagagcaauuaacugguaacacuugggagacuggcagaguucucauugcagguuugauuaucagaaaaggaucuaaagcagucccacuauaaaagagcuuaguaaucacugguauaauuuuagaaauuuuuauaggauuauagucauuaagacuuaagucaucuauuugucuauauaacaucacuacaagacaguaaguacaucuuuguggaucugcagagaucugcuuuaaaggagugcgauacuacuuagugauuguuauauauguuuaauaagaacaggaaaagcauauuaauaacaggaauguuuccuaaaaugaauaccuuacagccuugcuuaauaagggugcaccuguugcagauuauauaauaauccgaagcuguugcagauaauauaauaauccgaagcaggacauuucaggauggucaccugcuaguuaucagcuucucccauuauggcuccuaacauaaguguuuggguuagagcaacacucauguuccucuaaaaauuacucuuagcuugcucuugguugucaaucccucuacucauuauccagccaagucuuguucuuuuucuuuaacacacaucauagcuccaagacuuucaucugugccauuauuauucucaaccuucucaguacuauguccagguaauguccaugguccagguaguguccaugguccagguaaugcccauggucguccauaacugcacccuagucuuuuuauauccccaaugacuccagcucucauuucccauuugauucuucugaaaugccuuuauucuuucagaucucaucccuagacuggucacuuuaaggguucaggagucacuaauacuacuuguaccacacuauucuacauucgugaguacuuuuuaaucuccuugaauuguuugcaaacagguugcugucaugagcuguuguugucuucaggggcagucucuggauggucauuuuaagaagaguguauuauucaggauuucuauuccugaacaaaacaucaugaccaagaagcaacuuggaggaaagggaaacccuuucagcuuucacaucuacauugcuguucauuaccaaaugaagucaggacugaaacucaagcagguuaggaagcaggagcugaugcagaggccauggaaggauguuacuuacuggcuugcuuucccugguuuggucagcuugcuuucuuauagaacccaagaauaacaucccagggauggcaucacccacaaggggugaagcacuccccccagugaucacuaauugagaaaaugccuuaugguuggaucucauggaggcauuuccuuaagggaggcuccuuucucugugauaacuccaacuugugucaaguugacacacagaacuagccaguacaaagagaacaggauacucacagguacagaaguaagauugaugugaggccagaggaagaaggcauccaucuacagucauggacagggaccucggaauaaaccaacgcuucuaaaaucauuaucugugacucccagccucuggaacugugagagaaugcugcugugucuguauuaguuacuuuuguuguuucuguggcaaaaaaucucacaaagguaacuuuaggaagaaaggacuuauuuugguucccaauugaaagguucaauucauuuugguggcaaagcuaaagaggcaagagaugggaggcagcuggucacauugcauuuauggucaggaagugcagauaaaugaugcuacucagcuuacucucuccuuuuuauucaguccaggacccccguccaagaaauugucuuguccacauugaggguggguaacauaaucuaaauaaacucagacauaccuagaguuuuauucccauggcgauucuaaauuccaugaaguugacaaucauaauuaaccaccuugcuauguuguaucccuuaaaaugagguauuucuguuauaaagauuuauguacuguuauguauauaacuaugcauguauauauguguaccacagugugcagaguuuggaaaggugagaagaagauguugaaucuuccauaacuagagaugcaaguugugagcucuuaugugguugcugggaacugaaaccuaguccucuacuaguacuuuuuuaaaaaacaaacaacaacaacaacaacacaaaaaaacccagaaacuagguuuuucauuuaguauauucugauuguacucuccccucccccaagucucucagaucuuccccaguuucccaccuaccccaaauccacagucuuuauuucucucucucaucaggauacaagcaggcauccaaaacuaauacaauaaaauauaauuagauauaauaaaaucaaaccacaauaggacaaagcagggaaacagaacaaaaaaaaaagaaaaagcuuaaaaacacauagagacauauagacagagacauauagacacgcagacacauuugcacacacagauaugccauaaaaacacaaaacuaggaacauaauauauauguaaagagucugcgaggaggaaaaaagccccaacaaagcauuaugagacacauaacaaaaaugccauugagugagagagagagagaaagagagagagagagagagaguguguguguguguguguguguguguguuagccaucuacuguuggacauggguccuagccuuaagaguagauguuacccaguaaauacucaaacccuugaaauauuucuuuagcccagacugagauauuuuggaggcaucacuuuaaacaccuuauaugucacuuuuucuucaaaagcguucauucuugauacagucacaguuacucucuuacccucucucuuccucuccaucccuuuucucuuuucccccuauuuucucuuuauucucuucucuaccucuuuuccugccuacucccccuuaucccaauuacauccucauucuccccuggcugucaguaaguuccagucuaucccuggagaccaguccaccauaguggaaaacaucuccaggauugcucuucauucccucauugcacaagauggcuagggguauuuuuccugggggucugacuaaaugcuguuuggagcugcaucauguccuaaacuccugacuucaguagccuggucaaguaccgcugccuuacuauaauccuggcucuauccuagugacacagaaaacaccugaaggaccccuucaugaugacgcuuccuggggauauuuccugagcuaaaugaacugugguucccuagcuucugucuucucugcuuccucaguuguguuuauugcuguugaucuuuauggugcugcucacccccacacccuuacaguacuacuaaaauuccuguagugacaucagcccuuagguauguggguugacugugggaggcagcuccaucuggaagcuaaauagagcagcacaauccuguucucuuccucuccccaccccacccccagaacuguuuuccuacagguagagaaugccaaucagugaauuuacaaacugacauuuuucuaagguggcuuucuauuugaaaagguucuuaugauuucaaagagcugggaacuagguuuggaauuggcaaggaagccagugccacuagagagaauaggugggaggaagcauauguaccugaauucggugugccuggaaaguuuuggcugugcccuguagauggaguuuugugaccccagcuauuaacagcuggagcuuuucucaguuacacagaccaucuguggcaugccaaaauugauuuguacaaguuugauuauauggcaccugaauucuccuccuacccucccccugccccagguguucuuuggcuuuucccacuggucaacacaguaaguuauugagcuaaguaguccacagggcaaguguagucccgagagacaucccugaugucaagguagugcaggagggaugccagcugcuuuucucucuucuugcccuuggucuuuguuggccauaacaucauucagcugucgcugcucuuguguacuucucccuguucaacuguagacgaugaaugaugaaugaugggguacucaugguguuuguuguugggugcuuucauuuugcauuggguccagauugugggucaaugcugaaggcuuuguaggcacaguuuuagggucuugcccaugugccuugagaaaucaaacuuuuuuggcagacuaccacgccaccucugaggagcuaggucacucucucaaagugugcauuuacuugcuuaagaauguucuuagucuuuggcagaccaaggccaaggucaugugguaguggggauuauggaauacuaggauguguggccuccuuccuugcugaguugcuucccuugcaaagaaccacaucugccaauucccaccuugaggcugccuuucccacagcacagauggugcccuuccagguagccucccuccucuuugagcuguugagaaggcaccguuuagccaugaaggcagugcuguggaggccuguguuaguuagguggaaggcuuaaccuugugaaccaugauggcuauauggcaaaaacccuuggagaacugcaggcaucuguaugcagccagucugguggggugaaauaaacacaucuuuggucaaacuacacacugccaguguaagaccugaagagccuuauguccaagaugucccacucacagaaacacagauacugagaucaaugcaaaaaggaagagguuuauugauccagcacauugggguucugcaaugagagcagaggcuacccugaaucuccuaagcacacacuuuuuauacaguuuaaggguagaccuugguaacuacaugaguugguuuaaacccauuguuggccagagcugaccuuuucauuuccccccuuuagaaauggcaauuacuucaugaccuucccuaagcagcauugauagcccuaggugagaugaggucuucgucaccagaagagggaacugagacaguuuuggguguuaucugcaccugccuuucgggucaggguuuucuuguuuucuuuugcuugcuugcuugguugcuugguugguugguugguugguuuugagauaggguuucucuguauagcccuggcuguccuggaacucacuuuguagaccaggcuggccucgaauuuagaaaucuaccugcuucugccucccaagugcugggauuaaaggcguguaccaccacugcccggguaaagaaaguuuugguuuuuuuuuuuuuuuaagauuuauuuauuuauuuguuuauuuauuuauuuauuuauuuauuguaugugaguacucaguacacugucacuuucuucagacacaucagaagagggugucagaucccacuacagaugguugugagccaccaugugguuacugagaauugaacuaaugaccucuggaagagcagucagugcucuuaaccacugagccaucucuccaguccuggggcuuucuuguaaagcuuguuuuguugggucauuccgggaagggaguguucaucacaaccuucuaguggaaaauccccaggaugcuauucuagcuaagucuuugaggggucggucaucuuauguucucuaaggucacacauucccacaucaacauaucgcuaagacagcccagagcagaaucuugauuuuucucacugucuucuuuagaaacuugauuucuugcugccucucacuaggugacguuaauugugagaggcaguccuguguuccaaauauuuauugauggaaacaguuuucauuuauaauauguggaacucuuggggcaugccuguugcugagcuucaguuaauucaucuauaaacaaaaccuguugauccaugcauauagauuuuuaggguuacaauaaaugauacaaaacauaucucacagaacucugcauuugcuaagucuuugucacugggcaagcacugcccauucagcagugguacugugguaauuugugucucauugacuuggaaggauaugauagugcguacaaucacaucaucagguaucaggucuagaaucuggccuaggguggucugugauaaauggagccacuguaaucauuauaggauaaugggaaaaucugaagaauugggcagaaaaaugaguuaccuugggcaagucacuguauucuuuggggacuaagucacaaagggauaaguggauauuguaggauagggaagaaagauauuagaaggcagguaguaagguauucuguagagacauaaaguagaggugcagcugguggcuaccagaugcgauuugcuaguaguaccaacuuugccaucugcuuguucaucauagucuucauuagauauaacuuuuuauacaccuucugaguugcuaguguuuaucuucaaaaauaaguucugucaccaguacagcuucuaaaagaagaaauagaguaagaauaggccuauaggcauggucaauuguagaaucuuuaaacagcucaaccugagcacugagccuuacccugcacuguuaggugugcuugcuguuuuauugacacacagcuauguggcuugggggauguuguacgugcagaaaguaucuuugguuuucaguuuugucacauaugugaucuggaguuguugaggucuccugaagacugugauucccucuuuugccugagaucaagugacugcccagugucaagacaucaguucugagcucagcucuaacaauccucuggaagggaaauccauuccucucugcaguccacugacuuggugacacaaaggcacuaucuuagaaccucugggugucugaccugugaccucagugucuagugacaaugccagagcagaugcagcuucuucauauccggggcuauuugauggugccaccuuagugauuccuuuagcagcaaguggcauuuuguugagggaguaucgaguaauaguagaauucagaggugugagaaugggucaggguaccacgggcagguauguagugcugggguuuuacauggaaaagucuuugugaauauagaccaagacuggggagagcauagaggguaugcgagcuacagaauuaucucugaucucucuacucaucucuaauggguacugggucucauacuucauuuacucaaggaauuagacaaagucccacgaagcuuaggcugagaaagcuuugaggaaggaugauggucagacucuauagaaggaucaccauguaauucuggaugaguacucaggaagugccgguuacccguaccuucccuggaagaucaccauguaauucuggaugaguacucaggaagugccgguuacccguaccuuuccugaagucgaaguugggcgagauaacuaacagugcucuggcuagugcuugggaaagaauuccuaacuuccagcacaguuccucagucugcacaugugcuuauccacgucucagcucugcagugcacagaugcaucuuagggaacauuugagucucauuaagaaggaugagaucauuaccuauuucaccagcucuuuucucuuuucauaaaaucauuacagucuaugauuaaagcaucaaaagucaauaaacugaagaaucaggcaugugguaauuccuacgauuuaagcagaugcaauauuuuccauagguaaucuguaucccuaagcugauaccuucccuguccuugguccauuuccaugaacucagacccauccaugauuuggguugcuugcucauuuucauuaucuuuuaacauucccaaagacauacucuaauggauguggaugccucccacuccaguugcugcuaucaugcauuaccaaaugucuucuggcugaagauaaucccacauuuguucaucaguuuggaaguuagaaguugaaaaaucggccuuacagguauggugucagcuccacgaugcacgaauagucuauucuucccuguucuuaguuucuaccaccuguguuccuugcuuugugcuccuuucuucuuccccccccccccccacaaagcguaucugucuaaucuuuuuacccacugccacaaugcuauguauucucacuuguaccuucccccuugacaugaaguccauuuaggaauaauuuccuuaucuuaggcacucauccuacuuucagaguuucuuuuaccauguaauacaacauucacauuguaggaauuaucaugugagggauguguguguaucauuagcaauuccaaaggacaucagucuugguuccuaugguuuucaucucuaugaggcucauuuccucucucucucucucucucucucucucucucucucucucucucucucucucuccugccccacugacucagugaugcccuucucuuucuugucuauguaacaucuggaaucugucaacuaagaacauguaccacacacugccuugccacuauugguuuauuuguuugccuguuuggauagagguagauggcaccuacuucuuaucucugccacacagaaccaugauuaacuauggcaggaacuauuucuuggcuuccuaggaacauagguccuagaguaagaacccugauuucccucacggagaugccccaagaagccuuguguccugauuuccacagagccuuguuguccuagaauuuauauccuccugggaucucuagucugagcuucagcauuucaggauucccauuucccuagcccgucaucugucuaauucccuguguuggacuguaauagauuagccuaaggaaaagugaauagacaaguuccuauuaacauuuguauugcuuuucuuugcuauuucuuggccugggauggcugcagaaaauguucuuucaucuaaauaauguccccaucaguggcuggauucuggauuuuugcugggccguggaaaagaauagguguggggaacuucuaaaccuaggauauauaggaggaaugaaggucagaucagaaacugcaugcuacauucuuugcacucaugcuguauacacacugccuugucugcucccaugucaggcuaugguguagagaacuaauauccaguaauuagugaguugauaugaaaugccacacauuuuccacuugauguaguucuucuuuucuuucuaucucugucuuucugucucucucauuuacuuuucagacagggucaguccaggcuuaucuugagccucuaauccuauugcuuccaucuccauacuacugggauuauaggcuuauacuaccaagcuugguuuaugcaguauuugggaccaaacccagagccuugugcaugcuaggcaaguacacuguccuuugacauuuagucauauuauuucuuuaucccuaucucuuucuagauccccuucccuauugaacccauuucauauuuucucucccuuaaaagccaaaaccagaauagugcaugcgcacacacauacacauggaagggagggagggagggacggagaaaaggagaaaggaaggaaggaaggaaggaaggaaggaaggaaggaaggaaggaaggaaggaaaccaaauuucuuaaaaacuguagucuguuuuggccaccuauuuggaagguagggagagaacauugucuuagcaugcuuuccaggaagcagugcauaagugguucgaggaucugcagauaaacugaagacaguaagagugcucaaggcagaaauuauaauggaaauagaagcaaguaacugugaaaguaauuauuuuguucaagguagaugcuuaacauuauaagcuaauauagaucccccuuaagguuguagaaaaguugacaaggagcaagauacaugcaaaggcaggaggguauaguuuaauaauguauuucugccuccuuaauugggaacuauacgaauggaaaaagggaagaagacuugaaugguuuucaguguuucucaagcuguaacuuuuaaaauguggacugauuaguaagagauugugcuuuucuaacuaguucugggaauguugauguucuugauacaugagugacaccuugaaucuuaugggaauagaaggaaugcaggugcugugggaaaaugguacacuuaugccucuguguggucaaauguuuaacuagguaugcaguaguaacauuuuggagagugggaguaagugggagccacaaugggaaauugauauaaacucuauuugcuaaguggaaaaagagcuugggguucuguugguagaaacaguugaaagaagaugcagugguaucucuguuauacaagacacaacagcauaugacaacagcuauccaacaaccaugacuugaaccuaggguuuuucuuuuuuuuuuuguuuuuuuuuuguuuuuuuguuuuuuuuuuuuuuaaucucuauccuucuaggagaucaggaaguuggccauguaggugaugugaugguuuaaugguggcagagauuuccagaauccgucuggcauuuacuucaugguucucacugaagauuaaggugcuaugguguccaagauuguccuaaguaucccugacccugagccauuaagaagcaggaagaacaugagcucaauguguuaguagguaaauggcuuugaguggccuuucagaaccggagcaauggugucuuugcuuuuuugaguguaagcagucaaugggaagggauauucauuggauagcaagguagcaguccuugcugccuuuagaaucaugguaagaacuuagcccaaggagggcuuguggagccauucagauacaacaaggaaguuugauucugggccacuaugcucaggaaucuugaaaucugcuuuguccuuuguauuuuccagcucauuaauuugagugucuaaauccuugucauuauguaagauucaacucuaaugucucuuuuaccaaaaaucugcaaucaagucaguccuccaaccuuuggauagagugggaaguuagcaucuuauguucugguuuugcauuuuauuaagacaguacaucuuaauguauuuugauugccuaauugccuggugcuguauguauucucugcaugugcauguaguugaaucucacugcauaucauaugaagcuugguggcgggauggaacaugguccagggguuuauacuagagcaguacuccucagcuagugaucuacagacuuucucagaucacaguaccuuucccuauagcuucuacauuauccagucuugaaugagcccaagagugugcaugucucauaagcuccagguauugcuaguuuccugagacaacaaugaguaaucaucuaucucucacagagggcaugugcugugagucaggcuuggaaauagaccugggaauuaagcacagaggaauuaaauucaaagaugaacaccagagaacuguuuauagugaaggugcuuggugcuuggaaucuuguuuugaauauuuuuguuuguuuguuuguuuuuaaacaaaccaauuuucagcuucuccucaucuuucauaccacugacuguaugacguauggccauucauguaaacuaacuauaugauauauggucuuucaguaaacuauaggacaaaucuuaucucagugcacauaagcauuccuauaaauggguaaaagguaccgaaucaauuaagugguauucggagaaaaguaauuugaguugcaaaauuguaggaagagaauuuugaguaauccugagugaaauuaguguacuuacacuacaauuauuuugguuaagaauguagcucaguuuauaguguucuugccuagcauacacauaaguuuaacuccaaacccugcauggacuggaugugguggugccugcuuagaaucccagcauucaaggagucuuccaguaguacuauguccaauuuucugaggaaucaccaaacugauuuccagagggguuguaccagcuugcaaucccaccagcaauggaggaguauuccucuuucuccacauccuuacuagcaucuuccaucaccugaauuuuugaucuuagccauuccgucuggugugagguagaaucucaggguuguuuugauuugcauuucccugaugacuaaggauguugaacauuucuuuaggggcuuaaauauuccucaauugaaaauucuuuguuaagcucugcuucccauuuuuucauaggguuauuucauucucuggaaucuaacuuccugacuucuuuguaaauauuggauauuagcccucuaucagauguaggauucguaaagaucuucuuccaaucuguugguugccuuuuugucuuauugacaguguccuuugccuuacagaaguuuugcaauuuuauaaggucccaucugucgauucuugaucuuacagcacaagccauugguguucaggaauuuuucuccuguguccauauguucgaggcucuuccccacuuucuccucuauauaaucauuguaucuggauuuauguggagguccuugauccacuugaacuugagcuuuguacaaggagauaagaauggaucuuacaugcuagcugccaguuaaaccaucaccauuuguucaaaauacugucuuuuucccacuggaugguuuuagcuccuuugucaauggucaaguggguggguucauuucugggucuucaauucuauuccauugaucuuccugccugucucuguaccaauacaaugcagguuuuauugcuauugcucugugauacagcuugaggucagggauggugauuccccaagaaguucuauuauuguugaaaagaguuuuugcuauccugaauuuuugguuauuacaaaugaauuugcaaauugcucucucuaacucuaugaagaauugaguuagaauuuugauggggauugcacugaaccuguagauugcuuuugacaaguugccuauuuuuacuauauuaauccugccaauccaugaucaugggaggccuuuccaucuucugugaucuucauuuucuuucuucagagacuuaaaguucuugucauauagaucuuucacuuguuugguuagaguuacaccaagguauuuuauauuguuugcgacuauuaugaagagugucauuucccuaauuucuuucucagccuguuuauccuuugaguagaggaaggcuacugauuuguuugaguuaauuuuauaucuagccacuuuacugaaguuguuuaucugcuuuaguuuucugguggaguuuuuguggucacuuaaguauacaaucauaucaucugcaaauagugauauuuuuacuuccuuccuuuccaauuuguaucccuuuuaccuccuuuuguugucuaauugccuuagcuagaacuucaaauacuauguugaauagauagggagaguaugggcagccuugucuagucccugauuuuagugggauugcuucaaguuuuucuccauucaguuugauguuggcuacugguuugcuguacauuucuuuuacuauguuuugguaugggccuugaauuucugaucuuuccaagacuuuuaucaugaagggguguuggauuuugucaaaugcuuucucaacaucuaaugaaauuaucaaauuuuuuuuucuuugaguuuguucaugugguagauuauguuggugggcuuccacauauugaaccaucccugcaucccugggaugaagccuaccugauuguggugaaugauuuguuuugauguguuccuggauucgguuggcaagaauuuuauugaguguuuuuacaccaguguuuauaagugagauuugucugaaguucucuuucuuaguauggucuuuaugugguuuagguauaagcauaauugugcuucauagaauguauuggaugguguaccuucaguuucuauuuuguggaauaguucgaagagcauugguauuagguccucuuuacaggucugauagaacucuccacuaaacccaucugguucuuggcccuuuuuuugguugggauacuauuaaugacugcuucuauuucuuuagggguuaugggacuguuuggaugguucaucugauccuguuuuaacucugauacauuguaugugucuagaaaauuguccauuucauccaaauuuuccauuuuuugcauauaaacuuuucuaauaggaucugaugauuuuuugaauuuucacaguuucuguuguuguaucucccuuuucauuucugauuuuauuaauuuggauacugucucuuugcccucugguuagucuggccauggguuuaucuauccuguugauuuuuuuuuuuuuucagagaaccagcuccugguuuuauugauucuuuguauaguucuuuuuguuucuauuugguugaugguacaugguauuucuguggcuuguuuauuugugcauauaaugcaugugcagggcugaggguauauguguuccauguguuuaagucugagugccaccucaguacuguccucuucuuccacuuuguuugagacaguaaagucucucauguuuacaaauguguuugucaggguagucauucagaacuucuaugaguuuuccugucuccauguuucaucucaucauaggaacccugggauuacagauauacacaaguguaccaggcuucacaugaauucuagaaauucagauuuagguccuaugcuuuuauggcaaguccuuuacccacugagccauaucuccagcuucugcauuacuucuuuucucugcccuacauggcguaguguucucaucagcauaauucuguauacuucccgagacugcccugucuaccucggcccuucuaaggcaaaguuuugaggugucugcaucacuggcucuucuuaacuucuggaauugggagaagcuagaagcuucuaacacaagguccaagagagcuuugcauguguucuuugcagucuggaauaugucaggaugggugguuuauguggagugaaaaacugaggauuggcauaguagucuugugugacuucuagugcuauugucuuugacuggagggacuuguacuaggcaacacuagccucaccaugaucuucaccuuagcucuugaucaaggagccuucaguggcccccguuuccacuucugagguuuguuugaauuuuuauuaauucugauuucacucaccguauggagaguuccuuccucuuaugcccacuuuccucucuucgaaaucugucuuuugauuauuaguacagaugcuaaacugggaccccuuguuaccuggggauguagauggagacuggacuugauagguggacugcgcagugauggugaucuucauugcccucaacaucucuaaacuuaaaaaugcacagccagccuguaaauuuuuuuuaaaauuuuguuaauuagguauuuuccucauuuacauuuccaaugcuaucccaaaagucccccauacccuacccccccccaacccccuacccacccacucccccuuuuuggcccuggcauuccccuguacuggggcauauaaaguuugcaaguccaaugggccucucuuuccagugauggccgacuaggccauccuuugauacauaugcagcuagagucaagagcucugggguacugguuaguucauaauguuguuccaccuauaggguugcagaucccuuuagcuccuuggguacuuucucuagcuccuccauugggggcccugugauccauccaauagcugacugugagcauccacuuauguguuugcuaggcccuggcagcguagucucacuagagacagcuauaucaggguccuaucagcacaaucuugcuaguguaugcaauggugucagcguuuggaggcugauuauggaaggauuccuggauauggcagucucuagauaguccauccuuuugucucagcuccaaacuuugucucuguaacuccuuccauggguguuuuguucccaauucuaagaaggggcaaaguguccacacuuuggucuucauucuucuugaguuuccuguguuuugcaaauuguaacuuauaucuuggguauucuaaguuucugggcuaauauccacauuaaaccagagacacugaaacuuauagaggagaaaguggggaaaagccucgaagauaugggcacaggggaaaaauuccugaauagaacagcaagggcuugugcuguaauaucgagaauugacaaaugggaccucaugaaacugcaaagcuucugcaaggcaaaagacaccgucaauaagacaaaaaggccaccaacagauugggaaagaaucuuuaccuauccuaaauuagauaggggacuaauauccaauauauauaaagaacucaagaagguggacuccagaaaaucgaauaaccccauuaaaaauggggcucagagcuaaacaaagaauucucaccugaggaauaccgaauggcugagaagcaccugaaaaaaauguucagcauccuuaaucaucagggaaaugcaaaucaaaacaacccugagauuccaucucacaccagucagaauggcuaugaucaaaaauucaggugacagcagaugcuggcgaggauguggagaaagaggaacacuccuccacuguuggugggauugcaagcuuguacaaacacucuggaaaucagucuggugguuccucagaaaauuggacaugguacuaccagaggaucccgcaguaccucuucugggcauauauccagaagauguuccaacuuguaagaaagaaacaugcuccacuauguucauagcagccuuauuuauaauagccagaagcuggaaagaacccagaugccccucaacagaggaauggauacagaaaaugugguacauuuacacaauggaguaguacucagcuauuaaaaagaaugaauuuaugaaauuccuaggcaaaugguuggaccuggagggcauuauccugagugagguaacccaaucacaaaagaacucaaaugauauguacucacugauaaguggauauuuuuacuuuuuaagugggugacacucaugcuggcauugauaccaccugauaauaauagauucucuuucucccucuucuacaugggagggaacauuagucuuccaguuuucuuuccuccucccagcauagcauacucugccuggacagcaaaagaaguaacugagaaaucaacagcaccugcugaguuguugugcaagcaaagcuucugacaugacuguauugaauagaaagcagcauagugucuccaugagaacucaucuauuuuauagggcauuuccuuuucuuguuccuaauguguguccuuugguguucucagcucaggggauucauuaaugucuucaacaaucagacuugcagguucauaaaauuuccuuuccagugagggaaauggauaagaaaucaauucucucuaccugugagaaguaucauuaaaaauauuaagggccaaguccaguuggaugugauaggauaaauacuaccugagcccagaacucaggugcagcagaggcagacauaucucuuaguuugaugccagccuggucugcauagugaauaguaguccagccagugagacucuaacuaauaaaaauaaaacaaaacaaacaagugaacaaacaaaaauaaacaugcagaucagaggagagagcuugggugauuaagugcuaaggacaugaguuaaguuuucagaguccacauuuuuaaaaaguuagguauggugaaauaugcugauaauuccaguacuagggaggaagacacagccauaucuaucuggggcucaguggccagccaguuggaaugauauuccauauuccagguuaaugggagguccugucuuuaaaaaacaaaaagggcaacaucugucuaaagauagcuaagauuguuuucuagccuacaugcagauacacacaaauacaggcaaauauacauauacacauauacauacauacauacacauauacucauacauacagauacauauauacacacacagacaaauacacagauacacacacacaguggauaaguauaaaguggagauuuugcagggcagggaagacuuccuugaggaggcugucuuggaauagguauaucccugacucuggcaaagauagaaaggaucauaucccagauuguggacuguaggaauccuagggcaagauccucuucugccuugcaugggcacuaggcuuucccaggauauaccuauguagaacacucacagugaugaaccuuggucuaguuauaugcuaaauaaugauaaaaucauugaagauaaaauuuaaaacauauauuagguuaauauaugaauuguaacaaagaccucacagauuugaaauccugacuauuuuacaacaacugguaaccguauguuagccucagagcauuggcaagagaugcgucacuguguucugggacuuagauugcucaacugacagcaacauggauaaccuuuccuaccuuucucacauccaagaagcccagccuuucugcacuuaauuccagaugcuuagccuugauuuggugcaacugaauuauguacauaucuagccuugcuccguuuucuucucguuauccugugaugccgaaggucauggcagcauugcuaccaaaacaggcuguggcauugggcacuauguaaagaugguggagcagagaauuuuacaugcacauguggaaaugucacagugaaaucccauuguauaaguagcauacacuaauaaaaguguguuacaucugaaagaguuacuacuaaagugcaaauuucaaauuagcaagcacaacaaaccccauaagcauuuaccauaagcauuugagagguagccuugucaaagaaaugugugggugaucuguuuagccaaauuaugcucauauuuagugaaauauugacauuuguauuauuguacaauaucaauguuggaagugcuuauucuaaaaaauguuuaaguauucuugacacuauucuaaaggguuuauacaugcugucuggauuagucaucacccauaaccuguuagaagagguacugauaucauucccauuuaacagaagggaggugaggccuaaagcuuuuaucaagccugaaagcacaaggcugacaaacagcagauauaccauccagacucugguaaucuugccaugaaccucugacuucugagaacugaggguaugaauuaagauuucaacuucugcuuuaauggcuucccacacaaauaguuaaugacccaaucacuuuauuccuuaugaggaguuugggggaggggaaguuuugacaacuuguuuaauauuuagauguuuuccauagcucuuugacaguauuuguguguguuuaauuuuuuuauugaguuuuuguaaauuucauauguaccacaaucccacucaucccccagugccucuauaucugcccuugcacccccaagaaaacaaacaaacacaaacacaaacaaacaaacacaauaauagcagcagcaacaacaacaucucaccaaggaagcuacauguguuacugugugucucagaguauacccuuuugcccaaacagcuuuacuugcaaauguucauugcauugagucauuaguuuggcuacaggccucuagcuucugcaauacuaucaguauuggguccucacugggacuccucucgacauucuguugguugcuuuguguaauagaacucuugaagcuuugguucuggaggaccaguucaaaguugggguagauguuuggguggccaaacucaaaacccuggauuugggccugagugguagcugaguuggucagccugacugcucugccaggaaacucucuagcauucauaucagcugcaccagcucuccagcacugccccaggaagaggcaugucagcuuacuugaguacaauaggcagcaaaccucucccuaccucuccucauuccccuacauccccagccuauaccccugugcucuaaugcccuuggagcuggcuuucccacaccacuagggccuuuucuaccguggugcucaggcaagguguagggcagggccugcuuucaggagugauacagcuagggagaggcggggccaguuuacccacccucaugccuuagcgccagcucucccacacugacuaagcuaaggguggugccagcucugcagaacccuggcacaucaacauggccucagguggcagucuagaacagcuauuguuuacaugagccacagauaucaacacagaccccugcagggccauggacuuaaggaugacccuccagagcagcauggaacaaagauuuaccauggccucaaauggaucacaggcuacucacauuauccucaagauagauuuguaucuaaaacugucaaagaguggugaguggggcagagcaugguagagaugucccuuuccccccacacucaggcccuucauucuucaggcuauucauuacccccuugaguuucuccuccuucucuuccuccucuucuuccccuucugcugcagcugcugcuacugccucucuucacugugcacacaauauucugcuucacuuucacuuucaucucuccaccacuuagaugcuuaucuaguggaagcugggccucugagugucuuaggggaagggucucuagcacucucggcacccccaccacucugacaguuuuagauacaaauucaccuuaaggauguaugagaacaaaguauaccauuugaaauguaagugcuuuuucagcaauauaaauuaugaagcuggcaaauauaguucauuaaauugaguguaauuaaaacugugauauuuuuaaauuaacaagaaaaacaguggugaaauuaagaaaucuacaugugucuucauagcguccucuagcugauaacugagugggugguugcugacaguauugguaacauugauauucuggguuucaacugcaugauugucacacuucaucuaaaggaugcuuugauuuaauuucugcagaacaggcagaugacauuucuaaugaccagcauaucucuccuccccgcccccuccuuccagcauaugacaguggguauuuugagaagccaucugaacugaaguaauuauucaucuucugaguugugucucagggagauaaagucaggauuguuccugcuaaucccagggacgagcuauguucuuucacacucacaggaacacaucacucuuuccaaaagccugaagucuauaagugggaacccagaguacagagccaugguugagauuguuuaugacuucucuaaaaguuuucauuguguggagugguauauacuccagacuggguaggcugcuuauacccagucucugggagugaagauaagaacuuaucuguauagauuuuacaacagaggucuuccugagugucuguauaggcugcucagugguuaagaguauucauucaaguuugguuuccaguaccuuuguaaagcaucucacagcagucuguagcucuagcuucaggaaauacaauuuccucucuguccucugaagacaccucuacacacacacacacacaccccuacauauaauuaaaacuaacuuuacaauaucuagaaaguguuguauaugugcccuacaugcuuaaaggcccacgcaagauauuguugguuauauuauuauaagcccacuugcuuuuuuuuauuuuuaaucuagugauaacccugaaacuuaaucaucucacuuaucugcccacuuacucugaccucuuuccaucuuuagggauccugaacucacugggaaccccauauauuauauauguuaguuauuugagaauuuuauauguguugugaucauauucauuccucuucucaaacucuucccagaucuacccuaucuacucaacuuuuucaaaaauuuauuuauuuauuuauuuauuuauuuauuuuacacuccacaguuuauuucccucccagucuacccucugacuguucuacaucccauaacuuuucccucucccccacccucccacucacccaccagaccuguaaacuucugggaccuccagucucuuacguguuggguacaucuucucagauugaacccagacccagcaguccacugcuguauauguguugggggccuaguauaucagcugguguaugcugacugguuggugguccagugucugagagaucucagggguccagguuauuugggacugcuugucuuccuacagggucgcccuucucuugaucuuugacaaagccaaaaauauacaauggaauaaagaaagcaucuucaauaaauggugcugcucuaacuggcugucuguauguagaaaaaugaaaauagaccuauauuugucuacucagcuuuucaaaagaaaacugugaagaccaaucuguguuacccaaauauucuuggauguguggcuucccacuggaacauggcugaguuaccaggggccguaguuuucuuaguaaaacuggcuaccacucuccagccuaucagucaccucuggcuccgcagcuaggggugugaguuugugccuaacccucucaucuccaugcugggauuggccugucuuggacauacacaguucuugugcuuucuaucacaugugaacugccuugcugucuccagaagacacguuuccccugugucauccgcugccucugcucuccucucuuccacucuuucuggcccaucuuugcaaugauugcaagcuuuuggaggaggggaugcauuauuuguagggaacuccaguuuuguagccuugcugugugauuuuucuuaacgugaucccccgggauacugguuugcuggaacugacauaucaaggaccaaagauugaguaguguagauuauacuaucuuacuuaugcugcuggaagauugaagucugaagucucuguuuuuaaaaaccuauggugccuauuuagguuccaggaaagaauuauucuaggcaccucuuucucccuucugauaguuccuuggauuuugacuuccuaacucuagucuguuuuuccuccuguuccaaaucccuuccuuuugaaauuaauauuuuguauucuuugaaggucucauacauguauacaauguuuauugaccagagacauccuucacuaccuucccucaacuucuccaugugccucuauccauucuccaucccaacuucauauguucauuuugcugcugcuguuguuaauaacccuugaguccaucagaacugcuuauuugugcauguguuuggccagccauggagggauggaagggugcguauuucuuuuuaugagaauaucagauuuaauauauuagggccuucccuauuuaaagcugaccuccucuuaauuaaaauccaucuuaggaacccuauuuccacuauacugugaugggcuaggaguuagaauacagauguagaaauuuaggggugacauuguuggaugccuucagcuuguguccuacaaagaggguggaacauauaagaagggauaacgugaauauuucauuccuuuguaccuggcaauguauagccaaaagagguuaaucagcuaggcaguuguucagaucucagguagcuuguauuuucaugaggaugacaguuacagagaaacaucauucaugugaaguacugguuuauguacuggaaaaaaacaaauggguaauaauguauggggcacgugugagggauugguuccaagugguccauuuccagaagugggaggguaaaucugccauggaagacucaaaugacucaaacagaugugcacaaaauuucauauuaguuaaacaaugcagguuaugucuuagaagaaauacuaguuugagcaggggcauuuaaaaaaaaaauacccugggcguaucuggggagugaauacugauaccuaagaaaagggcagguuaauucuuuuagguaaggugcauagcaggacucuggaaggcucugccacagucaaacugaacauuguccagaagucccuucugauauagggaucgugggguuuuccauucauaaccauucuauuccugauauugaagcaccacccuugcuucugaaauccuagugguguuggcauuccguuucuucuaaguccucuuggaauaugaguuggcuggccuuguuucucagagcucacaucacuacuguauauauaugugguuuuaagccauguucuuggccuauggaaaaugauacuacccuuacuuaggggcucuguagcuguguuaguaucugugucuaaaaccuuucguucugaaugcugauuaugcaaaaaaauuuggaaaauucugcagaaggcugauuugggggucacaaucugaaucugcugaaucagaauucgugugauaaugggcugccauauauuuuauacaauacucuaaaaaugaugcugcugugcacucaugguuaagaaucccugcccugacacuuuggugugauucuccuuggguucaguucuuucauaagaauauguacaagggaggugagagggugcgccagagaaccugacagcuucuggaacaggcggaagcacagaggcgcugaggcagcacccugugugggccggggacagccggccaccuuccagaccagaggacaggugcccacccggcuggggaggcggccuaagccacagcagcagcggucgccaucuugguccgggacccgccaaacuuaggaaauuagucugaacaggugagagggugcgccagagaaccugacagcuucuggaacaggcagaagcacagaggcgcugaggcagcacccugugugggccggggacagccggccaccuuccggaccagaggacaggugcccgcccggcuggggaggcgaccuaagccacagcagcagcggucgccaucuuggucccgggacuccaaggaacuuaggaauuuagucugcuuaggugagagucuguaccaccugggaacugccaaagcaacacagugucugagaaagguccuguuuugggccuucuucuucggccaggaggagguccaaauacaagauaucugcgcaccuucccuguaagagagcuugccagcagagagugcucugagcacugaaacucagaggagagaaucugucucccaggucugcugauagacgguaacagaaucaccagaagaacaaucucuaaacagagucaacuauaacuacuaacuccagagauuaccagauggcgaaagguaaacggaggaaucuuacuaacaggaaccaagaccacucaccaucaccagaacccagcacacccacuucgcccaguccagggaaccccaacacaccugagaaccuagaccuagauuuaaaagcauaucucaugaugaugguagaggacaucaagaaggacuuuaauaaaucacuuaaagaaauacaggagaacacugcuaaagaguuacaaguccuuaaagaaaaacaggaaaacacaaucaaacagguagaaguccuuacagaaaaagaggaaaaaacauacaaacaggugauggaaaugaacaaaaccauacuagaccuaaaaagggaaguagacacaauaaagaaaacucaaagcgaggcaacacuagagauagaaacccuaggaaagaaaucuggaaccauagauuugagcaucagcaacagaauacaagagauggaagagagaaucucaggugcagaagauuccauagagaacaucggcacaacaaucaaagaaaauggaaaaugcaaaaagauccuaacucaaaauauccaggaaauccaggacacaauaagaagaccaaacguacggauaauaggaguggaugagaaugaagauuuucaacucaaagguccagcaaacaucuucaacaaaauuauugaagaaaacuucccaaaucuaaagaaugagaugcauaugaacauacaagaagccuacagaacuccaaauagacuggaccagaaaagaaauuccucccgacacauaauaaucagaacaucaaaugcacuaaauaaagauagaauacuaaaagcaguaagggaaaaaggucaaguaacauauaaaggcaagccuaucagaauuacaccagauuuuucaccagagacuaugaaagccagaagagccuggacagauguuauacagacacuaagagaacacaaacugcagcccaggcuacuauacccagccaaacucucaauuaucauagagggagaaaccaaaguauuccacgacaaaaccaaauucacgcauuaucucuccacgaauccagcccuucaaaggauaauaacagaaaaaaaccaauacaagaacgggaacaacgcccuagaaaaaacaagaagguaaucccucaacaaaccuaaaagaagacagccacaagaacagaaugccaccuuuaacaacuaaaauaacaggaagcaacaauuacuuuuccuuaauaucucuuaacaucaauggucucaacucgccaauaaaaagacauagacuaacaaacuggcuacacaaacaagacccaacauuuugcugcuuacaggaaacucaucucagagaaaaagauagacacuaccucagaaugaaaggcuggaaaacaauuuuccaagcaaaugguaugaagaaacaagcaggaguagccauccuaauaucugauaagauugacuuccaacccaaagucaucaaaaaagacaaggagggacacuucauucucaucaaagguaaaauccuccaagaggaacucucaauucugaauaucuaugcuccaaauacaagagcagccacauucacuaaagaaacuuuaguaaagcucaaagcacacauugcgccucacacaauaauagugggagacuucaacacaccacuuucaccaauggacagaucauggaaacagaaacuaaacagggacacacugaaacuaacagaagugaugaaacaaauggaucugacagauaucuacagaacauuuuacccuaaaacaaaaggauauaccuucuucucagcaccucaugguaccuucuccaaaauugaccacauaauaggucacaaaucaggccucaacagauucaaaaauauugaaauugucccauguauccuaucagaucaccaugcacuaaggcugaucuucaauaacaaaauaaauaacagaaagccaacauucacauggaaacugaacaacacucuucucaaugauacauuggucaaggaaggaauaaagaaagaaauuaaagacuuuuuagaguuuaaugaaaaugaagccacaacguacccaaaccuuugggacacaaugaaagcauuucuaagagggaaacucauagcuaugagugccuucaagaaaaaacgggagagagcacauacuagcagcuugacaacacaucuaaaagcucuagaaaaaaaggaagcaaauucacccaagaggaguagacggcaggaaauaaucaaacucaggggugaaaucaaccaaguggaaacaagaagaacuauucaaagaauuaaccaaacgaggaguugguucuuugagaaaaucaacaagauagauaaacccuuagcuagacucacuaaagggcacagggacaaaauccuaauuaacaaaaucagaaaugaaaagggagacauaacaacagauccugaagaaauccaaaacaccaucagauccuucuacaaaaggcuauacucaacaaaacuggaaaaccuggacgaaauggacaaauuucuggacagauaccagguaccaaaguugaaucaggaucaaguugaccuucuaaacagucccauauccccuaaagaaauagaagcaguuauuaauagucucccagccaaaaaaagcccaggaccagacggguuuagugcagaguucuaucagaccuucaaagaagaucuaacuccaguucugcacaaacuuuuucacaagauagaaguagaagguauucuacccaacucauuuuaugaagccacuauuacucugauaccuaaaccacagaaagauccaacaaagauagagaacuucagaccaauuucucuuaugaacaucgaugcaaaaauccuuaauaaaauucucgcuaaccgaauccaagaacacauuaaagcaaucauccauccugaccaaguagguuuuauuccagggaugcagggaugguuuaauauacgaaaauccaucaauguaauccauuauauaaacaaacucaaagacaaaaaccacaugaucaucucguuagaugcagaaaaagcauuugacaagauccaacacccauucaugauaaaaguucuggaaagaucaggaauucaaggccaauaccuaaacaugauaaaagcaaucuacagcaaaccaguagccaacaucaaaguaaauggagagaagcuggaagcaaucccacuaaaaucagggacuagacaaggcugcccacuuucucccuaccuuuucaacauaguacuugaaguauuagccagagcaauucgacaacaaaaggagaucaaggggauacaaauuggaaaagaggaagucaaaauaucacuuuuugcagaugauaugauaguauauauaagugacccuaaaaauuccaacagagaacuccuaaaccugauaaacagcuucggugaaguagcuggauauaaaauuaacucaaacaagucaauggccuuucucuacacaaagaauaaacaggcugagaaagaaauuagggaaacaacacccuucucaauagccacaaauaauauaaaauaucucggcgugacucuaacgaaggaagugaaagaucuguaugauaaaaacuucaagucccugaagaaagaaauuaaagaagaucucagaagauggaaagaucucccaugcucauggauuggcaggaccaacauuguaaaaauggcuaucuugccaaaagcaaucuacagauucaaugcaauccccauuaaaauuccaacucaauucuucaacgaauuagaaggagcaauuugcaaauucaucuggaauaacaaaaaaccgaggauagcaaaaacucuucucaaggauaaaagaaccucugguggaaucaccaugccugaccuaaagcuuuacuacagagcaauugugauaaaaacugcaugguacugguauagagacagacaaguggaccaauggaauagaauugaagacccagaaaugaacccacacaccuauggucacuugaucuucgacaagggagccaaaaccauccaguggaagaaagacagcauuuucaacaauuggugcuggcacaacugguuguuaucauguagaagaaugcgaaucgauccauacuuaucuccuuguacuaaggucaaaucuaaguggaucaaggaacuucacauaaaaccagagacacugaaacuuauagaggagaaaguggggaaaagccuugaagauaugggcacaggggaaaaauuccugaacagaacagcaauggcuugugcuguaagaucgagaauugacaaaugggaccuaaugaaacuccaaaguuucugcaaggcaaaagacacugucuauaagacaaaaagaccaccaacagacugggaaaggaucuuuaccuauccuaaaucagauaggggacuaauauccaacauauauaaagaacucaagaagguggaccucagaaaaucaaauaacccccuuaaaaaauggggcucagaacugaacaaagaauucucaccugagggauaccgaauggcagagaagcaccugaaaaaauguucaacauccuuaaucaucagggaaaugcaaaucaaaacaacccugagauuccaccucacaccagucagaauggcuaagaucaaaaauucaggugacagcagaugcuggcgaggauguggagaaagaggaacacuccuccauuguuggugggauugcaggcuuguacaaccacucuggaaaucagucuggcgguuccucagaaaauuggacauaguacuaccggaggauccagcaauaccucuccugggcauauauccagaagaagccccaacugguaagaaggacacaugcuccacuauguucauagcagccuuauuuauaauagccagaaacuggaaagaacccagaugccccucaacagaggaauggauacagaaaaugugguacaucuacacaauggaguacuacucagcuauuaaaaagaaugaauuuaugaaauuccuagccaaauggauggaccuggagagcaucauccugagugagguaacacaaucacaaaggaacucacacaauauguacucacugauaaguggauacuagcccaaaaccuaggauacccacgauauaagauacaauuuccuaaacacaugaaacucaagaaaaaugaagacugaaguguggacacuaugccccuccuuagaagugggaacaaaacacccauggaaggaguuacagaaacaaaguauggagcugagaugaaaggauggaccauguagagacugccauauccagggauccaccccauaaucagcuuccaaaugcugacaccauugcauacacuagcaagauuuuacugaaaggacccagauguaguugucucuugugagacuaugccggggccuagcaaacacagaaguggaugcucacagucagcuaauggauggaucacagggcucccaauggaggagcuagagaaaguacccaaggagcuaaagggaucuucaacccuauagguggaacaacauuaugaacuaaccaguaccccugagcucuugacucuagcugcauauguaucaaaagauggccuagucggccaucacuggaaagagaggcccauuggacacgcagacuuugugugccccgguacaggggaacgccagggccaaagggggggaguggguggguaggggaguggggguggguggguaagggggacuuuugguauagcauuggaaauguaaaugagcuaaauaccuaauaaaaaauggaaaaaaaaaaaaaaaaagaauauguacaaggaaagcaauugcauaagggaugucacuuguaccuccacaaggauaccuugaccauguagugguguggucauagauguaccucuuccccagggcaguuuggaaguauuuuguucaaauuugggagccuguccauugaugaccacacuguccuuagaucuuggcccauuaagacacucagggagcucugggucagccaggagcagaaacaggcaaguacuaaaaauaaaacugaagcucagauuguccuucuuaucucucacagaucacuggacagaggaagcagagauuuucuaugcuagcaucuccauuuguaacacaccucucauauacacauuagggacauguuuguuguguugacuuagguauuucaguguccagaugaacaccugcuaucuuaauuaauaaacuuuucagauccaagauuccuuguucuuuggcacacuaccucuaggagaaauacaaagcagcuuuccacagaugucaaaauaguaucuccucauaucaaguaagagugucuuacuguauguguguguauauauacauacauguguguguguguguguguguguguguguguguguauuuacauacugaauuucucaucuguaugauuauuuauaucaugcuccuuugaagucuuuccagguccuucugauucuugcugaauugcacaaaugcauccuucuuagguaccuuuuuggccaguguauucuguucaauuuggccuuuuacacuuuguaucugaccacacuuuccccuagguugcaagaugggacauguguuugccuuugcuuguacaaccugaguuguuugcucagagcacuagcuaguauucauaguacuacaauccuauuuguguuugcuaacaaaggacugccucauucauguucaugauuagauggacaguguaccuauaaccugugucuagcaguucuccaagguggcugaugaucuggcagccuucucaucucaggaauuuggagaggcaacgcagagcuaagcugaguucaguaaguggcacuugucuaacaggugucaucagaaaauaugaaucugucggugucugugaguaaagaguccaccaccugcagccuuggggagcugacaggaaagaaacuuagauuucugaggagaaaggagaagacagagaagauguuagagauaguccucccuuugacuaccagcuguuuugauuucccucacccuuggaucaguuugugacaauggucucuguucuuuuuuuuuuuuuuaauuauuuauuuuuauacuauguaucugaguacacuguggcugucuucagacacaccagaagagggcaucagaucagaugguucucagccaccaugugauuguuggaaauugaacucaggacuucuggaagagcagucaguacucuuaacugcuaagccaucucucuagccccucuguuuuuguauagauguagaccaagucauauuuugagcuuuucaacucauaggaugcuucacaaaguugcuuucacaaacugauuuuuucucugcccuucaacacaggugaauauggucaaaugcaccagaaugggaagauuuugcuuuuuguggguucugauucuguuucugacacagaugggucacccuguguaaaugcuuaaaaucuuaguguuguaguuccuuuuauuaaucagaaugagauugguuugacagaaaaggauuuacaacaacuaaaccuuugaaauuuuuaaaagcauucuucuaauguaaaagccaauuucuacacuauuguuuugacauauaugagaaaacaggugcggucauagaauucuauagagagggauuuuuggaacagaguucuaucauguauaugcucauaguuaaugaucuaacagagguugcauagcccacagaagucuagaguauuuaauauuuggucauuccuugaaaaguucugaauggguaaaauaucuuauuaaauauaauaacauguccauggucuauuauuacaaacuguauuuuauuguauauuacaaacuguauuuuauuguauagaucucuuucucagucuuuguuuuauaugcuaacuucacacauaaucuucugauacguguugugaauucucaguuguguuuuccuaucaucagagcuugcaugcuauuuauaaauuucugucauuguauguacaacauguaacaugugucagaugcaccacagucuuugaucugaagacguugauguccugacugacaucauuuaggagauuccccugccugugaugacacguacuccagcuuuucaguuaguuucuggaaucggaucccuuugggaauacugugaaacugggauauaaguauuuacaucagcuaucacaaugagcaguaaguggcaucagccacuuuuuaguauuuuguaaaaaaagcauccguugauaccaaaauaccacccuacaacuugugcucauaguauuugcaaugcagaagaacacagaguuaucuuauagaacagggcuuuaaauaagcauucguuaaacauaucucgaggcuugacgagagccaugguuuguuaaaguacagauugcugguucaggcuccacaucucccaaagcuaggagucuuagauaagaucacucuaauagauuccugggaguuuccucuguccuagcuuucuagcuaguugcagagaugccccaucccugccacugcccuccauccaguuuucucuuccaggaauaucuuccuccauccuucuuccaugucaucccuccuguuccuguacccaccccacccuuauccaguccccucuuuuugucaauccuggaugucuaaucuauuuccccuucucagugagauucaugcauccuccagccccagcucuccuuguuauuuagcuucuuugagucuguguuuuguagcaugguuguccuauacuuugcgauuaauaucuacuuauaacuggguacauaucauguuugucuuucugggucuggauuacuucacucaggaugaucuuuucuaguucuauccauuugccugcagauuccaugaugucauaguuuuaauggcugaguaauacuccauugcauaaauauacuacaguuucuuuuucuguuucuccauggagaaacaucuagguuguuuccaguuucuagcuauuacaaauaaaacugcuaugaacauaguugaauaucuccuguaagcaggcaagacuucaaauuagggauugggacaccaucccagccacaaaaccuuugacccacaauuuuuccugccuacagguaagggguaaaagauggaggaagaucugagggaaaggccaacuaaugacuugccaugcuugagacccaugccaugagagggagccaccccugacacuauugauacaugcagaugggagcccuaacauagcucaucagagagacuuuacccagcaacggauggaaacugauucagagacccacagccaaacaauaaguggagguuggggaauacugaggaaggagacagaagggugaggacaccacaagaaaaaccuacagaaccaacuaacauugguccacugggguucauagagagcaugaaugggacagacuuagcuaggccuucuguacacauggaagagucaugcagcugggucuuaggaauucugcaugugggacuccuaaaguggcagcugagcugacuguacugcaugcuuuuugauucuuuuccccuaacugggcugccuuguguagcccauguagaagauuugccuaguauuacugcaacuugaugugucaaggcccugugauauccaugggaggccuccccuuuucugagaagaagggaagggaggauagaugagaguggguaggugaggugagaggggagaacugagaggagaggagaggagaggaggggaagcugugauugggaaauaaaguagauaaauagcuauuuuucaaaaaauauaagauugcuagaaacagauuuuugugaaaaccucaaacucucacacuuaccagcaaaaaauggcuuggggccaguuauauagcucaucuggcucuuguuugcucuccuuacaaguggagggauuuucugcugcagaaaggcauggagaagauggagaucgugcuuucucagcaguuaguaagacuguccuaugcguaguuccagcauagggcgauggucuuaggaagcuauagcuuacuccauuguuguaacucacauuauaguauaauuuccuugaguuggagccuuuggcaagcucaguuccugccaggugagguagcccauugucuuaucuuguaacacguuaacccgauucuuauacacaggcuuauacguaggugucuuucaguuucccaacuacagcaacaacugugugcccuuaguguuuuucugcucaggacuucugucuuggaaauuccaugccuucuuuuuuuuuuuuuuuuuaaaucagguauuuuccucauuuacauuuccaaugcuaucccaaaagucccccauacccuccccccccccacuccccuacccacccacucccacuuuuuggcccugguguuccccuguacuggggcauauaaaguuugcauguccaaugggccucucuuuccagugacggccgacuaggccuacaccuuccuucauucuuguucugggaucaaaccucacuuucuuggcacgucuuuccugaaccacucuagaucugguucuauucuaauguucaguauuaaacaaaggaaaaaaaacauauucagagccccucugucaugccccuaagucuguuuguugcucgagagagaugagaacucaaaaacacacacucuugauucuuccuggagauuauaauaagcaaaggaaaauagaagcauugcaaacauguaaauagaauucaauuuuacugugauugaguuuaugagagcugacauauaaccauuggucaccacauaugccauguauucuauauauugaggccucgggggagucuucacugaagauaaggacuucguuaguguccuuuuccagaaggcugcauugaaauggauuugagauccugaaaauauggcccauacccuggagauaacacagacaaagggcagguaauggguauguggauaggacuguuugcugcaugugggcaugaagcaauggugcuguucacagccuccuggguaaacauuuuucuuugauaagcucaaacucaugaaugacuuucagcagauaggguacaaugaugagauuggucuuuuaaagagaauguacuaaguggagaagaauugagauaaugacagauaacaguacacuugggguuaguuauuaaaaaacaaaugcauacucuacuuaccuggaguuccuagaguaauuaggaucagaaagacagaaaguagaaugcugacuggcagaggucaggggaaggagauaacaguuuugcaaaaauccaaauagguugcuaauuaagcuugucaguugucuucucaugaagagguguugggaagcaaauggauucagagaauguugaccauguuacccugagaaagcuuuuuggugaaaacuugaggauaaaggguuugcauuuaauugaaacucucuugcuacagauuugaaagcuguaguuuuggaugggauagggacaagcacauuugggguggacugaggacuggcuuccugaccauuuuuggucccaagauauaagcugaaugcuuauuccccaucccccaugaauucauuauggcuaaauauccuuuauaguguuuuucuuaucaguuuccauugaaaucaaagcuagcuaugguauugguaacauuccaucauuauccaguuauuuucaagcuucagaaacuguuggguaaauugggagauguguuuguuuucuguugcuauuaacaaacaaacaaaaacugugauccuugguacuuuauaaaggaauaaagguuucuuuuuagucaguuuuguagguguggacaucaaguccguggccuugguaucugccuucuuucuugugaaugcuauauggagggccagcucaugacagaauagcaaaagagggaacuuuuuuguacagaagaguacaugugaguggauagggaaaaugaggguuagggagcuagaaaacacuacacucauuuuguuauacccuuaguaaccaguaauuuaguaacucaccaguaacuagucacuaguaaccaguaacucaguuccacaggacuuaccaguucccaugggaugagcauuacuuauucucuaauaaucucguuuaccccuauguucacuucuuaaagguucuacuacuuuucaaaaucaucacauagaggaaagcagccuuuuacuucaugaaccuuugggacaccacccaauucuaaaaaauagcaggugcaacugugagcauaccuuuagaucaagaacuucuguaugccacaagucucuucuugggcauuuuaauuuauuuuuauuucuuuguauauagaggucaaagagcaacuuaaaggagucaguucucuucuuaauaauauggguuccagcuauuaaauucaggcagucagcuuugguaauagguaccucuuccugaugagccaucucuccugcacaaaugcaacauuucaaaggaaaagaaagacuuguauauaaaacguaccuuagguuccuuuucaguaauuuuauuauuaaauaucagaaauguaaauaguguucuuagaaucuuuagugacacuuuagagcagugguucucaaccuguggauugugacucuuuuggcaguugaauaucagauauccugcauaguguuuauuuacauuacaauucauaacaguagcaaauuuacaguuaugaaguagcaucaaaauaaguuuaugguuggggucaccacaauaugaggaacuaugcuaaaggguuacagcauuaggaagguugagaaccauuacuuuagaaauaugguaacauacauuguuuuuguaggcugaacaauccaugacaguaggaaauagcacagcucagaccucacuaugcauuucccccacucagauacuaaagucaguuuaacaauuagagaauguaucugacuauauuggaucuagacuguaaauaacauagaguaaguaaaauagacccaaaaaccuaucacaaaugggaucagaacaggacuugcaacccuguaggaagaauaacaaugacaaccaaccagagcucccagggucuaaagcaccaaccaaggaguacacaaggaggaacccauggcuccagccauauauguagccgaggauggccuuguaggggcaucagugggagaagaggcccuugguccugugaaggcuggauaccccaguguaggggaaugggagggcggggaggcgggaauggguggguggguggguggcaguacacccucauagaagcaggaggagcgggaaugggaugggagguuuugggggugaacugggaaaggggauaacauuugaaauguaaauaaauaaaauauccaaauuuuuuuaaaaaugaaaaaaaagucuuuuacauuuaaacugugccuuaagaaacccaagcuaccuguguuuggcaguuucuuuguguguuauauaaaaagaaccguguggaauuucgggccuuuggcauauccugauagagaagucuucugccccauagcagaagauuggaaaauugaugcaugauuagauauuuccauguuauaaaguaaauuuaugacucauguacgaugacuccuaaagaguucuuuucuccauuuuuuagaaaaagauggcagauuaucaugggggucacaaacucaaucaaggacaaagagaaccaugguugauacuuuuauuuuuauuuguccugcuugucuauuucuuuagacuaucaugaguauaauuuuagguacccauucuuguucuuguggcuuucuuacuacucucugaacuuuuagaaccuucaacugacacuaauaauuugaaguucccaauuuuucaggucaaguuagaggauaguguccucuuuaucuuuuggguauguuggcaucuucugcugcaguauacuucucuagaggagagccaugcucuucaaagauguuccuccucauaaacuaagguaaaaguaacagaggugagccauuaggucugagggacaaggugcugcuggcauuuccagucaacuuauucuucagugcuaaagcaucuccauggacaaggcagagauuaaaagccucaggaaccaguggcagggauggaagcugucuugaggaauucagcccugucccaugauacacugagucagcccaggaguauaggggacugggugugugggguaugugugcaugaguaugcacccagccugguaaugaccacccucauagcuacucauuguaaaacacauccucuucaaaucucuagagagaggucucuuaugugaacucuggauuuugauaaaaaaguauauuuugggauguaggauuuauuuuuguugaauaucuggcuugauuagcauggagcaacacaugcagaacaggcuggauccccacccaacauccuccuccucgugcuguacaaucaggaagcacauucucucucccauuguggcuucugugggaagugugcuuuacauaugcaaauauaagccucuaguuucacuuaauaauuaucagcuggagauucuauugaugagcagcugaagcagcugaagccacucaucagggaggaaucugugaguuuaaccauuuguggguucccuuggagccugcugccucagauaagcuucugaauacucuggugauugcagaccuugagcucugauuuuccccauucacuucugccuggccugaaucuggcagcugagccuccaugaacccuuuaguauccugagcucauucugccccuguucagccuucucuuuucuguguuagaggcuggaugggcagagggaacccagcucuguuugcagcaccaacauugcuuauagcucuacaaguaauggccucuuccucuuccugaaguugcuuugcccaggcugccacagcuuccaauugaaaguucauggaaugcucaggauggccugguuaggauuucaaaacccaggcauccuuuuagcuucucuuuuccgucuucugccacugugcucaccaucuggggugucucauagucgacucucucugucacccucccuuguuguugcugaaccuggguggaguuagaaaaacucucauuuaaagcccuccauguuugucauuuuauaggaauuucuucacuuuucugauucuuagugaaacuauccuuccucagaucuccgucauauguuuagugagacauguucccaccuuguuacugggaagugcagccuuuauuucugauaaaagcuaucuagaggcagaaugugggaugaaauauagaaagacuuacucuuggcagguuaacuaagcucagcaggcuucuguuuccuucucaauauaugagcaauacgacuugcuacagaauugagacguuaaauuggguuauguguuagauuuaucugggcagaguggacagucaguaagagaacugcaaugccuauccucauguccacugauucuaguaaguggacaguuguaauaauuauuuccauucacauacauucuuuauuuuugauguugaagccuguugccuaguauaugguuguuucuaggucauggagauagcaugguggaugaaauaggaccucaguaaacccugauacuuuugaauuuauccuccgaagguccagagaagcaaaggagaaggggacagaaacauucuuauuggagagcaagcauagugaugcuuguaguggaagaugugccaggugggagagaaggacccagggcuucaguguggaugugaaugugggcauggagaaugcacucagggcuucuguaugggcaugggcauggucagugcuccaaaaguguguugccagaugcuucucugaagagugggguucaaauaaauucuuacugaaaagguuacagccagcagccccuagguaagcauugguagaaagcauccagaaagcccauacagcagacacaaaaugcacacaggacuacauugaggucagaaugauagcuggaaccagguaacugcuuaugagucacuguaaagcucuugggucuagcuuuauguuugauggaaaggaacuauggagaauaugauaugaccugaugacuaugguugaaugucaucugucugugcauggcagguaacugaaucaggguuagauggucauugggaacauuuagguaagagugauguggacagaaacaggugagagcagcagcuuagaguauguucaagguguaauuuaaagacagaaugacuauuuugaugcaguccuggaaugcuuuguaugggccaugaggagaggaauucaacgcaauguugcaacaggaauaaucauguuguugucaaccggaaaugcuuuucaacagcacaguuucugucccaacaggucauggugucaagcagguugcagauacagccaugacauauagaauaagacagccauuucuaggcaaauggcuguacaggauggcauuuuccacugcucucgucuguauaguauaaggcagugggucucuagggaccaugaaagaauguugggaaauuuaaggaucuuauguggaauguuuuagcugguguuggaaguucaauguuaauuuaccaagguaugaugcuacaaaugucauuuuacuuuuccauguccauucaauuucccuggaauguagcucauaccuugcaugucugggacuccuggaaaucuuuuggacgaugguauggugugcaagggacucaguccuaauucacaaauguccagaaaggcuagaacuccuccuacugaauguacccucugauccuggcacaggcuuuaaguuuugugggcaccugcucaugacagguuuuaaguuuaguagguauuauuagcaaaauauauuagacaaacauguauuuuucucuacauaauguaaagugccauucugauaaaaugacauuuuugucaaauacaacuccuaauucaaaaaagucucucguuccuuuccuuccuaguuuacccugauaaaaacccauucuucauuucugauuucccaaagagggcuaauuuggauuuguggaaaaaauaauagauacaagucccccucuugucuuuuuuuauucuugguuuuacuuuauaauugaacaauagcauuguuuuuaguggcauugcaauuuaaaacaauuggauaguacaaaaaacauucugccacauucacaaaaaggcuugcuccuguuucuguuugaaauguagcaaaguaccauguguggcagcuucccacugugucuugggguagcuuuguuaucaggcucuuucugauaaugugagccuucuuuuuagugacuuacuggauuuagaucccugaugaacacugaauggugaaggugaccugcaugcagcuuuacauuaguaggucaagcaaugaugauagaggcuuguugucaccugugucaaagccaguugauggagagaagauaagaacuaucagaggaccuugagaagauuguucaagucaucccucaccaguccugaaagucugcugaugggauguaggauuauccauguaaucauucauuuacaggaaguaaacagaaacaggugagcacagcaaacucuuacagcucaagcuugauuacuugagguuaggucccucuugugaucccagcucucuggagguuggaacagaggaucugguaacaauauggauagcuauauuauuaggucaguacugagcucuggguucaacaagagaugcugccucaauauuuacgauggggagucauugaggcaacucaaugucuucacacacauacacacaugugcuccugcacuuucauaccauauauauaugcacacucaaaggagaaaggcaaagaacuuuuucuugugcauaauauccauugaucagcuuuuccccaugcccaguuucuuagcucugaaggucuggauauuguuggacugugccguauauuagaagaaggggggggugguaucagagcuugguugguuuuguuccuugccauucagucuccaucucucugugaucugaauuggauguuauugcccauugcccucccuuuuuaaaaaauugcucuaaucauuuuuuaauacugaauauagucaccaaugcuaauauuuugaaguuucugugaaacuggcuggguaaagcauacauucucaugcccugcauauaauaaauggaaagaaaauuuuaaaaccuuguucaagaauuaucccauguggccaacuggauuucuuuuagauuuaaucuacaaagaaauacauguguacacacacacucacacaaaaccucacuagaacuuuuuacuguagacuacaaugguucucaaacaugugauuugccacuuuuacaaacaauauuagauuauuuaaggacugaguguuuuauagaaaauaauacaguuauuacaaagauuuuaguuuaacauuagacuaaugguaaaauacuuaugaacucuuucaucuugaguguuuuuuuuuuuuccugcauagagggcagcagcaggugguauguguguggggaaggggagaaacuuuagaauaucucuguaucucuuucauggucaagagucauagugcugauuaugggagcuucagagcucaguuugcagagauagcauagcaguuaggauugugucuguuacacuuguacagaacaggacccaauaaacugggcuacuuccuuaccuccagucaguuuggccuugaagcuauaauaaaauggauugauauuaaugguuaaauagagcagagagggaccaaaaugagugcaauaugaauugacugugguuuuacuaguuauaucucagaauuugaggugaauauguaguugugguuucuggaauaccuucucuuuccccaccaaugccuuuggaucacacggaagucaugacucugacuuaauugccaaguugauaauugaugguagacagugggccauugucuuuugccuuguuugguggcaacucgaauguuucucacacaacucuuugucugaucucaaguuucuuggcuaacaaagagaauuaauugcaggaguguuugugacuugcgcugguacacauacuucaguguacacuuuguacuacaguacaaagacugguuauaugguagcauacucaguucucacacaaggguguuuggggaucaagcaucuuuuucuaagugaaacuuuuaagaucagccugaacuucuuaaacuuguccgaaaugacauuguuuucaacauuuuaucuguuuugcauuuagaaguaacaaugaaggagaaugugagauuucuguauuucaaagagggcauugugcuuuuuccuuucuuuucuuuuuaauggcuguaacucagagucccugugaucaucccagggggacgagaacagcauggcaacuggaccugcuuuguagaaaacacuaguccagacuagaagauuaggggagccaaacaccucauaagcuuagaggaauuaggauacuguugucuuaacuacuuuucuguuguugugauaaaacaacauggccaaaacaacuuauauaagaaagaguuuauuuaggcuuacagguccaaugucuagagccuugaggaucuagggaagucuugguagcagaugcaagaaagaagcugggacucuuaucuuaaaucucaagcagagaaccagaacugagaauggcauggcuuugaaaacucaaagacugcucucagggacaugcuucuuccagcaaggccacacugcucaaagagugucauguccugggaacagguauucaagcaucugagccucuagagaacauucuuaccaaucaccacaaccaggaaauaagggcauuacuguucauaugacaggagaugaggcaagcggacaggacccggguaagagcuccacugcucugaaggaaacagugugaaaaccuccuuuacaccugagccagaagcucugacauacuguaugggccaguguuucuccacuuugguuaccugugagaaucuagagaaugauuguuuucugcgcugagaacuagaggccucccacuccauagcucauucaucuggguuaggcaugugcacacaccacuaauguauugugcuuacuggaaguggagguacaguuauauguugugauauauguauguguagaauauguauauaugugugucaaugaggaggacauuagcuauccugcuuuauaauucucaaccuuauuuccuucagacagagcaucccuucagugaacccugaacucaccauuuuucagcuaggcuggauggccagcaagccccaguguuccucuugccuuuguuugucccgaacccccauccacagugcuggaauuacaggcauuucuggucauaaguggcuuuuauguggguguugaggagccucugauugcacagcauucauuuuugaccuugaggugaugaacuuacuucuguacauaucaaacugccaaugugauggaaaugaggaugaaaagcauuaauucacaacaucugugugugggaagcuauguaaauaaggggauucuagagauggguuuaaccaaggagaucaauaugaugcuuuaggacaaagucccacagaccuuggacacaaaagaucugcaaaucugguuccuucuuacuuuuuguaaauaaaauucuucuaggauauaagcacaucuauuugauaucucgccucauaaauguuaggauguagugucuucguuguucauagaaauauacaggaggauagcucucuucaugucuggcucugacugcaggauuuuccuauguucaaggucugacuagaagggccagaggcacauccaaaucuggcccagucuagaaaugaguccugcagcaaguacguaacugaucccauagcauauggcaugccagccuuccacagagauugcgggauaaucaacacauauaaaucgguugagauuaucucuuaggauguuguggacaguguccuaauaccugucccuaauacuugucauuacaccacacagagauugcuuuucaauuuucuuucuuuguucugaauuuuagaugcuuugcuucuuaauucaaagcauucaucccgaguggauucagggauucaaaaaugaugauacauuucugcuuguuuagaacuucugggagaagcagaaagagguugucaacugagguuuugaauaauguauuguuuggcauuuuuaacucaaagugggcugaacuacaucaacacaugugcacauaugggcccuauggggggugucaggggaagaagagggggaagagagcccaagucccuccagaguuccuccuaugcucuggacaggcagacauugaagggcugccagacguuuuccacuucaccccgggugggcaucuaagccacugaccccacucaaggggugggguagacaagggcaacccccgauaccagggucuccagggugacacccucagccccagggauaugggagagagggcugagggagagagguuccuacgaagacaagaguccuaagucuuguccgaggcugcagcacaggagauuagaaaugguucauuaggagaaagccuaucccaucguccaagcucagcgauccuugaugaacagaacagucuaugguuuuagagcuuuauuauagaaaggcagggggaaagagagaagguaaaaggaagagagaccauagccaaaaguagaaaagggggaaaaggagagguaagaaaggcuagauuaagauguuagagagagagagagagagagagagagagagaggagaggagaguaaaagagugaggagaaugaagagacagagagauggggccaagcagccccuuuuaugguaggcuguuaucuuguuguugcuagguaacugggaggagucuagccugaaggucagaagcuugggacauuguauaagugacuacuagccacacgcuucuccugggagcgguaacuucgacaggagccuugaguccaggagacaugagggaacaccuaccgucccauguaggugaauuaucaccaccaggacccaggguuccguaccucagcucgacuguugaccagacugucugugaauagcccauugcccuacaugcaaacugucauagaaggauucacuguguauauaaauagauuguagauugaaacaacaaagugucgggggaagagcaacagcaaacacuaguacagggcuaagguuaggaauaaggcuggaaaaacaggaaagaaagacguuucauaaucucaguugcaucucauugcugaguaauguguacauauagccacagcuuugucucagcaauuauauauggagacacugagucacccaaaaaaaugcuacuuuuauuaagucuguuaguuacuaaauaggaggccauaguuaaagcuuauuuauucuuaaugcuaugcgcuccacuuccuuugcuuuccugguaacugcuauuguaucucccuuuuucuuuaaccugaacuauuaucauuuuauuuaaauaacaaguaguuugacauacauuagguuuguauuuuucuauagcauuuuaaauauuaucucuagaggucauaaacauuucccauggacccuucuucacaucccuaucaaguacaucccucccuccuccuccucuuccucuuccuccuccuccucuucuccucucucucucucucucucucucucucucucucuuucucucucucauuuugcuuuaacacggucucacuauguuucucuggcuguucuagaacucaauacucaauauauaaaccaagcugucuucaaauucucagaggucugucuaucggcugacauuagagguuugugcccccacacccagcuucuuuccguuucaaagaaguaaguaguugaaaaguacaggggcuuguacaaggugauguggccucaaaacagauuagauaaacacucauugcccacuauugucacaucuuccauuccaggcucugggcucaauauuauuauuucccauuuaggugucauuucuucucauaaagcguugacuuuuuuuccccugugucuuacagauaacaaauugaguuuaguuagaaccaaaugggggcccaguaauggccagaaauggauucaacaagaaugccauuuuucauaaguacauaauuaaagcuuguaaauuuuauaaacagguuugugggucuaugaggaaaggggaaagaagaugggaaugggcccuggugcccuguguuuuccuguguuugcacuuugacauagcaaaggacaugggcaaggaagugggagaugcccugugucaaaguuaugucagcggaagccaaggcauguggccaccugcuugcacacuacaguccuaugcucagaacaucugccauuuuaguaccaccuuaaauucuaucugcagcuccuagcucuuuguguuuggauuucuuauucaagccuucagccuuauugcuauguuaccauucuugucccuauuucacagaauagauucaaagcucagagcauuaaagcaaacagcuaucccccuuugcuacauuuccacaguuccucagaaucuugugucuucagagcuuccugacuuuugugcuuauguuccuaauuucuuucaugugagaacuggcccucccccucucuggcccaaagacuuugagcucagucccuuauguggggucauggccagguauggaaucaaggauagcuuauuuucugccgauucacucugugaacuuucauacugccuuucucccugucucuaugggaauagugauggaaaauuauggcacuauguguagcaagaaccccuguuaguuaccacauaccuugggagucugccuucucuuacuaacuagauguucaucuuucuuuacccuacuauaggcuccauguucacuaaguauuuuagcuacuugccugguuuaguuuguuuuguuuuguuuuguuuuguuuuucauuuuguuguuguaucccaaagcuuuaaacccucuguguaucugaggaugacccucaauuuuugauccccuaagugcugggguuauggguacucaacaaggcuaggugcaucaaaggaggcuauggacccacacuugucagauaagcccuaguccugagcuguuuaauucacucaauggaaggaaauauggaggcugacuucaaaagcugugguggaagcuuguaauuaaucagcccaguuacaaugcacuucugauucaccugugauuucaugucaucuggagauuuuuuuucuuaaucuuuuauuuguaguucagaguaguagaauucagcaagcccuguuuguugcauugcuagagcaguagaguaugcaguuaacccuaaaaugauuuggggcuaaauaaaguaguagauaucuguaaaggacaucaaauacgcugggcugaggcaaugcagcaugggcagcaugggcagcaugggcaguacaggugaacauggcaugugauucauggccagcuuugauuaucaagcuuuaugagccuuccugggacagcuuggaaucucagacuugucuagaauccaaggggguggagguggcaggaucuggguuguagaaaaacagaaguucauuuuagcagacuagggaguuggucauucuccagucaugagaguuauaggguggaagccucuagauaucuacccacugccuugaaccuggggugucagcagagugagaacaggaauagaagagacaacuucaggugugucucaugucucuagaacuacaaauaaucagcauucauuaggcacugaguuuauacaaugagauaugcuaauugucuuuggguagugguauuuuucagauuauaaaaauuaaaaaaggaaaagaaaaccaaaugaucagccuugaaacauagaagaaacauuauacaggcagaggagggcuuccauugggagguuaugcuuucaaaacaggguuuacaaggugguuuaggaauucaccuaagaagaaugccacuguauuauccucuuuugcuuuugagaucuucuauauucucaagcuccccaacacaaaggaaccuuccauucccccuuauccauacauguuuugugauuuuuuuuuuguuaaaaauguucacuugcaaaugugucauauggagaggaguacauugcauuuaaugaggaacaguauuaggaguguccuucucuacacaguauuuugauuuuuuuaucacugccauaagccauucuguucucacuuuuuuucccauuucaguguggaugcugugacuugucauucacacuccaucugcuuuccugcuaagcuguaggauugugguaagaauaugggaagguaaugcugggauuccuggagguaaauuuuccacgauaacacuuccuuggucucuccuccucuagaugggaaaccugugucucugucuccccuggagucccaagcccacaguccccgguacacagccuccagccaacgggagcgggagagccuggaagugcguguucgagaaguugaggaggaaaaccgugcucugcgcaggcagcucagccuggcccagggucagagcccugcucaccaccgugggaaccacuccaagaccuacuccauggaggaggggacaggggacagugagaaucugcgagcuggcauuguggcagguaacagcucugagugugggcagcagccagcuguggaaaagugugagguaaggaauaccagaguuggaagaagugacuauucuuuuccuuuauuauuauuaaucauuccauuuauuuacaucucaaaugauauccuacuucccaguuaucccucugucaccccuccucccauaucuucccucuccccucccuuuugccuguaugagagugcucccaacccauccacacucuccuaccccacggcuccagcaucucccuacucugcagcauccuuccuucuacacuccauguggucuguagguuguaucauaggcauuguaagcuuuuggguuagcauccacuuauuagugaguacauaccauguguggauuuuugugugugugugucuagauuuccucacucaggaugauaguuucuaguuccauccauuugccugccaauuuuaugaagucauuguuuuuaaucucuggguaguacuccauuauguuuauguaccacacuuucuguauccauucuucuguugaaggacaucuggguuguuuccagcuucuggcuauuauaaguaaggaugcuaugaacauaguagagcauguauccuugcuauauguuggagcaccuuuugaguauaugcccaggagugguauagcugagucuucagguagaacuauuuccaauuuucucaggaaccaugggacugauuuccaaagggguuucugggggaaucaccaucccugaccucaagcaauagugauaaaaacugcaugauauugguacagaaacaggcaaguagaucaauggaauagaauugaagacucaaaaaugaacccacauaccuaugaucacuugaucuuugacaguauaucuuaaaccauucagcagaaaaaaagacagcauuaacaaauggugcugguucaauuggcagucugcauguagaagaauacaaguugauccagaucuguccccuuguacaaaguccaaguacaaaugguucaaggacuugcacauaaaaccagauacacugaaucuaauagaagagaaaguauagaagagccucagauacuugggcacaggggaaaacuucuaaagagaacaggaauggcuuauguuuugagagcaacaguagacaaauggaaccucauaaaauugaaaagcuucuguacagcaagggacaacugucaauaggacaaaacggcaacccauagauugggaaaacauauuuaccaacccuaugucccauagagggcuaauauccaaaauauacaaagaacucaagaaggcacacuugagauuguaguuaaucaacugauauuugaugacugaaagcaauagcaaucauguggggaauuuggucaugguaugaacucacgugcaugcauguguggagaucagaggaagacuaugggugucguucuuuauuacgcuguaccuuauuuuuugagacaaggccugucauuggaacuuaaaguccuccauuugaucuaggauaauagguuagcaaguuccuggcaucuguguaucuccaccuucucccagugcugagauuaaagguauguguggccaugccuacacaugguguuuacauuugaauuuuaguucucuuacccacugaaccauccauucagcccaacaguagucauuucaguugucacagugucuggaguucaaaaagaaauuuacugaauaguucuguuuuggguaccuguggaaaaaugauauuugucugugacugaaugagaaaaaauggcccaaggccuccuuucuuguuaugugucugcaugggcugcauugggcuucacaacaaggcuaauuucagcacuaagcugcucacauggcagcuaaugcuuguaggucucaguuucccaguauguaaggcacauaggcccagccaguucuacugaggacagaguaugucaauugaaauagucacaaagauccaucuacucacaauggagaagugauacaaccucaucuuccaguaaguggaaugccaauuuaaaacagccacaguagguauuagaaaccuggaaaaaucaauggaugguaccgucugaugaaaguccacaucuucaugaugcaucucuauuauucugguccuugccuugagcuuccuuucucagguagucacaugacuucaauaugaguuaucauuuccagucucauaaggaauagcugaugccaugcuaaaccuuuuacaaaccaacuuuucucaugcaguauauuuucuucuuuuuaaaaaacaauaaccuauggcgagucaaagccacaugguuauuuuaaaguggugcaacuauaaagguugagccugaguaagaagcugcaugguuggcuuuaagaaccuuggccaugaacuacugugcauaauuauauaugacucaggacauccagauuccauacucuuagcacuggacacccaguccauauuguauauuugauagguaucucagcuccaaagggugaagaguaauccacuaugauauauagucacauuuaacuguggacauuguagcaugaaaguuugaugaggcagccagauggucauugcuugguauugugagaaaagugaaaacagugccacuuaaucaugccuacacuuguacauuuugcaagcucuguguaccaggaacuacacuuuguguacauaggccaguucggccuacccucauuuuauaaaugaagaagucaaggcuuagcaaggccacucagcacaaaaaaagugcugaucuagauuagauuaauacauacguagaugcaugcaugcaugcauacaugcauacacacauauauuauuuaacuauauaugcauaauauauauguuuuguuuuuguuguuguuguuguuguuguuguuucaagacaggguuucucuauauagcccuggcuguccuggaacucauuuuguagaucaggcuggccucgaacucagaaauccgccugccucugccucccaagugcugggauuaaaggcgugugccaccaccgcccagauagauagauagauagauagauagauagauagauagauagauagauagaacaaaguacucauagcaugguagcuuuuuaaccaucauaaaguaaacaauucacagguauuauuaguauuaucauucuguuauucuaguuccucaaccaucuagaacuuccucauuuuccauaagugaccuguucaccuuaaagaguuccucaguucucccugcuaccaacuccacaucacaaauauuuuaguucuguccaugaauuguugacuucagauacauuuguaugcauuugucuuccugugacaugauucuucaucauguuaugaagucauaaaugucuauauguagcacauaguagucuuguuuuccuuuucaagauuaauagucugucacauuucacguauuuauccauguaucuuugauugaacauuuuguugauucuguuucuuaguauguggauaaugaugccaugaccauaggucacaugaugaauauauaucuuuucuuuacagcuucccauuuuugagggcacauacgaaaggaugacagauguuucauguagcaauucuauuuuacuuuuucuuuuuuguuuuacauuggauauuuucuuuacuuacauuucaaauguuauccccuuuccccauuucccucccucccaaaaacacccuaucacauccucccucccccugcuucuaugaggguguuccuauacccaccuaccacuuccaccuucccacccuugauuccccuucacuggggcaucuaucgagcuucauaggaccaaagaccucuccuuccauugauugacaaguccauucucugcuacauaugcagcuggaaccauguguacuccuuuguugauggcuuaguccauggggauucuggggggucugguugguugauauuguugcucuuccuauagaguugcaaaaccccucaauuccuucaauccuuucucuaacuccucuuuuagagaccccaggcucaauccaaugguugacugcuaacaucugccucuguauaugucaugcucuggcagaggcacucaggagacagccauaucaggcuccugucaucauguacuucuugggauccacaauagugucuggguuuguuaacuguauauaggaugaauccccaggugggacagucucuggauggccuuuccuuuagucucggcucuacacuuuaucuccauauuugcuccugugaguauuuuguucuccuucuaagaaggaccuaaguacccacacuuuggucuuccuucuuauugagcuucauguggucugugaauuguauccugguuauuuggagcuuuggggcuaugauccacuuaucagugaaugcauaccauguguuuucuuuugagauugguuuaccuuacucaggauauuuucuaguucuauccauuugccuaaaaauuucaugaauucaucauuuuuaauagcugaguagcacuacauaguguaaauguaccaaauuuucuguauccauuccucuauugaaggacaucuggguucuuuccagcuucugccuauuauaaauaaggcugcuaugaacaugguggagcauguguccuuauuacauuuuggagcaucuucuggguauguacccaggagugguauggguggguccucagguaacuauguccaauuuucugaggaacugccaaacugauuuccagcuggguuguaccagcuugcauucucaccaaaaauagaggaguguuucucuuacuccacauccuugacaacaucugcugucaccugauuauuugauuuuagccauucugacuggugugagauggaaucucaggguuguuuugauuugcauuucuuuaaugaaccuugaugcaaaaauacucaguaaaauucuugccaacccaauucaagaacacaccaaaacggucauucaccauucucaaguacccuucaucucagggaugcaugaauguuucaauauacagaaauccaucaacauaauccacuacauaaacaaacucaaaggaaaaaaaaaaaaccacaugauccauucauuagaugcugaaaaagcauuugacaaaauucagcuucccuuccuguuaaaaauccuagaaagaucagaaaugcaaggcccauccuuaaacauaggaaaagcaauauacaguaaaccaguagccaacaucacacugaauggagagaaacuugaaacagucccacuaaaaucauggacuagacaaggcugcccacucucucccuaucuuacuugaaguucuagguagagcaauuagacaacaaaaggagagauacaaauuggaaaggacgaagucaaaauaucaccauuugcagaugauguaauaguauacuuaagugucccccaaaacuucaccagagaacucuuaaagcugauaaacaccuucagcaaaguggcuggauauaaaauuaacucaaacaaaucaguaaguagccuuccucuacucaaaggauaaacaggcuaagaaagcaauuagggaaaugacaacuuucacaauagccacuaauaauauuacgguggugugucucuuaccaagugaaagaucuguaugacaugaacuucaagucucugaagaaagaaauuaaagaucucagaaaauuuaaggaucucccacguccauggguuggcaggacuaauauauuaaaauugucaugaugccaaaagcaaucuacaguuucaaugcaauccccauuaaaauuccaacucaauucuucaccuaguuagaaagagcaauuugcaaauuaauuuggaauaacaaaaauccaaggauagugaaaacuauucuuaacaauaaaagaacuucugaggucacugucccugaccucaagguguauuacagagcaauagugauuaaaaaaaaaaaaccaaaacaacaaaaaauugcaugguauugcuacagagacaggcaggaagaucaauggaauagaauugaagacccagaaaugaacccacacaccuauggucacuugaucuuugacaagggagcuaaaaccauccaguggaaaagauggcauuuucaacaaauggugcuggcugaacuggcaguuaacauauagaagaaugcgaauugauccagucuuaucugcuuguacaaagcucaaguccaagaggaucaaggaacuccacauaaaaccagaaacacugaaacuuauagaggagaaaguggggaagaacuuugaacauaggggcacaggggggaaauaccugaacagaacaccauuggcuugugcuguaagaucaagaaucaacagaugguuccucauaaaauugcaaagcuuuuguaaggcaaaggacacugucaguaagacaaaaaggcuaucaacagauuggaaaaacaucuuuacaaauccuacaucugauauaaggcuaauauccaauauauacaaagaacucaagaaguuaagaauccagagaaccaaauaacccuauuuuaaaaaugggcuacagauguaaacaaagaauuuuccacugaggaauaucuaaugucugagaagccccuaaagaaaugcucauucuauuuuacuuuuucaauggucugcucuagaguuuuuccacagcagcucuaccacuuuacauccucaccagcagugagcauaugugcucuagcuucuccauauucccacuacacguagcaaaccuuacugcuagggggagccugcauccucugaacuuauugcacugaacauugaaaggauguuucuucugguuucuucuccagggaaaagccagguucucuccuaacucuucugagguuuaaagggucuaagcugcaucugcucauuuuccucagucuuccuccaguguaccucucuucuaggaagccugucuuguccuuccaggcaucaugccccuguaguucagguuccguccuuucugccuucagugcuuuuuccugagucaaaaaaaaaaaaaaggguugaucucugcaguuaauuuuuuagauucaguuuugcuggcuacuuugcuuuuaaaauguugaacucuccauaugcuuauuuuuugccuuucuaaauuaauuuuuuuaauauuaucagcuucucauucuauuauuuagugugccuaguccuuccucagacucuauaugcacaucucauaaucugcagaugaacaagucucauagaaaaugccaugguugcuuauagucuauagacaauguagucuaugcuuuaauaccaucugaagauaguaugcaaugccaccauaagcuaaguuuuauggaaauauuugugacauugugauauucugaaaauaauaacaagaaaaauggacuuguuuaguccaggugcacuuuuuuauuuaggcuauacccuaucugcugcucuauguagauuuugcagguguggcauaugaaugcauagcauuuuugcuaggugauuuucuguauuuucccugcacuagaauauaagcuaauggugucaggauagauaguuggucucuuuguucuuuuauuacugccuuagcaccuacaaaagagucuggcagguugaaagccaacagucauuaucugucacauuuccugguuaacauguauagacuucuucugggucaguacacucauauaaauaccuuggaguacagaacaaccagcaugaaucaguguugggcagagaguccacaugucccagacauucauaggcugaauguauugcucaucuaaguauugcucagacaacuuugaucuccugugaaguucagccuuauuuuuaauguuuuccaugcaguauggcugcuuucagaacgugagaacaucaguuuugaagcagccaguaauaugggcugggcacgaaggaaaugagaaagcuggagcuguuuacauuccuucccuccucguguuuuacugggccucacaaguaugaguguuggaggucauguggagauacuccugcaagaugaaucauuucuggucuucuaccaggcucuugggcggggggcgggggggggggcccucuaacucuauuucacuucaucaagccucuaaagaauuggccaccugaagugggaggcaugucuuccuauauuuuagauucaaaacaauuuugugugugauaucaggguuuaauauuuagaccaaguaauccaccuaugaugaaagacucccagaggagaaagguggccaaaaguucaugugauuuuuuguuuguuugguuugguuuuuuuuuccaguaacaucaguagcaauuguuuuucauuuuguuacccauacagguauuuuuugaggcagguucuaucuuaaggcauggcuuuuguuccaccccucucuaaggcauuggcuggcugaacccugguaccuugguucacugacuuacuuaccucccuaguauguuacuuaaaaaaaaaaaauuuaaauuaaauuuggaaaacagcaaguuagggaaaaucuguguauaagaauuugaacccucaagccaggcggugguggcguaugccuuuaaucccaguacuugggaggcugaggcaggcagauuucugaguucggggucagcaugguccacaaagugaguuccaggacaaccagggcuauagagagaaacacugucucgaaaaagccgaaaagaaaaaaaaaaaaaaagaauuugaacccucauuuuguagaggcaguugcuaagauaugagguuccaugugaugugcccaaucauucacuuuuaccugccuucacuuaugagaaauuaaagaauugaggaaguggagaaaaauguccccauuuuucucuuuucauagacaaagcccagagcagcuucuucuuuauguuuuuggagauggacaugcugugccacaaaugccugguagaccugagggggucccaggugauauauguugcaggagacauauagcuuccgucuggccauaacaguccuucuucuuuuccuuucugacaucucccugcauacauuuccccuccauacaguagcuacccugggaugcgaugcagacacuguguuuacugccaucagagccccaauggccaaccugaucuaauuuucuuuuccuuuuauauguacagaauccaucauaguccuggcauaucaggaaaggccaaaccuuuccaagucugaauccaucuuagagguucuagaauaaaguucaccuuuucauacuugcgcugucaggaauucauuuucauucacagcucugacauuccuaccuguagguacagguuguagagauugaauguauguuaggcaguguauucuggaugagagauggagguagaagccuugaaguuuuccuuguuuuucuagugucuggccuuuggagauuagcuaauaugcauaugaaccaaauaguaugucauaugcuccaguuuuggucacuaaugcaguggaaggaccaccuaugagguaaggugcugguaggucauagguaaagggggacaagggcugaaagagaaccaaagcaagaagcagaguaagauuacguacagagcaggugacagccucagugagugggaacuguagugccaacacaugaaggaagggaagaaagaggcaccacccagagccaaagugggaaguauucauccugacagaggcugacagaagcugacaucucagaucccacuggugccuccuguugccuacucuaaccagaaguggagugaaaggaaccugguuuauuugaucuagaaguucugguccugaaaggcacagaacaagugaauauguucagaagggcaaacaggaacacuaucugcccuccagucauacuuggugcuaaagaaaagucuuaauacagcagucacuacugggauacagaggaagguuuauaaaaaagggucuguggccacaggaccugauauucagaccaguguuuuuuuguuuuuguuuuuuuuucuuucuuuuuuucaauuuuuauuagauauuuuuuuucauuuacauuuauaaugcuaucccgaaaguccccuauacagaaaagcaagaaggaagaccaacauguggauacuucauuccaccucagaauagggaacaaaauacccaugaaaggaguuacauagacaaaguuuggagcuaagaggaaaggauggaccauccagagacugccccacccagggauccauccccuagucaagccaaucuuuaguacuguuucgaaacucucagucauggagggggucuuuaauccaccacaaagagaaccuugcaaacccuaauguccuaguauccaaacuuaguuaacaugccaguaaguccguuuccugucccugcucucuauucuccugcagccgcuaaaccacugccauuguugccuuuagaaaaacguggaucauguaaaacccuuccaagaauauauguuaugaugcuuauuuccucuuuucuuggguagcagcucugcugcucuggcuccagaugaugaauuuauucauaguggaaggaguauugguuggaagugaagagauuggaaaaauuauguaaaauauuuaagaguguguaugcuugagcuuauauuuaauggucuaauauuuuaaaauucccugaaccuuggaacugagaguaaguuugguaucucagaggccacauguuuuaaguauuugggauucagagagccagauucuguguguuuucugccucuucuucaucuucggagaucuguguccucacauacauguuuuuucucauucauucucuucaugauugacaugguggcucuuacauuuucccugccaucuuuuauucugaaaaggggagagauauuaucuagagauaagugauaaugaugccuucauuuuacagaugcagaaauuaagaaaugcauaaguuacucagcugggguagcugcaagaucuggaagggucugaauacaucuacccuacaccuugcuucuaaagauucaauuuucuggcaggaaugccuuuucuuuucuuuuucaaugaagaucagugugguguguguguguguguguauguguguguguguguguguuugugcacgcacguauuaggguuucuguagcugugauaaaacaccaugacuaaaagaaaguuagggaagaagaguuuauuuuguguauaguccagccauggcuaaagcucaaguaaggcagagaccuggaggcagaagugaagcagaagcuaaaugacaagcucugcuuaccagcuuuucacccuuggcuugcucaguuuguuuuacuaugcugucccggaccauacaccuaaggauggguccacacccaaugauuccacccaaaucugucauuaaucaagaaaauaacucacagacuugcccacagaucagucuuaaggaggcauuuucuuaauugagguguccucuuuccaagugauucuaggauucuccuauauauggguucuccugcuuggcaauugcguagauucugaagauaguaauucuggucuucccauugccgguaagggcuuuaucugcugaguuaucccccaagccucuuaacacaauuacaauuuaucuucgaguuagagugauucagauggggugaaggguaucuuguguaagcagcgucccuagcucuaccuacaagucaguaacauuccuaacacuaaguagcaucuuugcucagguacgcaguguauguuuucaggaacuuggagugauuucuaguauauugucaacaucucuguuccacaguuuaaaucccaacucccuauauuaguuacuuucuuggcacuuugucaaaauacccgauacaaacaauugaagagaagaaagaucuguggguauuuugcuuguuuauuuguuuguuuguuugcuugcuugcuugcuugguuuuugccuccggacuuuagaggauauagucauuuaugcuagggaacacauaucugugagaauagcucauugcuaaggcagugggaauaugagugaucuccuuacaggcauccagaaaggagagaaccuaggcccauaacaguuaagucaaccaucuaccaaucuacuuccuccauuugaacuccacuuuguaaaguucacacagcuuucuggaacacugcuaccagcuggagaucaacuaaccaaaaggggagugggaaguucacauucaaaucauauuccuccccaagugugaguuuccuauccuugugauacaaaaauuaaaacuguaacugacucccacagcugugaaauuuaaguuggugauaauguaugaugccagcucuuauugugcuugccauuaguuucuugucuuuccuucccucuuucguggcacuuugguacaagagcauagcaugaggcuuguaucagguaccagggaucugagaauuguaucuuugguagggaugauauugaggaaguggcugggaacagaauaaaagugugguuuagaugaacaucaagggaggcaggggugaucaugguagggugucaggggaaguaggcucuucacagcagagaaauuaggcauugugguaggcaacuauaaaaauucuauagauguauagcaaccacauaacaauugauuuacaugagacagcaaugaucugaagaagcugaguccuguuucuauuacugugguggugggaauggaccggaugauuuaauguaauuggaaucagagauguuaugggaauggauugaggcugauaaauaguuuaugguucaugucagauggaugugguuccuaaagucacaccaaauaucgugguaaagaauuccuauugcccagaagucauuguacacagcaucuaacagacugagcaaggucaaagaagaacuucuagaagggcugcccaggauagggguaugccagaagucaugaugugacagugugggcuaucagaagaagacccauuaugaugguuaauuuuaauuuuuaaauucacacaaucuagacucaacugagaagagccucaguuuaggucugugaggaauuguuuugauugcuguacuuaauguaagaaagucuacccaguguuggcaacaccauuuucuucacuugagauucaggacuguacagguaucgagagggucagagcacuagcauagaacaucuauuauuucauugcucugugugcuugacuuuggauauaaugugacuaguuccaucaaaauucugcagucuugauuuuccuacagugauagauuugaaucugaaauugagaggcaaaugaaccaaucauuccuuaaauguaauuugcuagguuauauuaugauagcaacagagaaagagacuaauacuuuaucugucaaaacaacaacucaucaauuuaaguauuauguggaagagagagcauucugcaaugcuuauaggacagauugguggaaauguguuuuuauucaaagaaaucugugcuucaggaggaggugcagaguguacagguagggacucugcauucuuuaacauaugauuucuuauuaaaguuguccuaaauuagaaaauucauucccagucuuguucaacaugugcugaaaauagaaaacaaugucuguacacuguaguaaaucaagagagaguugaugaugugguguagacaugauggcuagccuugauauguauggaggggcuagaugcaagcaagaucagggagggaggaagggagggaaagacagagggaaggaggcaagggagaaggagggagggacagagagagagagagagauuccuuuuccuucccuguuuuccucuuauuucuuucuccccuccucucucaucaccccagcccauuuaaaaauaauuuaaaaaaauuaaaaaauaaaaacuugguuaaccucagccaaccuauaugugcaagccugacugacaacuucaaaaguauagugagacuuuuuuucuuuaucauuuauaauucaaugacagaacauugcuauaccugcaaauuucaagaauuggucaggaggacuugcauaaaggcucuagaaagcuacuuauuugugguaauauuuugcuggguauauucuuguaggaaauacccaggagaguuggguauaaaucugugaaguugaauccuuucuugugguagcgacccuaggguauggagcaauuccacuaaccagauauguaccuccaagaaaagcugcaggcaugaaguagagguaguuugccaaagagaauaguacuagauugguggugggaccucaguaaugucuuuacgacucccacccauugcuuuacaagaacugcaggcuuuguuguuuucccugauugguuuuauuccugcuguagucuaguuuguccuuggcuuucuuucauuccucccuuuucaaaugagaauauuuacugugcuguuuuaugugagaagagucugagucauuuucugauuuuauaggucuccacagcuaagaaauugacuugaaucucagaaaagacuuuacucucaacaauaaugaaaauguuaugacauaucaauuauaaacgugaaauaaauguauuuugcauucugacauggccaugaggcuuugaggaccagagguggaauuuuuuauuuaaaaaugaaguaaguuuggaugccugguugguacuugaauuuauggugguuaaucuccaucaucuacuugacucaguuuagaaucacuggacaauacaccucuggugugucuuugaggucguuuuuagagagaaauaacugagaaucgaagaucuaccuuuaaugugaauagaaucauuccauggacuacaggcucaagcugaguaaaaguugauagaagauaucaacacagcugcuuuuugauucucuaagauauaagcaacaaguuucaugcuugcacuacuaaugagggaucuuaaaucauaauccaaaauacaccuuucuucauggauauuacuuuagucaaguguuuuagcacaacaaccaaacauaacugauacucaugccuuauguuguaguuauuggcugacccucaagcuuucccauagccacuugggguuaaagacagggucauggcucauguuuguggacacuacugccaacagcuuaagugaaaugacugguagugccccucucaauucugcccuuuaauuccuagaauaguauuacagauugggccuugagcugcucauuggcccguuugcauucuuucccuaagaccuuacccuaagcuguuucagaagaacaguucacucucugaacuauaccuucucagaaaacucagaugauuggcccauuggggcaaauuucuucucuuuugccaguuuccauugucuccaggcuucagggcagggaacucacuauuuaccuauuugaacuaaucaccauuuaucccaucucuaaaauguaauugaaaauaguguuaauggucuccauccaaaugaugauaccuccaaaaaccaauucaaaagacuuuaguaaaacuaucucaaguuauuuucaauggcuguaugcaggguccuuguuuucuauaaucccaacaggaaauuuagaugauauuuauuugcugugggccuacaaauacagaauaaccugcuuccgucuauaugacuguucacucucugugccuuuccuuucagaccauccauguggccaucgucugugccggauacaaugccagcagggacguugucacccuggugaaaucuguccucuuucauagguaagaugggucuuugcuuguauuguguuggcaguugugucccugauaaccugcaugcuaccuugaggaggguuauguaagaguaugcuuuuuuuaaucauuauucagacugccaugaaaauguaaucuuugucuaaaauaugagaaaguauauuagauuaacaauacuuaauagcagagguucagcauuaccagcuuucagaacuacaaaagccuucaaggacagcccaaguuagacacuucuauuucuacuaccccaugcucucucuagauuuuuuuuucuuuacauuuuuguuggcauuauuuuguacuuggcucuuugaaauaggucuguugauauaguuuuaaaaacagaagauuaaguuaaaguagacacacugugauggacccuaacccaguguuccuaguguuaaaaauguaagauuaggacagauauucagaaacaagacugugaagguaguuagccaaggaacuugauuucagauaccucagacuuccaucuuguagaacuguggcaaaaugaauuugugguuccaguuaucccuaguguguguuagugugguauggcaccaagaaaaacauaaacuaaugccuagauugauuugucccauuucuggguacuucugacuucugacuguauccuucuuuaugauaggcuaaaaugaacgucccuagcaguuauugguagaccuugucagucuccaugagaccagucagguuaguucucguccucugggaaauagagauacauauaucauuuaccucuucucuaugcuucugcauuuucacggaccuuucugccuuccuuuggagaaucauguuuauuaccuaggcauacuuaaguucacaucuagaauugagucuguagaucuagccaaucccuggcucuucucugacugcuuaucagggauuuugauaaaguucacguacaguuguaacccauaauacagacaggcauauaugagucagagaccugaacauucuuagcagaaggaacacugcugagaaguucuccauucaucugaauagagagcagaauguaaucacucagaugaauucuccacucagaccuaccaacacugcaaaaauguggauguaucuuucucccaccuucuaccucagucucccagccauccuuucuuuauuuagcaccaugcagcacuccuucuuacggauaugucaggucuucucuuuccuuucuauucaguucaggcccauaggucacuaaccugggcauaccuguuuggauccccagauuucuguucuuuauaucuauccuuucugacuccagaaugcuguuucagacaggaaucucugaucuugaaaguuguauguauccaagauguucauagguaaguuagaauuucauuaucccagcugucacaccauuaggagucaaugcuguucuuuuuaguguuuucuuaucucuagucucuucagugacuucaugacuuggcacuauggccuguuuguccuuccuacuacucucuauccuuuguccuccugcucugucuaccuauuccagugccaagccaucaauugccuucuuacauuauaaaauuucacacauguacugccucuaacaggaagccugguuuuaacccucaguauguguuuaaucuucuauucugcaguccacaaaacccugcuuauuaccuucuugucauacauauuaugcugaucaccauguaucuaucaacauuugcuucuguagcagaaauauggaccuuuucgagacagagacuauguacuauaucucuguaucccucauauuuagaaaaauucuaaccaguggaugcucauuuguuuaccaagugcuccugggggaggccuuuaguaagaaaucuggugauuucuuuucuuuuuuuuuuuuuguaauuuuuaagaaauuacauaagcuacaaacguagacugaauuuaucuucacauucaugucccuguagcagcaagagggcuucaaguuauuuuaaaccuuugcuuuaucuguuaacuuucugugaaucagaucaaucccaaaguaacuuccuaugucauaauguuuauucauuacugaccucccuggcauaucuuuuguacugaucccuuuauguagcuucagucagcuggucuauuggccacagaucacauuucauaccgucuagcaucaaggauggaguggagaauaugaauagcaacccaaaauauaacaauauuaauuaggaacaaagacuggcaaaucuuucuccuucuucugacccauugaaacuaugauuucaguugaacaguuucaguuucaguuaagacauuauaguaaugucagguggaaauuggcugagucuucuuauguaaagccaaaugucuuuuauuucaugacuauauucacuauguaguuuccagcuuuugugacccuacacucucauugcugcuugcaugcagacucuaugaagacuguacaugagccacauuggaaauucuuagccaugucauuauuccuuguguucaggacuagagaguccccaacagauagagucccaaagccucuuguuucaggaaagggagguuguauaaaaaaaguuuccuuccuguugcuuucacuacacagcuuauaaauugaugguuguuggggauaaaccauuuauauaguacgaagacauucaguuuaaaaauagcaguuuuauuagcagcuuuuggaaagcauaucauccuuccauggaggcaugcacgucugggagagagcucauuacuagugugaguuaugaacauggagucugcaccaugacaaugagugcuuggcucuccugaucaagauaaccauuggaguccccuccucacauugacauuauauaaaugagaacaucuguggauuaauuugcuacugauagugaguuuggauauuaaaacagaaggauauuucaaagacuuuuaggugagaaaguccagcuaaaaauagcuuucuucccucccaaguacauuauggggauugcugaagacaugauuaucaaauucauugacaaacaaaguaccuuccuaaaguuaauaauaauaggauaaucaugguuuaagauguuucuuuuggcuuucacuguuaauuacaguaauuagauuuauuuuccagacaagaguaaguuucaaaaagguuuucauuuaaggcuugcuuuguuaugucaaaucaauuuuacuucugcaauaugcuuggugacaguggacaugcuacauuuucaaagauaguaaaagacugacaugcacaguuaaauaacaguauggcacugaauauucuccaaccuucuggaaagaaauuucagaauauaugccgaagacccucgucccacaugacuacugaaugauuuaucucuuaaaaggauaacguaaacccuuuuuucuuuuacuuuugagaauauaacaugauuccuuccauauagcuuauauuacaauguccuucaaaccuuuccauagaauccucuuugcucucuugaaacugguaacuuuuuuaaugaauuguugauacguacacacacgcacacacacacucauucuaaauauaacaucagguauaaccaaacccuuuugaaaucuuguguauagucauuguaaaaguagcagcuuggguuggaaagggagcauagaaugugaacgcaucaagugagccaacauguuuuuuggcuuugcuuuugcuuuagcccuauggugcugugcuuccaggcaaucaguauacaucuuugaacauugugucugcuguuucccuacuacccaguuccuugcuuagaauaugcagaaagauucuucuguuuccuuguucaacaaauguucccucacuguguuccaaauucuguucuaaauguugucaggauacuaaaauuuccaguuuuccugugccugcuagggaagaguacuguugcuaagcccuguuucauagauaguacaacugagaaccaagauagcuaagccauuucucaagauuucauguccaagagaugaacagggccuaguuuaaguccagucugcuugcuuuacucuccacaacuaacaaggaguuucuuggcuuuaauaucuuuaccaucaucauuuuugguggagguguaggcauugugucauuguuauuaucauugcaaugccagucaucauuuucuccccugucaauuuguucuuguaagauccugaaucuugcaugcauaaaaggauuuaaaagcuuaggcuugguuuuguuuuguauuguuugguuugguuugguuuuucaagacagggucucucuguaaagcccuggcuguccuggaacucacuuuguagaccaggcuggccucgaacucagaaaucggccugccucugccucccaaguaaugggauuaaaggcaugcgccaccaccgcccagcaaaagcuuaggcuuuuaaaucuguauugcuaguaaaacuuaggauaguauguacaaaggaccacauggauaucuauagagguacuagggaaauaaucuuuuucuucacaugcugagcuucauguggacuauugaaguugaauuucucuuacccaguacaguaaauuuuaccaucccuauaacucuagaaaaacccaagcccagagaacuuaagugacuacugaguagauacuaauccauuaguucuagauuuguuucuaccaaccuuuaaaauucaugaggcuuucuuuaucuauuccauguggccucuugauucuucuagaaaggugcccuguucuccaugaucuuacaaagaaguuaauuaaguucucccuuauuuucccauaaaauaguggcuguuuagccuccuucaauucacagaugcuccgaauccagaucucugcuacugggaaucuccugaaauagucacaagugucaaugauccacugagggccgcugcugccgcugcugcugcugcuaucacugacucuuuucuuugccuaaaauugcuguugcauugugaacuuaauaaauaaagauuaucgcagcuuuuauagccuuguguauuguaaugaaagcagaccuuggauugccuuuugggagcuuuggcacuuuucuggcaagauaaggagagacaggagaaaagcagugauuuaaucuuuacuuucugcacugcucuauucaucgcauucugaccuugaaggugggagcaauuaaggaaacagagacaguggaaguauugcucauuaaaaguguagucuucaagaugugcuggagaugggccauucccuugccuccaaggggauauugauacucagacaaauaaagcuucugaguauuggauauggaccaugccaccucucuagcaagaggccuuuucccauuggucugaggcuguccuuuuccaaacauguuuauaacgagugacugguguaaaaaauaucuagcuuaaauaugauacuguuauaaaaccaaauagccuuuaauuaauuguauauugagaauauuccuuguaaguuuuuauuagcuucauuuguaaaauucuuuuuguaauaaauguguucuuaacaucugccuaaaugguguuccuuugcuuuuguacaaaagagaagacagagucucccaggcucuggcagacugugguacuugcaaggcucuaucaguaaaauccauucuuaccuuccuaaauuagaagccuaagcuaaagggaaacucauaagcuaccugugcaaaagaugagaucuuuccuuuauuaguuacucuuaaguuguagaagucuucauuaacugugggcgucaucaggguguuuccuaugaccuacagaacugaucaaaccuccugaucacagcccagccucuauaugugcagcuucucccaccuagggagaauuauaccaugcaagcccaggccacccaguguagugaaggaucaagaacagcagagcaaaacagauucacaucacuuucacauccacagucuggauuaucauuccagucucagauaacaaaauauguggaugagaauauuccuauaguaaauuggugcuuugagagggaagcauucaguauucccaauaaauuugccauuguugaccaucagcucucuugaauauuaggaauuuuuucuucaucuuuauuagauaucuucuucauuuacauuucaaauguuaucccgaaaauccccuauacccuccccaugccuugcuccccaacccacccauuccuguuuccuggcccuggcauuccccuguacuggggcauaugaucuuuacaagaccaagggccucuccucccacugauggccaacuagaccauccucugcuacauaugcaacuacagauacaguucugugggguacugguugguucauauuguugauccucccauaggguugccaaccccuuuagauccuugguuacuuucucuagcuccuucuuuaggggaccuguauuccauccaauagaugacugugagcaucuacuucuguauuuaccaggcacuggcauagccucacaagagauagcuauaucacgguccugucaacaaaaucuugcuggcauaugcaauagugucuguauuuggugguuuuauaugcaauggauccccggauggagcagucucuggaugguccauccuuccgucucaguuccaagcuuuaucuccguaacuccuuccauggguauuuuauuccccauucugaggaggaacgaagcaucugcacuuuggucuuccuucuucuugaguuucauguguuuugcaaauuguaucuugaauauucuaaguuucugggccaauaucgacuuaacagugagugcauaucaugugaguucuuuugugacuggguuaccucacucaggaugauauccuccagauccagccauuugucuaagaauuuaauaaauucauuguuuuuaauagaugaguaguacuccauugcguaaauguacaacauuuucuauauccauuccucuguugcgggacaucuggguucuuuccagcuccuggcuauuauaaauaaggcuucuaugaacauaguggagcauguguccuuauuacaaguuggaauaucuucuguguauaugcccaugagagguacuacuagaucuuccaguaguacuaggucaaaacuuucugagaaaccaccaaacugauuuccagagugauuguaucagcuuccaaugucagcaucugcugucaccugaauuuuugaucuuagccagucugacugguaugagguggaauaucaggguuguuuugauuugcauuucccugaugauuaaggauguugaacauuuuuacaggugcuuaucagccauuagguauuccucaguugaggauucuuuguuuagcucuauaccccaauuuuuaaugguguuauuugcuuuccuggaguucaguuucuugaguucuuuguauauauuggauauuagucuccugucugauuuaggauagguaaagauccuuucccaaucucuugguugcauauuuuucuuauugacagugucuuuuacaauuuuuaugagguuugcagaagcuuugcaauuuuaugagguuccauuaguugauucucgaucuuacagcaaaagucauugcuguccuguucagaaauuuuuccccugugcgcauaucuucgaggcuuuuccccacuuucuucuuuaugaguuauaguguaugguuuuauguggaguuccuugauccacuuauacuugagcuuuguacaagaagauaagaauggaucaauucauauucuucuacaugauaaaugcaaguugagccaguaccauuugaugaaaugcugucuuuuuucuauuggaugguucuagcucccuugucaaagaucauaugaccagagguguguggguucacuucuggguuuucaauucuauaucauugaucuaccuguuuguaacuguaccaguaccauucaguuuuuaucacaauugcucuguaguacagcuugaguucaggcauggugauucuaccagagguucuuuuauuguugugaauacuuuuuguuauccuagguuuuuuguuauuccagaugaauuuccaaauugcccuuucuaacauggugaagaauugaguuggaauuuugauggugauugcauugaaugugcagauugcuuucggcaagaucgccauuuuuacuauauuaauccugccaauccaugagcaugggagaucuuuccaucuucugaaaucuucaauuucuuucuucaaagacuugaaguucuucucauacagaucuuucacuuccuuaguuaaagucacaccaagguauuuuauauuauuugugacuauugugaaggguguuguuucccuaaguucuuucucagcugguuuauccuuugugaagagaaaggccacugauuuguuugaguuaauuuuauauccagcuacugcacugaagcuguuuaucagguuuaggaguucucugguggaaguuuuagggucacuuacauauacuaucauaucaucugcuaacagugauauuuugacuucuuccuuuccaauuuguauccccuugaucuccuuuuguugucuaauugcucuggcuagaacuucaagugcuauguugaauagguaggaagaaaguggguagccuugucuagucccugauauuagugggacugcuucgaguuucucuccauuuaguuuuauguuggcuacugguuugcuguauauugcuuuuauuauguuuagguaugggccuugaauuccugauauaguggauuacguugauggauuuuuaaaccaucccuacaucccugggaugaaggcuacuugaucaugauggaugaucauuuugauguuuucuaggauuuaguuugcaaggauuuuauugaguauuuuugcauucauauucaugagggaaauuggucugcaauucucuuucuuuguuggauauuugugugguuuagggaucagauuaauuguggcuucaugaaaugaauugaguagaguaccuucuguuucuauuuuguggaaucguuuaaguagaguuggaauuaggucuucuuugaaggucugauagaacucugcacuaaacccaucugauccugggcuuuuuuugguugggagacuauugaugacugcuucuauuucuuuaggggaaacgggacuauuuagaucauuaaucugauccugauuuaacugugguacgugguaucugucuaggaaguuguccauuuuauccaaguuuucuaguuuuguugaauauagccuuuuuuguauuaggauaugaugauguuuuguauuuccucagguucuguuguuaugucuccuuuuuucauuucugauuuuguuaauuaggauacugucccugugcccucuaguuagucuggcuaaggguauaucuaucuuguugauuuuucucaaagaaccagcuccugguuugguugauuccuuguauaguucuuuuuguuuccacuuuguugauuuuggcccugaguuugauuauuuccugcccucuacuccucuugggugaauuugcuuccuuuaguucuagagcuucuaggugugcucuuaggcugcuaguguaugcucucucuaguuucuuuuuggaggcacucggggcuaugaguuuuuuuucuuaggacugccuucauugugucccauaaguuuggguaccuuguggcuucauuuucauuaaacucuaaaaaguuuuuaauuucuuucuuuauuucuuccuugacuaaggaaucauugaguagaguguuguucaguuuccacaugaauguugguuuucuauuguuuaugcuguauugaagaucacccuuaguccauggugaucagauaggauaaaugggauauuucaauauuuuuguaucuguugaggccuguuuugugaccaauuauauggucaauuuuggaggggauaccauguggugcugagaagaagguauauccuuuuguuguaggaugaaguguucuguagauaucuauuaaauccauuuguuucaucacuucuguuaguguccaugugucucuguuuaguuucuguuuccaggaucuguccaauggugagaguggggguugaagucuuccacuauuauugugugaggugcaguguguacuuugcgcuuuacuaaaguuucuuuagugaauguggcugcccuugcauuuggagcauagauauuuagaauugagaggucaucuuggaggauuuuaccuuugaugaguaugaagugucccucgucuuuuuugauaacuuuggguuggaagucgauuuuauccgauauuagaguggcuacuccagcuuguuucuucagaccauuugcuugaaaaauuguuuuuccagccuuucacucugagguagugucugucuuuuucccugggguggguuuccuguaagcagcaaaauguuggguccuguuuguguagccagucuguuagucuaugucuuuuuauugggcaauugaguucauugauguuuagagaaauuaaagaaaaauaauuguugcuuccuguuauuuuuguuguuaaaguugggauucuauucuuguggcugucuucuuuuagcuuuguuuaaggauuacuuucuugcuuuuucuaggguguuguuuccguccuuguguuguuauuuucccuuuuauauccuuugaagggcuggauucauggaaagauauugugugaauuugguuuugucauggaauacguuuguuucuccaucuaugguaauugagaguuuugcuggguauaguagccugggcugccauuuguuuucuccuagggucugcauaacaucuauccaggaucuucuggcuuucauaaucucuggugagaagucugguuuaauucuaauaagccugccuuuauauguuacuugaccuuuuucucuuacuguuuguaauauucuaucuuuauuuaguacauuuguuguucugguuauuaugugucgggaggaauuucucuucuaguccagucuauuuggaguucuguaggcuucuuguauguucaugggcaucucuaucuucagguuugggaaguuuucuucuauaauuuuguuuuagauuuuugcuggcccuuuaagguaaaaaucuuuauucucaucuauuccuacuauccauggguuugcucuuuucauuguguacuggauuuccuggauguuuugaguuaagaucuuuuugcauuuugcauuuucuuuuauuguugugcccauguucucuauggaaucuucuguaccugagauucucucuuuaaucucuucuauucuguuguugaugcuggcaucuaugauuccugauaucuuuccuacgauuucuaucucucacuuggguuuucuuuauuguuucuacuucccuuuucaggucuuggaugguuuuguucaauuccaucaccuguuuuguugugauuuccuguagcucuuuaagggauuuuuauguuuccucuuuaaguacuucuaccucuuuagcaguguucuccuguauuucuuuaagugaguuauuaaugcccuucuuaaaguccucuaccagcaucaugagauaugauuuuaaauccgagucuuccuuuucugguguguugggguauccagcacuggcugaggugggagugcuggguucugaugauggugaguggucuugguuucuguuaguaagauucuuauguuugccuuucuccaucuggucaucucuggcauauguuguuauaguugucucugguuggagcuuguuccucuugugauucuguuagacucugucagcaauccugggaguccagcucucuccugagucucaguggucagaguacuuucugcaggcaaggucuccucuuucagggaaggugcacaaaggucuggcauucagaccggccuccuggcugaagauaaaggcccgaaacagggccugucccagaagauguguugccucugcagucugaauguucaccuucacagacuggucuccgagugaccagggacacaagaugucucucucaccugcucuggagaucagagcccuaccagugggacaccucuccucugaaggggaaggugcccagaugucuggagccugaaaaggggucugucccagaagcugugucacuucugcaguccucacucucaccugugcagacucuaaauuucuaaauuucaucaauaaugguuucuggcucagaauccuccccaaccaagcuguuguuaguguuauuuuaagcauguuaaugaguauguagagcuaucucauugugcuuuuacauuuugcauuucuuuggggauuaaugggauugagugucuuuucaugugcuuauugaccauuuguaaaucucucuugaaaaaauggcuauucagagccucuccgggacuuuuaauuggcuuacuugucuuuuuuuguuuguguuguaaaugaucuuuaucauccucacaaaucccucaucaguuacucacuagcagauauuuuucuccuacucuugaguaauguuuuucacuuuauguccucccaagcacaaaaguucuauuuauuuuccuuccuucuuuccuuuuuucagcuucagcagcacauaauuauuccaugugauccugggccuuagggugcugagaugagggugcuaggauaaucaggcucuugaaggaaccuuccuuuguaucugcaaguggacuucuguaccuuccacauuguagugagcagggacaaccaguuuuugucuuguuuuguuuuuuguuuguuuugauucaaugaagucuuguuuauccaugcucucuucucuucuuuagaugccaaauccgagugaugugugugauuuuugagaauagcauagacuuucuugacuauuuaagaacucaacuuguggaucugggaugucugaagaucagacaguuuucaccauagguacccuaagccaguguugucagaguuuauuuucucaugccuaagauguauaaggauauaaugggaagcaagccaaggcugagcagaacaaauguacauuuauuaaggaaaaaugauuaagaacuccugacagcagggaaguaaaaccuucuugcuguccugccccaguuaccguagcagcuagauugacauugaaguaccuuucuugagacugagcauuuuuaguaccugaagaccugaaccuguauggaguucacauaacuuauacaauuucuguccauagaagcagaguuacucuuccuucuguaagaaauaaguuuggagucacaaagaaauacaccaccacuucaaaugaaguauuuagacaaggcaaaacuauaaucuugaugauguguuuauaaaaagauaaagagagagaauaucuucuauggaaugugugugauaagguaugggggaagaggaugucuuagcaggcccaugccaaggcauccuuucccucugagggaccagaaacaggguguuauaguauagaauagaguuuauucagggaauggggagggggauagaauuaagaugguagaagaggcagagagggagagaguagagaaguagaggcuggucaugaacaccuggauccuggcggaauggaaugggaaagggaaggaagaagggaagagcucaagauggcaagagagaugaaagagaacaagagagagaggaggggggcaagcagccccuuuuauaguggaucaggccuaccuggcuguugccagguaacuaugggguuagacauaaugcuaauacuugauccagagugugugccccaaugagcaagcacauugacaagaaguguacuugauauuuauucuaauuugggugguaacucuguuuuucccuauugguugaauuccuaccucacaguuuuauucauuuggccauucauaaaaaucuugauaccugaggaauaaaggaugaaggggaaaggagucagggcuucaagggaaaaagggcuacuguuccaggccgugaaauuccuagaaugaagcccugagccuuuaugcaagcaaugauugucucauguuuuggggguaguuacauuaaaagauuggggguagggaacaaacaaacaaacaaacaaacaccuuuuacaaguugggauaaacagauuuuaauuccuuguuuuaaauacaaguuuuccaaguauagaaaagacucauauuugauauuucuuacaaaugcaggcuucauauugccuuguauucuuaacucaugauccaccauggggccuucccaugacugccugagcagaacaacuaaacccuaguuucauaaauuaguuauacuagccauuguugaagucccuccuccauuuccuucaaaaugcuucucuacuuaaguuccacuuuuuuugucaaauugugguggaguuugggucaucuuggucuuuuuugaucuacuuauuuuuuucauuaaacaaagacaagguaauucuuuguaugagaugaaaaaauucuggagaucauuaauaaaauggagcucccagaguccauucuuaauacaguaggguauagaggguucuugacuggcuucuguguucaucuuacuaacuuuggagaacaaggcagaaggcaaugauuccagcaaagcugugaugguccaagaagaggucagaaguaugcagaagagcagaauacauuuuuggagcugcagugggacaugcaguuuccaugccccacuaagguagugaaaggaaaccagaccagugacuggaaauauaaaagcuuuccuucagacagcucaccuuauaccagagggagaaugcauagcucuaucagagacuagcagugcuaacuuugggauggaaccaaacaggaaccugggauggggccuggggggggggggggggaagaaaugaggcugccuuugguaggaugucuaaagaacacugcccugaguuuaugacccuggagcuuauuuuguagaaagaaugggagauggucauaugguaauacagagacaugagaaugauggugagaucauuaaaauccuuguuaacucaauguaggagugggaucuuucuauauuauacagugaacagagaauaaagauaucaccaaagguuaggugugaucaugauagccaucauuaaccaaguacuucuaauauauguuuuauuugcuugauauacuugagaccaauugauguagaugauagauagauagauagauagauagauagauagauagauagauagauagacagacagacagacagacagauauagaacugauaauaaucaaacaaucuuaaaagucucaaaacugacacuuagagaugaaucuucccaaaguucaccauuaguuuuuuacagaaccaggauaagucaaagccagugcauuuaucuccugagauccaacuuggaaccacuaaguacaggguauauguaguggauauguagaagauggauggggcuguuuuuugcugggaaggcuggguaaaugguauuguaagacccccuuucggggaccccuacucuagucuugggagugugagagcacccaaagaaacaugaggacccaacuugcuguaauuacaugaggacguuuaauuacggagcuccggaccgacauguaucccacacaggagauaacggaugcuggccacgaggcuagaaagcuagggguuuuuauggggcaaggggcuuaggaguguggaauucagcacagcgacacacuauuggcuuauucaaacauuaacagaaagauuacagggcaucaagacuuuguuccugugggcugagggcuuaucuuuguucacauagcaaccaguugauguaugacuuuacccggugucaaggggcaguaaacagaggggagguuccagucaggugguguugacucagacaauauagcccugcuaugucuucacaguccccuuuaucuuauggucaagcuguucccaggaauguuuuaacuacgaggcauacccagguuuguuuuucucuuuucucagccccaggcagccucuaggcucacaaacaaccagcaauuucugaguacuuuauaugacuuacaggucuugaaauuucaucuuucuuucaguauuuauugcuaaucccaaagauuugaggagaaagacuagcaacccaaaucaaauuaauucuaaaaugcaguuaauuaaaacuagcuuuuuuuuuuguacauguccugucucucccuguagaugagaaucaagauaucaacauuagacaugaggaagacaagguuuauagcucagcaguuggggguuuccauauaggggauuugguaggcaaaauaagcuacaaaagcagaauuguauguccuaaaacaaagauguuugcaagaugaucauaacaagguagucguaacaacagguagucauaguaagauaauuuuaagucauaauaaucaaguaaaaccaaggaaugcuuauuguuuccuggaacagacauuaaugaacaauuucugguuauagcucuauuuuuugagaaacagguuuaaucauaaacaggaaugagccuaguuugucuuuacuauaaaauaacuauuuuauaagauggagguaggcuggucaucguuaucauuuuaucagaaucaagcaaaugcugcaggaagagccagaacuggacuuaaaacucauuuccauuuuuucccuguauccauuacuuuuuuuguuucaacaaaaaaacuuaagagagaacaauuuaaugaaggauuuauucuagauuacaguucaauuacauuacaaccuuucuucuaguaccaauuuucacaauugucacuuaccucuuuuguuguaagaaaauacccuaacaaaaucaacuuaagaaagaaaugguuuauuauagcuugcaacucaaggggauacauuucaucauaaagggaaggcaggagcacaaugccaaucaguacaucucugcagugagggaagcgaaacucgaacaggaagugagcuuuaagccauacaaccucagacuuucucucacuuaguucagcaaaauuugaauccacuaaagguucuaguaccuacgcaaacaguaccaaaaucuggagaucaaguauucaaguaccuaagucaaaucaaggacaauucauauucaaacuacaaaagcccccugcauccuugcccuguguuaugcugucaggaacuguccaggaagagcuggaaacuguagauaguugggugaguaaaagucuuuggacccauuacaaaagaggcaagcucauauccucagcaagguuccagaugaccacagcaugaacacauauguuuguuuuagaaaagaaaaaacagaaaacacaauuuaucuuugaguuaauggagccagcuacccauacuaauuuaugguaaggucucugucauuacauuuuugcauuaaugauggcaugucaaguuggugggugcaaaaguugucauaauuauuaauuauacccuacuuaaaauuuuuagaauaaagacaucuugauaacagaugugggaaauguguuuuacuuucuuuguuccuugcuuguucacacucagaaauucaaguuugaaggugauaucuuuucucccuugcaguucuaauauuaucaccaagaaguacuuuagagcuucugccugauuuacuuccacaguggccuaugauaguaucuuacauuauuugcuuggaaaggggugauuuugcaacuagaaucacgacccuuaauguuccucuggcauccuccuuuccccucaauaggcggaacccucugcacuuccaccucauugcugauucuauugcugagcagauccuggcuacacucuuccagaccuggaugguaccugcagugcgaguagacuucuauaaugcugaugagcucaagguauggaagggaaauggggaagggagaagaguuucguagaucuccuauagcugggagccuugguggggaguuagacuguuacaaggacagagaccucagcuccuaauaggaaauguucagguucuaauuaugcuuaucugacuuuaucauuaagcagcacauuagcaaaacugcuaauacagacucugcuuuggucagugcaguucuagccaccaagguacacucuaaaagcugaaguucacugaugucaguuuaugccugaacauugucugugguagaaugguagaucaucauucucuagcucuugaggugaauguugaccugagagucugacagaacuugccuuaacuccaugcacuguuacuuacuggccacaagacacaaaucaaucacccgcccauguuggccugcuucuucagggauagaacuguuguacucccaggucuugggguaaguaagaguuucugaugaaagaauauauguugauacccuaagauuauccugaauaauuacuacauuuggaguguuuuaaccaauaaaagacguguggucaucuaauugcuuugcuuaaaguucuucuauaacacaaccuugcuuccaugaugguugagaucaugaucuaaguaaagaccaugagcuuuagcucccaacucuucuucuuauuuaucuuuugucauuccuaugaauucuuccaaacauagcuauaaauauuagagagcccgggauguguggcuucucuccaguauuguaguccuuuacucaucauauuuccucugucaggcuuacuugcccuguuaucuugucagguuucacccauccuuuauacccaguggcauugcuauucuuuucuuuccaagaauaagcaaggaaauuuauagccauuuguccuucccauucauaucuaauuuaugauccuuaguugccaggcagccacagguagcugaauguaucccaagccaaaauguaaguuuacuuaaaacagaguuauguguuuaguuuuuuuauuuuuuguaagacacuagcauagauuuuaagcauggaaguacaaaugacuauuguguuaaugauguaauacagagccugccaauggagucuagcaguguuucuuuaauaaaauaaguagccgagagcuuuuuucgguacauaguagguggugcaugguaggugucucacauacuagcaaguuuagcacgcugcuauaguuaaaggaauuaacagcuuuaaaggaacacuuuggccuuuuguuucugaucaccuugggaaggacgaggcuccuaggccuggggcugauuuuggaaagauguuucuucuaagagccacaaagccauuauaauugcauuucagaguaguagcauuuuaaauggaucauguugauaaaggcuagaguuucugauuuucacauauuucaggcucagagguugaucgagauauucagaauuuugcauuuggugauugucauaauuuaugugcaauuccaaucuauucugagcuaaaauugauuaacacucuuaaaaccguaacaacaaaauuuagcaaauuacuguaguaauuaagguaaaaggcaagccaaucuuaucucccagggucuuaguggcaauaccauggggauaugaaaccagagaggaggagcagagcugccucugccuccacacuuaucaaggcacuuccucccugcccugucccagucaacuuaucgcuccuuuagagacacagagggagccagauagggcagcacauuucuguaauugcagaaaacugggaucuagggcaggaggauaucuaucucuaagagaaccugaaguauauagggagauucugucuccaaaaacaaaaacaaaaaacaaacaaacaaaaaaacuuggggagagggcaaucccuauauuuuauuuucaaauacuugucuuccaccaaaaaaaaaaaaaaaaagcuguguauuugggucugagccuuggcuugcuaacuuguguaauaguucgaaauaaagccagccacuaagggaagaaauaguauaugugacuugucagguucuaaaaaugcuuggcuuuuucaguaguggccugaagucagaggacuguuagaacccaagaauuagagaauagcaggcaacauggcaaaaauccugauucagcugggcgugguggcacacaccuuuaaucccagcacuugggagguagaggcaagcaauuucugaguucaaggccagccuggucuacaaagugaauuccaggacagccagggcuacagagaaacccuaucucgaaaaacaaaaacugagucaaaauaaaauaaacauugaagaauccggcauugaaucccaaggucauauaguaucuauguuguuguggauccuauugaucacauggccuggaauguaauccauggacuuuaugauguugaagggacaagguguuccacagagcccaaggcuuuccugugucucugagccugagaggagaggagaggaauagagagguucugugguucuccuacuccugagugauugccuauauuuucccuugguagauuuuugucagcuugacacaaguaagcauuauuugggauagaaaauuucaguugucaaaaugccucugcaagauuaauuuguaggacauaguguugauuacaaguuaguuaauuggggagggcccaacacacagggguagugccaccucuaguagguggcucugcguuauauaagaacuuaggcugcauaaaccauggaaagcaagccaggaagcaguguccucuguaaucucuguuucaaauucuccucacagguuuugcccugagauuguuucuuaccucccuucaaugaagguuuauguucaggacauauaagccaaauaaaccccuuuucucccaaguugccuuuggcuuuggauuuuaucacagcaaaagaaaaaauaaaagaacauugaguuacagcuuuuauuguuuaaaaaagugcaauaauuuaaaaaaaauacuaacugacauauuaaaaauaguacucucugagucaggguuucuauuccuggacaaaacaucaugaccaaaacgcaaguuggggaggaaaggguuuauucggcuuacacuuccauauugcuguucaucaccaaaggaagucaggacuggaacucaagcaggucagaaagcaggagcugaugcagaggccauggagggauguuguuuacugguuugcuuccccuggcuugcucagcuugcucucuuauagaacccaagaacuaccagcccagggauggcaccacccacaaggggcccuccccccuugaucacucauugagaaaaugucccacaacuggaucucaugaaggcacuuccccaacugaagccuuucucugugauaacucgacugugucaaguugacaccuaaaaccagccaguacaaguacuaucuucuagaaucuuuacuccauagaauauucuugauauugguuuuuuuuucuaccuguuaccagcucucucuuauaucugaggauuucuaaucccacauccuagcagauuaaugaauaugaacacauuauguggaacauaguguuuucaaggcacuagugaucacacagaaaaacauuuauauguggucaccucugccaacuugcgucugcucucaucugccuagaugcucaucauugguuugucaguccuuucccuguguguauccccauaucuuagcugagcccugucuccuuagcugagcccugaugucccuaaccaaguuucaugaucuuccccugcccauuggcaucccuugccuuuuuguuuuguuuuguuuuguuuguuuuuguuuuguuuaucaagacaggguuucucuguguagcccuggcuguccuggggcuguccuggaacucacucuguagaccaggcuggccucgaacucagaaauccaccagccccugccucccaagugcugggauuaaaggcaugugccaccacugcccagcucauaucuugucuucuagucugcucacauuuccuuuuucaggacuauucuugaauaauaacaaggaucaguuuucuggaaaaggaaguuaggcauggcaccccaguuauuuguuuagucuucuguggucccauauugcuuuuaagagccagacuauagcugagcaggccuuuuuuuccuuuucuuucuucuuuuaacuaggaaacucuguuucuuggucuuucuuuccuuauugcuaggucauucccuguccuuuuccugagccugugcuacugugggaaacugccuccuuuguuaucaccaugggcguucuuuguuauuugaguuugugggauuacacacauuucuucagggaauucaccacagaccauauuccuccaugccauguuguuugugauguuugaauacuugguuaccaccaguugguaggucuguuugggaaggauuaguugguuuggccuuguuggaggaagugugucaucuggaaaggcugugagguuucaaaugaccacagcauuccuauugguuucuaugucuuauaguuguauccuuacagauguaagcucucagcuacuacuccagugccaugccugccuuucccuugccaugcccccugaaaugaugacaugggcucuaauacucugaaacuguaaggcucaaauaaacguuucugcuauauguugccuuggucuugaugucuuauuagaaagguaacuaugacccuuuucucuguuugcucccuggauuuuuuucccuucugugauccuuguuggaugccugguugagaaaauguuuucuaaguaacugauauacagugcauuuagaacuguugucuuuguuuuguuuucgguucuaggguuuagccugguuccuggaagauguuaggcaugcacuguagaacugagcuccaugccuuaucuuuccuuuuacuuuuugcuuucagucagugccucacaaaguuuuccaggcuaguguggcaccuaugauaauccugcugcaagcuuccuaguagcugggauugugggacugugucaccauuagcaacgccagcacuauauuaugaagaaaagcaaggccaaauuuugaucacaaaagagaaucaccacauuucugaguguguuucggagucuggguggauagccugccugagacuuugcaauagugguuuuguauauaccagcccaugucccaguagcaguccugggacagauaaagcaugcauauuuuuuuucuaucuuuucuuuugacucucccacuuuucuuuuuuucaaauagaguaucuuuauacaggcugcauuggcccugaacucaccauguauccuauguuugcuucaaauucacuaugaaacuaggaugaauacuuuccuauauuaacugccaggaacaaagcauacuuucauuaucacccuuuagauaauaucugggaaggaggaaaaacaggagggaagcagauaugaacuguauuuuuuaguuguguucaacaaguaugucagaaagcucauauacagacacauaagauagccuucccugauaugguuggcuccaaggaaucacuuuguacagcucuuggaaauaguauuucucagaaaugugccugugggccccuuauuaucucuguuucuguuggaguaugagagaauaugaaauuuaugagggauggguacaugauuaaaaaugaacuaucuuagucagggucucuauuccuguacaaacaucaugaccaaaaagcauguuggggaggaaaggguuuauucagcuuacauuuccacauugcuguucaucaccaaaggauuccccuggcuugcuuagcuacuuucuuauagaacccaagacuaccagcccagggauggcacccucccugcuugaucacuaauugagaaaaugcuuuacagcuggaucucauggaggcauuuccucaacugaagcuccuuucucugugauagcuccagcuggugucaaguugauacccaaaaucagccaguacacccaccauggacugguguacuucccuccauaaugaccaauuaguuuggauuugcaaauaggagucucagucugccugucccugcugucuguagaaugucccucagucuuuccaguacuuggauagcccauuuauuucuacccuccaaaaucccuaucaggacaguacuuucugugcccugaccucugcugaaaacucguagcucugaacauccagagagaagggguauuuacuuugguacagagcuuuauagaugucuggacacugucacucacuucucaugacaacgcucugggcuugagaguaaaguuugauucccuccaucucacagauaauucauaaaucugcaacccaguacugcagaauauuugccuaagaucaggcaguuaauaaaugccaaggcugauauuugacuuuucucuuuugaaaugagaugauauaagacaggaugugcaauucacuaagcacaaauggaguuuggaucugaaggaaagggcuguagucaccagaaaaugaggaugcccuuguccuaguguacuugauccccugacuguugggaccccuaggcucaugggcuacauauaacaucuauugccuuuagagugaguauauuguuucuaaugauaucccugcuucgccucugcauucccacaauucuaugaugucaguucaguauccccacuauauggacaauuaacuguaauucuuagcuuaauccugaagcuaccuguaaucauggcucaaaacccaacuccauugugucugauucuuguccuuuguucuuucccuuucuuguauauuaucuguauuucuaguuaaacaagagucccccaagcucucaauaugguccuuuuucugacugccccugaaaaacaaaugaauuaagcaugaagccuccauuuaauggcuugcugggaauagaacuuucugcuagggauaaaagugacccacucuagugagguugcugagguuugcaaugacccagaaaucucacccagggaccuuguucaaauauaaaugaucauuacuguaguuugcuuuaaaucagcaaaacaguacuugccagcuuuuagacaaguuccuccaugucuacuagccuuuuaucuugcccaccuggcuaccacugggauaaagaugacccugagcucauaaagggaaguggcuagagcaguggcuguuuuaugauuugucucuuuaguggggagucccaauuuaaucuccuuugcucauagcauugaugccuguucuuuacccacauuacagagguuggaaaguggaauucaagacaguaguuacugaaaauauugaugguugacugaaaauuggugucccacucaucgcuaguugccauugugcugguguucauuaaaacagaagaaguucucuuuagauacuuguaaucucucagcccccuuacaggccuucaagaagagcauuucuguuguuccucuccaugaaccauuaggugaccuccugccuacccaaucucauuuccuaggaagauaaacuuucugaacacugaaauuucaaccauagugaagugaagcaaacaugaguucuguguguugaaggagacaugauauuuauaacuuuguaaacaaauuaguccuggaaaggcaagaaaaguaccaaagggcuccucaaauauuuuuucuagccaggugguggugcaugccuuuaaucccagcacuugggaggcagaggcaggcagauuucugaguuugaggccagccuggucuacaaagugaguuccaggacagccagggccauacaaagaaacccugucucaaaaaaaccaaaauaaauaaauaaauaaauauuuuuuucuaauauagacccuuuccucaaacuguauccuggauuuucaaaagauaggccuggaguauaguauagagcuccacacugauaggaguugugcuuuuguugaugugacuggacaucccugugugcacaaaaguuccaucuuuuuugcagguucuguucuacuaugagguacccaacagaggacccagaggggaaguacagcuugugguuuucugacacauuuaaaauaagcaaagcaacauacagcccuuaagucuuccaaaccguagcuauagcucccuuuauuggugaugucucagugcauauaaaugguauuuuaugcugagaugcucagugcuuagcacacugugggcacuuacuuucuucucucauggcugucugucacauguaaauagacccuaaucaggacaguucaguguaugauauuuuaccuuuacaacagugcaaaaguguuaugcauauauuaaguguacuugagauuuggaauuugggucuuucacuuguuaauaacauguagcauauuccucauguaauguuaugcagcaacugagaguuguagcguucaguuagccccacucuacuagagaaaacgaggcagcucaaugacagguuguuuuguuuagcuguaguuucuguguucaauuaguaaaugaaauucugaguuacuuuucuuuuucuuuuuucuuuuuuuuuuucuuaaaauagcauugucaguacagaaccucaucagaugucaagaaacauuggcauuugaggguuauuaguaacaucuuuaaucucuuccacuaccaaggugauuucugaccucucaaaggacaggcauuauggcuugguuuucagaauaguccauagacuuuuacuccuacuccucgccuccuucuuugucauauugcugcaggagugcugacagggguuaaauacaugcaggaccaggauuggugcuauuaacuugugcucuguaaugcuuuuuuguugcauagauuaacaguccaguuucugaaaaggaggucugguuccaauaccaacaaguaugucucuggccuuugucacagagaauuagggcaagaucagaggauauacauguuguggguaaauaagugcuauagagucaaaaacaugccuauuuuauguauagaagaccagucacuggauauuauaugguggauguauauaacuaugaagauagacaauagaaauuucaucagccuuauaaucuaugucacaucuuccacucauuuugaacuuaggaaauuauauucuaucuauagcaagcuuuuuuuucuuuuuucuuuuauuuguuuugagauagagagcuggccuuaaacuaacuaucuguguagaccaauuuguucguaagcuuacaaacaucuaucugccucugggccucugagauuaagggcacauaccacuauauccagcuaaauugaagccuuuuaaugaaugggacuuguuuccuucugagaaucauggaaucuuuauugggaaaggacauuguagcccucugauauaaguucagauuuuauguauuauuugauaaacagaugauugguucaucuuuguuugaauacuuccaaugauuugauaucauuuuccuucccaggaaucuuucauccuauuuagaaccaaucagaguuguuugcuuugagcuucaucuuucugauucuguacauuaggucauguacuacugaacaccuagugcaaauauauauuugauuuaucugaaaacacugucacuuucuacauuagaacaugagaaccugugaacaaggacuguaacucagcucugugcucgccuguuagagugaaacaugguuccaaaucaccucuuaaauguucugucccucaggcucugcagaauuaauccaguccucugccuucucaaagacuuggcauaucuaccacauucucucuucucccuuauuacuuuuauuucuugaagcaaaacacaaaggacauuguacagacuugugauacaacuuaaauacgucuuugagcuguguuuucacaaauggcuucuaucauccauuuucucucugucucauaucucucugugaccguggaucuucaugccgcauuuguuacaauuuuuccugagcuguauaugcccuuucucaucuggaaaaaucauggaucugaguucagauauuuacuaaacucauuuaaagcuauucagugccacagacuggacucagugggucccucaacccgcagggaaauucaggguccuguuucucagguggacaagaaguuggcggggugacaaacagaugcaaacacaagggaguguuaaucugaauguaauuucucaaagugagcaucagacuuauagaagaaaacaaagaaguuaggugacacaucagccaagguacuuugucugacacaaaacagagaaauguguacaugcagaguggcaggaacuaggcugugguuacaacugagauuaaaggcaggcgucccuuucuaaagucagccauuagggagccaggugaggauuucacaccugucaucaccugugcuauuccucugagccuugugaaagcuugcaccaggggguucugcucuugcuaaccuuuucaugaauaaugcaauacuguuguaguucuuccuuaaaccacaaaccugcuucuuccuaggccuuuguaaauuccugcauaugagagugacuguaauucuaaguuuacuuuguagaacuugcccugagauuucuagcucuuacccaguaaacugcaaugccugauuucuuucacugucuaucaacacuggaggcauuacaucggaauaaguagcauuaccuauaauauaacacugacuauggcaaggacaaaucuggagcauuuguguuacuggaugccaaggcuccaggagaaaaguuuccaugaaacuuuuugccucaggccugcauccaagcuuuugggcuagcugcacagacuucacuggaguggguguggcaauucaguaccugaaaauaccuugguuccaucuugagcacugaccagcuucucauucugaguacuugugaucauccccacgaucauaccucagcuaugugaagagugaaaugcuuccaugugccugauggcccuauggcuucucaaaaccuuuaucguauuagugaagcauuaauuaaaauuaaaaaaaaaaaagaaagaaaacauuacuagaucacugcggaggagacaugggagacaauaugcuuuauagaccuuugacaacucuuugugccacucaccccaccugaaaacaucuuaaauuagaaccaaugucauggauuugagaaucauuggcauaauugacuuugaaguuuaaagaauauuauaaaaagacaaaagcaagaugaaaaggaagaacacuuuuuaguaagcauagccuuugccuacaugguuuggugggcaccucuggcuugaauuugagaaguggcuauugcagccuugaaacuuaugauggagguguuccguguuugaaugauugacugauuggggcauauucuuuugaaaugggccuccuaugguaauacaaugaaaguuuuuagaaauuaggagcuuuuaaauaagccaagcagaagucaucagaugccccauuauguaauucaggacuuuguccauaaugaagaauacuauaugcauauuggaaaugaaugaucucugaccuagugggcucauugaucacugcucacuacuaagugaacauuucaguuacagggauuaaacagaaucccuccuuuuaaaaagagauucccaucaguugacaguauguagaaugacaugcuuaccaacuauaaccuuuauuuaguuccacaauaccuccggggguggccauucugacugcaccauagccagaugaggaaaugaguguuuucaagaagccuuguuccaaagacuauuauuguaaauuauaaaaccaaaaagacugagucaggcaaagugguuugguagaaauaaaguagggcaugauuuaaagaguuuuacaacuucuuuaguuacguuuuauaaagcaccaugaaucuguuuacagugccauauaccuauaauaacugccaucuggaggcagagacaggaggcuuguaaguuuaaggcuagccuaggauaaccaguuagagaauucugagaaagggaaggaaauggguacauauccagagaauacaaguauacaugugagacaaaugagauaacuuuuauaguauauucaauuuaauuauauuuguaucaauuauuuuguuuugcuuuguuuuuugagcuaguguuuuuuuauugaauauuuuuuuauuuacauuucaaauguuauccucuuucccaguucccuggcuccuggaaugccccuaccccauccucccucccccucuuucuaugagguugauccucaaacuacccacccacuccaaccuuccuguccuugauuccucuacacaggcucaucucuagagccugcauaaaaccaaggaccucuccucccauugaugccugacaaggccauccucugcuacauaugcagcuaaagccauguguacuccuugguugaugccuuagucccugugagcucugaggaugugguggggggaaggguccaguugauugauauuguuguucuuccuaugggguuauaaaccccuucaaucccuucuauaacuccucuauuaggaacuacaugcuucguccaaugguuggcugcugacaucugccucuguauuuguaaggcucugguagagcaucucaggagacagccauaucagacuccuuucaacaugcaauucuugguacccacaauagugucuggguuugguaacuguauauuggaugaauccauguaccuuugggacagucucuggguggccuuuccuacagucucugcucugcacuuuagcaccauauuuacuccugugaauaaauauuuucuccuuguaagaagaacgaaagcauccacacuuugguuuucuaucuucuugagauucauauuauaucuugaguauuuggggcuuuagggcuuauauccacuuaucaguaugugcauaccgugugauuagguuaccucacucaggauauuuucuaguuccacccauuucccuaagaauuucaugaauucaguguuuuuaauaacugaguacuauuccauuguguaaauguaccacauuuucuguauccauuccucuguugauggacaucuggguucuuuccugcuucuggcuauuauaaauaaggcugcuaugagcauagugaagaauguguccauauugcauguuggggcaucuucaggguauaucuauauaugcccagaaguggaauagcuggguucccggguaauacuauguccaauguuuggaaaaaccggcaaacugauuuccacagugguuguaccaacuugcaaucccaccaucaguggaggaauguuauucuuucuccacauccucacccuaucugcugucaccugaguuuuugauuuuagccaaucagacuacugugagguagaaucucaggguugguuugauuugcauuucccuaaugacuaaggauguugaacauuucuuuaggugcuucucagccauucgauauuucucaguugagaauucuuuguuuagcucuguacuccauuauuaauaguguuauuugauucucagaauucuaauuucuugaguucuuuguauauauuggauuuuagccuucuaccgacuuaggauugguaaagaucuuuucccaaucugaugguugcccuuuucuccuauugacaguauccuuugccuuacagaagcuuugcaauuuuaugaggucccauuugucaauuacuaaucuuagagcauaagucauugguguucuguucaggaaaauuuccccugugcucauguguuugaggcucuuccucacuuucuccucuauaaguuucaguguaucugguuuuauauggcguuccuugauccacuuggacuugaacuuuguacaaggagauaagaaugggucuauugacauucuucuacaugcugacugcuaguugaaccagaacgauuuuuuaaaaaugcuguuuuuccacuggaagguuuuuagcuccuuuaucaaagaucaagugaccauggguguguggguucguuucugggucuucaguuauauuccauugaucuuccugccuuucucuguaccaauaccauucaguuuuuuuuaaucacuauugcucuguaauacagcuugagguccagcauggugauuccaucagaaguucuuuuauuguugagaauaguuuucacugucuuugguuuuuuguuauucaaaaugauuuugagaauuguucuuucuaacucugaagaauugaguuggaauuuugaugaggauugcauugaaucuguauauuucuuugagcaaaaucgccauuuuuacuauauugauucugccaauccuugaucaugggaaagcuuucugucuuuugagauauucuucgauuucuuuucuucagagccuuguauuucuugucauacagcucuuucacuugcuugguuagagucacaccaagguauuuuauauuguuuguaacuauugugaaggguuucauuucccuaauuucuuucucagccuguuuauccuuugaguggaggaagucuuuuaacuuguuugaguuaauguuacaucacgccacuuugcucaaguugauuaucagcuguaggaguucucuguggggcauugggcuauacacagacaaucuggucuccagucaagcugaggucugaacccuggaguggugauaauucaccuacauggcaugguagguguuaccucaugucuccuggacuuaaggcuccugucgaaguuaccacccccacagcccccacaggagacacauggcuaguaguaacauagacaaugucccaaguuucuguccuucaggcuaaacuccucccaguuaucuagcaacaauaaagauaacagcccaccauaagaggggcuguuuggccccaccucuaucucuccucuccucuccucucacucucuuacacccccuuacucucucuuucuuacucucuaaccuuucuucucuuucuccuuuucucccuucucuccucuugaccauggcuggucucucucucucuuuuaccucucucuuucccccugccuuucuacaauaaaacucuaaaacuauagacuguguucaucaaggccugcuaugcuuggaugaugggauagcccuuccuuuaaugagccauuucuaaucuacagauggaaggccuuccuguguuccaguaaaggccuggacuaagaacucucaccagccugggaaccucucucccucaucccucucuccuguaacuucagggccgaggaugucacccccggccccugguaucgagggcugccccuuguccaaccccuguagaguggggucaguggcuuagaugcccacccaaggccaaguggaaagccucuggcagcccucccgcauaugccugcccagagcauaggagaaacucuggcuggaggugggcuuaucccuaaccccuccuuccccaacaccccguuaguucccacaguucucugcuauuauuuuuggugucacgaaguauacuauaauaucugcaaauagugauauuuugacuucuuccuuuccaaccuguauuccuuugaccuccuuuuguugucuaauugcucuagauagaacuucaaguacuauacuaaauagauagggaaagaaugggcagcauuuucuagucccugauuugagugggauugcaucaaauuucucuccauuucauuugauguuguuuacugauuugauauauauuguuuuugcuauguuuagauaggagccuugaauuccugaucuuuccaagacuuuuaacaugcagcauuuugucaaaugcuuuuucagcauauaaugaaaugauuauguggaguuuuuuuucuuugaguuucuuuauguagugcauuauauugauggauuucuguauauugaaccaucccugcaucccugggaugaggcauacuugauuguggugaaugaucauuuuaauguguucuugaauuaaauuugcaagaauauuauugaguauuuuugcaucaguuuucauaagggagauuggucugaaguucucuuucuuuggucuuuuuguguuuuagguauaagcguaauuguggcuucauagaacgaauuggguaguguuccuucuguuuuuauuuuauggaauaguuugaagaguauugguauuaggucuucuuuaaagguuugaacaaauucugcacuaaacccaucugguccugggcuucuuuuugguugagagacuguuaaugacugcuucuauuucuuuugggguugugggacuguuuagauuguuuaucugauccuguuguaacuuuuguaccuguuaugugucuagaaaauuguccauuuuauccagcuuuuccaauuuuguugacuauaaacauuugcaguaguaucugauguuucuuugaauuuucaugauuuccguuguuaugucucccuuuucauuucugauuuuauuaacuuggcuacugccucugugcccuuuguguagucuggcuaaggguuuaucuaucuuguugauuuucucaaagaaccagguccucauuuuguugauucuuuuauaguucuuuuuguuuccacuugguugauuucagcccugaguuugauuauuuuacuguuguuuacuccucuugggugaauuugcuugcuuuuuuucuagaacuuucagguaugcuguuaaacugguaguguaugcucacuacaguuucuuuuugaagucauuuagagcuaugaguuuccucuuaccacugcuuucuuugggucccauaaguuuugguaugaugugucuucauuuucauuaaauucuaaaaagucuuuaauuucuuucuuuauuucuuucuuaaucaaguuaucauugaguagaguguugcucagcuuccauauguauguguguuuuacauuguuuuuguuggaauuuaagaccagcuuuaguccaugaugauaugauaggguacaugggguuauuuuagucuucuaucuauugaggccuguuuuguggccauuauggucaguauugaagaaggugccauaaggugcugaaaagaauguauauucuuuugcuuuaggaugaaauguucuugcuauggugggacaguggguucuggugauauaacugguuucuguugcuucugguuuuuuguuuguuuguuuguuuguuuuauuuuuccugcgacaggguuucuauguguagcccuggcuguccuggaacucacucuguagaccaggcuggccucaaacuaagagauccaccugccucugccucccaagugcugggauuaaaggugugcgccaccacugcccagcauuucuucuguccuuaaguguguuucccgccaucugauuaucucuagugcuaccuuuccuugcuauaucugacuggagccuguccuuucuguaauccugguugugucagaacucuauagaguccagcugucucugcgauccugugauuugggguagugugaucuugagaugcuaggugugucaaaguuccuggaagucaagcuaccucuggguucaugagaucuucguguggaguugaacucacauagauccuccuggcuuuccucugaaaugcuaagauuaaagacauacaccaccaugucagucccucaguuugguuuuauacaauuaaauguaccuuuaaaacauguuacuuauuuuauuuuaauuaaauuugguuuaaaugagaaugaauuuaucaaaaaguauauacaaaugagauagcauguaacuuauauacauugaauaagaaauuuaaacacacucaaauauuuacuaauugaugaugaaaacuuuaaaaauaaagugucuucagacauuuaagcaaaauugaaaagaacccaggaauaauacucauguuuugucauguauaaaugaaaguacaauggguuaugcugugugggcacccagaagaaaacaaaucaucauaggucauuucccagcuauccaaagucaucaaaauggguauucaagaacagaaggaucuugggacccaaggagaugguucagguuauaaagguacuugcugucaagcgugaggacacaaguucaaucuacugaccuacaugguagaaggagagaaacaacuccugcaaauuaucuucuggcuuuuacuuuuauaccauggcaugugugaaccagugugaauaacacacacacaaacacacacacacacacacacacacacacacacacauuuauguauaaauagauguaaaaaguuguugaaaaggaaugaagagccucguuuuuaaagaacagacaguauguauugagaaaggguauaugcgaucuggagauaggugccuuaaaucaacuucaagacugagucuaaaugucagaaaauugguuuuaaaauauggccaaauaaccaucugagcacagacauuaaacauuaugggaaaugugaauuggauuuaaaagcuacaaaaucuuagauaauuugagugaguaacucagaugguguauuuuaacccuccacuuuccugugugaauaaaggugaacuuuuuggaaagccccgaugcaacaaguaaugaaaugaagacaauuaaacaaaagauauuagguauuauuguuacaaauaaaacaaagucuuccuaaagaaaauaggaagucaaaugaugacugaaaaaucugaugcuacaucauuagauaugcaugugaaauauccuagauaaaccuucuaaccccuuuaaaagcuucugaauaaagcauguacucaaagaagcguauuugauaggggauaacuuccacuaccaacacaguuauagcaaagaagcaaagguaaagauaguuuuagaaaauagaaccaaggucaacagcuaucagucuccauauucacauacagaggaauaauggucuuucaaauguccaugacauauuuacauagcuaauggugacccacaacacacaaaacccucauuauauucugugccaccaauaaugcuaggaccucugaccugaccccauuuuaggaaaauauccuaucagaaucuuauuuuuuuaaugauaaauuuaagaguacuugaaaaguaugggaaugguaaaaauaccuucuuaacauuuaguuaauucaggacaaaauauacaugaaaauguugucaauuguguaacuaaggaauggacauggaacacuaaaauuuccagaguuugcccagaaccaucacugaagauauguuaauaaccuuuucugcucauuauucagaaucaaagaugguuaugaauggaacuugcuuuccauuugguaauugaaacaugagcaauguaguggcccauagaggauggcaauauauauacaacaauguugaaauaaugacuggaauucauuacucauucaccaugcaccugauguagcucuaagcacuugguguggauuuacuuaggucauuuucacugauuugggaaugaguacuguuacaauucuauuuuucaaaugacaaacuuggauacacaguuaccuucaucaaggcuucuuagccauaaagugcugaaaauggaccccagucuucucuaugaggucugugcugauccgucaaagugaaguccuauugaagaaaacuucuuugugcaguguauggaagauaacagagcugcucgacuggucacagugcagagaauaaaggaauauugaaugcucugucagccuuauccuaaacuuggugguaggaggugggggguagaaaauagaaagagccaaagguuggagagaaccacugcaaaaaaugucuucuuuauaugguuauuguauaugaacucucacagcaaugauuaccuaaacaagccaggcacauaaucgagccuaucaguaugccaguuagggauaggggaggggaucacaaggcccuauuucucucucagaccuauugcugcuugcuggcugcuggggaaaggagaguccauuuuugucaaggauacuugggaagcuuuauuucuaggucauccaugugcagaaagcuauagauuggggccguagcuguacauggcauccucucugcuccauuugcuaagccuuacccucucucuccuguauaaagagcucaugucaagaguaaugcuuaaucuacacuucuacucaacauuucuaacuuacaugguugugugggggggggugucugcgggugugugugugugugugugugucuguguguggggggggugcaucugugggugugggggggugucggugugucgaugugggggguguagagcaggggaaggaggagugagagagggacaaaguaggccugugcaugcaugugcagaguucagaggaagaugucaagugucuucuaucacucucugccuuacucccuuaaaacacagucucacagugaacuagagcuugguuuuugcuuaucuuuuuuuuaagauuuauuuauuuuauguauaugaauacacugaagcugucuucagacauaccaggaaagggcaucagaucucauuagagaugauugugagucaccaugugggugcuaggaauaaacucaggacaucuggaagaggagucagugcucuuucuuuuuuacuuuuuuuuuucuuaauauaguguauaguuuuauuuaaaaugaaaauuugaaaauaaagcagaguaaugacauauaauauagcacacuaaaggaaauaacuuucuaauaauauuuuuguuaucacauuuagaaauucauaucuauuuuuuauuagauauuuucuuuauuuacauuucaauuguuauccuaguuuccccucuguaaaaaccccuauccucucccccuucccccugcuccccaaccuacccacucccauuccugguccuggcauuccccuauacuggggaauaaagccuucacaggaccaagagccucuuccauugaugaccaacaaggccauccucugcuacauauauagcuagagccaaaguuccaccauguauuuucuuugauuggugguauaguucuaaggagcucuggggauacuuguuaggucauauugauguuccuucuauggggcuucagucuccuucagcucccugaguauuucucuggcuccuucauuggggaccuugugcuccaucaaauggaugacugugagcauccacuucuguauuugccaggcacuggcagagccucucaggagauagcuauaucaggcuccugucaacaggcucuuguuggcaucugccuagugucuaaguuuggugguuauuuaugggguggauccccaugugggacagucgcuggaugguccuuccuucaggcucugcuccacacuuugucucuguaacuccuuccauggguauuuuguuccccauucuaagaagaaaugagguauucacacuuuggucuuucuaaacuugauaaacagcuucagugcaguagcuggauauaaaauuaacucaaacaaaucaguggccuuucucuacacaaaggauaaacaagcugagaaagaaauuagggaaacaacaaccuucacaauagucacaaauaauauaaaauaccuuacugugacucuaacuaaggaagugaaaggucuguaugacaagaacuucaagucucugaagaaagaaauugaagauuucagaaaauggaaagaucucccaugcucauggauuggcaggaucaacauuguaaaaauggcuaucgugccaaaagcaaucuacagauucaaugcaaucaccaucaaaauuccaacucaauucuucaccuaguuaaaaagggaaauaugcaaauucaucuggaauaauaaaaaaaccuaggauagcacaaacuauucucaaugauaaaggaaucucugguggaaucaccaugccugacuucaggcuguacuacagauuaaaugugauaaaaaaaaacugcaugguacugguacagcuacagacaaguagaucaauggaauagaauugaagacccagaaaugaacccacacaccuauggucacuugaucuucgacaagggagcuaaaaccauccaauggaaaaaagacagcauuuucaacaaguguuacuggcacaacuggugguuaucauguagaagaaugggaauugauccauucuuaucuccuuguacaaagcucaaggaacuccacauaaaaacagagacucugaaacuuauagaggagaaaguggggaaaagccuugaagauaugggcacaggggaaaaauuccugaacagaacagcaauggcuuguccuguaagaucaagaauugacaaaugggacaucauaaaauugcaaagcuucuguaaggcaaaagacacugucaauaagaaaaaaaaagcuacuggauuuuuuguuauucaaaaugaauuugagaauugcucuuucuaacucuaugaagaauugauuugaaauuuuaauggggauuacauugaaucuguauauuucuuucagcaagauggccauuuguacauuaucaauccugccaauccaugagcaugggagauauuuccaucuucugaagucuucuucaauuucuuucuucagagacuugaaguucuugucauggaucuuucacuuguuugguuagagccacaccaagauacuuuauauugucugugauuauugugaagagugucauuuuccuaauuucuuucucagccuguuuauccuuugaguagaggaaagcuacugauuuuguguguguguguguguguguguguguguguguguguguguguguguuaauuuuauauucagccacuuugcugauguuguuuaucagguuuaggaguucucugguggaguuuuuggggucacuuaaguauacuauaaugucaucugcaaauagugauauuuugacuucuuccuuuccaauuuguaucucuuugaccuccuuuuguugucuaauugcucuagcuggaacuucaaguacuguauugaauagacugggagagagagggcagcccuugucuaguuccugauuugagugggguugcuucaaguuucucaccguuucauuugauguugacuacugguuugcuguauauuacuuuuacuuuguuuacguaagggcccugaauuccugaucuuuacaauacuguuaacaugaagggauguugaauuuuguuaaaugcuuucucagcaucuuauaaaaugaucauguuucuuuuuuuuuccuugaguuuguuuauguaguguauuacauuguuagauuuccacauauugaacuaucccugcaucccugggaucaagucuacuggaucauagugaaugaucauuuugauguguucuuggauucuguuaacaagaauuuuacuggguauuuuugcauuaauauuuauaagggaaauugcucugaacaucucuuuuuuuuuuuuuuuuuuuuuuuuuuuugguugggucuuuguuuuugguaucagccuaacucuggcuucauagaacaaauugaauaguguuccuucuguuucuaguuugugaaauaauauugaguauagaguauugguauuaguucuuuuuugaaggucugauagaauucugcacuaaaaccaucuaguccuggacugguuuugguugggagacuuuaaaugacugcuuauuucuuuaacgauuuugagauuguucaggugguuuaucugauccugaauuaauuuugguauuugauaccugucuagaaaauauuccauuucauccagauuuuccaguuuugucaaauacaggcuuuuguauuaggaccaaugauuucuugaauuuccucaguuucuguuguaguaucucccuauaaauuucugauuuuguuaauuuguauagugucucugugcccccuaguuagucaggauaaagguuuacuuaucuuguggauuuucucaaagaaccagguccuuguuuuguugauucuuuguauaguucauuuuguuucuacuugguuccuuucagcccugaguuugauuguuuccugcuguuuacucuucuuggguguauuugcuugguuuuuuuuuuuuuuuccuagagcuuucaggugugcuguuaagcugguauuguaugcucuuucccauuucuuuuuggaagcacucagagcuaugaauuuuccuguuagcacugcuuucauugugucccauaaguuuauucauuaaauucauuucauuaaauucuaaaagucuuuauuuucuuuauuucuuccuugaccaauuuaucuuugaguagauugauauucagcuuccauguguaugugugcuuuuuguuuuuuuuguuguuacugaagcccagccuuaauccguagugaucuaguaggaggcaugggguuauuucagucuucuuauaucuguugaggucuguuuugugacguauuguauggucaguuuuggagaagguaucaugcggugcuaaaaggaaguuauauucuuuuuauuuaggacgaaauguucuauauuuaucuguuagaucccuuuggucauaacuucuguuaguuucacugugucucuguuuaacuccuguuuccauuaucuuuccauuuuggaggauaguuguucagaauugagaguucuugguagauuuucccuuugaucauuuugaaguguccuuccuuauccuuuuugaugacuuuugguugaaagucaauuuuauccaauaguagaauggcaacuccaacuuguuucuuaggaccauuugcuuggaauuuuuuuuuccagcccuuuacucugauguaguauuugucuuugacacugagguggauuucuaguaugcugcaaaaugcuggguccuguguccagucgguuagucuauguauuuuuauuggaaaauugaguccauugauguuaacagauauuaagcaauagugauuguugcgcccuguuauuuuucauguuauuuuuauguuuguaugauuaucuucuuuuguguuuguugaaagaagauuacuuuuuuuuccuuuugcuaagauguaguuuccuucauuguguugucguuuuccaucuauuauccuuuguaaggcuggguuuuuagaaagauauuguguaaauuugguuuucucagggaauaucuuuuuuuuuucauuuaugguaauugagaguuuugcuggguauaggagucugggcuggcauuuguugucucuuagugucuguaugagaucugcccagaaucuuguagcuuucuuagucucuggugagaagucugguguaauucugauccuucuguauuuuucccuuacugcuuuuaauauucuuuguuuagugcauuugguguuuugauaauuaggugacuggaugaauuucuuuucuauucccgucuacuuagaguucuauagguuuuuuuuuuauuacauauuuuccucaauuacauuuccaaugcuauuccaaaagucccccauacccucccccccacuucccuacccacccauucccauuuuuuuggcccuggcguuccccuguacuggggcauauacaguuugcauguccaaugggccucucuuuccagugauggccgacuaggccaucuuuugauacauaugcagcuagugucaagagcuccgagguacugguuaguucauaauguuguuccaucuauaggguugcagaucccucuagcuccuccauugggagcccugagauccauccaauagcugacugugagcauccacuucuguguuugcuaggccccggcauagucucacaagagacagcuacaucuggguccuuucaacaaaaucuugcuaguguaugcaauggugucagcguuuggaugcugauuaugggguggaucccuggauauggcagucucuagaugguccguccuuucgucucagcuccaaacuuugucucuguaacuccuuccauggguguuuuguucccaauucuaaggaggggcauaguguccacacuucagucuucauucuucuugaguuucauguguuuagcaaauuguaucuuauaucuuggguauccuagguuuugggcuaauauccacuuaucagugaguacauauugugugagauccuuugucaauguguuaccucacucaggaugaugcccuccagguccauccauuuggcuaggaauuucauaaauucauuauuuuuaauagcugaguaguacuccauuguguaaauguaccacauuuucuguauccauuccucuguugaggggcaucuggguucuuuccagcuuauggcuauuauaaauaaggcugcuaugaacauaguggagcauguguccuucuuaccaguuggaacaucuucuggauauaugcccaggagagguauugcgggauccuccgguaguacuauguccaauuuucugaggaaccgccagacugauuuccagagugguuguacaagccugcaaucccaccaacaauggaggaguguuccucuuucuccacauccucgccagcaucugcugucaccugaauuuuugaucuuagccauucugacuggugugagguggaaucucaggguuguuuugauuugcauuucccugaugauuaaggauguugaacauuuuuucaggugguucucugccauucgguauuccucaggugagaauucuuuguucauuucugagccccauuuuuaaugggguuauuugauuuucugaaguccaccuucuugaguucuuuauauauguuggauauuaguccccuaucugauuuagguaaagguaaagaaccuuucccaaucuguagguuucuuguguguucaugagcauaucucucucucucgcucuugcucuugcucucgcucucucuuuauguuauggaaguuuucuucuauaauguuauugaagauauuuacuggcucuuuaaguugggaaucuuugcucucuucuauaccuauuauccuuagguuuggucuucucauugugucuuggauuuccuugauguuuuggauuagaaauuuucuucauuuugcauuuucuuugacugauguguuaauguuuuucuagguuaucauaugcaccugagauucucucuucuaucucuuguauucuguuggugauucuugcaucugugaccccugaucucuuuccuauguuuucucucuccaugguugucucccuuugugacuucuuuaguauuucuguuuccauuuuuagaucccagaugguuuuguucaauuccuucaccuguuugauuuuauuuuccuauaauucuuuaagcaauuuuuguguuuccucuuuauggucuucuaccuauuuaccuggguucucuuaauauuucuuuacgggaguuauuuauguccuucuuaaaguccucuaauaucaucaugagaugugauuuuaaaucagugucuuauuuuucugguguguucagguaaccaaggcugguuguggugggagaacuggguucuguugaugccaaguagccuugguuuuccacuugcccuuugccgucugguuguaucuggcgugcccugauggguuuggagggagagccccacuugaaucaggaaucugaagagaagugguggucuuuccuguguuugcagcuguguaggcacuccugggagagcagcucucuccuagagguauauguagcucuguggcacaggaucaguucugcgcgcaaagggaaacuggaagacuccuuucccaagcagcuccuugguuccuguauggugagguuucugggcagguuucucugagcagcaguggugggccuaucugcacucacaugccugucuccauuccugguaggcuagcucucucacagugcucuacaguuauuuuuaaaagacuuuaucaagucacaauuuuuaauauuuuucuguauaaguuaaacuauuuaggauauaauacguauuuuaaagagagaaaaguggcaucugcagcauugacugggcagcuaagaacacuugcugcucuugcagagcaccugaguucaguuucccacagcaaauaucccauagcuaccuuuaccccaggggauucagcugcuacuuguggucugacaccaggcacacacgugguacacauaagcauacacaugcagaaauucauacccauaaaauaauagguuaauucaagaauaaaaagacagaaaaggucuuuugguccaaauuuaaaggcauguaccucucauaccuacucauacaggaaacacauauaauaguauguagugguaccuuagguacaaaugaucuguuuugauuuucuuuuuuuuuccauuauuuauuagguauuuagcucauuuacauuuccaaugcuauaccaaaagucccccauacccacccacccccacuccccuacccacccacucccccuuuuuggcccuggcguuacccuguacuggggcauauacaguuugcguguccaaugggccucucuuuccagugauggccgacuaggccaucuucugauacauaugcagcuagagucaagagcuccgggguacugguuaguucauaauguuguuccaccuauaggguugcagaucccuuuagcuucuuggguacuuucucuagcuccuccauugggagcccugugauccauccaauagcugacuaugagcauccacuucuguguuugcuaggccccggcauagucucacaagagacagcuacaucuggguccuuucaauaaaaucuugcuaguguaugcauggugucagcguuuggaugcugauuaugggguggaucccuggauauggcagucucuacaugguccauccuuucaucucagcuccaaacuuugucucuguaacuccuuccauggguguuuuguucccaauucuaaggaggggcauaguguccacacuucagucuucauucuucuugaguuucauguguuuagcaaauuguaucuuauaucuuggguauccuagguuuugggcuaauauccacuuaucagugaguacauauugugugaguuccuuugugaauguguuaccucacucaggaugaugcccuccagguccauccauuuggcuaggaauuucauaaauucauuauuuuuaauagcugaguaguacuccauuguguagauguaccacauuuucuguauccauuccucuguugaggggcaucuggguucuuuccagcuucuggcuauuauaaauaaggcugcuaugaacauaguagagcaugugucuuucuuaccaguuggaacaucuucuggauauaugcccaggagagguauugugggauccuccaguaguacuauguccaauuuucugaggaacugccagacugauuuccagagugguuguacaagccugcaaucccaccaacaauggaggaguguuccucuuucuccacauccucgccagcaucugcugucaccugaauuuuugaucuuagccauucugauuggugugagauggaaucucaggguugcuuugaacucaaaugacauguacucacugauaaguggauauuagacuagaaacuuagaauacccaagauacaagauacaauuugcaaaacacaugaaacucaagaagaucgaagaccaaaguaugggcaauuugccccuucuuagaauugggaauaaaacacccauggaaggaguuacagagacaaaguuuggagcugagaugaaaggauggaccaucuagagacugccauacccggggauccaucccauaaucagccuccaaacgcugacaccauugcauacacuagcaagauuuugcugaaaggacccagauauagcugucucuugugagacuaugccggggccuagcaaacacagaaguggaugcucauagucaucuauuggauggaucacagggcccccaauggaggagcuagagaaaguacuuaaggagcuaaaggggucugcaacccuauagguggaacaacaauaugaacuaaccaguacccccuggagcucgugucucuagcugcauauguaucagaagauggccuagucggccaucauugggaagagagacccauugauuggucuugcaaacuuuauaugcuucaguucaggggaaugccagggccaagaagugggaauggguggguaggggaaugcggggggggggggggggcuauggggggacuuuugggauaucauuggaaauguaaaugaagaaaauaccuaauuaacaaauuuuaaaacaaaagaagauauuuauaggagaagugaaacgucauacuuagaaggucacugaaaacuuguuucacacaaguugggcagucagggaauggaaagucacuccugaauuagcuacuacugugugugugugugugugugugugugugugugugugugugugugugugugugcaucuacguguuuucagcaaagaauguagaguccaccucuggaaagacagcagugaacaucccuuaucaguguagguuucgugugaggaacuugcuuacuucagaagcaguaauuagucauaaucaguauuuaucaguuuuccuuuccucucucuuuuuuaaucuguggcuuuccaguuaaccaguuuggagaucaaguugaauaacuugccucuaauguuuguguggaaggccuccucagggcacucuccaagcucaaggguagaggauagcucugagaauaccccugaaagcacaauccaauuaagagucucgcaguucucaagugauucacauuuggaggagcuggucuuuucuccuagcacuguuuugacuuagcacaaccacgaacaggggcagccugacuccagucuguuagcacugggcaguugaagucacuucagagaagcguuuugacuagaaacugagcuuggacugaggcugcaauugccccuaaagaugaggaagggagaaggcacuuuccguuauuagguacccagagguuuaagaagguggcaggaagucauagaauauucuauccgguguuauaaauggaaggcagguuuucauucuguuuuacaaaauaaucuccugucugccuauuaucugcagagcuuacccgugaacauuaaaacucuucaugcugcacacucugaaaggaaagacugucauuccuguaucucuguggcacuuuauucuucuguuucugauugaggagaauaauaauaaaccaaacguaaaauugucacccaaaucacucaagaguuuucuagcuuucagcaugcauagagucagagugugugugugcacucuaagaagcaagccacaaacggaaccucuacuccauucugagcuucuuugaaagcgcuaugcuuuacagguuagaaugaugagugaggaacacagaaguuguccauaaggaucuccugugugcccagaguuaccagugagagaaaagggugggagaagugugcuuagcagccaaucagugcagagaaaauuacccucauauuuagaaaaccaggccuuaauuuuauaggguacagaaucaaguccaaaauaaguuuccccaaacuacacagcauauggcaauaagaaggauggucuuuguucagcuguuuagaguucuagucuuauuacugaucaacuugcaacagaaugacaacuauagacccugggauuauccuaguaucugugauauggucagaucuaagaauuuaaugaagggauggguucugaagacagaugucuugguggacaaaccaagaaaaaacaaauuuuguucauguccuuuuauccuuuuggaggccagcucugguaguauguucagugaucuaaggaggagaugcggcucggugauuaauauaaagcaggcccacacucacacaugcgugguggacgaaacaaggcuccagugacuuuuauuuccucuuauucuucauauagcuuugaaaaaaauucucuauguaaggaaaaagaucaccugauagacucuaauuaauauauugccuaacagaugaauaugcucaacuauuauguauuucauuaucccugaaauaaugguguauacaaaacgggcagggacacucuaccugauagagacaggggaagggaacuggggagaugcucaauaaagugcuuaccuggagaaccugacuuugauucccagaaugcaugcaauagacugggugugguguuacaaacuuauaaucccagcacuagggaggcagaaacaggccuguuacaacuguacauacaugcauauguauguguguggaaguguacauguauauguggaucuacuguggcacauccuggaguugggccccaucagaaaccuccccccucuaauuuucaugcagagcaaaugucccugugcucuugacccuguauggugaacaucuaguauucagaugccucagaaccagcacuuggcauuguugagggagcuucccaggcauggggcucacauaccuugauuuaauguggaauuuaagguuauacuuaucugcagggcugacugguacuuagcucuagcagaaagcuacagccugacuugcugagacagggccaaugaagggaggcauugcuuacugucuuccaucaagacaggucuucucuggaccaguuacugaguaacaauguucuuccaaaccuuaggucccauuugaggggcagaacaucagcuuguauuuugacucuugccuccuuuccucuugaaagucuuucuuuuccucuacagaaugaaaaaauaauuuccagugggucaaacaggaaacacuuaccaggcaaaaaagggcugugugugugugucugugugugugucuguguguguguuuuugugugugugugugugugugugugugugugugugugugucugugucugugucugugucugugucuguguguaugugugugucugugucuguguauauagguuuucaacagucccuuugaauaagguuccuuaucucaguauugauaguuugggucuggcaauuauucaugguuaaagauguucuuucugaggguacugagaacccagaccuggucuugccccauaacccccuuguaauguacacacacacacauuuugacaacugagaacaucucuaagcuuugucaaauaguuucaugucacccacacauaaggaucuuaaaacauuggggugacccuauugucuaggaaaaugcugacuaccuuggcuucagaauagagcuggugacaugaaauaaacagcugaaaaucccggaguguuuccugagucuccuauccgaaacugucuuugggcuugccuggcuuacuuccuacacuucaauuagaaaacaaaggaaaucuggucuuggggcagccagcugggcuaugaagcaugcauagaaaucacaaugugauacauaacauauguaccuagugaaagcaacaaugugcuucauauaacugguuuuaccaaaaggcauaaucugcuuuuugcucucuggguucacuguuugaauuugucauccugaauucaagaaccccaguggguuuuuaauccauucacuauugguuaaauaauauguuugaagagaaaauagcaagugaugaucaacaucuuauucucaggcauaauagcccugcugaaacuccccuuucuuguccccuguuguuauuaauacaguguuauuacuuaauguacauugaguuccagagggugcucaccgccuuccuauuacauauacauaauacauaaaacuuacucuuaaaaaccagccauuauaaccaaggacaggaaaucacaagagcugacagcugugguaaggcuucaaguucuuugcuugcuccgugugaucaggcacuuuauuccacuguaucccuucuugacgcagaaucaacuaacaguguacaugcgugcugacuugggugacagucuguucagacauauguuuucaaauucugaguucaggacuuacuucauuguucugauugcuuccacauaaagauugcuuucaauauucccagagaauuaauaaauacaaaguguguagggacuuggcaguauguauguauauuuacaaccauguaaaguuuacaaagcuacaucacucauuuguucuuguuucuccauaguuugaaguuaggacugaugcauaaauucauuuccccaaguguggccuccaagcuugauuauauggaagaaucacuuguuaaugucaauaacccaaaacagcacucuuccagauguuucugggagcuagccuuauuucuguguccgcugaaccugacgacguugcaauacuaagcaccacuucuagaugcucaaauucauuuugguuccguggcaaauagggguuuuugcuucaaccuuaccuguagaaaaauccccaaacuccagugcacaugugcugcaggccagcaguuauaguauucaaguguauacacuggcugagucccaaaggucaagauggcacacuggcuauguugugaagaacagaauugagagcacuuuuuaauuugagucuuguuuuauuauuccuuugcugauuauuuuguuucauaguuuccuuaauagaauuucaccugcugcuuauaauccugcagauacuggagacaagaucauauuuagauagaaagugauucuuuguuauuaguacuugggauuaccuugaggggguguucauuuaugcuaaacugcaagcauuuugagcuucauauuucagacuugauuuccaaucuccaucucaagaacugcacuaagaacuuauuuauuguuuuuccuucucacugcucauuugagcaucaguuuccacgaguauaaagagcuucacaagaaacacguguaauguuucaaacacagcuccuauagcucuuuauaauggugugauuucuuuggcaucugcauuaggauuauuguguagaggggaaguuaauauuuguaaauugccuuaaaauauugucucuuacauagcaaaaauuuuauaauugcuaccuuauuguucucauaaauacaauaauaugcucuuuuguuaguuauucuccugagauuugggaacaguccaccuuugcuacucuucccuuguuauacaaaauugggcagcauaaugaauguuuugauaaccacuugaagaauuaagagcacucuauuuaauuuuuauuuauuugucuaucagugugugggcaggcauacccuugcuaugguacagauaucggucagaggauaaaucuggaauugaauuguuucucuucuaauuguauaucuggaagacuggauucaggucuucagccuuuacagcaagaaccuuuaucuauagggacaucacauggccuuccuuaaggccauuagaaagacagcaaggaccuuuaucuauagggacaucacauggccuuaaggaucaggccauuagaaagacagcaaggaccuuuaucuauagggacaucacguggccuuaaggaucaggccauuagaaagccuuuugacuaaucaaauacucgagugaaggaacaauggaauuauuuugcuuuauguauuaugucuauucugcuuugugcuaaggauaggaucaagcaccuguguguucuagccaaguacuccacccuugagcuacacucccagcuagguuuuacuauugugccuucuaaggaugauauucuuuucccuucuguauucuccuuuaugguaaauucccccccuagacagcuaguuagccucaacaucuaauuuccuugccaaccaucauauaaauacuaagagccuguuaugaagggugaaugucaauauauagucacacuguaaguagucugaagacuuuaagguuaaguuuaaaauauuugaaauaauaguaagucuuuugguuaauguuaguuaguuuucuuacaugaguagaaggacauucuuuuuaaugaaugacccguuaaaaggaucauuuucucuguuagccaguagaaauucagacuuccaugaaagaguuuuguuucccaugucuugugaaagaaaacaauuuuaaaccaaccagaaauuaauccaguggcgcugaagcuucaugucccugaaugcugccaugugguugaccuaucggaugcugugaagugaguugagggacaacuaaaaaggaggcguuggugagagugagagagcacaucccagaauagagaaagccacugucugcugaaacugccuugugauucaauccagaaugggaagcagagcuuugggacucuggagugcuguacuguacugugcugggauugugcugggauuaccuuuccucgccugccugccugcguuuagcuuaggaugaaggugggaucuaauacagaucaguucuuagcuucuaguuaaaauguuuuccucucuuaucaggaguuaauuuaucugcuaauucaacuacuuacugccuucugcuguaagaauuuaauaucaaaccauuauaauggcugauuuuuuuucuaccccuauacaaaucagaggaugcucaucuuaaggauaugugacauaggguacacugaugguuccccaucacucauuacauuuauuauaacaugauuaccuucauucauacuauuucagcaagaauugauuccaguguuagaaguguguuguguaugugaauucagaaguacacacauaaaaucacauauguauuaugcacaaucuauuuguucaguagacauguauauuuuagaacauuaaaugugggcacaacuuaaaagcuuauguuggggugggcaauuuaaccuuugcauuuucucuguugaccacacucuuauaccuaggucacaguucggguuaauucacacacacacaccuacauaauuauuauuaaaacuaagcucugcuguaggcuugucaaagacugaccaucuggcuuagaacuagaacuauauauuagaugcucuguaccuacuccuguaauaaacaucauacaaaaauucucuuaggucuccggaaacugucaauuuucccuuaaggcagaauacuggcgcaucaggcuuaaaagucacuugagcuuugguugaaagcaugauugaaucuguguuagagaagucacucaguaagccagggauuuguuucucugcacauuuguuuggguucgaugcaggaucucuuguagcccaggcugaccucaaauucauuguauaacugaggauuuccuugaacuuugaauuuuccugcuuccacuuucucagugcuggcauuucaggagugcagcaucauacacaucugguguguuuguugcugggugagcauaaagcuuuaaagcuuugugcuugcuggacaaguguucuaccgacuuggguggguccuuaucucuuuagccagaauuguuugugucacuucauugguucacuuugaaacuauuugcaaaguguauucucugugcccagccaugauaugucuguagauagauagauagauagauagauagauagauagauagauagauauacauauacacacacauacacacacacacacacacacacacacacacacuguguauuguacuaagaacugcagcuucuaaaaauauuaaauccacgugauacaggaacuaauguaauuuucucuccauaguauauugaaaaauauaguaauugagaaggcagcaauauuucaagaaauuaaauggcuacaacaguccaguucacaaaucacaacucugggugcugagcagaacuacauuucagaaagugaaguggggaggagggagaaugcugcagugaaugcuccaguggccaaucuucucaaacuccacagaucuaaacaaagucccccugcgacugaaaugugaugagaggaagggacucuguacacagacaggagugucuggcaucauguuccucuuggcucacugagccucugcccuuccagguuggcuuauauuuacagagugugguuugcuaguagcuuucuguggcuuuuuaugugcuagccagcaaggguuugguuaggcugugaguacacauuaaguaagucucccuugaugcuuugucaccuauaaugaccaucuuugagguucuucaaaguuccuuucaaagaugcugauguuggaagacaugagccauagaauucagcauuucaguugauguugcuugcuaaaaauaucaccaaaacauuggcuacuuguauugaaauagcauuucuaaguuugagaugucauaagagauguggaagcaacuccagagccuaucucaacaaaacuuguuacuaauuuuuagaaacaucuucucuucuuguacuuccagacagcuaucagcuuucaaugggacacugugccucaaagcugucaaugaccuguucugaacauagagcuaauuaggacucagcgugagcagaucagccaauaaaagauagacuaaugcuuguuuugggguuuccuuugcuuagaguuacuuaaguuauaaucuguagagauuagaaucaccuacaaugcugacagaaagcuacagauuccugguccuuacaccaaaccuaaugaaucuaggauguauccaggaaucugcauuuuugguacauuucuuccagauuaauaacccuauaugguccuucugaugcuuuccaguuuccuucugucacucuaacuuauucucuaaagcauguauuccaaaaacacaggugagacuggauaaaucuucuaguuaguacaaguccuuuuauuuuucccacucugucuuuaguagcgcauaaauacuuugcaacuuucuacccuuuccauguguuccucuaucacuccuaaccccuagacagacuuuggccgugaaugacuuaaugggcaaaggcacauaaacacagaaagaaaugugacuuuacaaguucucuucuuacauucacauucugacauacacauauuggcacauuugcugacaucaugcacacauuacaguacucaugaauauuagaaaaguaucaaaugauaguuacuuuucagaaacacacacagucauguguguucacauacuuggcuuucuguuuauauuucugggccuuuaauacuggcaccuauucuauuuucuuuuagcaauuugacaaacuccacuuccagcacaguucugcaggccaaacugagagauuaucuccuccagacaucuuccugccccucccuuuuaaaugucuuucucccagauggcugcugugcacacacucagcauuuaucccagcacuguuuguucuauucuguaauuacagaucuuggagcuuauuuccaagauggcccccaauaaagccucuaguauccacaccauugucagguccuuugccacagcguaucuguguggcuaaagagauagugaagaaauaucacugugcugcuucugaggccugcuccuggauggcaugcugguuuccaucuccucccuugaauucuucacucuagagaaggcaacugccguguugacacuuguacaguuuguugggugacccagguguugagggacagagucuuucuauuagugugcagugugaguggaccacaccaacaggaucacgguggaacaggaucagaucuuuuaacccaaauccagacucugauaccuggagauuucacugccuucuugagcacagccuuacaaggaauccaccuggcaaacuuuccaaauucuggcaugggaaagccaugugacaugauaaauagcuguugcuguuugugauggguguguuuaccaagugacacuagcagugucuauaagugaaugucucuagaccacugguauuggugucuagccccucuauagcaccacaacaucacuagguauccccaaaauguuccugcauaugugcauguaaaggggcaugugcaugugucaagggagggaagugguccacuuugaagguuguccucagucgcuuuccaccuuauucuuuugugacaaucucucacugaauuuagagcuaagucagcuagacugaccagacauugagcuuuagcgaaucucugccugccugauauauauauauauauauauauauauauauauauauauauauauauguauauguauauguauauguauauguauauauauauauauauauauauauauauauaugccauccuguugggcuuuuuuuauacagguucuaggcaguugaacucagguccucaugcuuauuauguauuuagacuaaaccauuucccaagccucccaaaauuccuuuaaaauagcaaagggaaauacccacaaauauagauggcuauauaguaaguacaggucuuguccuuacuucuuuugcccuuaguguuauuaggagaaaaagaaguacccagggccugcaugaagcaccagaauguucauacgcuggacaagggcauaccauaagcauucccaucaucuuaacaguuaaaagaaacucauagacauaaaguucuaggcacuuucccaaagagaccaacuaagaaguuagacuugucagauugguugugguaagcacaggauuuggaauucaacucacagaucucucaagcuggugcucccgucaggauacuucuccccagcaucucuaggagcgggagagacuccaaugacuacaugucccacauuccuuuucuauugcacacauucagagaaguugccagaacaaccacccacaucauaaaugaugucucaaacgcucccaaugacggugacuuuuaauuuuuuaaaaaaaugugucaaggugauuuccuaaacuuguuuucuaucauacaguacaucccaacugcaaccucaccucccucaucucuuccuagucucuuccaacacaccugcccuaguuaauaucagaccaggcacaaaccaucauaucagggcuagacaagguaacccaguaggaagaaaagggucccaagaguagguaaaauaauaaucagacauccucacucccauuauuaggaguccagcaaaaaauccuaaguaaacaauuauagcauguaugcagaauaucuagcacagacucaugcaaguucugugauuguuuccucaaucuuugugagccccuaugagccuugcuuaguugguuuuauggguggaguuccagucuccuugacuccuguaacuccuacaaucccucugcccccucuuucauaguguucucuggauucugccuaauucuugauuguguguauuuauaucugcucccaucaacuguuggaggaagccucacugguuuaagcacccaucuaugaguauagcagaauaucauuaggaauaauuacauugacuuccuuccuuccucccucccucccucccucccucccucccucccucccucccucccucccuuccucccucccucccucccuuccucccuuccuugcacaacauuucauugacuucuuucuuuuguuuuaauucuuaauuuuuugguuuuuucugagccauguuugauuguauaguaagucucugagcuaucuagcuucaggauccugaccauccaugcagcauuagacauggucuugcucuccugucuugggcaucaaguuagaccaucuugguuggccacucccauaaucucugagccaccauugccucagugcaucuugcagacaggacagauuugguauucaugguuuuguggcugggcugcaccacugagaaccuauccugguuacagaagaugcacugcaggcaucauauccucuuuuaccaggaguccuugauagggucacucucauauguuccaggaaguuuucaccucccuagguuuucauaaugccuccuaaacccccaccuauccaguauuucuuccuguccuaucccccucccuccccaaccuguuccccccuguucucaucucuacccuccccaggccacauauaaaaucuauuuuccuuucccacauagcuccacagcacccaucuuuaccuaaauuaucugaaucuauagauuguacugucuuuuucuuaauagcuaauauccaguuauaaguaaguagauaucauauuuguuuggggggucugaauuguuccacuuaggauuuuuguuuguuucauccacuagccugaaauuuuuaugauguccuuuuuuuuuucuaauaccugaguaauauuccauuguguaaauuugcauuuucuuuauucuuuguuugagagucaaggugaucuuuauuuuacaaaaaaaaaaaaaauguugauacguguaaggaacuuuuuuuuuuuaaggaguaaauauggacacauagugauggagaaaagcuuacagauuauaaauauacuuaaucccuaggaagaaaggaguaauuuuauuuuacagaugagaaaauuaaggcccagggagauuuagaagcuaccaaugucuaacucuaaagccuuggugccgaauugugguggguuuuuuuuuuuuuuuaauauuuuccuggagccaacugaaugguucagcgguuaaaaacacuggcugcacaauccuaaugaccuuaacuugaucccugagauacacacuguacaaggagagaagaguuucucacaaguuauccauacuuccacaugcaugcacccacacaauacuaaauuaauguaauuuuaaaaauuaauaucuuccuuucuggugaccgugguucugccuucgaagcucuuugcuuuuaagcaggagggcauaauuugauaucuggaucuggauuagaaacacugcacauaguaauguaugcuugcacucuaggcagaggcagagguagaagcagaguaccuuaggauucgucagucaguuugccuagcucgauuggugagcuacaagacaaggagagacuuugacucaaaaggcauggaagacguucuugaagaugacaccugagacugucuuguccuaugcucucuacauucacacacccacaugcauauaugcacacacguacacaaaugacuugcuagugaauuaagcuguguuuagauggagagagaauuuuauucugacccuuauuagaaacccaaaaauguaggagggcugcaaugagaagagacaggaacaauauaacccagccuuuauauauugugguuaaguacaagcaaauggaaggcuuuuagguggugagggugggucucaauaaauuaacaugcucucuccagugugccuaaaacaucauaaaugccaaugcauuuuuucccucuuaucuuuauugcaguaucuuagggacuacugagaauccacauuuccaaugagaaguugguguccuuuccuagccaaaccagacgucaccuucccccacccccacugcaccugccucuguauugucuaucaaaagcuauaaacuuggugucauagcuugcacaccacugugccucauuucuuuuuuuuuaaauauuuuuuauuacguauuuuccucaauuacauuuccaaugcuaucccaaaagucccccauaccucccccccacuccccuacccacccauucccacauuuuggcccugguguuccccuguacuggggcauauaaaguuugcguguccaaugggccucucuuuccagugauggccggcuaggccaucuuuugauacaugugcagcuagagucaagagcuccgggguacuaucacuuuuggagaggaauagaccaaugcucacaacacuacacuauuagguuuuguaggucacuuuuacaagguuacugaauguucaguauacucgggagcuuuauggaaacuccacuuaguucccaaugaguaacuuagugucagagcuuugacaaggugacuuuuaaacugucaguguccuccauuccugauuugagaagaagccuguaaccugugaucacuucugcucccuucggcaugugcaguagauuguaaucuugggcacagcugcauugcugcuaauuaaaucccccagccacacugcuuagaauuaauaauauaguaauaauauucugcccaucacaauaaggguaacuucaucuuuauugucuuuuuuuaauuauguggacccuuuggcguauuaaccaccauguggaaugaaucuagcagauacuucugucucuguuggauguuuugugaugagugguugcauaaagcccaccuccuuucucuagccaggauguccuucuuaccaugaaagccaagacuuaaugacccuuguuauauuaaagcuuguuccugggugggaagaaaaucaguacccgugugaaugcccuaagagacuacauagaaaagccacacaacacgcuuucuacccagaagugugcuuuuuauuuagcacuccacccuagaggccuuacauuuuccagcagguuccagauugugauuauuuuuuuaacuuuucacaaaggcaaacugcacacauauuuuuacaucagugaugaauagugucuccccucccaacuuccauuuguaaccaccucuuuaacguccuauaucauguauuuccaucauuugauugagcucaaaaucucaaucagcugagcuuugauacugcugauauugacauacuagaaaaaggagaguggcuuuuauggaguuucagcaugaccagcaaauuuugcuuucccauuggcaguguuuaaugucaauauuaagagcucuaguaagucaauauuaagaguggccauugugaugauuaggaaaguuuaggcuuauacaggucaacugacuuagaccucagauagcauggcaaaaauguaacaaguucuuugcucaaacuuuuuguuucaacaagccauaugucuuccaucacacaucauggacauuugcaaagauugacaucucugaucuaagucaaagagaauauugaaaguaaaguuugagcccaggcauaagcaaaacuaagguucugcccauuuaccaagcuacucuugaacauagacccugugggauauugccacaauaaaaaagaauauuuuccaaaccucaaggaguuucagucaaacacaaaagacagaaaagggaaauuaaacaguguguuaguguaguguguaugugggagcgagauaacuuacuuccuuagcuccaguccaaccugaggcagagaagaggugccuccuagaugacaguggcaugcaaugaagaaguagaaagaaacggaagaucaggagagcaguagaaaccauguguguccugggaauaugagccuauugauuaauaauaauaacuacuauuauuacuagauuaauaauaaauguaucugcuacacccaccucauccucuuucuccuaaagauucugucauuuccuagcauuuccugugguuuucuuucuaaauacaaacucauucacacgccucauuuaccuccaauugaacacuuggauuuaauugauuaugaauuaaguugggcacuugaggugacauucaggccuggcucauguggagauuaauuucuguagucucacaguuuugugaugcauccaagugacucacaucuauguuaaaaauaaaacugagagucagggcaaucuaauuagauggcuuaacccaacacugugguucucagucuucaccaagcuguccugcuuuaguaguuaccaaaauagauggauaaguuaaucaaaggucugauuaaauagcacagcuaugcagcaugaaguucugaucgccagguuucagugcaggcaguucuuuggggagggacgaaaugaagaugaauuccaaaagccagaguuuucaugcggaagaguuuuauaaagcauacugagcggaauugcuugcugagaucucugaucuuaaugugauagcuaucuagaaagcuaauucccagggaaacaagagguaguuuggaggaaaaaaaaaaaaaaaaacuggaaccuuccucuggcagauucuugguauagguguaguugugggugugcaugcauuuggaagccagaaauugauguaagguugcuuccucaauugcucuccaccuuacuuuuuaaggaauggucucucugaaccuagaacucaucaauucaauuaggcuggucaaugagguccaggggaccauucaucuguuccuuccgccucccagcacuaggguuacagauguaugucuaccuuuuuauauggguuaugaugauucaaacugagguccugauugcucagcaaacacuuuacuuacugagugaucuucucauccccuccuccaauaaauucuaauagguuuauaucauaccuguauggguugugguuggagguauuggauggucgauguucucauguauuguccuccguucaccugacccaacuuugcauuuuuuuccucuaugaucuguaagguuuucugcugacaguuacuuuuuaaaaaauuucuacccacuauuaacacuauggcuaagcucuuacugguaggcauauauguccagguccuucucaucuuuuucccuucucuuugugcccauaaauucugcuuuaugugcccacugguuuguucugagugaugccuacuagguacuagguauacuagagaagcaagagaauuagauggguuuccagauccacucuugugauuugccacugguauuauguuccccucaauuggaguuuacugcugaaucaaagcagcauaacaccguguggcugucuuuucuggauuauagaaacugcuggccuggcacuguaaauugcaagguuggaccuuucuucccuuccuugccccuucacugaguaacagugccugccuugaauucugcaaacauugcaaggauuaguccuuuugauaguaaccuuuccuuucaaauuccuaguuugagugugacaucuguuuccacccaugaagugaauuuuuagaaggaaguauauuauaucaaugaaagaagguuagaaaagccaggaauagcaauuaaaugaugauacuggaucuugaauucaagugcaacugaugccaacacaccaaggauuuauguuguuauaaauaccaaacuuccugacccuuaacacagugugcguggagagacauaaaacuggggagcucucucaguugcuaaauuacuugccuuguaaacacuuggacccaugcuaguugcucagaaccuguaacugaaaacccaaacaucuugguauuucauugaaguuucagugcugagugagaugagggggcauaaaucccugagcuucagugaaaaaccagugucaccuaauuggaaaaauccagaucaagugauaacccaugccucaaaaaacaagguaaauagugccuacagaaugauaccugaaauugaucuguggcuuccacaaaggugaaugcaugggaacucucuuccacacacauaaacacacacauauauguacacauacaugaaguauagcucuguaaguacuuggucugagugaacugcaucagaaagaggauggaaaugcauaacugcugugcauccuuugugucagaaacuaauuuuagcccucuuguuuguuuauuuuagcacuagucaucaaauccagggucuucuauaugcaagacaaguacucuaacagugcauuccacccuccgucuccuuuaauuuugacaugaaguucguaccaucuccauuuuacagauaaaggaaccuaggcuugagagauuaaauaccuucugguuguggaauccaggcuugaauuccuguguuguuggauuucuuucucuccuuuauacuacccaaguaaaaggugacagauuuugaacacagagggugguacuuaacugugaaaugggcacauguuguugaguucugggagucuucuuuuuuuauggccauagcucuccuguuucaagcagaggaugggguaaaccgaaaaaccaguacccuacaaauauuaaagaauuguagacagaguagguuugaaagaugcaguagguccuaggagcucccaaaggaauauuuuuuucaucucuuuccuagagcauccuuugcccucuuaauaucauaugcaggauuucugugcuagcauuguuuugugucauuaccaauccaaccugucugccuuccuccacugaugaguucauggacacuugcagcuguucauuuaauuuuauggcacaguggugaaauuuuuauagaaauauauucucaccauuagacuuagaauuuaguauuacuuuuucaaauuacaauauaauuacaucauuuaucuuuccuuucauuccucuaacaccuuucauguauugucuuucucaacucuauagcaucuuuaauuaguauguauguauauauauauauauauauauauaugcauguauauguauaucugcacacauauauuuacauauauguacauauacaaguguacauguauaaguauauguacauauauacagauauacauaucuacacauauauuuaaugcauuuauauaacaccaacuauauguauauauacaugcacacagaccugcuuagucuguauaauguugcuuauacauauaugauuuuagggcugacuuaguauuagauagucacuuggcuuucugucaacuguuugcagaauacuuagaugccuacagcacucugucuaaguuugggugcccauaacauuuccuccuuccguguuggcaauucaauuccugcucuuuuugaagucauguuuaggcagcaauguuguugagacuucauggauguggcuucccugacguucucauagaugcagucucacuguagccuuccugguccucuggcucuuacaaucuuuccacuaacauuccacaauguauccugaguuguuuguuuguuuguuuguuuguuuguuuguuuguuuguuuuuucaagacagaguuucucuguauaacccuagcuguccuggaauucacucuguagaccaggcuggccuugaauucagaaaucugacugccucugccucccaaguacugggauuaaagguguguaccaccacugccuggcauauccucaguuuuaagugcaaaaguuguguuuaguaucauuuggugcugggugccauaaaauuacuuucucuguaguuugaaaaguucugguuuucuguaauggucuccaucuguucaaaaagugagugguacacuuaucuguggguauaagaauaaauauuuagaaugcaguuaggaauuuuacuaguuugguagaguagggguuuuagguacuuuccaagaaccauggccucacuauccugguaguugacuagguuucuaguaccaggcacaauuuccuucauguugggugaagcuuaagucugaguaguagguuauugguuaccaucaagauauucaugccacuauuauacucuuguaauacacaauugcugaguguuguccuucaaaggugucaucacucuuggcugcuucccuuccuuggaagcuugcauggcaccuuuugauuuaauuaaguuuacaccuaugggaauugcuucagauuagauccaucucauacuccagguucuguaucuaaagcacacaguaucuuuagcaauacauacuuauugccuaucacuagggagcaaucaagaacaagaaaaauagucuacaauuuuugggggaagaggggaguuucuugaacuuuccaguccaacagcccagaugggaucuccccauacuuggaaucagggauuuuuguuaaauagucuauggcuauuggaggaugcaugaucagcccagaaaacuuuuuuuuuuucauuuaaacuacauauauguagugugcucuccuucucuuuugcacugaccuccccaauuuaaguccuucucucuauuuuucccauuuccuccuucaaaucaauugcaccuugcuauuauucucuaacucucuuuccacauuccuggauuuuuuuuacuuuccugguuucugcaguugccccagguuacauagucaccucugaagacuuguagcuaggaaccucagaugucaaagaaaaugugacauuuguuuuucacagcuggguuacuuacuuacuauauauuuuccuaauuccauucauucaccuuuaauguuuauaauuuuucuuuauagcggaauauaauuccauaguauauaugcaccauacuuucauuggccaucucuuaguuggugaaucuuuaaauugucuaaauuuucuagcuauugugacuagaguggcaaugaaaugggacucccacuugguuguucaucgaggucuuuaucuaucaguagucuucaugccucugccucccagguucuaugugaaauccacccauauccaacucuuaaaaccagugugcucuaaaugaaguuauaaggauaaagaagaugaauauuguuuggauuucugagguucuggcuccauccucauuagaagcuuuauacuguugaaauuaaaauguggaccaugggucacauggagauaccgccacacaauguugugugcuuuuucuccuauagugaucuucacaaauggcauguacagaagaggauuuuaucaaaccuguguauaauuaugggccccgcacuguagcuacaaguauuaggaaaaugugugccuugcagcuuaaugccacucaccuauacugcacugguuguucccuuucugucacaugagcccaguagcccugagauaguugacuuaggucuaucuuccauuacucuccaaugaccaacauuaugcagaugcugaccagguccucauuucagugaggaagcacucacacuaacuuagccgauuauaacauuaaaauagagaaaaacauaaauuagaaaaauaccuugagguuucuuuaguggcaguuaaguuuaaugaauugaagaaauacaaugaggugcuaagcauuuuucuuuuuccuuuuuuuuccccacauaacuuauuuucuucagugggcucauauaacuuugcuaauagcaauaaagccugucuuaaauauuucaguguugaauuuguacuuaauaauuauuucacaaccaauauuuuaggccuaucuugauuuaaauacacuuuuauuccuagcacaacuugauacauuugaacuaaaugaacaaaucuuuaaauccauuuaucuauuuaacaaauuuuuauuggauuguauucugucucagcaugguuuauaauguuaaagcaaugaauccaugugguaacuuuuuuccccuuuucugauuguaacagcucacuguuuaucucuguucucuucuuuccugucuagucugaaguguccuggauucccaacaaacauuacucuggaauuuauggccugaugaagcugguucugaccaaaacucugccugccaaccuggagagagucauuguccuagacaccgacaucaccuuugcaacagacauugcagagcugugggccguguuccauaaguucaaagguaaaaucuagcuguauuuuauucauuaccaagugugugugugugugugugugugugugugugugugugugugugugugugugucugugauuguccaugcauagcuaugagaguuuguguuuucacagaggcguaugccauaguguacauguggagauaaguacaaauuuugagagucaauucccuccuuccacuuugaauggcagaaguuaaacucagguggccaagcuuucagggcacacacuuuaaaucauuuagccaucgucucagucaguguucuuauuuuuaaugugguccuagagauucaucuuagagccuuauaugugccaggcaagcaugcgaccaauuagccauaccccauccagcguuacaucugagaaaggacaugagcuuaaggagaauauuaauaagaaaucacaaauguaaaagucaaaaauuuauuauuauuucugaaaaguuaaaguaaaacugaaaguuguauuucuuuaggaauugaagagauuggaugcaugcucauaggaaaacccauuuuaggugacugcauagucaaauuaucagcuauguuuauuuuuaugaauaugauaaaaguauugguguaucuuuuuguaugcacauuuugaaauuuauuuuuccuauuauuaaaacuagauuuccuucuaauauaauauauacugauuauaguuucuccucccucugcuccuaccaaauuuuuccaccugcccuucucucuggauccacccccuuucugucucuauuacaaaacaggcugguaaaggauaauaaaauaacaauaauauaauaagaugaaacaaaaaguaacacacuagaauaggaugauacaaacauauagaaagcaaagaucaaaagaaaagacacacgcaugcacacacacacacuugguauacauauauauauauucaucucaccacagaaaccuaguuguuuauacacucaguaauuucauaaaaacacaaaaccuaaagccaugauaauaaauaaaaauaaaaggauaaaaacauaaacaaauaaauaaaagcccuugcauuugguugccugucuuccuugcuuguagggcuguuacuacuacuuaguagaugcagaaugcagucugugauaggcgucucaaggugucuuucccugaggaaucagaagggauaaauuccaaggaucucuggucuggccugaaugaaagguucugugggacucugguaugaccagaacugccagaguguuccagcuuucuguuggccaucuaguguugccauguagccuaaccuuaagaguagcuuguuacccccaguuaaacucccuuagagaaaacaaaauauucauuuucaagaggauuuccacuggggauaguuucggguuagggacaggccugguguccacuuucucuuugcagcucuaggacuccaucuguuacagacacugcaggcuguguucacgcugccucaguuucugugaguucaucuauugauccuuguuuucuuggugccuuccauuccucuucucuggcucuuacauucuuucccccuucucuucugcagcuuuuuuuuucuucugagcccugaggggagaaauuucauagagagaucccauuuaggacugaguguuccaaggugucucacucucugcauuucaucucaucauggaacuuuguuuuuguucccaucugcuacaggacgaauuuucucugaugauggcugagucaaccccgaucuaauauagcagaauguaauacuauguucuuuuauugaacagugguauuugauuuuacccucaguaccugaucuuucuaauaccaggcucuuggauaaccagaugagcagguauggguuccacuggauagguggaguaugccuuaagucaaaucaaauauaaauuagguugguuauucccucaggccucuugccaccauuacucuagcauuacuugaaggcuaguagaaauugaaggauuuguagaugggcugguauuuacauuucucauuggguaguaugcagaauauauucuuauaccaaagauacuagccuauugaguugaaggcucuauguagucacuagcucaccuucuccacauucaaugaauuguauaaguauucaauagaaucuaucaacaaccuauaucuuaacaacagccugguuguuuuagggguucccaugggaugucuuuggcuaacaucucaauuagauguaaugcauucuugaaacugaagcuucauuuggugacaagagguggcugacuuugucuuucucaauaguugacuucauguguuuuaggaaacuuuuauuuuauuggguuuccacacuccccuucuaauaaugcauuucauuuuuaguauaucuuucuauauucucucccucaucccuucuuccuccaaacuggacccucaaguccaggucccaaguguugauauuuuuauggagagaagggcacucagcauguaucauuuuuuuuuuaaucaaauaauguuuugacugcugagaaagccuggaaagcaauaguaaagacuauugauuaugcaguauuugaaauaucuagugccuuuugcugucaucuucauuguuuuaaacauauauguaugcauauauguuuuuaugguuggauuucuaaaguugcucuuccuaucugauucuuuuuauuauuuucauacaugcaugagguacauacacauaaaugugcagauagaaacaccugugcaugcacauguguaguucacugcaagacaucaaguguuuucuauaauuuucuacuuuauugcuuuaaaaaaggguuuguuuaucugguuuguuuuuuguuuuguuuuuugccuuuuuuuuuaacugaaguuugaugauuuuguuaggauaucuggcaagaaagcugucagcauguguuucuaugcccuugaaugcugaagaacugguaugugcauuuaugccuggcuuuuuaugucggugcugaggauugaaacuuaaguccucauacuuacaaagcagguacucuuuuccauuaauccauuuccccagacacuuuuuuuagauguuguucaagcuaucaucauuuaccucaaaguauaugggacuaccuaaggucaaguaaugagccugauauauauacuugaggggcauacgugagagaaguauuacaaaaccuagauguuggucuauucuaauaguaccugccuaaaagucuucccuaacauuaccugguuuuuaaaguucuuucacacuauggccaaauccaauggcagagaaacuaacuuccuuccuuccuuccuuccuuccuuccuuccucuaucucuaucucucucucuauuucucucuccuucuuucuuucucucuuuccuuccuucccuccuucccucccuacuccccucccucccucucuucuuucucucuuucuuucuuccuuccuuccuuuuucuuucccuguuauuucuauuucauucuuucuuuuuauuuaaaauuuuuauuagauauuuucauuauauacauuucaaauguuauccccuuucccaguuuccccuccaaaaacccccaucccauccccccuuccccucuucuaugaagguguucccuccacccgcccauccaguccuacuuccacauccuggcauucgccuaaacugggauauugagccuucuuaggaccaagggcuucucuucccauugaugucccacaaggccauccucuguuacauaugcagcuggagccauggguugcuccguguguauucuuugguuggugguuuagucccugggagcucuaggggauuugguugauucauauuguuguuccccuaugggacugcaaacccccucagcuucuucaguucuuucucuaacuccuccauuugagaccccacacucagaccaaugguuggcugugagcauacaccucuguuuuugucaggcucuggcagagccucucaggagacagcuauaucaggcuccauuaagcaagcacuuccuagcauccacaauagugucuggguuugguaacuguauaugggauggauccccaggaggggcuuuuccuucagucucugcuccacacuuugucucuguaucuccucacauggguauuuuguucccucuucuaagaaggacugaaguaucuacccuucagucuucuuucuucaugaguuucaucuagucugugaauuguaucuugcguauucugugcuuuuaggcuaacauccacuuaucagugaguucaugccauguguguucuuuuuaugauugaguuaugauauuuucuacuuccgucuauuugucuaagaauuucaugaagucauuguuuuuaauagcugaguaguacucgauuguguaaauguaccacauuuucaguauccaguccucuguugaaggacaucuggauuuuuucagcuucuggcuauuauaaauaaggcugcuuugaacaaaauguagcauguguccuugugauauguuggagcaucuuuuggauauuuagccaggagugguauagcuagguaauacuaugugcaaucuucugaguaacugucagacugauuuauaaaguguuuguaacagcuugcaauccuaccagcaauagaggauuuuucuucuuucuccacuuccucuccaguaucugcugucaccugaauuuuugaucuuagccauucugacuggugugagauggaaucucaagguuguuuugauuugcauuucccugaugacuaaggauguugaauauuucuuuaggugcuucucagccauucaaguuuccucaguugagaaucgucuguuuaacucuguaccccauuauuuaguaguguuacuugguucucuagagucuaacuucuugagcuauuguauacacuggauauuagcccucuaugagauguaggauugguaaagaucuuuucccaaucuguugguugccuuuuugucuuauugauaguauccuuugucuuacagaugcuuugcaauuuaaugaggucccauuugucaauucuugaucuuacagcauaagccacugguguucugcucaggaaauuuuccucugagccaaugugcuugaggcucuuucccacuuucucuucuauuagcuucauuguaucugguuuuauguggaggucccugauccacuuggacuugagcuuuguacgaggagauaagaauggguccauuuguauucuuguacaugcugacaucaaguugaacuaccaccauuuguugaaaacccugguuuuuuucccacuggauguaauuaccuccuuugucaaagaucaagugaccauagguuuuuggguucauuucugagucuucaguucuguuccauugaucuaccugccugucuccauaccaauaccauacaguuuuuaucacuauugcucuguaauacaguuugaugucagggauguugauucccccagaaguucuuuuauuguugagaauacuuuucgguauccuggguuuuggguuauuccacaugaauuugcaaauuacucuuucuaacucuauguauaauugaguuggaauuuuuuuuaagauuuauuuaucauauguaaguacacuguagcugucuucagacacuccagaaaagggcaccagaucucguuacggaugguugugagccaccaugugguugcugggauuugaacuccagaccuucagaagagcagucgggugcucuuacccacugagccaucucaccagcccuugaguuggaauuuuaauggggauugcauugaaucuguauauugcucucggcaagauagccauuuuuacugcaucaguuaugccaaucaacaagcaugggaaaucuuuccaucuucuucgauuucuuuuuccugagauuugaaguucuuuucauacaguucuuucacaugcuugguuagagugauuaugaagguauuuuauguuauuugugagaggaaucauguuccucauuucuuucucagccuguuuauucuuugcauaaaggaaggcuacuggagucuuugaguauuauauccagcaacuuuagugaaguuguuuuucaguuuuaggaguucucuguuggaauguuuggggucauuuaagcauacuaucauaucaucugcaaauagugauaauuuugauuucuuccuuucuaauuuguauccuuuugaccuccuuuguugucugauugcucugguuaggacuucgaguacuauacugaauagcuagggagagugggcagccuugucuagucccugauuuuagugggauugcuucaaauuucucuccauuuaguuugaugcuggcuacugauuugcuguauguugcuuuuacuauguuuagguaugggccaugaauuucugaucuuuccaagacuuuuauuaugcaggaguauugaauuuugucaagugcuuucucagcaucuaaugagauaaucauguauuuuuuuuugaguuuauuuauauaguggauuauguugauggauuuuuauaugugguauaaucccugcaucccuggcaucaugccuacuucaucaugauguaugauuguuuugcuguguucuuguauucaguuugcaaggauguuacugaguacuuuugcauggauauucauaagggaaauuagucugaaguucucuuuccuuguugggucuuucuguuguuuagacauacguguaauugugacuucauagaauaauuuggguaguguuccuucaguuuccauuuugugcaauauuuugauguguauugguaugaggucuucuuugagggccugauaaaauuccacacuaagcccauuugguccugggcucuuuuugcuugugauaguauuagugacugcuucucuuuucuagugguuauggagcuguuuagaugguuuaucugauccuuauuuuucuuuggucccugguaucugucuagaaaauuguacauuucauccagauuuuccaguuuaguugaguguaggcuuuugaguaggaucugaugauuuuuuuuuuaauuuccucagguucugauguuaugucuccauuuuuauuucugauuuuauuaaauuggugcugucucugugcccggugguuacucuggcuaaggguuuaucugucuuguugauuuuucucaaagaaccagcuccuaguuuuguugauucuuuguauaguucuuuuuguuucuucuugcuugauuucagcccugaguuugauuauuuccugccaucuacuccucuugguuguauuugcugcauuuuguucuagaacugcuaagcugcuaauguaagcucucuucaguuucuuuuuagaggcacucagagauauggguguuccucuuagcucugcuuucauugugacccauaagcuuggguaugcugucccuucauuuucauuaaauuaaaaaaaaaagucuuuaauuucuauuuuuuuuucuuccuugaccaauuuaucauugauuagagugauguucagcuuccauguguauguggucuucugguucuuuuguugguauugaagaccaguguuaguacauggugaucugauaguuugcaugggauuauuucauucuucuuguaucuguugaggcuuguuuugugacugaguauguggucaauuauggagaaggugccaugagguagaagaagguauauucuuuucuuuuaguauggaauuuucuguagauaucuguuaaauucuuuugguucauaaguucuguuacugucacugugucucuuuuuaauuuccaucaucuguccauucaugagagugaggugcagaaaucucccacuauuaauuugagaagugcaauguguacuuuuagcuuuagcaaugugucuuuuaugaaugugggugcccuuguauuuggagcauagaugcucauaauugagaauucaucgugguagauuuuuccuuugaugaauaugacguguccuuacuuaucguuuuugauaacuuuuggaugaaaguugauuuuauuggguauuaaaugacuacuccaucuuguuucuugggccauuuucuuagaauauuguuuuccagcccuuuccuuugagaagugucugucuuugacacugagguguguuuccuguaugcagccaaacgcugggucauguuuacauauccagucuguuagccuaugucuuuuuauuggggaauugaguccauuaauguuaagagauauuauggaaaagugauugaugcuuccucuuauuuuuguuguuacagaugguauuauguuugucuggcuaucuucuuuuagguuuuuuaaaagaagauugcuuucuugcuuuuucuaguauaguuuuccuccuuguguuggaguuuuccaucucuuaucuuuuggauuugugggaaaauauuguguaaauuugguuuugucauggaauaucuuagguuuguuuuguuuuguuuuguuuuucaucuaugguaaaugagaguuuuguugcauauauuacccuggacuggcauuuguguuuucuucgugucuguaugagaucuucccaggaucuuguagcuuacauagucucugaugagaagucugguguaauucugauagaaaugccuuuauauguuacuugaccuuuuucucuuacugcuuuuaauauucuuuaauauuuaauguauuuauuguuuugauuauuaugugaugggagaauuuuuuuuuuuuugguccaaacacaaauaaaggugggaguugagccaagugaaugcuagaaauauggugccuguuuucuuggcaaauguuaauaggucacgcuguuccuugauagcuuuggaauguccugaugcuagcaugccucccaucuuguuauuauaaaaagaagggaaggaaaagggagggagaagccaauggugaaaggggaacgagggugucaugucucuuaagguguuuccugcugucuaggggcaucuucaauuuuagggaguagcuggcuuucaccaacuggauccacuugauaaucguucgcaucaguuuccucaguggauagagguucuuuuaugagcagugguugguaauccuguaacaggaggugauuaugaacucacagaccuauggucauuugaucuuugacaaaggagcuaaaaccauccaguagaaaaaagacaucauuuucaacaaaugguacuggcucaacuggcaguuaucauguagaagaaugcaaauugauccauucuuaucuccuuguacaaagcucaagucuagguggaucaaggaccuccacauaaaaccagagauucugaaacuuauagaggagaaaguggggaaaagucuccaagauaugggcacaggggaaaaauuccugaacagaacaccaguggcuuuugcuguaagaucgagaaucuacaaaugggaccucauaaaauugcaaagcuucuguaaggcaaaagacacugucaauaagauuaaaaaguccaccaacagauuggaaaagaauuuucaccaauccuaaauuugauaggggacuaauuuccaauauauacaaagaacucaagaagcuggacuucagaaaaucaaauaaccccauaaaaaaugggguacagagcuaaacaaggaauucucaacugaggaauaccgaauggcagagaagcacuugaaaaaauguucaacauccuuaaucaucagggaaaugcaaaucagaacaacccugagauuccaccucacaccagucagaauggcuaagaucaaaaauucaggugacagcagaugcuggugaggauguuaagaaagagaaggugacagcagaugcuggcauggauguggaaaaagaggaacacuccuccauugcuggugggauugcaagcuuguacaaacacucuggaaaucagucuggcgguuccucagaaaauuugacauaguacuacuggaggauccugcaauaccucuccugggcauauacccagaagauguuccaacugguaauaaggacacaugcuccacuauguucauauagccagaaacuggaaaaaaacaaaaaaaaaaacaaaaaaaaacaaaaaaacagaugucucucaguagaggaauggagacagaaaaugugguacauuuacacaauggaguaguacucaucuauuaaaaacaaugaauuuaugaaauucuuaggcaaauggauggaucuggaggauaucauccugagugagguaaccagucacaaaagaacucacaugauaugcacuggcugauaaguggauauuggcccagaaacuuagaauacucaagauacaauuuacaaaacacaugaaacucaagaagaaggaagaccaaaguauggauacuuaguuccuucuuagaauggcgaagauaauacccauggaaaaaguuacagagacaaaguuuggagcuaagacaaaaagauggaccauccagagacugccccacccagggauccaucccaaaaucagccaccaaaugcagacacuauuacauaugccagcaagauuuugcugaaaggaccugauauagcugucucuugugaggcuaggccaguaccuggcaaauacagaaguggaugcucacagucaucuauuggauggaacacagggcccccaauggaggagcuagagaaaguacccaaggagcugaagcagucugcaacccuauaggaggaacaacaauaugaacuaaccaauacccccagagcuggugucucuugcugcauauguagcagaagauggcuuaguuggccaucauugggaagagaggccccuugguuuugcaaacuuuauaugucccaguacaggggaaugccagggccaagaagugggaguggguagguaggggagcagggugggagaaggguauaggggacuuuggggauagcauuuaaaauguaaaugaagaaaauaucuaauaaaaauuugaaaaaauaguuugguuagaaaucuuuucuauuucuuguugaaggaauguaaacaagauuaaugagucaaggagcaaauauaauaacaccaggaagauaacuaggaaagguguuaagaaagggaguauccacuuccauauagaauuuucaaaaacccuguaacuggaggucucaugguuucugaaguucuugaugucugacuguagcuccuggauuuuauuucucacuaucccggauugguugacuuagaaacagcauuuuucuuggaguaacaggcaaagacuaccuucuuuagcugucaggucaucuagcccccauugguucugaagcaccacagcugccaaagaauuaaucuguuccuagauaguaagcacauguucagucauuuccuguagaucgcuuuuaaacugggaagugaauguauuauauggggucauagaaguuguuauccuugcaguucaaguauucacaccuauggcuauucuuguagagaccaagaguggcaggacuugaacugcauucuuauguugaguagcuaccauaucuacaacugcgauuggcaggggcucauuucccuggauuacuuccaguucagggaaaauugacauguucuggacugcagggcauuguggcaaagaugauauaucagggguuauaguuuuauuacagucuagagagcucaguguuccuacagaaugagucuuaaaacagugugccacgccaaagagagggauagaaguaaagucauggcaacauuggacucaaggcagcugacaaaggcugagguaagguuacuaggcaguaucacuguagacauugugaccauugugaguuacuuccagaugguacacauagccagcaaucuuuaaagcauccagggcuagugacaauaaggaguugguaggccaaggucaaggucugaagcaaaaggcgaaaugacaaguuaguacuauuuaugagagaugucaaagugguaaguaccucagaggaguguuugauuaucucuucuaccuuuacuauaucuagagguugggcgauugagccauauuuucccuggauauggaugguacuuaguggggaacugggcuaauuuuugugguaaagcuuaccaacagcuacugauucccaccuggaaucccuugggucucguauguagaaagagugucuugugauaucaauagaagaaaugauugauccgugauucuaguauauguaucugauaagaccaauaugggcagcucccauauucgucuggccauuuucuacaauaaucauuugucuggucaaagagaaaacaaguauagagaucauaauauuuagaugggguaacagauacagggaugauagcaguuacgauuaguuccuggcacccggcuauggagcaguuuccugacccuauuuggaaagccuauuuguuaucugugggaguuucuuggacauccaaucuccagauggaagggcuacccuuaauuaaaaugaacagcgggggaagacgaaaagaccacaacuaauccagugucuaauccggugaggucgagcucugcugcuggaguggagucucauuuucuggaauaggggacaagacgggugugaucucaacaucuucuggaacuuaacagagcacgguucuguuagggucgauguguaugggggggaaaaaaggucaucuuuagguggaggaaugaaagugaaggugagacagauggacccaaugaaagagucccuggaguuuagcagcuguaggggucaugaggauuaccuuaaaagggcccugcuauuugggagagaggggugaggaccgaugaucuggaggagagagaaggcuuuggucuccaauguuaacgggcaguggacaggaaacagaguguggcugagguaggugguggucucaaaguuccauaggggagaacgaagaugggaaaguaaugggauagcuaaguggucugggaggggagagcacuuaggugaaagacuaggaguuaggacuggacauccauacaugaguucaaagggcgagaugaggagagguugcuuggggagagcuuguggucugaaaagagccagagguaggaguuuuacccaaucaaggugaaguucuugugacagcuuaacaagaauaguuuuuaaagagugguuaguucuuucuacauuaccugaagauugagggugguagggaacaugaaaaugccaaggggauaagccaggcaugguggcacacgccuuuaaucccagcacuugggaggcagaggcagguggauuucugaguucgaggccagccuggucuacagagugaguuccaggacagccagggcuacacagagaaacccugucucgaaaaacaaaaaaaaaacaaaacaaaaaaaaaaaaaaaaaagaaggaaggaaggaaggaaggaaggaaggaaggaaggaagaaagaaagaaagaaagaaagaaagaaagaaagaaagaaagaaagaaagaaagaaagaaagaaagaaagaaaauuccaagggaaauaaauuugggacuauugucugauuuaagggagggugaaaaagaaaaugccagggaaauaaauuugggacuauugucugauuuaagggaggguggggcaccaaacuggcggaugaucucccagaggaggagaucagagacugucuaagcccuuuuguuaguugugggaaaugccucuacccaugccgagaagguguccaccaagaccaggagguacuucgcacaucugauggugggcaugugaguaaagucaaguugccagucaguuccagaaagggaaccucuagccugauaguuuguaaaaggggugcuacgauaccuugaauuagaguuaggcaucugacagacuuugaaagaagcgguguuagauuuuaagaaguauaagucuucaggaauaagcuguaggugggucuuaacaaaagaagacaaugcuuggcuguuaggaugaagaggauggagauggagauguagauuguagugaaagaaucuccuggggaggaucuaggguaggaguguggaagccaagcacaugcacuugggaggcagaggcagguggauuucugaguucgaggccagccuggucuacagagugaguuccaggacagccagagcuauacagagaaacccugucucgaaaaaaaucaaaaaaagaaaaaagaaaaaaaaaaaaaagauauaccagaauagcacagcucaaguucuuaugucuuuggagguggcagcaacaggucacgugcuauaaguggcgggcagccaugcuucccggccccccggccacacugugcugccaggcucagccccacccugccauccuuugugugggcccguccccuccugcucagcagcagggaugaggugguguggcacauguggccuccccagcagcagcccagaagcagcagcuaagacccacaccuaaguggugggccugguggguugcggccuuguguacaaggccaguagggugcuccauugaggcuggugcuucaggcagcaugaguucuggcuuuguuguggcuggcacugggggcgcugucuacguggagacucaggugcaucagcucugagcugggagacuccgugccuccauggucccaccgccuccccagggguccucagaggaauucauuaggggcuacuguuuauuaaagcaguggcuuucaacuuuccuaaugcucuaacacuuuaccacaguucuguccugaccagugugacagucgacagagacuugggggucacuuagaagagaaugggggacaagaaaugugaagaacggacagcaagucaagaggucugaucaagcugacaaacuuuuauuuuucccacccagguuauauacucauaugaucuugaguugggguuggaggggggucacuuugucuccggguaaugcaccuguucccggaacaggauauugacuggguaaacaguucagcaggaagaucaaaacagaauggguuauuaggcaccuaugcacaagauuuauagcuauuuguucucggcugacuucaggauccaugucuauuuguacucagcugggcuaguacuuucccacagaggccaagacuuugugccagaaagcacuuaaggcaguuaauauucaaacaacauugcucccaacacaauuccuuauauuaugguaaccuacaagcauaaauuuauuuucuuuccuaauuccuaucugauaugagaucccugugaaaagaucauuugaccacuaagguaucacagccuacagguugagaaccacuauccugaagcaacuccgaacaaggcaccugacuucacaaagcucccugauaggccagacuacacuacaucuuuaucuaucacucgcaaggaguauaaaaugugagguuuucuccaugcugucucuuuccauuuuuucguaaggaaauuuaaagguaaaaauaaagagguaaacuuuucuguuucccauauaucaguguuuuuauacuuuuuuuuuccuucuaaguuagaacuaaggaagguuaugagcaagaagaaaucucaccccccaccagcacccucuaccccacccccuaaaauguagaaugcucuggucaaaaggaaaaauucccaccucaaggcaguggcacuuaacuucaugcacuguaaacauauugacuggccauguccaucuuugucuauugaaggacauguccagaucuguuguggcucuuuuauugagccaauacacuagagcugucaacauugcugauggucuagacuaucccucuguuaaacuucauuccacaaaaaucaacuaaagacucaguucuugccuuagccucagccuuugggaaaugucccauaucucuuggcuucugcuucuccucaauaucaggacccucccuguccauauaaacaggcugcacccucacccagccuguaucagacauggaggauuuucagaucuuuaguaggaucugacugcagcaguuacaggaagauuuucugagaguauaaauaauagaccccuuuaugguuagcaccauaaucagauacugcauuugucaaaacuauauauuaucucccacagauucaugugcugaaauuuuccccaaaugguaguacugguuggggagguagugggauucaguuaugggagcauggugugaaagauucacccuguuccagcaccuuccuagcucucucuacuuccuggccacuaugaauugaguucuuccuugcucugucccuugugucaugaauuuuugccucacccuaagcccacagaaagaguucuaagugaccauaaacuaaaaucuuugaaagugaaccaaauuauauauugucuucuuuuaaguuauauaaaucaaauaauugcaaucuaaaacuaaguagcaaagugauaagggacaaaaccuugaaccucccauuuuauaauauacuauuccagauaucaaauaccuuuugacaguugggaauauugugagaauauaaggacccaagcucuuuauuuugacagaaauggaggcagaaagaaggaauggauuuccuugcaagugggugguuaauaugcagcagggugauaaugaggauucucacagaaaggugacauuuaagcaaauacccgaagaaguuggcagaacaagugagcaaguaggugugccuagaaggagcauaggccacuguccugaucucaaggagcaucaggcacacaaacugcuaugaguagauacguaacaggguugacuucagaauggaauggagugaccaauaaaagggcuggaggcuuugcauguuaacaccgugggaccuauggaggacagugaacuuuuaucaauuuugggaucuuuuggcagacucugucagaggugucaccugaucugccuucuuuuuauaaucguucauccuugcugugcuuaggugacuagaagagggcaagaaaaacaguuagggaacuuccaguaauccuagugggcaaugacuugggcuucaacccauguacagcauguaaaaagcuagaaguuuucacuuuagaacacauucuagaauuugagucaucugcaaauuccagaaaauaagguaggagaugauuccagguggcuagacuacuguggugucauggauuacacuggguaguauaauagaggucagagcaaaggucaguacuuguuuuaagucuuuauaaacuucagauggccaacuggacaucagcauggagaaacaaggaggugggccuagagaugaauguuuaugaagcaaaggggaguucaauauugucaacuguuccugaaaccaagcuagaaguuuuaugcauuucagaguucaguaaacuggacuugcacacuauuccguugcuaaagcagacuccaaacucuucagcuuuagagccuauggucugucacuuugugucacuucuuuaggauucccacugggguaguugagugacaccuacuagucugauaguggggguuagaucaggugacuugaggguccuagguaccugagcuaacuguacauuaaauucgauguaggaucugacuguaguaauuacugcaagguguucuaaggguauaaauaauagauguaugcccauaacucaaggcuuuuggaugaaggccuuggaaaauaaugaagauaauguucuggccaaugaggacaaugaagaagagcaugaugccccaggguacaaggugaucuucaaacaaauaugacuagccucaaucauauguuuccacuacccaguuuaucuuugugugacacuugguuucuuuucagagcaucucaaauuuuccacauuugcuuuguacuuagcacucagcuaaucaguccaugggcaaauucauuccucacagucuggcaugaagugauuacugcuaauguuccuaucuuaaccauuugggagaggaugcuuacugaaguauguuuaagccaagggcugaguucuaaaggugcagaacugagauucuaucucacacugacuaacuuaauuccuuugcucaccugagaugaggaguaagaaacagaaaauuugaaaagaaaaauugugugaagggagcugucucuggagaugccaaaggaaugaacucuaagauagauagauagauagauagauagauagauagauagauagauagauagauagauagauagauagauagauagauagauagauaugcaugccuauuuguucaaguaagagacauggugaugcaggcacccagguccugcauauagagcuaucaaagagacuccaaggcacagauugcaaugaguaguuucacaaaaacccaaguagagacugggacugcagacaaugccuuucaucugaguggcaggaaguagcuguggacccaagaguucuauguuugaacucuucauggggagaaaaguuaagaccauguugagauauacaguaacuguugaguuuucacauauuuauauguuuaaucuuagucuuccaugccuuaguaguaagagacagaagaggacaguaggaggugaugcauuguagccucccccagccuggaguaggcuggcuuugaccuugcugccacugagaaugagaccaccuggggugggauggcucuauuguucugucaccugccccugcucuucuccaagacacugcuaccugcugagaagcccuugagauauuccagagacagcauccugcacugacuacaggcuggcaacaggcaucaagaauggauuggcaggggaugggccuucccccuuuauaagcacagacuuuuaguaaacuuuggaggccuuuaauggaaccaugucuuggccuccauuauuucucucgacguuuucuucauuacagcuccggccucccacuuaggaacccaguuaguguggccacaggcagcuacaaugcauucaugaaauuuaacaaaaugagacucgugcccauguaaaaguaaccugguugaguuugcucaccucuuuuauuuugcagaaacacaauuagaaggcauuauuccuggagcaaaaaacuaguauuuccaaggucagauugugccuugaucuugagacuuuuuaaguuucaggaacuucaauaaaccuguuuaugggugauccagucaaaggugcuuuguuacaggggcucccugacuucucugagccuacaugaaguaggaaugaugcuaaugggguucuugugagaccugcacaagauaauauguguuauucccuuuauaauguuuccucuaaggauuccugccagagucagagcaagugggauaaugggugacaucauuaauuuguaucauuaauggugacaucauuaguucacagcuuuguccacagagcccuugggccuguggcuagguuuacauguaaaauaucagacaagcuaaacacacacacacacccuagaaguuuuacuucagaaaggacauuuggggaacuuguaagcuucuagccagauaucuugcaggaguuuucuuccagugccuuucaaguucuacuugucuuaucuugccuagcucucugauugccuguucccugaugggacugguggaacaucaagaacauaggaaagaaugagagcaaguuucgaauuccugcugguggccugcuuaucagcaggguaagccugggggaggggguuauuaacuucucacaaccucaucugcaacaguagguagaaaauacucauguguccucaaagucguggguugagguuugagagugacucacugacccugguaccucuuggauacucagaaacauuguaccuuuccauuuuccuucuuccuagaacuuuaauuucccacuucaaagguggcauugauuuuucucuuuagcugauacaaaaggaaucaaaguggagguuucaggacagccacacaacaccuuaucugucagguucccuugauuaaagcugucccuuuuuuaaagcuucuccaacuccuuagauaguuuccccucauuuuacauuggcuuucaaugcuucuuaaacuguagagacagcuugucugcagcuaagaaaaauaaaacauuaaaaaauauauaaauuuucaaaugaagaggcuuuacaaugacaccuguagccugccaccaacugugugacagucaguacagaagcuggaguucagcagggaagauucuucuuguucaacaaucaucuaguccagccaugagccugaaacauuucugucuaauuuguaccaaacuuuaaaagaauuuuuuguacccucaauaacaauagggcuccuacccaguuuccaaaguguucauuguucuuuguuugggugggaggaaugggauuugacauagguucuugauauguugucugugugugugguguuuguguguguguguguguguguguguguguguguguaugugugugucauauaauugacauguauuuguuauauuugcuugauauauaucaaguaauauaugauagauaaguuauauuaauaaauauauaucuuuauaucaaauaauauauaauaucauaguccuugaauguaaagaccugggauugcagaugugcaccacugcacuaggcuuuguuuguuucuuuguuuguuucuuuguuuuuaaugucuaccuugggguugauauauuacuuggagaauucuuacggucuuuagcaaccuucaguccucucuguacuugauacuguccgguucguaggaacagcauauacucaagguugaguucuaaagaacaagggagaagaggaacuguuagagacaacuacagcucacucaaagaguggcucauguccaucuucccugguauuuauucccucuggucccaugaccucucgucuccuuaaacuccuucaugucuuuugacagacaucaguuucuaucaggacaugcuuaaagggucuuauuuaauccugcagccggaggucuauuccuaucccuuucaccaauucucaaucucacuuuccaguuucacucagugucuucuuaucuggugaguaacuacacagcagaugacugcccugucccaucucuccuuugcugcacaucugagugcucuaaguauagaacauucuaccagucauuccuugucuuacacacucauauguaagcacuaaaagaccaagaacagaugucguauuccugguuugcccaauaccaguguuggcauauaggagauacucaguaaaguuugguacauggaagauaaauaaugcagacaauuccaaaagaacagauuuggagggauaaggcaggaagaauaggaaguaucuggagaguacauauuagccuuacgguuuuuuguuuugguuugguuuugguuuugguuuuuugguuuugguuugguuugguugguuuugguuuuucaagacaggguuucucuguauagcccuggcuguccuggaacucacucuguagaccaggcuggccccgaacucagaaauccaccugccucugccucccaagugcugggauuaaaggcgugcgucaccaccgcccggcuuagccuuagguuuauuaaaagaugagcucauuaaaaaugugucaacauuccaguggaaugcuucaguuuuuagaauugaaaaugauguauuuggcugaauauggggaccuuauaaaaggggaggcaggaagcuaguaccacagauucccccacuuagccacagggcuuuuauuucaggcucucugguagauggcaaaaauuguagcuagucccaaauccuauauauacuauguuuuguuauauacaugcauauccaugacaaaguuuaauccauaugcucaacaaagagaacaguuauaauuagaacaguuguaauauacacuauaauaaacguucugaaaacuauuguuuuucuguccguaaucucucugugcuuccuguuuucaguuaaaacuucugacguucagcuucucuuugagaauucucauugcaaggaucacuucucuagcaauuaaggaccucuguuaaauaaaauaauggcuacucugaacaucaucacuguuaucugcuaacucuuaacagcuacuaagugacuguaaggcagacaggauagguaccaagaaaugauucauaucucugguaggauggcauagaauuauaucacacccugauuguugggacucucucucucucucucucucucucucucucucucucucucucucucucucucucucugucucucucucucucucucucucucucucucucucucucucucucugucucucucucucucucucuccaggccugaguguuccccaacugucagaagccucugucugugcaggccuuagugcacaugaacuauuggaagcuucuuccuguguggcccagccaaggagugaggauaguucgugccuccauguccucugccauaagaguuuacugugcccuggaguccuggaauagugcagggaaccaugucccuauauugccaggaucucucaauucuaacugguuucuguugauuugauggcuucuuuaauaucauaggagucaauaacugacuuaaaacguccaaaagacugucuuugaaucauagaaagaaguucugguuauagauaagucuuuucuucuugcccccuccucuucccauuucaaaugcccauccccagggugaugguauaagggaaaugaggcuuuuuauuggaguugcuuggcaucuucuugguaucuuuauaacuuuugcauuguuugguucaugggaccucucuuuucuuaggaaaaacuggagauaauaagcuucacaagguauugguaucagggucugcucacuggauuuucaucauuauaauggaauacuugaguguuguagaaugauucccugagcaaaguggcugccaucuuccuuagaccagcuuugucugcuuauaaggcuccaugaguacugggcuuguucccuguuaacagaacucuuuagaaagagaggguaagaggaucauuguaacuuuaucuuugcccaccaauuuguggaauuccaaucuaauugcccauggccuuugcauuuagauuaagggagguacugugguuugaaugaaaaugggccccauaggcucauaggaagcuucacuauuaggagguuuggccuuguugguggaagugugucacuggagaugggcuuugagauuuugaaugcucacaccaggcccagugucuuuuuucugcugucugcugauccagauguagaucucuuggcucauucuucagaauaguaucugccuaugugccaccaugcuuccugacaugacauuaauggacuaaacuucugaaacauaaaccaacccaaauuaaacguuuuccuuuguaagaguugcuauggucauguucuuaucacaguaguagaacacugacuaagacaggagauuaacugagagaggcuuuaucuaugcugcuauggggaaguuguaauccaugcuggaugaagguguuccaguguggcgauuggaaguuucuacuugugaaguccaggcuaaggaauaaggauaucccugcccacuaaggaaggaacaagagcagaaagccagauuauggucaucuucagaccucccuaauagccuucuagggagaacuaaaggccucaaagagaacagcuguccacgggcauguuccugauuucccaaagaccaggcucuacaucuuaaaaauuguaccaucucccuacagguaucucccuagaacuaggacuuuaauaagaccaauccaccauauccauacuguaacacaguacaaccuaaauacaucuacaucauuuccuuagugugaaguauuugaacuagagugagcaccuggcagaguuagcugcuggugucauucagauuagagugacuuucuugucaucacaagaaggaagacacuguaaaaagauucaggaugacagaggcccuugauauuagaagagucauucccuacccuccuugaguaaugaaagauuccaaauuaucccaacugagaugggaauaggaagcuugggaauagagggcacauagguagaagagcuggggaauuuucuuuucuuuggaaacagcagcuaugugucagaacaggauacuccuaagagcugcauggaggcccaacucauccuugcauauuacacuucagcuucucacucucucaaugggaauaauacuucaggacucaaaucuguaauuuuccuaacuuugcagguauuuguuguauuaucucaguuccaggaugcuuaauuuuucacauugcaccauuuuagaagauguagauugcaaaagcaaauugauaguugccuucuagauaguguuuugauagacccuauauucagcggccucuuauaauccugagagaaaguauuaucuuuauaaguauauuucacuagcuucuccuuuuacucuugagugauagggaagagaagaauguggguaaguuugaaugauaauggaccauauugcucauauauuugcauccuuaauccccuaguguugaacucuuuagaaaacauuaggagguauaucauuguuggaggaggugugucagaaggaggagaggcuuugagguuucaaaagcucaugcuuauuguacacacauacuccucucuuucugccugugugucugccuaccugcccucagacacuuucccugcagggaaccuagcucagauucauacaaggucggugauuaucacuuccgucuauguuagccccuaugaacuuagagcuuaguugacuuugggaugauggccccugaccaucuaggauucucugaaguaaaaauguagagaacagaaaagcaggcaauauuaggaagguaguugagaagcugaugguggguuuaagcagaagcaggagccaguuccugggagagaaggcauaucaggcugugucuggcuauaacgagaauagugagauuagugaccuagucaaacaucugcccucaguacugaaaggugauugugcugcugucaugaaagaugcggacuguuucacuauacuagagaguucagaacccaaaacaaagaguccugaccaggagccccuuaugucaaaacuaagcuaauguggagggcggguaccauacagacucugggcuauuuaaaaauuaaucaugaauuucuguagaccugagacauaauggagcuccuuuggauauauaugagagaaaggacuuuaauaaauacucaaauuuuagauuccuggauacagaagagaauaaccauauaggugauucuaguuucucggguuaacagcagguggguaauaugaaaaaaaaaaaaaaaacaaaagauaaagguuuaaugauaaauaauaacauuguguuuccaucuuuuuuuuucuuggcuuugguuguuugcaugucuggaucccuauuuauauugaaugcuucacauaaauaccaccuuuaugcuccaucaugaggcauggaaguauuguuuugucuacuuagcauccacuuccccccuucaaaagcucuauuccuucuugugucacaaguguuugauguguauggguccauuccuggcuauauggauaaagaugugagcuacucugaccaguaaccacauggacaacucccuuggugagaggauuguagagagauguucugugaccugcacugaagaggcagaacuaauauguguacaaccaagaaucucugcugaaaccccuaguaaagggagcaucuuuuccucugcaaaugcaggacuaugagcuugugauguuggaauggcccucuguacuucuaacacuggcauaggacuccaagcccacccuauguucagcagcuugcaaagugaccucugggacucaguaugauggcauacacauagauuuaauguauaacaacuaaagaauccugagcaaaaucugcaaaggaaaaaggcagguggauuugaggauaaaggaagccaggcucagagaucuaaaaacuuuuauagucaagccagggaagcuaagaccuaauggagcugcguuguguauauaugagaggaaggacucucauauauauccaaauuuuagacuccuuggugggaaaacaagacuuuacauagggacuauggacaagaugaucucaaaaaaaaaaaaaaaaaaaaaccaacucccagaucacagcaaagacugguacugagccaggcauuucugaggauggccacuugggugauuugaacucucuucucuauaugcacauugagagcuuaggcaagucugagagcuugaaaagaagagaaaaagucuagauugcacugguugaaguacuuaccuccagccaguccugaggcaaaguuugcuuguuuaauuucuuaaaucauuuuauauuuuggucuucccugucucugagaauuaugcgaacuaagggaucccauccaacauaaauguuugaauucauuagucuugaacaaccauuuccguuuugcuuucuuggaccacuuuuuagaccgggccugugccugugaccuagcacacgcccagccucaguuaggcacuuuuauacaucaguaagguuuuuuuuuagcauuuuagaagguaauucuauuuaaauggaaaggauaucuuguagccuauuaauguaauaaugugaccuacauuaaucuuuugauaacuuccuagcuccaauuaaugcugcccauaugugugcaugaaugugggaccauccauaggaauuagaaaaccaacuaauggagacaccuucaaagaagaauucucccucagcagaauucuccaucagcugaaauuucucaugagugaaaaagaaaagaaaagguaaaauaagcaaucaaaagaaaggaaggaaggaagggagagagagagagagagagagagagagagagagagagagcaagaaagaaagaaaaagagaaaaagaaagagaaagaaagaaagaaaaacagagaaagaaagaaaauauaagaaauuuuaauuuguauauaaaaauauuuuuuauucagucagauguaacauuguucuucauuguuacaaauuaguucuucguagagaauuuggucaggucccuagggaagcagggccccuauuugggcuugcuguccuguguuucuuucuacuuuggccuaauuaauuaugucaucauucaagcagaugaguuuaugccuuauggggauaacaauuaaaaaauaaaucaguguuugucaaaguggaaagcuauaaguggagcaauuuuuuuuaaagcucucuuaugggauuaauuggaaaaaaaggacguuuucuaguguuuauugauguggauauaagcagaaaguaagagguaaaugcuggaaagacagcucaaucuguaaauugcuugucauacaugcauaagaacccgaguuauggcucuagcuaccacaugaaaagcccaacuuagcaggacaugccuuucacccuggaguuagggagguuggauaaauauggauuucuggagcucacugaccagccacuauagccaaauuggaaagcugcagauucgaugaggaacccugacuuaaaaaauaaagugggaggcuauugaggaagauacuaaacacugaacccugaccucuauacagauguaugugugcauguguguuuguguaaguguguguguguguguguguguguguguguguguguguguguguacauguaugagcacacacacacaaagagagacagagacagaaacacagaaaagcucagauagucagccagguguaggcauagguacauauauacauagaaaccaaaaaaacaaaacacccagaagugacuuagacucuaugaagucaucuagugcuuuuaauugcaaagagccugugugauucagggagauaugacuggaugcagaccuguguuuuacagucaccaugcuuagggaaucacucucuuuuuuuccguuuugaaaagaucuguacaguaaguuuuucuuuuuaacaauaguuuuauuuuguuuuauuuuauuuugugugaguagauguuuugccugugucugugcaccguuuguguguguagugccugcagaggaaaagguuuggaaucccaugaauuuagaauuagaaaugguucuuaacuuccaugugaguaugagaaacuaaacaggggucaucuacugagcagcaggugcucugagccaucucuccaguguugcuuuggugaguauugaaauagugaaugauauaagaguuaaaugcauaugacugugcaaucuugauuacuuuaaaguucuacagauuuuauacaggguucacaguuggagccaaagucagaauuguauaaacugugaucccugacggaucauccaccccgugcacacaaccugcauuugccugacaguagcuccuucugagauggccuucaggguuuaugacaacccaagccucauagaugcuuaaaaacgaaaccuuauugaauaaauaacauuagaccuuugguuccuguagcuguaauacuugcugguucuucuaugaagcauuaaguacccaaaugccuuugagauccagagagaacuuaagacacugaaguaacaucccagcaugggaugcuuucugaggcagacauagagacaggagcagcagugaugaaaccgugcucccgugacauucagaucuccuaaaacugaauaaugcacacaaaagguccaaaagaacauuuacuuucuagacccauagccauagcccggcuuauguucccccagacaagccugaaaaccaugacaaggggaggaggguguuuugcuuagcuuggauaugucucauagcagcccaaucucuagugucuauguccuugacuugggacuugaaaaaccacugccacccaugacaccagcucuucuuuuaaauuugggggaugagaacauguuuuccuucuaaacuaccaagaagacaguguggggcaggauugagguguaguauggacucuggacaguauugcacuaaggaaagaccuccgucuccagauacgaaacagguuugcuguguguuucagaggagagucuguuccuuccuggccuccuuguaaccuucuccaccuaaaccaugagucuguaucaggaauaaagaguguaugcgugcaguggugucuggguaaauccagacacuauuggggacaccuagaagcgcuugcugacaggagucugauauagcuguccccugagaggcucuaacagccugacagacacagauguggaugcccgcaagcaaccauugcacugcgcacggggaccccaauggaggaguuagggaauggacugcaggggcugaagggguuugcaaccccauaggaagaacagcaauaucaaccaaccagagccucuagagcucccagggacuaaaccaccaaccaaagaguacauauggagggacccauuaccccagccacauauguagcagaggauggccuuguggggcaccggugggaggagaggcucaaugccccaguguagaggaaugccaggguggugagguaggaguagguggguggguggggaagcacacucauagaagcagagguggaaugggauagggggauucuggaggggaaaccggggaaggguuuaacauuugaaauuuaaauaaauuaaauauccaaugauauuuuuuuuaaagauuuauuuauuuuuauuguauauaaguacacugagcugucuucagacacuccagaagagggagucagaucucguuacggaugguugugagccaccaugugguugcugggauuugaacuucggaccuucggaagagcagucgggugcucuuacccacugagccaucucaccagccccgauauuuuuuuuaaaauaaaaauaguauauguccacuucaguacagggcagaguuugaaacucacagcuuucccauuuggaauaaucuguggcuaacauuuaagauuauugaggauuguuagauauaaguguuauaguacugccuguauccugacuuuucuccuuaacuacacauggcugugcucuauccuagccuggcuguguuguccucgguauuccccuugauaucucuguaccuuguguucuguguaauaaaacuauucccugcccaauuagugaacagaggccagccagucuguggauaagugaaagagauuacccauuucuguuucugucuuuucucccauuuuaaaguuaauaucaucagaggaguucuuuaaaaaaucuagaucccuaggccaauccuguuccaaccaaacccuggccucugugguucccccacugagagaggcaugcauguagaggccaaaggucaaccuugaaggucaucccucaggacaacaucuaauuguuuuggaaacagauuuucauugcccuagaacuuaguuuaagcuggcuauccagggagccauaccgguccacccuuguauaccaccucaguuguagaauuccugauuaccacugugucugggggauuuuugguugguugguuuuguaaguuuguuuuagguggguucugaggauccaagucagaucacugugcuuguaggacaaugauuuuaauuaacagaacuagcuucccagccccuggccauauuugacaaacauaacaagaugguuguaaugugaggccagaguugagaacgacugugaucagguaacugaccuggggcuacucuuugcuauguggaaaaagacauugcuccuugcuuacuugucuauggaaacagagaggcagaguaacauuugggagaaguguuuggagacaggauuaaaauccuggaacccuugccucugugggaaagaugcuguuuacuuuguguuaagagcucaaacagugaucaaaauccaaucaauaucauaaauagaagaaaaggucaaggcuggacuggucaugggaucacguaaccacagccaggcagaagcuagcauauguacugauucaaguuuuuaacuggcaaagcccagacacuuggcacccuagccacagcauggagguuugccuggcuauguugcucuugcuaaaaaaggagaaaugccauuuucucagcaauugcacuccuugacucauuaguauaguuggcaugugguuauuuguuaacuucucugaaaauauccaugagaagagagagccauggcaggagauguuacuguuugcugacuuucuguuuuguauguuccucuccagaguuaaagggacugugcccaucccccugacaccugguccauuucucaagaagcagcugaacgucuccucaaacccuagcuagugucugaguucacaaggucggccaucacagcuuuguggauuuauucuaggucauccagaggacaaaccuuaagagccuggaguuuuaauuacaauguuuuuaguuuggaugacuuugauugagaauccauaagaaaucucauccagaaugauuuaaaggauauuucuacauauguuagucaggcuugccauggucuauauaacaagauguauuggagaaggccauuucccccacugagcccauccaucuuggcccacuggcuccuuuaacgaaagaacaucacgguuguugacagaugagugugaagcacagauaccuggggcacagggaacuuuuuacaccaggucucuuauuaaaagaacuguccugguuccauugccaaccugacuuucuaaccugaaguguagaugcaggcccauugaugcuuuucguacuugguggacugagucccaaagcaagaaauuccuuuugcuuuauuuacagaaugguuaauguucucuguagucuugauagguuuuaaaaucaccaugacaacuccugugauaguauaugaggauguuaucagaacgucuuaaaagaucagggaagagccaaucugaauaugagcugugguccuggacuaaacaaagagacagugaaguaagcaucaacauucaucccucucuauacaucuauacaucucuauacaucucuauacaucuguacauaccugcacuauuuucuauacaauaugugcaauuaaacaacauccugccuccaaugaacucuuguuguccuuuccuacuuugcuuggaauauucuguguaaaaugcuuuucuagacucccuaaguuguuuuuaccccccaccuccaaguguuacaaaccuuccuuuccaaaacagugucaucagcacacuauuaagaugccucacacauucuggcagugugcgccugccacuaaauagauugugagcuccuuuucuauaguccaugugaccagaagagccagcaagaucuuguuuggcugaucuuaacuuaaaagagcagggguguacagcacagucaagcacaguggcuggugccaaggagugcuguauguggcauuugcuauucuuuccaaaugagugaauucuugaucucaguauugccaacauuuuguauaauacucagcaugggcauaguuggggucgaugugguucauuucucuguuuuaaaaaccauugcacugcagcaaagauuagacagucuaccuuuaaaaaugcuauuguuuucauuuucauuuucucuccugcccucccucccuccuuccuuccaucccugcccaaccccucucucugugugugugccuauaaaagagccuguuaccugacuugucaugcucucccacucuuuaccuuaugccuuuaagacagggucugucagugaaccuggagcuaugcuagugaccagcaagacccaaacagucuuucugugucuguauucuacaauguugagauuuuagguacaugugcagccacacugagcuauuuacauggguacugggauuugaacucaggcccaaugaaccacuuccacuucccccuuccacauccucuuuuguuauuuuuuuguuuuguuauuguuuuguuuuguuauuguuuuguuuuuuaacauggcuucaagccaauugguggaucugaaagacaacauacaaaggacaaaacuuaucucucaaggaaauguauggaugcagaaauagggagacagagauauucacucucuuuuguaccgaguuugccaaggugaaggcauaggagaagcacaaaugugagacacuuaaaggggcuuuaaagucuagguaagaguuugugaaggaaauuccuaggaaauggagaguauauuuauggcaguuuucugaggauguagcuaaagcucacuguucauuguaauuagguguguaggaggcuaaaaaccuuucaaaagcaggauugaguucugcacaccuuccuucaucuuucucucagucauauacuagguugagcauccccuaccccaggaauauccucauccuaagccaugcuccaaaagauagccggugugacucaguuacagaucaugaagaacagaccauguaaauccuaauacaaagaguguccuuugacagggaaguggaaggaaauuuggcuauagagaagcagugauuugacaagcaguucaacugggguaacauaauauaagacagagcaaggagccauaagccaagaaaugcagguggaagcugcacuuggaaguaaaagacagcaugggauggauucuucccucaucuccagaagaaccagcuaugcaauacccugacaccagcacagcaagacagaugucaugcuccuagucugccaaacuguugcagaauacccuuguauauuuucuagccagagagucaucuguuacaacagcagcaagaaacuaacauucugggccacugagaccugaguucagucuccagagcucagguaaaaaugcuaccugugguugaguacaucccagcaguacuacaagggaggugagaggcagacacagaaucgccaagaagcuugaaagccagcuagccuggagcauacuauauagcagaagcaagagccacccucccucaaacaagcugcaaggacagaacugaguauuaaaaaagucacugccauggauucauuuucccccauaucuaucucuuucucucucucucucucucucucucucucucucucucucuuucucucucucucucucucucucucucucucucucucucucucucucucucucucucucucucucucucagcucuuuccauaguggcuuuccaugucuaauuaaacaucugccccaaaagaaaguucgguuucuuuguggauguacguaaggaaagacagguaacuuuggguugguuuuuuuuuuguuuguuuguuuuuguuuuuuuuaggcaagaucucaugcuucccaggcuagccugcaauuauaacuguagcugaucugucucccccuugaaaaugcuggaauuauacacauaugccacuauacucaguuuucuuuuuugguuuggaaugcuugcuucagaucuuugugauucauauacaaguacuccauggaagauacuguuaccugcuuccucauuuucccuagugccugcuggguccagguccugccuguuguaccucaauuguuguaccugacaauugauugacaaacgauaaaugcuugcacuguuauauuugaaggcucagaauccugacuaguacaauaaucuauuuuuaaagagagaaauuauagcuuuauaauagauguagccaccacaguacucuaagugacaauuuucaccucugggugacacccuucgugcugcacuucauucaguuuuguucucagagcaaaacaauagcugccacugucuucagauggucacucugcugccauuaauuuguccuuacgauuugguuuuccaaacaggauggccuaaaauauuuugguuuuccauacauuggucagagagaaucauuuugaaagacaauuucacugacauagaauuuuaaguaaccuaugugaccauguuuuuagaugaauuaucaaacauagcaucuugaacacaugagcguaucucugacuccacucuaauucuacuaaugucacaggaaggaacuaaaggaagauacacguugaacaggucagagagaaugagaacaucagaaaaaagcacaggagagaggugaaaagaacacauaugggaagcaccaguacugaugaggaaagagagcagacaacacaagccacuuccccacugggauucaaggcagaguguggacugccuaauuuuacugaacccagaaaugacuuaacaggaaggggcugcauagacaaccacauauuauaggcagaccuauaaagaaucagaagccugcuuucugcucaugaauccuggcuaaaguucaucuccaugcaugcuguuuaaggcuuucucuguuuauacuauauccaauguaaagaggccggauuucauuucaauaugaaaguugcaguuccauuuucucuuugccucacccucacugaggaaaguagaauccaagauuuugaugucuugggguacauuguacccccaagcccaucuaacaaaaaccaguuucaugcccauucuuccaggcucugagcuacuggaccuggaacucugagaacacagcauuuucagcagcuugugaagugacugaggcugcaggucaaaagaauuuuguuccugguggcuguugccugcugccgucagcugcaugcgagcuccaauuccuugcuggacauugugaggccauaguguaccaggcuuucuccaaaccuagcaccuccuacagaggaaugagcuaaagucuugugggguguucuuuuugggcuccugaguucuuauuaugcugauguuaucccuuuguugucuaagcucugccagugacaguggguacucauagaaucugcauaccugcaaauggcucuuccagaaggacccugcuucauggcugaauuaugggccaaugaaaauccaggacuuacuucaucaucauguaguaugggauagugguacagguaggggagagaacagccuagaauaucaaacaaaccugauguuaauaaucugggagcugaaacaaacaaacaaacaaaaucauucauaaaacauaugcucagcaauaaaaaaguggacaccugaaaaaugaggaacaauuuuaggacuucuuuuucuuuggaguuauguguauauacacuuguacaugcacaguuauaugugcgcacauguggagaccugaagaguuauucucuauugaccuuucacaguugccuguaacuuuaccaaauaggugaggcuggcuggccagcaagccccagggauuuuccugagggcucccuccccagugcugagaauacaggugugccuacuauacacagcuuucuaaaugugaauucuaagcauugaccucagaucuuccugccuuaaaagcacuuuguugacugagccaucuccccaaacacaacuuuaagaaacuaaaggagaaauuugaguuucaaaaauggucaaaagucagagcaagguaguuugccaucuauauacaaauuaacuuaggguugugaucaauaaacacaguuacaccuaaaaccagagcaucagguuagugagaugguucuggggauaaaggcuccuugccacucagccuauugaccugaguuugaucuuuaggacccacuugguagaaggagggaauuaauucuugcaaguugaccucugacuuucacauacauguuaugugauacacacacacacauugagcuccgagguucaagagagcuguugacuuuaaagacucugugagccuccaucucugagggagggacccacacacucccugaggcagccaaccaccagcuuccacggaggugaugauaggaggcaaccuacuaugugacaaucuaauugaaaagaggaagguauuacaaauagaacucacugucauaaagagucccgucauuguugcaggcauggacagagccacccgccagcuaacuaugcuaguaaaauuuuccagcagcuauuagaauaacuuagaauuauccaaauucguauagguaucuauagagaccaaacagcucuugucuuugcaaauaauaugagcaucuguugacugccacugcugaaagacugaaaguccuauguguguacacaugcacauaugucugaaguugaugucagcuauuuuccacugcuguccucacuuucucucauaagacagauucucucacuaaacccagagcucauuacuuggcuagaaugacugacuggaucuucaggaaucuaccuagauccaccugcccagcacuggagcuacauacaugacuauacucacuuucuuaaguggcugccaggaucugaacucaugucuuucaugugcucacacagugacuuuuucuuuuuuuuaguguuuuuaccuccuuuuaaaauauucagcacuuuggccagauaauuauacuuuccaucaagagaagucccagaggaguaaugaaauccuagucucuguugaagaguugucauaccuguuuuuggaccugccagucauacugauuucagacagcugauaagaaugguucaaguuggcacucagguuuaugggagaucugugaucugucacucaugacacugacuagaugaagaaagugacauguaggaacuaacuuucccaggguagucuagucucaccuuccaacugcuauuguagggcaucacagcacuggaagccccauugacuuaucuuuauggggugccacagggcaccagcauguagccauguguauuucuauccaucugcaucuggagcaucagcguuggucaguauuaggaaaguacgguuguaacuuugaguuguuuuugguuuugguuuuuuuguuuuaaucccugaaugcagaucuuuaagcuacuucaguagugaugcaguugccaccuuggcuauuccuugagauuugagacaaucagcugaaaacuucaugguagucucucugcaaccaugacugcauuuccaucauuguacuugguguguuagccaacauuuaacugaaugguagauugauggaaucauugcauaauugauuaauuuauauacaaagagaacagaaggaaaucuuaaaaauggaaaguccucacucccaagaguaaaggaaaacagaauaaauccaugucauucuuaaugauugagaugguuuuuguaguauauugacuccugcucuguugucccccagguaucuccccaauguccaccuuguacagcguucccucaaaucaggcaaaauugugcucuggaucuuguacagccuuggaacuuuuaucuuuugucagagacaaauagaugaaccacauagcauucuggauuuauucaucagauuuacuaaaaaaauccuaugucuguagugaguucugccuguucucuggaguucauucuccugccuaaaagccuggcauggcccagccuucugcgaccugucaccauugcuaaaacggacccccuuauuuuguuauauuuuguuauuucauuuuugagauacugccucacuuuauugcccaagguggccaaacuuguaacucuccuguuucagccuucuacucaaugggacuauagaaagaagccacucuauuccucuggcuuaaugcccucuugaagaguuuguguuguucuuccucuucuuugaauucucauauauugcaggauaaaugcaugaggaaaaagggacaugcccugcauacaguaugucugccagaacucuuccuggaauacauuauccauauaaugucuggguacugauguuggcucuggauccuagaaaguauuucauuuaaucuucuuauaucuaauuuuuuagaauaucccaaaaaccgaugguuaagcaguagauccuggugugacuacuggaaaugcuuaacaguggauuaagggccuuuucugacaaaugguacagaggaaaucauccuaccucauucuccaaagugguaaaguuauuaauuaguuaaguuugcguugacucuaauaguuaauauuucaagaguuguacauuuuacugagccuuuaaguguuuuauuagcaaaccacaguucuuauuuaucuuuacaacagcuugauuggaauguaagucacaagccauaaaauucauuuuuucaaaguuuauaauucaguggauuuuaaugugcucaaauacuuacuugagcaaguaacaucaccaaaguuaaaaacauaggaaugaccccaaaagacagacuucauauuugugagcugucucauuacucauacauacacacaaaggcacacaugcacaugucuguaugauuuucaaguuccaguauuucagauaaagagaucucucugauauguguucuuuagugacugcuuguaucuagucuaauauuuucagaauucauucguguaguaacaguuuguucuucauucuuuucauggccaaaugauauucuaucuacucugugcugaugccaccacuuuuaaugcuuuuaccaaccgauaggcuuuugggcauauuguacugucugacaauugugaauaaugucacaugaguauuuauguccauaacuauuguguaggcauucauuucaauucucuaggaguuggauugcuaagucauaugaugacuccauuucaguuugaagaauggccaaacuguuuucuaaauaucugccucacuugcaguugcuguucaugcacaaggaauacaaauauauuagauaccaauacacuggcucuuccucuaauggggcuucuacacagguaaggaauacagagaauguuccucuguaccaguucagaaauacccaggggucauuauugcuauggaacacacccaggauagaggguguagggguauccuagaaacagaugcuguuguuuagacacaaacugaggcaggaggcuuuuuuauagauuauaacauauucuagucacagaaaaauuaucccuugcuuuuucuuuguuuagcacuauagggcagcauuguccuucucauuuccaguugaacuccaaaccucagcugccauucuucuugagaccaucucccaguggcauggaagcccccacaggauggauccacccagaaacauuaucagaaagucaauggacuuugugcugcuuucccuaauugucauauucucuacugagacuggaauucucucacauauggcauaauggaaggaguccaaacaagacauuaacauuuuaacugugcuaagccagaagaucugugcagcaaguuaauaagugucaaaagucucugugauugaaacuccaguggcauuuuagaaagaacuucccagggucccucuugccugauuuguucuucagcaaagucuccaccaauaggaagugugauggaaaacagguccuuuugccccuccagggccugaacuaagccuuugcuuucugguugccuuaguuaucucuuuucaaccuuuucuuguaagcuuuuauugauaccaacaaagcaggaagaccuaagcagcuuucacaguccucagggauauguggugugcgccacuucuucucaguguuggaaugagaagauugaccugguggcugcaaggcuccaggacuagaagacugucauagggaaagagacggaugggaugccagagugaguguaguaggaaagcaugacagauaagucuuucuaaggccugaauauuggcuagaagcuucuuuuguucaagaaaugagauuuuuuuguuguugacccaauacuuugaaaguggaggagauuucagauuauguuuaagcuaagaaaguggcucacugaguaaggugcaugcuuacauaaacaugaugugcugaguuuagaucugauacaccuacauaaacauccaguuugaucccuaaacugcuuacguaugugcacacaaacacacacacacacacacaugaacccaaauacaugugcauauacacgugcacauaaaaagcugaguugcuuuuguuuuguuuaguucucaaucuucaacuuuuaaaauguggaauaacuuuuguuugguuaaaggaucaguaguaaucauaaaaauagcagcaaguuagaacaaagcuaggagagaaacaacuucuuugcugcuuuuaauauuagaaguaaacucuuagggucccugcaaccuggagucuggguguaacccaggcaugugugggacaggagcuuaugaucuguuggguuauaucagauaacuggcucugccuguagcuugaguuuuaagggggacauugccgccuucugguacaagagaguaaagcaugaguaucuccaaguaaaauuuccacucucucugcaauagaaaccaggccaucacucuucccucugggcaucucuucaccagcgugaccaugaacuuccuacauagggucaacucagggacaugcauauuugaccuagaucuuuauuuuauuaaucugcaggaagucagcaugccuaugacaugguaucaggcugcucaaguuaccugucucaguggaauucccauccuguaucuacauguguuacaaaugugagguguuuguuuuucugccauuuaucaaaagaaauuagaaucauaacucacuguccuggggucacuucauggauuuucagccccacacugccagccccaguucccuccuggcuaggacuccuauacugaccaguggcccuuaaauugguggccuuggggcagggaguggggguucuugaagcagaaagacuguguuaaaugcuaaaaugaugaccaccaguggaguagggucuggaugccagagccguaguuuuuacucacagucugcucauugcuggcucuauagccuuuggcuggugacugaucuuguuaggggaucgacugacucuuauguaaaauggagguacuugagcacguugagcuugaugaauuauuaugcuguuugagacacagcucaggaggaagcaucaucauccugucaucacauaagugccagccauuguuccugugccuuagcuuaaagcugaacauuguccuguucuuuuauugucuuccaguuguauuucuccagaucacaucuggagccccacugaauugggaauaaagauccuuagagaaacacaaguuauuaggcauggaagcagaaccaacagugaagcuggacuuacagccucugauaguucugauuuugcuccguagccaugcuuguggggaucuagaacaaguaauaaaucuuaaaaaaagacuuaaauuuuuuuucauguacuucaagugagcaacagcaaaaaauccaaaagaagcuuugaugcauucucagcucaggucccauaggucucacagcccugacccugacgcugguugggacacugggcuguggucuucuccuuauccacauaccucgucagccccugcaaaguguugucauaccagcacuugcaugccucucaacuuccugcuugcuugcucauccucuugaagauuaugucuccagacagccaugccauuccucauuccuugaaguuuccauucagaugucaccuuagcaaaggaccagcaguuuacagucuuuacauuggcuuaucauuugccucuguacucacccuuggaacaugucagcucuuuggggcuuacagaguacaguauacaguugaugcucaagacuuguagaugcacaguauuugugggugagcaguacuagugggugcacaguauuugugggugaguagcacuuggggggugcaugugcuaaggggcuuauuacuuagaaagacagaucagguggccuggaaagcacaaauguucacacacucacaccaaauuuuguauaugcuuagagauuuuaagaaaugacauaacuuuuucagaucaguuuuaccguuucaauuaccuccaauguuaugugaaaguuccuuugcauuacuugaaauggaucuuuuuuaaacuggucuggacggugugauauauauauauauauauauauauauauauaguauuugugguuugcauguaaauguccagaugacugaugguugcaugaaucucuucauguaguuacuucuuacccagcuaccuuacgucauagaaugucuauuagaauauucugccucauaaaaacaaguuguuuagccagagaugguagcucauuccugcaaucccagcacuugagagguagugguagaagaauugagaguuaagacuagccucggccacauagcaauuuggaaacuauccucaauuauaaaagacccuguugcaaagaaaaguauuuaucuuuauuauugaauuguaagacuuuuguauguaucuuagguauagguugacuaucaaauauauauauacauuccaacauugcccccccccaccaucaaaagacaaucaaguucucuauuucuuagagcccuuucagggcuaaugcucagugaaugucuuaagucaagacaccaagcccucugcuugcauagcacauuccucuauggaauucucacuccuggaauugggagaaaggccacaccguggccuggagauuacacucgagaccucuuccucucugcuguggcuuuugcagaccacaagggugccaguuucucaucuguuaccuuuucucauugacaguagccgaaaugagcccagagcugcccucuacuaugcugaaaauaccuuguagcugcacagcuuucuauugucucuucugucacaaaauuaauucauuuauucaguaaacauguauggaguuccugucauaugccgaguacucuucuagaccucacgguuuacugcagcuaacuacagaugacccaacucccuacuuucuggagcuggccuuuguuaggaggucugagaggaggggcgugguaugcaaugguaugacaggacuugucaucuguccguggugaccuucgcauuuacagugguaaagaacaaugagcauuuggacccaaagccuaaaauucuaacacccagaccacccaguuagaaucagagugaggagcuuguggucugaagucacacuuugggguacuauccgggcucaacucuauucaauagugucuccagugagauuugaguccaaacucuacccagggaccaccucauaggaguaugguuuccuaugaguacacaccacaccuaaagcauucaccacaguugguauccacauugucacucuuagugaagcugggcaaaccacuuuuccuggcucuugagugucccccuguauaaaagaacugcuggugacagcucuccauauuucuuuuucugauugaaugagcaucacaccuaggcuaguuaugccuuugcucuguguagucugacccacuaaaauaaggcuaugcauauuuaaguaaguguguauguguaugcaugcacucacaaugacacacauauuguguauauacacacacauacauguauguauguguauguuuaaauauguauguauauuacaauuuaaacacauacaccacauaaauugaaacaaggucauuauuagcuucucggucucuagauuuucauuugucauugccaucgcauacguugggaauguugccagguaagaaaacuuauuuccugcccuucaagcuccaagcuucugcuacucauuauuacagggagacuauaccuaguuucuucuuacagguauguuuguuuuauuucuguuuguucuacuuccaguuccguggagauaaaauacgcugaaaguaaggaaagaaaugguuucuuauagcugacaauucuggguuacagacugaugacagcaaggaagucacaguagccggaacugaaaacagcuggucauaucacauccacacuugagagcagagagacaaaugcaugcaugcauucuuagugcucagcugccuuuuucuacuguuauauaguugagggucccaaaccagggaauggugcugcucacuugcagccugugccuucccuuaucgauuuaagcagucaaggcacugcccccuacaggccaaccugaucuaggcagucccucauugaaaucugcuuuucuuucaggguuucucuguauagcccuggcuguucuggaacucacucuguaggaaauccaccugccucugccucugccucccaaaugcuaggauuaaaggcaugcaaugccacuaccaggccuagcuuuucuuauuacccugaaauuagucuugauuaccuuuaaauuauucaagauugaccaccaugcaaagugguuucuucuuucauuaaucucacuaucuggcugcauuuguauaauuuuuuuuuccuagccagcacaauauguucccccuguaagcaggccucugugaaauuccucuagcucucauauggcuuuguucaguggucacacuggaaaacaucccaaaagccgugcugcuuccuguguuuccaaaacaaaugagggauccccuggcauuagguucuuccuuuuaaaaaaucauuagugaagaugacacagcauaccaggcauagcauauagaagacaucauaaaaaaauagcauuggauguuuuuuucucuauauuauaaaggcuguaugcauagaguauuuauuagaaacuggagacaagggacagaaugcauuugucccacauccacaucauagggaucagugcuuauuucugcucuuccuucuguauauuuuuaaaaacauuuauuuuccuccucuguguagcacugguuccuaauuuuucauuucauuuagcauuacugauuguuguaauagcuacuggcugguaagcuucagucuacugcuaagucaucauccuuugcagaucuucucuuguuuuuauacacugaaaaugucucuaauuuuuuuuucuuccuccauuugaaaauauuaucaaaacuuuguacuugaaaucuggaacuccagugcugaagacgcuaaguaaaacaaaagguucgccgugaguggaggccaggcugggcuaccuggcaaauucaaggacacacugagcugcauggugauuuugaugccagccuaaaauucagcacagugagugagacccaugggccucaaagggaaaggaaaaagucaauuucaaaugccuuugcuauauuggagauuuuucaaaauuaguaucuuagcauaaauuaucugagugugauuucaggggaagggauuauuuguucuuagagucacaccaagguauuuuauauuauuugugacaauugugaaagauguugauucccuaauuucuuucucagccuguuuauccuuugaguagaggaaggacacucauuuguuugaguuaauuuuauauccagcuacuuugcugaaguuguuuagcagguuuaggaguucucugguggaaauuuuggggucacguaaguauacuaucauaucaucugcaaauggugauauuuugacuucuuccuuuccaauuuguaucccuuugaccuccuuuuguuuucuaauugcucuggcuaggacuuccaaguacuuuauugaauagguaggaagagaaugggcagcuuugucuagucccugauuuuagugggaaugcuucaaguuucuuuccauuuaguuugauguuggauacaguuugcucuauauugcuuuuauuauguuuagguaugggccuugaauuccugacuuuccaagacuuuuaucuugaauggguguuggauuuuaucaaauacuuucucagcaucuaaugaaaugaucauguuuuuuuuuuccuuugaguuaguuuauguaguggauuauguugauggauuuccauguauugagccaucccugcaccccuggguugaaggucccuuugaugugaucuuggauuagguuugcaagaauuuuauugaauaauuuugcauuaauauucauaggguaaauuggucugaaguucuuuuucuguauugggucuuugugugguuuggguaucagaguauuuguagcuucuuagaaugaauuggguagaguaccuucuguuucuauuuuguggaauaguuuaaggaguauugguauuaggucuucuuugaaggucugauagaacucugcacuaaacccaucugguccugggcuuuuuuugguugggagacuauuaaugacucuuucuauuucuuuagagaauaugggacuguugagaucguuuaucugauccugauuuaacuuugguauguggcaucugucuagaaaauuguccauuucauccagauuuuccaguuguguuuaguauaaacuuuuguagcaggaucugaucauuuuuugcauuuccucuguuucuguuucuaugucuccuuuuucauuucugauuuuguuaaugaggauacugucucugugcccucuagauagacuagcuaaggguuuaucuauuuuguugauuuucuuaaagaaccagcuccuaguuugguuguuuccacuugauuaauuuuagcccugaguuugauuauuuucugccaucuauuccucuuagguguauuugcuuccuuuuguucuagagcuuucaggggugcugucaagcugcuaguguaagcucucuccaguuucuuuuuggaggcacucagagcuaugaguuuuccucuuagaaaugcuuucguugugucccauaaguuuggguauguugugaugucauuuucauuaaacucuacuaagucuuuaauuucuuucuuuauuucuuccuugaccgagucaucauugaguagaguguugucccacauguaagugggcuuucuauuguuuauguuguuauugaagauuagccuuaaucugugaugaucugauaggcuacaugggauuauuuccaucuucuuguaucuguugagaccuguuuuugguuuuuguuuuguuuuguuugguauuuauuucauuuacauuuccaaugguaucccaaaagucccccacacgcucccccacccacucccacuucuugacccuggcguuccccuguacugaggcuuauaaaguuugcacgaccaaugggccucucuuuccacugauggucgacuaggccaucuucugauacauaugcagcuacagacacgagcuccaggggauacugguuaguucauauuguuguuccaccuauaggguugcagaccccuuuagcuccucucuagcuccuccauugggggcccugugauacauccaauaacugacugugagcauccacuucuguguuugcuaggcuccagcauauucucacaagagacagcuauaucuggguccuuucagcaaaaucuugcuaguguaugcaauggcgucagcgugugugaguuuggguguguguguauguaugcacacaugugaaugaauauaauaccaggucagugcugaauaucauucucaaugacaaauucuucacuaacauuuuuugagacaggguuucugaauguagaacucacuuauuggcuagacuggcugcccagcaagucccaagguuucuccugucugaaccuucccaaccuuccccuucuacccuggaaaaguuuccacaugcacaccaccauccccaacuuuucucugaaugcuagagaucugaacuugguucccuuuccuugugcagcacuuuaacaacaaaagaaacacuuuaccccuagcaccaaggccugcuccuuuuaaaaaagacuucuauugcuuuuaaacuggguaugcaugcauggaugaguguguguguguguguguguucuccucucuauaaauacacucuuuccaccagucuguuuccagcaggguacauucuguccuuuccaugggugcuugugcauggucaugcuaugaaggauuucucuaaaccugauucauucugguuuuuaugggauuaaugucagcuguggcaaugcuaaggucaccuaaguccucugaauguuugaguucugauaacaguccaaaguuugaugcaaagcugagccauaccaugcacucuacaguagcaacauggauaacaugaagaagaccucuaacaugguuagaaaauuccuccuaagcuuauugggcaucuccuuucuuuucaaguuuaaaaacauccaauaacugugugcaucauucccaaaacuuuaagauuccaccauauccagauaccagucaguacacagguacagcuuauguguauggcacuacaguguggagaaugagcagccacaaaagcucugugugaauguaccugaguacagcugccacaugugcaaacaucuguccaaaugagagcaaaaucuggcugucccagcuuguucucauuagucauuuaauagcucaucuggggcuacuguguaugagugugugacaaauugcuugacaucuuaguacugucaugguauccucuaccauggaucuguccuuccaaggucaaguagcaacuagagaaugccuuuuaagguucagcaccuguauaaaaugacacuggccagcugagguaguagaaucuuguguaaucauuuguacaucuuccagagcugggcauuuuuuuuuuacuuccaccuauuaauggaaaaugucauugcccaaguuccuuaauccaucuccgucauuugugaaguggcugguagagcuguaguaauuaaagaugugcagaauucucagaagaagucuuggaacauggaaugugcuguauguccauuucugauauccccaccacccuuguacaagguagcugcaggcauuaggauuaauguccuuagaacacauugugaauaauugaggaagguauuguuauuguccauccuugucucugugaacacacugacuggcuaggguaauuuguuaacuacaagaaagaaaccuauauguaggcuuauucucuaaucuaucagguagucuccagcuuguugauuucauuacuguauucaaauauucuaggucuuuaggucuccaacauggaucaacuucaaggucacagaugagauccaguguagcuuggggcuuuguucuaauuaucuagaccucuuagcuaggugaagcccaaguaaauauacauuauugaccucuuuuaucuuucugugauucaauucuggcuaaucaagaaagagauuaaagagauugcagcauaguuuuguuuggggagaacaugaauuauuuuuaaaauuggucuuugaccacaugccccucaguccaacauggcauucuguucccuugucaaaguguuuguguguaccgcuguuacacggcuuuauagugcaggugaggccucugaagcgaucagaagcaccuugccucugcucauuucugaugaagacauuggcuuccaccaggaggcccugggcuagcauugugaacaccauucaaggacauacacuuagaccuauaaaucaauaguuaguguagggugggagugcagucuacaacuuugugugccaccuaggugauuauggugcugcaagcaguuugaaaucuucauguuuaccucacccuagguuaggcugaacacugucagcaagugugugccuuauaaggguggccuaggaaggacagauauaccucucuccccaagcaaaggcauaccugagaccacagaaucagagugguaaauugaagccaauuagcagcuaguaacugcuagcacuugucaccaagguaguuguuaguaauuagcacuaaugacucuggagaggaaaacaguugugguucaaagacaucccuaccauuugaauucgcuguggguuuuucuguuugcuucaacuucuuuuuuuuuuuuuuuuuuuuuuuuuuuugcacuauuuuuccuuuacgugaaaauaccaucacaacugaauagaacuaacucuagagaaaagcacauggagacauaauaucauguggugauuuucacauuuuccaggaauuucuccuaccaggaagucuauagaaguuaugccucauccccuucucagugcaccugagucuuuccuauagcaaugucucaauaaacauugugacagucucaaggaagagcugaaacuguuggauaaagucaccaguaacacuucuuucugcauuuagugagaaaggaaccagagaaaaggaaaggaacuugaagagaguauuuucaaaaagaaaaucaaauuuauaaauuuaagugcucaguugccaaacagacaucuuuucuacagaauguccucagauagaagggucgucacuccuaacucaaucaccugugaauauauugugcauuggaaggagagaaaggcugauugguuacccauguguguccugcagguuggagaugaacugugaucucaccuguucacugaugccuauagaggcuguguguucucaccagggugacucuaaucauguguuuucagaacacuagguuacaugguguaagcauucgaucaauggcugucugauuuaggcuguacaaagguuuguucauucuagacacuacuccacaaugaucaaaggucccccucugcagaaguguuugaagcugacagcuguuugcuaguguggggucuuguuaauuaagaggauugagcaggucaucaaagggaaaugugguuaucuccauucuuucccuucacuuagcgcagagcauaaaauuaagggcauuggugaggaacuagaagaggagguagaaauugcaugaguuaaagaucccuccuccaugugguaacaacuucuuuccucugcuacaucauuugcaaagauuguguucaucaguuuccauggucuauggcaguacagagcagucugcaguuucucaacuuauauguuguagaagagugccaaguugugacuccacuccacauuuucccucuccuauuucuagggcacccuucugcuuugacucuacauguuugacucuucuagagaccauagaaguggaauuuuagcauguuucuucuuaugugacuggcuuauaucucuuagccaaguauuuucacuaggcccauacuuuagcagguaucaaaguucucuccccugggcauauacuagagcuaugagcaucuuuacccaucagcuuagagccagcccaucacaaggcuucacuuccaguaccaugugcuguguagacaacuuugcuuuauuuucaacuugcucaaccaaggaaugugcuugcccucaggucucugccucgaccgaaacucauccuuuauggguagcaucucaucauucuacccaggugcauaucauccucaaggcuuucuccucaaaacuguuacccuggcuaaaagaacauguauuuagaucauggcaugugacugccaugguucguucaucuuuacuuccaacagccugugaacaguuucuuucuugcuucugugucuccugacuauuuagcuuaagaacuugggucacaguuuuuguuauucaaguaauucucguaguuugugagaggaaguagcuagcuugcuaaauagcagugagacaagauaaggauuuuaacuaaaggaguuagauguguuugcuacauucagcucccaacccccucuuaaauuuuacaagcuauguccagcuuaggaacacaaguaggguccccuguagguuacaacagcugucagaugucccuaaugccagaauucugcucuaagccacuccaucucugguuucaggagauauguaauauuggugucuuguccagagaguugcucuuuauugcugggcuuaaauggaaaauuguuccagaguaccaagugauugacucuuuagccccaaguaagaauguagcuuucucagaauaaaauacacacacacacacacacacuuacuuuuaaaaccucccauuaaagaagaccucauuucaaaagugagccucuggaugaaggccaagagaacccugccuuugaacuccaugaacugguagcaacuggaaagcuguaaugcuggcacaugcuuuguaaauguagcauacucugauucauggaucuuggccauaaucauaaauuauaauugaaaauaauuuuguguuuaaaauagcguuuuauggugaggaauuuucugcauuaguguuaaaauuucacaucauuuuugauucugacuuugauuucuuugaaucugggauguuuaaacuguuauuguauucaauguaguccaaccagagcuuuguauagaggagcccaggacacuaaacaauguuacuguccauucugccaucucuuaaccuucaguaagugaggggagagaaagaacauugauuccaaauggcaggaaccaagacucaauuucugaaaagauacaaucucagcaugacaaggaguucccaaagccugggauggcucugaccuuacccaagucaucuagcagacagucauggacccacaauaguacugcagaauucucaucucucagacugugccuccaaagagcucuagcucaaaagaacuauccuguauucaaucuccagucuccuucugucuuccccucuuuguucuagcuucugccacucaccauacuaugugaauccugcuccccaggaucuuccuucaguugcuugaaacaccucuuaauaggccuuuucuucuaugaaaaccagcccagucucagcagggccuagagguuuagagauggcauagaagcuauacaguagaauaauggagccuauucugaccuucucaucuuuccugugaugaugacaguauuaauuguuucaggcagaugccuuccugccugugcaaaccugacuguccagaguucaguuuagcucagcuuccuguccugauggcccacagggaggauacacugcuccaacagagccuuuauuccagagcuuggacagaaaagauagggaugucgugggcaggcugcuuaaguuauguacuuauucagucccagugagguugacagaugcgggcucuuaagaguguguuugccugcacgugcaaaccagcauguugaggccagagguuaaugccugguuucugucucaguugcucuccaucauguaauacuaaggcaggaucucuuacuugaacccagagcucaccaauuugcuauagggauccucugucucugccuccugcguacugggauuacagaaggcuaccaugcccacccagcauuuaggugagcaaugaggauccaaacucauccucauguuuacacaguaaucauuuuauccacugggccauuucccaucccaaaugcaggcucuuuaguaauuuuccuauguauuauuuuuuuucaguauagggcuguugaaaaauaaguugccccuuuacaccauuguuggaggggcucucuuucuucuucaaggguugcugcuuuugcuuugucuaaugcaaaaggacuaauggcugcagcuuuccugcccgaaugccaaugugacucauuguuuauuuggugccauuugcuguuucuggaaucacuguuucuacuuuaagguauuaugucuggcuucuaaaguguuagaagcuugcagcaaacaugaguguugugcauucauagcaauccaggagcuuguauucuauauccugcacagaugugguaacuaaaguucaugguauaguggaagggccuguaauccacuucauaugguacuacaaucagaaaugcuagaauccaggaugaaacucuaaagugucaauuuuuauaucacuuuugagaaugcaauucauauaccauaaaauucacugguucagaauguacaauucaaaggauuuuaguuaggucaccaaguucugcaaccaugcaacauuagaccauuuuaauauucuuuucagaauuccugugcccauuaguauuuauccuauuuccuuaccuccuaagcccuagcuaacccguaaucugccucuguggauuugguuuuguuguuguuguuuguuuguuuguuuguuuguuuucuuauuccacgugcauccugugacuagaauuauuggacacauuccuguuuggccuccuuagcucagcuugguauuuucacacuccauccaugcucuacuauguguuaguguggaauucauucaauaacugaaugguauucuauugcauagcuauaucauacuuuauuuauccacauuccacuugagcauucaagucaucuccucuuucugguuacuuuacuuguccuaguuucaaugugaaccaucccucacugacucauguguuugaacacuugauuccugacugauggcauucuuuuggaagauuaugaaacuuuuggauaaaagaacuagcugggugacaucgaugaauagaguugggcugugaguguuaaacccuggcccugcuucauggcuaguuccauguaacacacaguucccacacauuccuucugucacagucaaauguacuguuccugcuauacuuacccaccaggauacacuacuugcucugaacugaggaauaacagagucauccucccuuaauuuguucagguaacuguaacagagaacauuaaccaauauaguaugacugugaagauucaacacaauuuauaauuuauuuguuuacuuugcauguauuuuguuuguguguauguuuguguaccacaugugcacaguuacugaggaggucagaacacaguguuggauucccuagaaugaguuacagaugguugugagccaccaugucggggccaggaauuaaguccuggaacuagugaucguaucucuguaccaucucucuauccccucauuacaguuuugagugggcauuuuuauguuucuccugauauauuccuaggaguggaaaucgcugagucaucuaucuaguacuauuguuuggguuugaaggccugauuuuuuuuuuuuccaaaaccacuucauuaugucuucaugacugaucuugaccaguuucaaugcaagaaucaugucuuaggaguuuuggauaacccccugauuccuaaguuguccuacugcaacaaaucuguuggcauaugucgauccuacugcaccaauuucaggccuuggagcaaguaccugauaauauuucaauucaauagcucuccaccuccuuacccuagagcauauucacuguucuuuaucacaaaaauggauuggaaguguuugagaagacacuagaaacccauacaaaacacagagcaugguaguuuaucauuuggucacuuuccacuucuacuugaauuccuacuacgcauaguacauaguagaugaagaugggggugaugucuggacaaagcuuguccucaaaugauuaaaaaaaaaaaaaaaacauuuuuccaugucugauugcuuguucugcuuccugucucugguuaauacugcaaaacauugauaccccaagcuccuaaaaagaaccccucuuccuccacccaagggccuugaccuuuacucuuuuagacuaaaacuuccuucccucuguuccucauucaguuacacagcagaacugaguuguucuuucagcgucaccuuuguuaucaccaucucagaauuaccgaaauaucuuccuccuacaccaaguaguaccccuucauagcacauauuucacccguuaggagugccaucuccgugauugacauccacauauaugacaagacuguacaccuuugaaaaucacuugccuagugcucagagaagcuuaucccuggauuguacauggaaauccaaagaacccuaauacaaaaugccugccaaccaaccccucuggacuaccaggcauggcgauggagucaggauauaggcuuaaggaaagaaaaguguuaaauagauugaaccuaagaaagaaagaaagaaagaaagaaagaaagaaagaaagaaagaaagaaagaaagaaagaaagaaagaaagaaagaaagagagaggaggaagagagggauggagggagggaggcagggagggaggggggaggagagagagagagagagagagagagagagagagagagagagagagagagagaaagaaagaaagaaagaaagaaagaaagaaagaaagaaagaaagaaagaaagaaagaaagaaagaaagagaaagaaagaaaagauuaggccaccuucuaccaguuccaggaaagaaaccaugaggaugugagaucccugagugcuguugccaguagugaguauggagugccagccaaaaaccuucuaucaaaguugauguauccucuaucaccucucuucugcccacaccccauaacuuccacuagccacugcucaucaaauccagaugaaugucucaaggauguggcuccuucucagcagguagggaagcccuaucucucucagcaacuucuguucuuucccuguccgaagaacaccaccucucaccagcccucuccuguucucugcuuuugaaguaucagcaauaaacuuuuacagauggugacaagaaaagccucauuagcuuugucccugacucagagaguagcucuaauccacugaccuucugaaucacgcccuuuaauguaucauucccaauacaaagccucucaaauaguacugaaacugcuuugaagugucacagccuccccacagucugagcuccucuuuguauucuagauccaucuagaaaggauucuggacugggccaggagguaucuccucaacccagaaagcuuccagaaaucucucccuuguuccaguaaugagaguuuggguuuguccccaugcuuauaccuggacuuccaacagaucuagaucuagggaggucacaauuuguccuagucaguguucugcugcuaagaagagacaccauggugaugacaacucuuauaaaggaaagcauuucauuuguagcuugcuuacauucagagguuuauuccauuaucauuauggugguaaguauaccagcacacaguuagacauggugccggagagauagccaagaguuccacauucagauuggcaagcagaaggaagagagagacuauugcacugcugugguaaaucuccucccaaauaagccccagcaaaugaaaacacaacaaaguuaauaugauuauauguugugcaccuagauugggcagaucuaccgcuacacuaccaucuuccacaucuaugagaccccuuagaacuugagguuucuccaggccaugcacuucuacucagcucuucuucuuucuucuucucuuccucuuccuccuccuccuccuucuccucuucuucuucuucuucuucuucuucuucuucuucuucuucuucuucuucuucuucuucuucuucuucuucuucuccuccuucuccuucuccuucuccuucuccuucuccuccuucuccuucuccuucuccuucuccuucuccuucuccuccuccuccuccuccuccuccuccuccuccuccuccuccucuucuuccuucuccuuuuucuucuuccuccuccuccucugcauccccacccucuucucucuuacaccuucucuuccacugcccuuuuaucugcccaaucagcagcucucuauuuuacaaauuaaggugggaagcagguuuacaggaaaucaccggagugcugacucacuccuuguucacaaccacucacuggagaacugaauuaacaucaaauauaauuagccccagggcuauccacaacaagagacaauggaucuggcuggagcauuugaaaccucaaagucuacaucucaauggcaugcuuccucuaacaaagacacacucacccaaacaaugacacaccucuaaauaaugccaaccauugaaauauaugagucuaugggaaccguuccuauucaaaccaccacacaauucuuuucaccuuuagcuaugaauuuuuauuaagccauacuugacuuccaugugaaccaggaguaaauuaauaauaccucauccuauuaacaugcagcgcaccacuuauuagauaaauguuaucauguauauugcuuuuuaaaucuaacaguuaaauaaguaaaggcacuuauuugaucauucucguuuucuaaaguguguguguguguguguguguguguguguguguguguguguguguuuaaugugauggcaaguacauaucagaggauaaccucaggugucuguuuucacccuucaucuugaauuacagguuuacacuacagugcucaacuuuuacauugacucuuggucucauuugugcaacaagcacuuuugugcacugagccaucuagccaacccuuuccucauuuuucucagugauaauacagaaacucaaagauguuaaguagcuagcaagaaaucgucgguuacaagaaggaaucucugguuugaaucaggcgagugggcacacagugagcccucgccugccuuggaaaccaagaaacucugaacccuguuuuucuuuuucuuugacaaacgugcuaggauucuuauagcaaaugaucuccuguaagaggcaaggccucucccuugcugccauuguccucauaauggcccuuaaagcauuggacaggaaacauaagggcuuuuggaagcuugagaugaaagaagugcuuuguucauucuccugcuuucuaaaauuauuccaaggcaaauuguguuuuauaggauauaucacuuaguuaacaaaacugcaagcuagacucgauaguauccagugugaacagauccuauucuaccaugcgacuccugaguguaagagagaaaugucuaaucagacuugcuuuuuuuaccucuuacacguguauuauacauaugguuuauaaacucuuuuuugguugcaggugauuucuauuucuccaggagaaauaggcuucucuuucacaucuggaaaaagaagaaaugguuguuuaggcuauaucuucucaguuacauuaucuauuuccucaccaaucaguauauguaaauaaauaaauguagguuauaugguaaaccuuuuucaaagaggaugcauauuuucaacauauucuaacaauuagcccauuacuaauaccuuucucaaauuggcagcuacauucaaaacaguaagcccuggacuucaugguccacucugaccuucaaauuccacccggcuaccaagugcuaccauugucauaagcaggggaauaacuuagauaucuaucaucccaauagcccuuaaaaccacaugagucuguuuuauagucaguuuuauuuuuaaaagagaacaacccuuacuauucuccuuuacguauaaacaauaacuaguauucaucuaaaguaauuguucucucugaggcuuucugacucagucugcuaacuuauaccuaguccuggaaccuucuagccuccauacagucuuaucuaggccuagaaugcuuucaaucucugagacuuucugccaaagaagcccacccuugcuuguuuuuuccugauuucugggaggcugguucaacauuagcuuuuaauuuuagaucuggcucagaacuguuuugcaagcugacugauucaaucuagcuucucucuugaccucuccagaacuguucugcuuggccucauacuaacucuggcaguauguuauaaucuucugguuccuucucacucucugacucauucuaucuucaugugugucuaguuuacucucucugcaacuuugucucucuaucacugcccugguaaaacugucucacuccuucucuuucucugacuuguccccuuucauagcuuccauuuuuucucucuucuuguaaaauuuggguauauucuguucugucagaucucccccuagcucaucacauugucugcaacucaauuacacaucacuuucaaacaugggcgcuuucuucuacaaaguacuuuuacuuuccuuuuuuuuuuuuuuuuuuugauguuucuuauuuauuuuuuuuccauuuuuuauuagguauuuagcucauuuacauuuccaaugcuauaccaaaagucccucauacccacccacccccacuccccuacccaaccacuccccccuuuuggcccuggcguuccccuguacuggggcauauaaaguuugcauguccaaugggccucucauuccagugauggccgacuaggccaucuuuugauacauaugcagcuagagucaagaaaggauggaccauguagagacugccuuauccagggauccaccccauaaucagcauccaaacacugacaccauugcauauacuagcaagauuuuaucgaaaggacccagauguagcugucucuugugagacuaugccggggccuagcaaacacagaaguggaugcucacagucagcuaauggauggaucacagggcucucaauggaggagcuagagaaaguagccaaggagcuaaagggaucugcaacccuauagguggaacaacauuaugaacuaaccaguaccccggagcucuugacucuagcugcauauguaucaaaaguacuuuuacuuucauuggugggguuuaaaggugaauacuaagggugugucuguauuccagccagagggauugcaacauuaauguucauauuauuuacaagauuugaaagucuaagagucuugggcuuuuaaaaaaacuaaaaaacaaacaaaaacaacaacaaaaacaaggcaacucucagauggaaagauuugcugacccuuaagugcuuaggguuuguuuuaggaucugaggaguucuaagacauccaccugcuggauuucuaacuuuaguaguguacacacacacacagaguuucucauuuaaugaagauuucugucuuaguuuaguuuuccagugcuguaacaaaauacaaugacaaaaacaauuuagaggaaaaaguuuuuauuuuuaacuuacaguuccagauuaguguccagcauguggagaagucacaauggcaggaacucaagacguggucaaaaaccagaaaauagugaauuaaugcauacuagucuucaguuuuaagucucuguuuuuuuuguuuuugguuuuuuguucgguugguugguugguuuuucgagacaggguuuuucuguguagcccuggcuguccuggaacucacucuguagagcaggcuggccucaaacacagaaauccgccugucucugccucccgagugcugggauuaaagguaugugccaccacgcccccagcacgucucuguuuuuaugcaggucagaagaaaucccugccuaggaaaugguaucaccaacaaugggagagccuucacaccuuaauuaaugugaugaaaauaaucucccauaaacauacccacaaggcaaccugaucuaggcagugcuucauugagacccucuucauagauuguuuuauacuauaucauguuggcaauuagagcugaccaguucauuguaacuuguccucuccccagcccaagccauucugaggagcucaggggacuauuuuacagacacaauccugcuuaaaggacugucauucuuacaugagguuugagaaaauguaauuuauaacaaagcaaauuugagcuugccuacaguggggcacgugauaagcugcaguugcauucuuagcuaucuuguugcaguaaaucuccuaccaaauaugcccagcaaaugaaaauacaacaccaaugucugcuuuaaaaccugugcucugggucccuagauggcacugucuugcugugugcccucauaugacagaagggacauggagcucuacagggucuuuuuugcaagacuacuaaccccagaaaggccuugucuucuaauagcaucacauugagacguagauuucaacauaaaacuugggaaaacucaaacauguagcucauuacaagcacaaugaauaaaacaggugauauugaaagacaaacuucagauuuacuuucucugaggaaaaaaaaugcuauuacuacugggacacuguuuuuauacucuguaaagauugucucuuauccaaaaaugcuuauagcugaaaaacaucaaauucugucuuuguuguugugguucuuguuuuuucugauuuuggaauauuuguguauguguaaucagauaugucagagaugacacccaagucugaauacaaaguuuauauuucauauauaucuuauacucauagccuagugauagccugccauaugagaucaaguguggaaucuuccacauguuaauuaugucaauugucaaaauguucuggguuuuagaaccuuuggcguuauaaauuuucagacuacagaugcucucaaucuauguuauuuacuauguaagguaacaaggcagccaggaacuuaacagaucauagcuuccagcuucuagcacuguuccauaccauggaugauauaggacaaggaccguaggcaaaagcaaggugagggugagcaugggaagauacugaaugccaccagggaccagggaguuuuggucagugaagaacuaggagacauccaagcacaagggaccaucaaugcaagagcagagagagugugugacgcuaagagagagagguaccccaugcacaugcuggggagagugugugaugcuaagaaugagaggaacccaugcccaugcugcuauugugccaccacugugaagagaagacgucgaacagggucagggcuauugauguagacuugguagaugagcuuuacggauggaacaaagaaaggcuggugugagauuaggucuaaaugugagacauuaguuguauagcugaguagagagccucucuccuaagcucuauugugcagaaccugucuagaggccacaaggguaagcgagcagaaacgugaggacauucaucugccucauguggacuugauguguuguucacaaagcaucaguuagaguucuucauucugauauuuccauaugcucuacaagguauccuggcggagggaagaaagauguuguucugagcuacagcagaaaccucaaccaaaccuagugacuuuggcaaguuuuuucuucgaaaugagccucauauuucucaccugcaaaaugaguggauuuguugagccaucuaguugcuccuccucuugcaaaagucacugaaaauaaacagaaaaaguagauugaaagcauuuaaaacaaaugcacugauaaggcguaaaagggauugaucuaacccaguaaaauaaccauuuaccauuuauaagguaccaugccuuaagcacuauacagagaagcucacaugcauuaaucuaugcugcauuuucauaagggcucugugccuauacauuuguucaaacccuaaguagcauuaauacugguaagcuuaucugaguuaauauucacaauaauuccagucugcaaauguuaauaucucuaccuuuaagagguagggaacugagacacaucaguuaaauucauuauucaggaccuaagaucuuguaaguggaagagccccagacccucacacagggacuccugacuucagagcucaucaagagaccauuguucaguguugccuucugucuaaaaauucuauguacagcuguugaucaucaguggcaucuauaaauucauguucaaaaucaguuucuggaacaaaaaaacuugaaagcaaaagacuaugacauucagggaauggaugucuuuugagguuuggucuuguuuuguauugugaugcuaagugcaggcccugauaccuagagucugcacauagacccaagugaugcuauguguccuugcccccaaguuaucucugauugguaaauaaagaugcugauagacaauagcuguacagaagagucaugggugacuguuagguuuccuaggcuuggggcuggaggagaaccacuagaagaagaugaauggaggagaagcugccaugagugaaaugagccaugaaaugugacccugagggcugacuaauuggaguuaagagcagcccaguugaaacaguaaguaauaacauagguuaucaauagggcauagcauagaugguaaauauauacccaauucuaguacugauuaaauauuaaauauaaagguugugugugucuuucauccaggcacagaauaaucaaagguguagaaaccguggauuggaauuaaauaauuucuacaacagaugucacuagauucaguagcaucuuuuggcugagagccuagagugaagauugaguagcucuuguauacuuugcaagccaaugaaugaaagcugcuacaaaauugggagacagaaaaccaaagcaacaaauaagugggaaagcuuaguugcuucaaaaaauuagacacauugguuauuuauuacuuuguaggacucaaauguggaucaaggaaccagucugccugggaucauuguguagaacuuaaaggcucuuaggucugguuucauggauaguaauaaugccaacuacaagaagaugcagcugugcaaucuugaagaaguaauucaagauuucugucuuucacuuccuuaucuuugaaaugggagugaugugcuaguacugcacuugaggugcuugagagaggcuaauggaaaaccaaaugaauaaauugcccuguaucuguaucagcauuagcauccaucauuaccacuggaccaaauaaccuugucaccuccacaguggacuguuaugcgcauacaaaaugcauccgacucaaaagaguucuucauuuugguuuguauguauuuuugcugagaaguggcaccaauaggcuccuucucaguuggagaauugugcuuaauagcuggguaaagaggggguaagauuagcguuugguucuacuuaauguauacucuugucauuccaccuuacccugcaaaagguuagagacuguagcauaguagacaguaauggcuuuaugaacagguacccuccaccuccagcaauggccuuccaucuccaacacuggccuccuuagcuccccaucaaauuuuauuaugucaguaacuaugugaagccccaagacagggugaccuuagguaauauaggacauuauuuuucauuaaaacaaaaaaaaacuuguauuagaauaugaaauauauagaaaugauuauaguaaaaauugaccauuccaagaacucacugguaauugguaauuugaguuuugagacucaaaauagguaaauggaguuuugagacuucuuuguguagccuacaauggcaagaacugccuguauaagagacuguucuuugcuacaugagaacucuucugcuccagccucccaggcccugggauuacacacauauaccacaaugcucagcuguuuaguccuuccucaggguuuuuaggcaugcugucaaagaaauacuuuacaaugcucugaauguuagaccugugccuucagagagccuagucugacuccucuucugucucuagucugcugagcccaguucuugcucaguucuuggagcuguuucuucuucagagaauuuggaggacauccagagcaaggcuuugaaaaagaaagggacauagcccagcacauggguuuuguuuuggaucgguuugguuugcuuuugcuuuugcuguuguuuuguuuuguuuuguuuuguuuuguuuuguuuuguuuuguuuuuuaccuagugugauucugcacccuccuggaaucauuugaccugagaaaccuggagaagaaggguguucuaucuccuaagucuagaccuuacagccccagcuccuggcacuggugccuuggcucuuggggccacaucucagugcuuggaauauccacauuccucuugacauuuuccuuaguuauuauauuaucugucaccugccaauggcuagccaggccuccuuagucauccuguuaacaguuaccaugcuguugccaccuguucuuucucuuggccacucaucacucauuuagucauucugcacuuuuuguucauccacucuuuucagagugcaggcagcaauaguuuucuaucuuuucuuguguugaucuauuccaugaaacacuucugaacacuuaaauaucuacagagcccgaucuguggaucagcuuccacgucaguaguaacuuugcuuuaucacagguucaggaaugcucuucuuucacccugaccaugucuguaugucacaggaaguuugcuccaucuugcaucucuguucuuuuguaucauuguuugacaacuuguuuuaguuucagcuguguagccccagccaacgacauaaauggauuuauccuaucauugccuucaucacuuacccaguaccagacugugacgaaagacugaaauuugauggaguucuaaauucaaaugaaguggauuaacagggaaaacccccuguaaguucccuuucauauagacaaagcacuaaggcucaggagaaaugcaaccaaucaauaauuuauuuaaaaggaagcuucuagagcauuuuuuuuuucaucuucagaauuuucccucagcuucaagugaauauccagcauugucuuuuaaguggcagaguccuggcuggcugggauagcugaaguaaaagugagaauauagaucugucuuuguacgucuguguguguguguguguguguguguguguguguguguguguguguguguguaggccagaggucuacaucacaugacuacuucaaucacucuacaccuuauuuuuuuagauggcauauuuuuuuuauacuuuuuauuagguauuuuccucauuuacauuuccaauacauaucccaaaagucccccauacacucccacccacucccccuuuuuggcccuggcguuccccuguacuggggcauauaaaguuugcaaguccaaugggccucucuuuccagugauggccgacuaggccaucuuuugauacauaugcagcuagagucaagagcuccgggguacugguuaguucauaauguuguuccaccuauagggcugcagaucccuuuagcuccuuggguacuuucucuagcuccuccauugggggcccugugauccauccaauagcugacugugagcauccacuucuguguuugcuaggccccggcauagucucacaagagacagcuauaucuggguccuuucagcaaaaucuugcuaguauaugcaauggugucaguguuuggaagcuaauuaugagauggaacccuggauauggcagacucuaaaugguccauccuuuugacucagcuccaaacuuugucucuguaacuccuuccauggguguuuuguucccaacucuaagaagggaaaaaguguccacacuuuggucuucguucuucuugaguuucaugcguuuagcaaacuguaucuuauaucuuggguguccuaaguuucugggcuaauauccacuuaucagugaguacauauugugagaguuccuuugugauuggguuaccucacucaggaugaugcccuccagguccauccauuuggcuaggaauuuaauaaauucauucuuuuuaauagcugaguaguacuccauuguguagauguaccacauuuucuguauccauuccucuguugaggggcaccugggcucuuuccagcuucuggcuauuauaaacaaggcugcuaugaacauaguggagcauguguccuucuuaccgguugggacaucuucuggauauaugcccaggagagauauugcaggauccuccgguaguacuauauccaguuuucugaggaaccgccagacugauuuccagagugguuguacaagcuugcaaucccaccaacaauggaggaguguuccucuuuuuccacauccuugucagcaucugcuaccugaguuuuuggucuucaccauucugacuggugugagguggaaucucaggguuguuuugauuugcauuucucugaugauuaaggaugcugaacauuuuuucaggugcuucucagccguuugguauuccucaggugagaauucuuuguuuagcucugagccccaucuuuuaaggggguuauuugauuuucuggaguccaccuucuugaguucuuuauauauauuggauauuaguccccuaucugauuuaggauagguaaagauccuuucccaaucuuuugguggccuuuuugucuuauugacgaugucuuuuugcuuuacagaagcuuugcaguuucaugaggucccauuugucaauucucgaucuuacagcauaagccauugcuguucuauucaggaauuuuuccccugugcccauaucuucgaggguuuucccuacuuucuccucuauaaauuucagugucucugguuuuauguggaguuccuuaauccacuuagauuugaccuuaguacaaggagauaggaauguaucgauucgcauucuucuacaugauaacaaccaguugugccagcaccauuuguugaaaaugcugucuuucuuccacuggaugguuuuagcucccuugucaaagaucaagugaccauagauguguggguucauuucugggucuucaauucuauuccauuggucuacuugucugucgcuauaccaguaccaugcaguucuuaucacaauugcucuguaguacagcuuuaggucaggcauggugauuccaccagagguucuuuuauccuugagaagaguuuuugcuauccuagguuuuuuuguuaauccagaugaauuuguagauggcauauuucagugaaccuguaguucuguaguuuucuagacuaguuuuccugggaacccuagauaagaaggaucuuucuuacucucuccaacacugugauuacaaguaugcauaguugcaacaggcuuuuucgguggaugcuggguacuggaauucaagucucaccauugcacaagaagcacuuuacccacugagacaucuucccagacccccaaaucuuuggcacuccauggaugaacauauagugaccagaaauucccugcccacauguaaccauuuuuuaaaacaaagcuucaguuuguucuuguucauaaauaguauauuuuauauaacugaauaucacacauggccagccaucaagauaccacuguagugcccuccgcuuucuagaauguuucuaaacuugaaaguaagguggagcaacaauaguaaugauaaguguauauggcacaugucagaaguguugucguaagaaacacaagcccugugugcugcuuuguugguggacccuguguucucugcucugcaaagagagauucugaggcccaaaagacacucugcccaaggaagacuuaacagcucaggugggacuacuggugugcacuugaguuuugacgagaugaggcucuauuguuuuuguuuuuuuuuuuuuucaaagucucugugaaaauauguaguuaacauaaaauaaaagagagaaauggagacaagaauggaauauaucugaguuuguucagcagaagagacuaaaauggaaucauuuuguggcuccaguaggcauuucuggagucagagagcucaugggaggacugccacugagaugccaggcuugugggcauugaaauccaagaguguguucuucauauucuuggagagugauggggauaaugacaaguuaccuccuuuauauuuccauauuuucaaaugagaucuguucuuaugugaccagauacacuaugcaugaaccuacauacugaguaccuacuguuuauuaguuauuagcuaagggaggggaucagcucuggucaggcuaagagcaggagaauuucagaauuucagaaaacaaggcaaaauugcaucauuaaggacacaugauuuugacaguaauagucacaaugucuacugacagcaacauccacauucuuggugauguucugaacaaacacaaagcaggauggaauaggagaggcacaucugcucugucaagaaagaacaacucuuucuaaaguuaggacaaaaucaugggucauuuucuuaauucuuuaucacacgaaagcuggggaagauuugugagucauggccucugagacuuuuagaaugaaaaaauaaagaugagugugcuguuauuuuuauaauuucuaugaccaaauucuggacaagaagcaaguuaaugagggaaggguuucuuugggcugacagcuugaggguacaguccuugcuggcaggagggcuguaacaguaggaaugugaggcaguugcucccauugcaucuacugucaggaaauagagaugagugcuggugcucaacuugcuuucucccuuguauuuaguccaguaccugagcccacaggaagguguuaccauguacaggguaggucuucccugcucacuuaaacauuccuuacagaaacagaguuauguuucauguacuuugaaauuuagucaagcugauaaugaagauuaaucauauccaugaaaaaaagguggcucuccuuuuagaaaaguaaacccauaggaauaacauaccuagacuccuaagugcaaguccuuaucaccuguuacuggauuaacugagauauuuaaauugcacagaggagaagcuauuugagggaguaacuaauauuguuuuuuuuaaccugugaugauuagcccaagcucucaaaaggaaaaccuuuuauacuuaguucucagaagaggaaaacaguaagaguagacuauaggaagguguacaaagugaggacaaugagcugucgagucaaaagaucuuuacauaaauucacuuagagcucuggcuaugauaccugcuuuccaaucagggaugagcacuccuccccuugcccuggagucaugcuaaccuuccuuggagauaccuagcaucuuguugguauuuuaucucucugauacuagaauauaagcuaucuugggucagaaugugcuucuauuuucuuuauuacacuccagugcuugguauagugacuauauaaauauucaauaaaauauauuuaacugaaugacuguuuucaaagauuuucaaagauagcuaauguaggagcugcagugaugguucagcaguuaagagugaguacuguuaaugcagaaaacccagguucgcuucccuucauuggcauagcaucucaccaucuguaaacuccacuucuagggcaucugauacucucuucuuuccuaugggagcuccaugcacaugugacacaggcaggcacacacacacacacacacacauacauacgcacacacacguaaagauaaccaauguaauaaugucuaaauagaaagaaagccauucugcuccugacuaacuuucagguuuugguuucuguaucuccauucauccuuuaauauucuaugugucagaaacacuucccugauaucucuuuccuaugguaguauaugccaugagaguaaagauugaacucugcugucuuuuuucuauuuucuuauuaucacauuguaugauauuugauaccuagaagugcuccauaaaaauuuauuuaaugaaggagacuaauaucugcaaggagauuaacugagggcauuuaggaccacagggaguccauaccuagccaagcaugucaauagacacuaaggaguugagugugcuaugaagacuuaguaguucaacaucaugaggacaucugcaccguauaaggauauaugcaccuuagaaagauaucugguucagcuugaugguuuguauauguuuagcccagggaguggcauuauuuggagguuuagccuugauggaauaggugugucacuguguacaugauguuuauacccuaggccuagcugccuagaagucucuauucugauagcaggcuucagaugaagauguagaacuaucagcuccuccugcaacauaccugccuggauacugccauguuaucgccuuaaugauaauggacugaaccucugaaccuauaagccagccccaauuaaauguuguccuuauaagaguugcuugaucaugauguuuguucauggcaauaaaacacuaacuaagacagaaguugguaccagggacuauaccuauugcugugauaggccuaaccaugcuuuuguuugaaagaauguggauuuggagacuucagauuuguauagcaguggaaugcuuuaaacgggucuuauuccuaguaggaauauggaaggcuuuguuacuaagagugauuugaauuguguggaccuggcccaaggggucucaauuaggaagaauuuuggaauguggccuaaagacuguuuuucggauauugggggaagaauguggcuacuuucugacuuugucuggagaaucugccagaggcugaguugaaaagacucagauuaauugcauugacaaaggaagucccagaaacacccuucauagccuuuguucucuuguuaagugucaugaagagcauuucaaacaaguguagcaagcugagaaagaaaaaauauaaaauauauguuuugaguauuaaaagggcaccaggaaguaaaauggagcugauuccugugcucaaggauauuaaauuaaauuaagggaguagugaccuuggggcaagaucccacccagcuaaauuuagguccaggcaugguaguacaagccuuuaauaccaggaggcaaagacaaacagaucucuaaauugaaggccagccuagaacagaacaaguucuaggugaagaaaaauuuaaaucuaggcuuggaacacaccuuuaaaucccaguguuuaugagacagacaugcagaucucuguguucagucagucuacaaagcaaauucaaggacagccaagcuuaggcagucaaagcuaaugauaauguaauagaacaaggaggccauguucuugccccagccagcagcagaacucagcagcuuuggucagguggcuauggcuuuagaguccagaauaaaagggauuauugggacaauugacacuggguagcuggagcuaagaaauuagugguaauuaaaaagugaccagcaucacugaggugaaaucuucugggcaguuuuauuccucagagcacagaaaaguuauguuccagacauagccaagguugugccuugugcugcagcuggacuuuguaaugugugucccuaugugguacugguuuugaaagcaugacugggucaugaauagcagcucagucuuggugcugugagaggccauggaaugccauuggugaagcuccaguuguaguuggcaguccaggacugaaggggacauacaaaggauuugaggcuuggcaccaugaagagagcccaugagaagcuacuggugaagccuaguugcaguggaaggccccaguauauuugagaugccaguaccaugggaugaucaccuaagaacagcagcaucaguggaguggaucaaccugagcuuagagugcuacaaagggcagagcugcagaaguggcaccagcccuuuggaggagccuagaagaucauguguggaucccagacuuugaaacaaaaagcuguagcauugaaguugccuuggagaccccaagauguucaagauuccagcgccgugagcuaucugcugaggaaaacuccuaauagggaguggaaccagcccaggagaaagcaguuuguuauagucaacaaagaugaaaaaggaguuggaaaucuaaagacugcuuuaacaucagacauggagaugcagaguuuggaguuugcccaucugguuuccuuucuugcuuuggguauuaaaguuaagucauuggauggaucucagaagagguuuugaccuuaggacuuuuaacauuguugagacugcuauagacuauggggacuuugaaaguuguacuaaauauauuuuucauuuugcuuuggguaggcauggcccccauagacucaugaguuugaugaagccuauggggaucagggaguggaaugugaugguuuauguauguuuggaccacauaguggcacuauuaagagguguagccuuguuggaauagguguguuacugugggcuuagacuuugaugucauaguucuagcagccugguagucaguauucugcuagcaggcuucagguguagauguagaacucucagcuauuccuaaaccaugacugccugguuucugccauguucucaucuugauaauggacugaaccucugaaccuguaagcuagccccaauuaaauguccuuuguuuuuuuuuuuuuuguuuuuuuuuuuuuuuuuuuuuuuggggguugaaaugggaaauacuuauuuuuuuuuuuauuuuuuuuucuuuccauuuuuuauuagguauuuagcuccuuuacuuuuccaaugcuauaccaaaagucccccauacccacccacccccacuccccuacccgcccacucccccuuuuuggcccuggcguuccccuguucuggggcauauaaaguuuguguguccaaugggccucucuuuccagugauggccgacuaggccaucuuuugauacauaugcagcuagagucaagagcuccgggguacugguuaguucauaauguugauccaccuauaggguugcagaucccuuuagcuccuuggguacuuucucuagcuccuccauugggagcccugugauccauccauuagcugacugugggcauccacuucuguguuugcuaggccccggcauagucucacaagagacagcuacaucuggguccuuucgauaaaaucuugcuaguguaugcaauggugucagcguuuggaugcugauuaugggguggaucccuggauaaggcagucucuacaugguccacccuuuaaucucagcuccaaacuuugucucuguaacuccuuccaaggguguuuuguucccacuucuaaggagggguauaguguccacacuucagucuucauuuuucuugaguuucauguguuuaggaaauuguaucuuauaucuuggguauccuagguuuugggcuaauauccacuuaucagugaguacauauugugugaguuccuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguucuuuccagcuucuggcuauuauaaauaaugcugcuaugaacauaguggagcauguguccuucuuaccaguuggggcaucuucuggauauaugcccaggagagguauugugggauccucugguaguacuauguccaauuuucugaggaaccgccagacggauuuccagagugguuguacaagccugcaaucccaccaacaauggaggaguguuccucuuucuccacauccucgccagcaucugcugucaccugaauuuuugaucuuagacauucugacuggugugagguggaaucuuaggguuguuuugauuugcauuucccugaugauuaaggauguugaacauuuuuucaggugcuucucugccauucgguauuccucaggugagaauucuuuguucaguucugagccccauuuuuuaaugggguuguuugauuuucugaaguccaccuucuugaguucuuuauauauguuggauauuaguccccuaucugauuuaggauagguaaagauccuuucccaaucuguugguggucucuuugucuuauugacggugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuucagugucucugguuuuaugugaaguucuuugauccauuuagauuugaccuuaguacaaggagauaaguauggaucgauucgcauucuucuacaugauaacaaccaguugugccagcaccauuuguugaaaaugcugucuuucuuccacuggaugguuuuagcucccuugucgaagaucaagugaccauagguguguggguucauuucugggucuucaauucuauuccauuggucuacuugucugucucuauaccaguaccaugcaguuuuuaccacaauugcucuguaguaaagcuuuagguccggcauggugauuccaccagagguucuuuuauccuugagaagaguuuuugcuauccuagguuuuuuguuauuccagaugaauuugcaaauugcuccuucuaauucauugaagaauugaguuggaauuuugauggggauugcauugaaucuguagauugcuuuuggcaagauagccauuuuuacaauauugauccugccaauccaugagcaugggagaucuuuccaucuucugagaucuucuuuaauuucuuucuucagagacuugaaguuuuuaucauacagaucuuucacuuccuuaguuagagucacgccgagauauuuuauauuauuugugacuauugagaaggguguuguuucccuaauuucuuucucagccuguuuauucuuuguguagagaaaggccauugacuuguuugaguuaauuuuauauccagcuacuucaccgaagcuguuuaucagguuuaggaguucucugguggaauuuuuagggucacuuauauauacuaucauaucaucugcaaaaagugauauuuugacuuccuccuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguaugggccuugaauuccugaucuuuccagaacuuuuaucaugaauggguguuggaucuugucaaaugcuuuuucugcauccaacgagaugaucaugugguuuuugucuuugaguuuguuuauauaguggauuacauugauggauuuucguauauuaaaccaucccugcauuccuggaauaaaaccuacuuggucaggauggaugauugcuuuaaugugaucuuggauucgguuagcgagaauuuuauugaggauuuuugcaucgauauucauaagagaaauuggucugaaguucucuaucuuuguuggaucuuucugugguuuagguaucagaguaauaguggcuucauaaaaugaguuggguagaguacuuucuacuucuaucuugugaaaaaguuugugcagaacuggaauuagaucuucuuugaaggucugauagaacucugcacuaaacccgucugguccugggcuuuuuuuggcugggagacuauuuauaacugcuucuauuucuuuaggggauaugggacuguuuagaaggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucaguucugauuuuguuaauuaggauuuugucucugugcccucuagugagucuagcuaaggguuuaucuaucuuguugauuuucucaaagaaccaacuccucguuugguuaauucuuugaauaguucuucuuguuuccccuugguugauuucaccccugaguuugauuauuuccugccgucuacuccucuugggugaauuugcuuccuuuuuuucuagagcuuuuagauguguugucaagcugcuaguaugugcucucucccguuucuuuauggaggcacucagagcuaugaguuucccucuuagaaaugcuuucauugugucccaaagguuuggguacguuguggcuucauuuucauuaaacucuaaaaagucuuuaauuucuuucuuuauuccuuccuugaccaagguaucauugagaagaguguuguucaguuuccacgugaguguuggcuuucuguuauuuuuuuuguuauugaagaucagccuuagugcauggugaucugauaggauacaugggacaauuucaauauuuuugaaucuguugaggccuguuuugugaccuauuauguggucaauuuuggagaagguaccaugaggugcugagaagaagguauauccuuuuguuuuaggauaaaauguucuguagauaucugucagauccauuuguuucaucacuucuguuaguuucagugugucccuguuuaguuucuguuuccaugaucuguccauuggugaaagugguguguugaagucucccacuauuauugugugaggugcaaugugugcuuugagcuuuacuaaaguuucuuuaaugaauguggcugcccuuguauuuggcgcauagauauucagaauugagaguuccucuuggaggauuuuaccuuugaugagaacaaagugccccuccuugucuuuuuugaugacuuuggguuggaagucaaucuuaucagauauuaggauggcuacuccagcuuguuucuucauaccauuugcuuggaaaauuguuuuccagccuuuuauucugagguagugucuaucuuuuucucugagaugugucuccuguaaacagcaaaauguugggucuuguuuguguagccaguuuguuagucuaugucuuuuuauuggggaguugagaccauugauguuaagagauauuaaggaaaaguaauuguugcuuccuguuauuuuuguuguuaaaguuggcauucuguucuuguggcugucuucuuuuagguuuguugagggauuaccuucuuguuuuuucuagggcauuguucccguucuuguauugguuuuuuucuguuauuacccuuugaagggcuggauucguggagagauaaugugagaauuugguuuugucguggaauacuuugguuucuccaucuaugguaauugagaguuuggcuggguauaguagccugggcuggaauuuguguucuuuuagugucuguauaacaucuguccaggcucuucuggcuuucauaaucucuggugaaaaaucugguguaauucugauaggcuugccuuuguauguuacuugaccuuuuucccuuaccgcuuuuaguauucuaucuuuauuuagugcauuuguuguucugauuauuaugugucgggaggaauuucuuuucugguccagucuauuuggaguucuguaggcuucuaguauguucauagguaucucuuucuuuauauuugggaaguuuucuucaauaauuuuguugaagauguuugcugguccuuugaguugaaaaucuucauucucauccacuccuauuauccguagguuuggucuucucauuguguccuggauuuccuggauauuuugaguuaggaucuuuuugcauuuuccauuuucuuugauuguugugccgauguucucuauggaaucuucugcaccugagauucucucuuccaucucuuguauucuguugcugaugcucaaaucuaugguuccagauuucuuuccuaggguuucuaucuccaguguugccucacuuugaguuuucuuuauuguuucuacuucccuuuuuaggucuaguaugguuuuguucauuuccaucaccuguuuguauguuuuuuccucuuuuucuguaaggacuucuaccuguuugauuguguuuuccuguuuuucuuuaaggacuuguaacucuuuagcaguguucuccuguauuucuuuaagugauuuauuaaaguccuucuugauguccucuaccaucaucaugagauaugcuuuuaaaucuaggucuagguuuucggguguguuggggugcccuggacugggcgaagugggaguacuggguucugaugauggugaguggucuugguuccuguuaguaggauuccuacguuuaccuuucgccaucugguaaucucuggaguuaguaguuauaguugacucuguuuagagauuguucuucuggugauucuguuaccgucucucagcagaccugggagacagauucucuccucugaguuucagugcucagagcacucucugcuggcaagcucucuuacagggaaggugcgcagauaucuuguuuuuggaccuccuccuggucgaagaagaaggcccaaaacagggccucucucagaagcuguguugcuuuggcaguucccagaagcugucagcuucuguggugcagacucucaccugugcagacuaaaauccuaaguuccagggaguccuggaaccaagauggugacugcugcuccugaggccgaggccgucucccgagccaggcggacaccuguccucugguccggaugguggccgguugucugcggcccgcccaggcugcugccucagcggcucugugcuuccgcccgucccagaagcuguccgguucucuggugcacccucuaaccuguucagacuaauuuccuaggucccguggagucccggaacccagauggcgaccacugcugcugaggcugaggucgccucccaagccaggcggacaccuguccucugguccggaugguggccgguuaucugcggccugcccaggcugcugccucagcggcucugugcuucugcccgucccagaagcuguccgguucucuggcgcacccucuaaccuguucagacuaauuuccuaaauucugcugagucccggaaccaagauggcgaccgcucuaaauguccuuuguaagacuugccuugaucauggcuaacugcaguuaacaucggauuuaagagcaggcaugagcucuagggcugguuauaucuacauugauaucaccaaccaucucugaauauucccagauucugauguugagagcucaguugacuuugaaaaaacuccuucaauccuacuuucagcguuaacauuggaauacaaccaaccauuucgcugguaggaacagauucagcaugaugaugguuugcaaauauuugucuucaauuuguaaaagcuauaagcagucaacauuuuaaauuguuacuagaugauuaguggcauuaugugucacagccauccuguaaacccauccauugaacauggaacaugccuggcuuagccccagagugagaauagauucacccccaguuaguccuugacaaugugugugugugucugugugucugucugugacucuguguguauguuuuuacagcauguuucaauuucauugauauccauugaaauaauguccuacuuucugugggccagugggcgugggggaauaaaaggagugguagaaaaccagcuuccugccagagaagguuuuuuuuuuuuuuuucuggugcuuugggcaggcagaugcgggaggauugccacacgcuuuccauguggccccagguggguuucuggcugugggaagccacggaaccccaccuccccggcggauggacaaaggaaaguccgaggucucugggccucauggaagccaaagauaacagguuuuuagucuugggcauaccagacaccgcuggacaccucggaagagcugagaacaaaaugggggcccugggggcggcucugucauccccagggcugaagggagagagggcagggggagaggauggguugggugguucccaugcaggugagagucuuugguucagucuguggcuggagagaaaggaaguuagacuuggcucuuuaggggaaagccuaucccaucauucaaguauggcgggccuugaugaacagagacaguuuaugauuuuagaguuuuauuguacaaagucagagggaaacaaaaaagguagaaagaaagagagaggcuggccauggccacgugaagaggagaaagggagggagaacuagagauaagaguaagaaagaugagagcugagagagaguggggaggggccaggcaaccccuuuuguagugggcugggcuaccuuucuguugccagguaacuguagggaggagcauaccuggcuauaguaagguaacuguggggguggagucuagccagaauuccagaagcuuaggacauugucugcaugacuuauagucacaggauuauggaguugggggcacuguggugucaggcaacugucucugggaauguggcucacuguuccgucccuuguagaguuuccuacugggucugcagagcaagccucauucaaccaaaacagguugccuuucacugccccacaacuuuccuguucauuacucuuauuucuucccucacgcccucacuaugcaagcucuagcuaggagaacuuuuuaugauaugucaguuacuuuuuaucuacuuggauauggaaacccuuuuguagcaauugaacacaugagaagugacuggaaugacuaaaggaauggaauuauauuuuccucuaauuuuuauucgcuuacaauuaaauggccacaucaugacucaaacauucugccaagcuuuaucuaaaaucuuaaugaguccuuugugccucagugaagcccacuugcucaagaaaucccucuuaauuagaaaacaauugcagaauccuuugccagugcucuuauucugaggcucacaccacagcaucaaguccaagggcuucccacauugcuaagccugcaguaagcacucagucggugaaagguaacaucaacuuugaccaucaaugcaugccucagcggagguacaaucuacaacuuacaaauugugaacaucauagccagacuuuucacucucagucaauugucccacaugucccuacagccccuuuaauagagcagaaauucugugcccuaccaggucugcuucuuagacaccaaaccaagaagcacacugacauucagugaguuauaucccuucaggugaaguuaacugucaggaggggggaaaaaaaaaacagucucauuuaaacugaagaauaggcuaccaccauguuuagcacagguugacugcagugcuugguccuucagucucccaugcuucagugucacugggacuccuuggcagcuggaggaaaaggcagugaaaaccaaaguacucugcaaguuccugagcugaguaacucaugggccagaauaccagauaugugugcugagaaaaaggguuccaugcuguaguacagaaacucaacaauagacagaggugugacugagagcaacuggaagucuacaguuggcugucuggaccaagcacugcagcauaccugugguaagcagcuaccucuucaguuugaauggcauuguuuuuuuacuuccauugcuucaauuagugucuuguugguaguaugcccucaguaauuaucuuuggauggauaagcaaaugaauaaacgacaaauuugaugaacacaaguuugcaguugugcucaaguacuuuaccuuuaaaaaagaaaaaaaaaauguuuuuuucuacugcaggcugcagaaauccaaaaagaaaagaauaaacucaggcuacagccacucaaccagagagaauguaaaaaggcaauauuugugucuaugauucagauauaaccuuuuaauaaaagucaugaaauuacaaacaggaugcuuauaauaaauuagauaaaaacggucuagagacccuggaaguuucagccccuguuuucugaagauucuguaacuuggccacaggaagucuggggauuugaaucuagagauugauaccucuuugguucagugugcccaugagaguugugaagugaaaaugcuaagcguaaauaaggaugcuuaauugcccuagguacaaucaucccugcaucuacagugugugauaauggguaugugauaguuuaagaugugagggguugggaaggaaugauccccuaccuuuaguaguuuucucaucccaucucagaaguugugcuucuauuucuucugauuuauuggauuugacucaauuucuagucuuugacccucuuuuccugauuccucuguuuagucccacugagucugccccuuucucuggauuuuugaagagcacaggaugcuuaauaucaauguuacgcuugagauuaucaggguaauuagccacuagaaaaaauuaauauauccacuggguauaauaugaugaaaagcaccuuauaaacuaccagaaguggugacuggagaaggggguagaaaauagguggugaccuuuuuuuuuuuuccugcugcauaagacccccagaaacucuuucagaacacugauuccacaaaucaaauagauaggagaaaaaaaaaagcuuuugauggcauaugcaucuaguccuaucagguauacagaugaggaaacugacacacaaaauauacaaauaaacauccuaagaucgauaaucuagccacacuggcaggccagguuuauuaucuuauccuaccuugucucuguuagcagaaauucaguguaacaagugugcacuauuccagagcuuuggguuauggauacucugcuguaacauuucucaacuagaaaagagaaguauucauucuuuuaugacaaguaugacaauucuccagucaucuguuaucuguagacaauggggacccaacaaaaauagacacaacacacaaaaaguccugcccuugucaaacuuucaguuuucucuggggaaacacagaaguguguguguguguguguguguguguguguguguguguacaugugcaugcauguguuucugcauugugugaauauacacuagauuauggcauaugcuuggaggaaaauuaauacaggagggaaaggguaccagaagagagggcauuucugugggagugugcguccaagggaccuugcugauaauguauuugaaucugaguggugaucugaucuaaagcccagggcaguguuuuacaaagcuauagaauaggacuggacuucauauauccaucuaaucacuaaugaaaccucuaaccacauugucacuuacugacuacauaugaaauucaugguuucaguaucuaguuaacagauucacaaguuucucuaguuuggauauuuuuauuuccugaaauuucuuacaaaggcuauaaauuaauuuuguauugaagccagcagaacaaagacagaagauuacuuuagguuauaagacuucaguggugagguguaauaagaaaucaugguacaugaaaaggagcacuggggagcagaaggugugaaccagaaucagacauagcaauggcuuugauccugacaguguaucuacuggcagaggauuuuaucaagcaauagaaagcuaagacagcauacuucagccuuuugaccuucacucugccagcagccaagaaauaaacugagaagaaaggaaaggccucaugcuucaaugauugucuucuggaagcaauauucucuuuccacauaugauccagaagauuugcugaguaaguuuugggccagcauuuaaaucaaguugacaguggcuguagcaaaagauucuuauauaaucauuaauugaaacuccucaaggugagagaccauugcuuauuuuucucugcaucauccauaacaacaagcccugucaauauuauuuuaucaaagaagguuaugucguaaagugugaccaacaucaggaaaguagcuaacuaauuucuuaauagagacaucagaaacuuaccauggugcucaugauuuugacuucuuuguguauuuggcaaggaacauucuuuuguaaaaaugucacucaaccagccaagguagauacauguaugugcaaagaugaggcacugcucaccaggccauaccuugcuguuucuacucuacaugcucaacauaaagcaaaauaccaaacuuuuauccaccuuugaaauccacacgguauacaccucugccuccaagcugugccaaacaagagacugauuugcccaggaacauguccacgggguggccagaucuuucuccuaucauaucucccuuuccgcaucugcagcccuuauguauaccaacccuuucugaagaugacucuaaaagccaauggcccauaauucuaccuccaucaguuuaauagaguagagauaauuuaauuucccuuuaacgaggagggauccugaauguccagggguuauaauuaagagagugccagugaucauuaucagcauccauuaucacugccuggucccccucuuuaguuccccuuggcuacuuuccuuuccuagcugcugucaccuugucccaugcuuucuuugaaugucuggugguacugucccacauuccuaaccuccaucaucacuaccaucaacuuguaccauuccuuuacuucccaccucccagugcucugcugcuccgaguuugcuucuucugcacauggaaacagugucuagcuucaccugggauuccugcacuccagcauuaauagauacuccagcuuuguuguacccuugguuaugagugaagcaucuccauuucuguaaugaagccuuuggucucaaggaugaaacuugcaguaaauauaguugcuucucugagaagagagagcuggaugaaauaccuuagccugguggcucugugagaacuuucccuuuguaaucugcugcuugcuuuccugcuacccuugaaaugauaccacuagacccuaaauaaucuggcucacaugaguuguggagcaaggcagcuaagacuuccaaaaggauugaaagguuacuagcaaaaaugaggaagaaaacacuuagcaaauacuucccaggggguaagauggugaccuaaaagaguuuaaugguagaaguucuggaguugccugcuuacuuggacaucuuaugagcuguguccuauuucacaugaagucugugaugucugucuuuccaaccccauguggacaggcacuguggccgcugcauggucagcuguuuccguucucaguuuccuggaauaauugccaacagaaagagcuccacuugacucccccacaggucagagacaagaacugcagaccucuggcuucucuguuaaaaauguuuccaaucaauugacagcucccugagggggagauacuccuuuaacaaagaggaaauauuguauucuaacagauccagaaaaaccaaucauucauggaucauuaaagaauuccacucaaccuugaguccccaggaucuggcauagagcccagugcagaacauuauccaugauagucaauaaauguauuugaaaugacagaggacaagagagaggagggaggauggggaggaaagcagagaaauggugcauagccaugccauacucuuuguaagagguguagaaucucuguugucacucaagguuugguccugcuuuuccccaguucugcuuccaggcuuuugaccaguuagcccaccccauuccuuuuuuuuucaauuagauauuuucuuuauuuacauuucaaauguuaucccccuuccuuguuuccccucuaaaaacccccuauccccucccucuucccccugcucaccaacccacccacuccugcuuccuggcuguggcauuccccuauacuagaguauagagccuucacaggaccaagggccuauccucccauugaugaucgacuaggccauccucuaauacauaauaagcagcuagagccgugaguuccaccauguuugcucuuugguugguggauuagucccugggagcucuggggguacugguuaguucauauuguuguuccuccuguggggaugcaaaccccuucagcucccugggugcuuucucuagcuccuuucuuggggaccuuguccucuguccaauggauggcugugagcauccacuucuguauuugucaggcacuggcagagccucucagggaacagcuauaucaggcuccuaucagcaagcuuuuguuagccuaccccauuccugauccgaaucaguaauaaaauauaacagucauuguaaucaugcuuaacgcuggggaaguaauuuuaguuagaucuaagaacggaucugugaaguagacuguuuguaauaugugaucugucaucauuugauaggugacagaggcccaaaaauguugaccuagcaacugauggaaguuuccuaauuuuaauuuuuuugggggggggcaaguucuccuauaauuaaauguuuaaaaacauggccaacuuucaacaucaguuuguuaacuguugaugaaucuguagaaaagaauguugugagaugcaugcauaaaauggaugcuaucccgugaguuugauaguauaccagccaggaaaggaaguaggauauauaacaccugugccauugucauuauuugacuuuggacugaauauuuaugaucauauucuaaaaccaggucuaggaaauaagcuguaaguuguuuguuugguucauugguugguuguuuuuaagcccaauccucgugugugugugugugucuguuuguguuugugcacggcacguguacacaugcaugugcaugcuuacaugcauaccgcauggcaagcauguguauggcagaagucaucagaucucccgggagcuauaguuacagguaguugggaguuacuugaaacgggcuguuuugaacugaauuuugguucucugcaagagcagccaguucuccaaacugcauucuuauuuuucuuugugguuuuucugauuuguacauuucauggacguuuucccccuugcuuuauuaucagaaacaaagauauaugcauccuaaucuauuagacacuugaggcuuguuccaccuagauuccagugacguguaaacuguuagaacacguuuugugcuagaagcuaggacagguuuuguguaccagaagaggacugcugucuaggaaacgucuaggguucagggacuuucuguacaaccugcuaaggaucaacucuccuaaaguccuuucuuccauaggcagggaaguggggaguuuaugccuaguucuucuuacucauacccuuuuuuauuuaaaaaaacaaaaagaacaaaaauuaaaaauaacacaucaagacaggaggcagauagaaaaaaaaccaugaaaaauguuuuacugcgcccugaaaggcuucagcuugugacauuaguaucagcaaggaauuaauugauacuauuauccuguauuucugggggaucucauucuaccugaaaugacaugggcccuucugcgugucuccugugaacucucaccccugcugucaucacaccucugugucugucgcccacucuacuuccacagcagcucagagaagguacauggaacuuccccucaguguccacccgcugcagaucaccucuucuccacaguagaaaaacccagcaagcauuuuuuuuuuuauucucugccucuauugugucugauucccaugauggaacucuguuccuuguauggccuguuagaaauguccauuccugucaacuaccuucacuguuuauuuuuauuugcaaaaacauuuaagcagcauacugauuuugaggaacaaacauuggaaguaauucacgagaagauugauuuauaaguagcuaguaaucauacacucccaguuuucaaaaauuucgccugugcuaauucauccagucauucaucuuuugcugucacaugcuguuccaggccugucaauugcaaaacugacuggcugaggacgaagauucuguuucucuuauacuuauauaccacuagaauugaugucaguucuucccuucuuuccccuucuuucucuguuuguccauuguccuuucacucaucugcccacccaucgucuauucauucauccaucuauauugagcuaaucagguuaugugcuaagcauuucgaaauguaaaaagaggcuugauggggacugaggcugaguauuucaggugugacaguugaaguugccaugauaggcuauggguguuaggaucaaaccuuaaucucacugagauauuuagaggcaggacccuuggaaauaguaaagauuagauagagucaucagaggaacagaaagccaaaauuucugugaagccgggcacugccuucagucuucaccaacgagaagaucaucaccagaugcaaguccuuaaaccuccagaacugugagauaaacacauauuuuuuuuucuucuguaauuuacccagccuuggguauuucauuacaguuauagaaacagaauaaagcaugggucccuuauguaucuguacuauuuuuacuacaauguaauggcuuccucaggauugauugagagucugauuaaaagccaaagcauuaacugauuauuuaccacccacaaauugugauucugcugcauucaaaguaagcccugccaguugugagucaugccuugaauguggaaucauguccaugagggaggggacugggauuguccucagagcuuuugaagauagagugcacgaagguucaagauguguuucccauuugcaugaaauuaguucuucugugaacaagcaucuguauuucucuuugcugaaacacugauauuuucgucaagcuguugcugaacuacaaagaagaagcaaguauaguuucaaauacagagugacuucugacagucucuuuaaaggacucaauuaucaaauagaaacucucaacaaagaacccuuuacagauggcaaaaucccuccuugucuugugcaagagguucaaacccuuucuugggauggaccugcuggccuuccugacucucaguaaagcacucuaguuguacccuguugacccccucuccugguucaucugaaaagcaaaacaaaacaaacaaaaaaaaaugucucaaggugucucaugcugcuuuucugagaacagugcuuauagaaugaagguuuuuccggggaauuugacaacuuuacuucacagauuagcccuuacuuuucguuuuuaugacuuuaaauuuugucuaacaaaaucaucuuuagacgucuugagauaagaaaaaauacccaugacagguuuggaaggcagccccuguaaggaguuacuuguuugugcacuggucagcuccaagcuuccucaauguucuuuaguuccagagagcaguaaguguaguacacgcccccauacacccaagguagaccacugaccacuguuuguguagaaaaggaagacccugagcacaggcugaagcuauagcugauagguagaauauuugccucauguauaugagauccuagguucaauccauaguaccaggaggaagagaaagaguaggaguggggauugagacugauucuccucauggccagcuugcccuaaacuauuauccacaguaugacgucccauagauagaacucucucauuguguccucauuacauagggccuuggggaauguauacauucucaaagagagugccuaauuaguacccaguuauugccuuggggugggggaggggaacagaauguaaauuaaaccuuuccucauuuaagugacagcacacuuuuaucacagcucuccaaaccaggagcucagguugguaugugaguuacagaaaugugguuaaagagcauggcuagcuauauaauggguuacuuugucuugauaaaaccauuggaacaaugauuacuagaggugagugucaugauucauuccccuucauaauuaucucuagacuaugaguccuauuauagcaucuuuaccuagcagaaggggaaacagaguugaagucagacauccuggucuuacaccauguuuaaucugaacccagacccacuuucuguauugaauuuuguaagauccugaaaaguuuagaaaaacacacuuucuuaagccucaagaacuugccccaaacuggacauaguaaugcaugccuuuaaucccaguauuugggagaccaaggcaggcagauaccugauuucaaagcuauacugguuugcagaaugaguuccacagggcuacacaaagaagcuuuauuugagagagcagagacagagagacaaugagagacagaaugugccccacuaagugguaugcagaguuuccugucuccaaauucagauauuuuacccccaacuaacugccccauuaugggaguacuggaagagauagaaagagauauugcuugagaagagaggacauggaaccacaggaaggccaguugcuacuuccaggagcagauagauuuuccuggcugcugacuuccacucugcuaucuucaucagugacuucucccuugaacagaauugcuuugagauugcagaugagcaagcuguguuuugggugcaggagcuuagcuggcuugcugacagcuaaguuuucccuuggggacauaagacaucaacaaagccagagcacccugugcaucuuacauggucuuuauuuuccugcucuguucaauugguguccuccugugagcacaagugaauaacaagaacguuucccaaauagugauuacuuuagacugaagggauuuaguccuaacagugucauuuuagcuugucaguaggcagguggaaguggauguugugaaguuuaaagcucuggaaugggguacaagaugacacuguaucaaguacauuguaacuaagccaccucucuagcuuuguugccuuuuagaggacuaaaagcagcagccagcaacacaugucuuagcaaaagagauuauuccacuccagugacccugaaguuucucugaaaccuguguguuugugauauugugaucuuugagaaaucaggccauuuuuaccuccacaucuaaaguugagaaauaauuugcagaaagcuauuaaggcauuaguucaaauugugggcugauagcauaucagccacacauuucuacaaaggaguaugaauagagaaaaaaauuaauaguacuuuuuaacccuaaaaaguggcugccuuuuccuucuaaccuacuuuucacuauuugucaaauauuuucuaacucuuugcauguacuuggaaauauuuuuguagggcugggauaaaaauaagauacuauggguaaaauuucaaacuuuuaaaguugagucuaaucaucuugguuugccuggaacguccccuauuguaccaugaaaagccuugugaccaggaaucuacuaguucccagagaggaauagaguuggucuuuuaacuauucaaaaauaauucuucuaggaacuugggagaugagucaauccaggaaaccugucuuuguccuuaguacccagaacccacaugaaaaaaauacuaagucugauaacacauauuuguaauuucagcccugaaaacauggaacugaaucaaaaugaaauccuggguugugugggguuuuccaggaagagcagagacaaggacucagagagagcccuggucucugucuagagaaguccucguggaugagguaggacucagcagagcaguguuuuggaaaagugagaaaauuguucagagccauucuggcaacagcauauaauccacagaccuucaauuaugccagccuuauugggcccaugaguaauuuguaugauuguugccagagaggagaacuuaaagcagaagaagcagcuucuaaaguauuacagagcccucuuccuguccuuuuauauccuagugcaugggacagaaaacagacuaccccucuauuccaauaaauauucacugggagguuaugugggcagguugaacccaagccagugagucuaggcuuggagccaucaguaagaaaggaucuaguuuccuuccguccguccauuaauaauacugugcuuucuaauuaaugaaacacagcuccuaggacauggaauagcaggaagauuuaucacgcacugauacaaauuggaagaaaaauauaaguuagaguuagauaccgaaggagacucauacaaaagagauuuuccugagacuuuucaggggacagauauggggaauguaagggagccaacuguguaguccacaacgccugaguuugagucccagcucugccuccugguagcuacaugacuuuagaccagcagcuuaugcuuucaccuuuaguuuccucaucuguccaauaggaacuaagguagacaucucagaccugcuuuaaaaaguugauaaaaguaugcaacuauuuccuggaagcauucaauuaauaugauggguuuuuauccuuuacuuuuuuuuauuagcuauuaucuucauuuacauuucaaaugcuauccccaaagcccccuauacccuccccccaccuugcucuccaacccauccacuugcaguaucuggcccuggcauuccccuguacuggggcauaugaucuucacaaugccaagggccucuccucccauuaaugggcaacuaggccauccucugcuaccuaugcaacuagauugacuagguuuugacucaucuuggaauucaagaaugcagaauaugcuacuuucaaaaugugacugguaaauauugagguguuuagagauuuuuuuauugguugacuuucagugacagccuacuaaaaaucuugacuauuuaggaggugaaaguuuucagaugugguuuccuuggaaucuucaacaaagacauacacauuuaaugaaaggguuacaaaauaauaacaauaauaauaaugaugaugacgaugauacagagaaugggaucuugauauuagggcacuaaccaauaucacauuuuagaaacuguuugauaccauucaguaguacuaguccagacauugccugaaagauacauguguuuuguuuguuugcucguuuguuuguagguuucuucuacagaaucuagcaagacuacccauauaggugcacauguagaucacccuucaaaaaauaaugauaacaggagauacuagaaucaggagccccuuuucuguccaauaaaaguucagcuucacggccauggacugauggacuuaaagaguuuaaacuugaaccuuaaguacuuaucuuacagauguguuagagccaagagcacugugcaccuuauagccuucgacucauguagcauuaaaauuauccagagagcaaaugucaaguaaugaagucuggguuacucccaaucugugucauuaauugccuuuuggaaccagaaccuuugcaucugacaauaaaauugaugaaugaaguauugcaaaguugcaagugcuaugcagaauucauuacaggugaugguauguuccagaggacauaaagaccuggcccuguguacuuuacuuuccuguaauaucaacccaugaauuucaccaauucauggugaaauucaccaaaccaugaauuucacugaauuucaccaauuugcuuuuaaaugagaaucucuugaagaaaccuaggaggcuaucuucuggauccugccucuuuuagaaagaguuuuaauaaaaguuugggacucugggacaguugaaggaaaagaaaacuaguuauuuaacaaaauugcacuggacacugggggcagauagaaauaaucaccgugccccuccgaucaguguucuuuccuucugcggaauuucuuacuacugagcacacugcucugaggucguagcugcuacagauucugcacaugugugaagaaagaugaggaagaaaagaggauguccugagagguuuaguuugcuuuuguuuuggaagucaagcacaucucaugagaaagguaguuaacaauagcauuguuucaaaauugagaaaagggcuuguuuaguaaaauaggugccgugcaagcaaggguauaugaauuuauuacccagaauccacaaguauaauaauacauacuuguaaucucagcacuuggggagguggaggcagagagguuuaugggacuuggcuggccagcuagccaggcuauugacagcuccaguguuuaggagaccccugucuuaaaaaucaagaugggucacuccuagagaaaacacuuaacauugccuucuggcugcauacauacagauauauacauacagauguguguguguguguguguguguguguguguguauguguaugcauguacauguguguauguauguauauguacauauauauguauauguguaccuguauaccuacaagcaaucaaauacuggauagaaauuauuuuuaaaaaguaauaauaggagaaaaugaacacuucaguaggggcaugcagaagaaaguaagggcagaaugaacuggggcugaaagucuguugcuguuucuguuagaagcuauucuuuccuagaguggauuauuuggugaauaucaaacagaaacagaaaguccugggauuauagguuaacuucauaguccaucuaagugucuucuaacaaccuucuuccuccagcagauauuuacaaagcaugucgaucuucuagauguuaguacuuuaaggaaauaaacuucacucaagagcuuauguucaagcauuaaagaaagaagcaagaaaaccggaauacauauguacaaacauacauguaugcaugcauaaauacauacaugacucgcauuguaaugauagaggauuagagaaugagacauggcagcagcaacuacacugggccauaaagaagguuguguuaguaugguuuuugguuuuuuuggggggggguugguuuuuuuucauuuguuuugguuuuuuuauuauuacauuguuauuauuuucacagccauauuaagacuuaagauucuuauuaauucacagcuauuucuuuuuuauuauauauuuuccuucuuuuuuuuuaaagauuuauuuauugauuauauguaaguacacuauagcugucuucagacacuccagaagagggagucagauuuuguuacggaugguugugagccaccaugugguugcugggauuugaacucuggaccuucggaagagcagucgagugcucuuacccacugagccauuucaccagcccuagauauuuucuuuauauacauuucaaaugcuauccugaaaguucccuauacccucccccugcccugcuccccuacccacucacucccacuuccugcccuggcguuccccuauacuggggcauauaaaguuugcuagaccaaggaggcucucuucccaaugauggccuacuaggccaucuucuccuacauaugcagcuagagacacgagcucuggggguacugauaaguucauaauguuguuccuccuauagaguuacagaccccuucagcuccuuggguacuuucucuagcuccuccauugggggcccuguguuccauucaauagaugacagugagcauccacuucuguauuugccaggcacaggcauagccucggccuaaucagccaucuuugagaggaggucccuuggucuugcaaagauucugugccccaguacaggggaaugccagggccaggaagugagagugaguggguuagggagcagggcaaggggaggguauaggggacuuucaggauagcauuugaauuguaaaugaagaaaaugucuaauaaaaaaaaauguuuaaauaaaaaaaagucuauagggcugcagagaugauguaguacuauccauguaagcaugaaaaccagaguuuagauccugagcacucagauaacaguagcauauauagugggagagguaaccuaccuguaaucccaucauuagagagagaaagggaggggguuccuugggagagcuggcuggccaagacuagugaaaucagcaagcucugauuuuuuuuuucaauuuuuauuagauauuuucuuaaaaugcuaucccaaaagucuccuauacccucucccccccccccuccugcccuacuucccaacccacucacucccacuuccuggcccuggcguuccccuguacugauuuuaacaauggauccugccucaauacauuauguagagagugaucuaacaagauagccagcaucuacuacaggcuuuacucacacacacccacacacaugugaacacaugcacauauacuauacuguauguguuucaauuuguaauuaaugauuuauuaaacagacacccuagaaaauaacacguguuauguaauugcuagaauauaaaucaggguguuuuaguacaagugaggacauuuuagugcaagcaguuacaacauagaugacccagagaccccacuugcuaaauugguaacaguuauuuugaugcaacaaaaaauaccaaaggguauugacaggacuuagcuuuucugugccuugcuugauugauuguuacuugauacauagagugacaucaguucucauaagucugauuguguucucucauuuguuugguccacugcauugauuaaacaucguaaaaucaaaaaggcccugggguacauucaaaaugaaauggaaauaggugaguaguuaggauuuccauuucuuagaaggcuuuauaaugacuuguguggcugagauaacuuuggaacaacuugagccaucgguggagcuacaaggaauuaaguggucaagaggaucuggucagugcugggucguucuagggagguccaagccugaagagagaagacaguacaaggcuggacucagcugugcuucaggauaagguuauguagucccuggcuacucucauccucugauccaguagacuuucuaagcuugauuuguaacuuuauaaacuguggucacuggugguagggcaauuauaguugcuacugggaaaguagauuaagguguguagucaauuaugacaucaagaaaaguauaaaaugucaagauccaaaauguaaaacauuuccaaacuucuauagugauggugggagucaguuuguccuuugaucacaaaaaggcaagguuuucaaaacaaucacagucaaagaucauauaaaaagaaaagagaaguagaauguagcaggccuugauuuauauaaacacucuauuuucuauuauucauguacagucuacuuuuaucuuacaaaggcauucaguaagaaaagauaaaaugauuuauguguaagaauccuuguauuguacacaauuugaaauugaacuaagagcuuccugcacccaaaguuacaagaaaagaagaguuagacugagauaacaacucaguaaagugcuuaccuuguaagugugaugaaccaaguuugaucguuagaacucauguauuaaacaagcacgcuggugaaugcuucuuccgaucucagaucuggacauucaaggacauaauuucccuugggcucagccaguucuacuguucuacuugagaagccccaggccagugaaauucaaaagccucaaaaaacaagauggacaauguuugaggaacagcauccaugaaccuguacacacauacacauaaguauacauuuguguaaauauacauuuguaugugugcauauauacaaacauguacacacaaagaucuaccgagccaauuagggaauucuuuuucugaaagaaaaugguguguguguguguguguauguguguguguguguguaugugugugugugugugagagagagagagagagagagagagagaauucaaacgcuuaagaccugaauuaguguuuugaauuuaugauuauuuuggauuuaagaauauuuugccauguuuaucuauaguacccaaguauaaaugugaaguucauuuacaucauauacaucucagauauauaauuugaauguauuaugcaauauuuuuaugcaugacacaaagcuucaugcuguauuauuuucuaagucuaauaucauucucggagaagaguuuguauuucguugcacuucugauauugggaucuggcuuaggacuguuuaucuguacauacucucuuauguggguuauagcaauuacuguuuauagugaaauuucucacucggaacuuuccaaagcaaugugagcucccaugcuauaguguaaauuaaucaaccugcaagauaguagucuccccaggccaaggcuugguaucucaagcauuuuggacucuuaaaguccuucagacaauucuuuauggccauaauucaucuucucuagguuuuguuaagcagagagagucagaaguucaggacacacaaauaguaaugauuuuugacuaagaacaaaggcuaggaaagcuauagccaucuuccuggguguccucuaaacuucucagaacugggcugagagaggaugccuuuuggaaacagaacucuuuuacaccaagauugacaucuuuuccuggauuugguagcuuuuaaauauuauccauuaucuggcaugcauaaggccaaaugcuuuucugaccuauucaucucaaguggcuuugaacccuaaagaaggaaugcaugucauccuaggcagauuuuccugucauucacuacugaaccagugaccuuuucuagauggaacauguggcagcaaugucugucugcagucacgggaacagucaccggaacgguacuucaugcuaccaagagccacuuuccaaggcuacuacaccacugccuccauucauuuaacauucuuuuucucuuacuggcaugccucugaaauagaaaacauccugucucaagaaauaacauggaucuuccuucugaaccuaguggaggcuccuaagggcuccagaguacucuccacacagcaggaucucagaaucaccucgagaucacgggugacuggaacacaacaucagcccccaaagaaucacagagcgucuugugccagcaggaacagggauaaaggaacgcagcccaaccaaaggcuggggucuguucaggucauguccagccccgccaucuuccuucugaacccagcagaggccacuaagggccccagaguacucuccucaggaccucaggaucaccucaggaucauggugaguguaaugcaacaucagcuccaaagaauugcagagggucuugugccugcagaaacagggacaaaggaaccacgcccaacuagaggcuaggauccauucaggucggggccagccccaccauauucuucgugaaccccuccuagggcgucuagagccccagaggacucuccaugccccagggccccuagcacacccaggaccucgugaucaccugagagcacaugggcaacagaagcaacagagcuucuuggacagggucccuucuggccuucauccucagccaggaggcggaacugagacccagaccccuggggaccuuccuugccagaggagagucugccuacauggaggguucugaccccaggucucaggagguggaucagagcuccagacuucuggacaccuguccugcaagaggagagcuugccugcagagagugcucugaccacuggaacucaggugagaguugaccucccaggagugcugacagaggcuaacagaaucacaggaggaucaagcuccagccagagacagcuugaacauuaacaccagagauuuccagacagcaaaaagcaaauguaagaaucuuacuaacagaaaccaagaacacugggcaucaucagaacccaguacaccaacgacagcggguccuggauacccaaaaagcaagacgcggauuuaaaaucauaucgcauaaugaugguaaaagauuuuaagaaggacauuaauaacucacuugaagaaauacaggagaacacugcuaaaacagguggaaacucuuaaagaggaagcacaaaaaucacucaaggaauuacaggagaacacuguuaaacagguaaaaguccuuaaagaacuacaggcaaacacugcuaaauacuuagaagaaacacaaaaaucccuuaaagaauuacaggaaaacacaaccaaaugggauggaauugaaaaaaaaccauccaagaucuaaaaauggaaguagaaacacuggagaaaacccaaagggagacaacucuggagauagaaacccuaggaaauaaaucaggaaccauagaugugagcauccgcaacagaauacaagagauggaagagagaaucucaggugcagaagauuccauaaggaacauggacacaacaaucaaagaaaaugcaaaaugcaaaaaagaucauaacucaaaacauccaagaaauacaggacacaaagaaaagaccaaaccuaagaauaauagauauagaugagaaugaagauuuucaacuuaaagggucagcaaauaucaucaacaaaauaauagaaaaaaacuucccaaaccugaagagaugcgcaugaacauaaaagaagccucaagaacuccaaauagacuggaccagaaaagaaauuccuuccuacaaagacagaauauuaaaagcaguaauggaaggaggucaaguaauauauaaaggcagaccuauuaggauuacuucagacuugucaccagagacuaagaaaaccagaagauccuggacagauguuauacagacccuaagagaacacaaaugccagcccaggcuacuauacccagcaaaacucucaauuaccauagauggagaaaccaaaguauuucaugacaaaaccaaauucacacgaucauaucuuuccgugaauccagcccuucaaaagauaauaaagggaaaacuccaacacaaggacagaaacuacacccuagaaaaagcaagaaaguaauucuucaacaaaccuaaaagaagacagccacaagaacagaaucccaacuuuaacaacaaaaaugacaggaagcaacaauuacuuuucuuugauuucuuuuaacaucaguggauucaauuccccaauaagaagacauagacuaauagacugacuacacaaacagcacucaacauuuugcugcuuacaggaaacccaccucagggacaaagacagacacuaccucagaguaaaaggguggaaaacaauuuuccaagcaaaugcuccgaacaaauaagcuggaguagccauucaauaucaaauaaaauugacuuccaaccaaaacuuaucaaaaaagacaaggaggggcacuucaaauugagaggggcaccucucaauuucuaaauaucuaugcuccagaugcaagggcagccacauucauuaaagaaacuuuaguaagcucaaagcacacauugcaccucacacaauaauagugggagacuucaacaccccacucucagcaauggaaaaaucgugcaaaaagaaacuaaacagagacacauggacacuaacagaaguuaugaaacaaauggauuuaacagauaucuacagaacauuuuauccuaaaacaaaaggauauaccuucuucucaguaccucaugguaccuucuccaaaauugaccacauaacuggucacaaaacaagccucaacauauacaaaaauauugaaauugacccaugcauccuaucagaucaccauggacuaaggcugaucuucaauaacaaaauaaauaauagaaagccaacauucacguggaaacugaacaacacucuucucaaugauaccuuggucaaggaaggaauaaagaaagaaauuaaggacuuuuuagaguuuaaugaaaaugaagccacaacauacccaaacuuauaggacacauugaaagcauuucuaagaggaaaacucauagcucugagugccuccaaaaagaaacuagagaaagcacacacuugcagcuugacaacacaccuaaaagcucuagaacaaaaggaagcaaauucacccaagaggaguagacugcaggaaauaaucaaacucaggggcgaaaucaaccaaguggaaacaagaagaacuauucaaagaaucagccaaaugaggagcugguucuuugagaaaaucaacaagauagauaaacuccuagccagacucacuagagggcacagggacagcauccuaauuaacaaaaucagaaaugaaaagggagacauaacaacagauucugaagaaauccaaaaccccaucagauccuucuacaaaaggcuauacucaacaaaacuggaaaaccuggacgaaauggacaaauuucuagacagauaccagguuccaaaguuaaaucaggaucagguuaaugaucuaaacaguccuauauccccuaaagaaauagaagcaguaauuaauagucucccaaccaaaaaaagcccaggaccagccacaauuacucugauaccuaagccacagaaagauccaacaaagauagagaacuucagaccaauuucccuuaugaauaucgaugcaaaauuacucaauaaaauucucgcuaacgaaauccaggaacacaucaaaacaaucauccaucccaaccaaguagguuucauuccagggaugcagggauguuuuaauauacgaaaauccaucaacguaauccacuauauaaacaaacucaaagacaaaaaccacauaccgucucauuagaugcugagaaagcauuugacaaaauccaacacccauucaugauaaaagucuuggaaagaucaggaauucaaggcccauaccuaaacaugauaaaagcaaucuacagcaaaccaguagccaacaucaaaguaaauggugagaagcuggaaguaaucccacuaaaaucagggacuagacaaggcugcccacuuucucacuaccuagucaauauaguacuugaaguccuagccagagcaauucaacaauguugugucuggccaguagaucacaacauggguucuagccuggaaaggcauuuuggaaaccuggaagagaagaggggcugggcugcgugagauaaggaaggaaccaagacaaagcucucugcucaagguucaauuuuuacaauuucagcacucaguuauaaaggaagggagaggggcccaauucccuccaaauaaucuuggaguccaguagcagggugaucacguaauggcuucagaacagcaaagcagcagguuccagcagugggcguggcagaaagauugagcuggaagcuccaccccugagcaagcagguuucaggcugggggaggggagacuacacaacaacaaaaggagaucaaggggauacaaauuggaaaggaagaagucaaaauaucacuauuugcagaugauaggauaguauauauaagugacccuaaaaauucuaccagagaacuccuaaaccugauaaacagcuucagugcaguagcuggguauaaaauuaacucaaacaaaucaguggccuuucucuacucaaaggauaaacaggaugagaaagaaauuagggaaacaacacccuucacaauagucacauauaagauaaaauacuucgguguaacucuaacuaaagaaaugaaagauauguuugacaagaacuucaagucucuguagaaagaaauugaagaucucagaagauggaaagaucucccacgcucauggauugacaggauuaauauagucaaaauggcuauccugcugaaagcaaucuacagauucaaugcaauucccaucaaaauuccaacugaauucuucacugaguuagaaagggcaacuugcaaauucaucuggaauaacaaaaauccuaggauagcaaaagcuauucucaacaauaaaagaaacucuagggaaaucaucaugccugaccucaagcuuuacuacagagcaauugugauaaagaaaauaaauaaauaaauaaaaauaaacuucaugguauugguacagcgacagacagguagaucaauggaauagaauugaagacccagaaaugaacccacacaccuaugguuacuugaucuuugacaaggaguuaaaaccauucaguggaaaaaagacagcauuuucaacaaauggugcuggcacaacuggcaguuaucauguagaagaaugggaauugauccauucuuaucuccuuguacaaagcucaagucuaaguggaucaaagaccucaacauaaaaccagagacacucaaauuuauacaggauaaaguggggaaaagccuugaagauaugggcaugggggaaaauuccuaaacagaacagcaguggccucuucuauaagaucaagaauggacuaauggaaccucauaaaauugcaaagcuucuguaugacaaaagauacugucaguaagacaaaaaguccaccaacagauuaggaaagaauuuuuaccaauccuaaaucagauaggggacuaauauccaauauauacaaagagcucaagaagcugaucuccagaaauucaaacaaccccauuaaaaaugggguacaaagcuaaacaaagaauucuuaacugaggaauacggaagggcugaaaaguacuugaaaaaauguucaacauccuuaaucaucagggaaauccaaaucaaaacaacccugagauuccaccugacaccagucagaauggcuaggaucaaaaauucaggugacagcagaugcuggcgaggauguggagaaagaggaacacuccuccauugcuggugggauugcaagccaauacaaccacucuugaaaucagucuagcaguuccucagaaaauuggacauaguacuaccagaagauccagcaaaacucuccugggcauauacccagaagauauuuuaccugguauaaggacacauauaaggacacaugcuccacuguguucauagcagccuuauuuauaauagcaagaagcuggaaagaacccagaugucccucaacagaggaauggauacagaaaaugugguacauuuacacaaugaaauacuacucagcuauuaaaaacaaugaauuuaugaaauucuuaggcaaauggauguaucuggaugauaucauccugagugagguaacccaaucacaaaagaagucacuugauauacacucacugauaaguggauauuagcccagaaacccagaauacccaagauacaauuugcaaaacacaagaaaaucaagaagaaggaagaccaauguguggauacuucauuccucccuagaauagggaauaaaauacacauggaaggaguuacagagacaaaguuuagagcuaagacaaaaggauggaccauccagagacuaccccacccugggguccacccuggugucccauaaucagccaccaaacccagacacucuugcauacgccagcaagauuuuacugaaaggacccugauacugcugucucuugugagacuaugccagugccuggcaaauacagaaguggaugcucacagucaucuauaggaaggaacacagggcccccaauggaggagcuagagaaaguacccaaggagcugaagcagucugcaacccuauagguggaacaacaauaugaacugaucaguacucccagagcucuugucucuugcugcauauguagcagaagauggccuaguuggccaucauugggaagagaggccuuuggucaugcaaacuuuauaugccccaguacaggggaacgccagggccaagaagugggagugggugguuugugguacaggucgggggggggggggggaguauauaggggacuuuugggauagcauuugaaauguaaaugaagaacguaacuaauaaaaaaaaucaaaaaauaauuacgguguuuuucugccaccuaguggacauuauuuguaagcaaaaacaaaacucaaaacagguauaguucugaagagguuuguucuaugauuagaaagaaagagagaagcugggcgugguggugcacgccuuuaaucccagcacuugggaggcagagguaggcggauuucugaguacgaggucagccuggucuacaaagugagcuccaggacagccagggcuauacagagauacccugucucgaaaaaaaaaaaaaaaagaagaagaagaagaaaagaaagagagagagagagaaggagggagggagggagggagggagggaggaaggaaggaaggaaggaaggaaggaaggaaggaaggaaggaaggacgagcaugaauauuccucccaaacccugguuuauagaaaaagguccagcucugccccaguuauauuccaucccuucaucugcuuugcaugcaguaucuucuuaauacucaucauauaucuauuuguagaagaaaaugccuacacagcagaaaucugguuuguugggaauuuggaggcauuugcuuguuuguuuccagagcauggaaaguaugcacagauccauguauggauguuuguagaagcuagaagaauccuccucaggagcugugcaucuugguuuuaagacccugucucucacuguuaccagcggaucgccaaaugugcuagacuggcugggcaaugaguccuaggaacucccccauuuaugcauucccagcaccgggauuacaagcauauaacccuauguaugaugguuuguauaugcucggcccagggagugccuuguuggagucgguggggcauuaagacccucauccuggcugccuuaaaagucaguauucuacuagcagccuucagaugaagauguagaacucucagcuccuccugcaucugccugaaugcugcucugcucccaccuugaugauaaugggcuggaccucugauccuguaagccaaccccaauuaaauguuguccuuauaagaguuuccuuagucauggagucugcucacagcaauaaaacacuaacuaaggcaauaugccuggcuuuuaauguggaugcuaggauucgaucuaccuccauuuuuguccuaauuuuauaacucagaguuuagaauaguguuugucuuauaguaacuaacuguugggcgacaggaugauggaugagacaacuaauggcggaaagaccaaauggguuugagcugguuuguuuggcuguguaauaucuggcuguuugguaaucaguuucuguaguugagacuuucuagcuuaguggcuauagaccuguacaccaaggcaaaagacacugccucucuaccucugcccuacugcugcugugacuuugcaaagaacugucuacccuaaauucagaagccuccauuuaguauccacgagaaagaauaucaaugcugucauaguguuugaaaauauuuuuuaaagacagugcuucaguugagguguuauuagugaguuaauaucacugcaggagcugacuaauagcugcuuguuauagguagguugucuuuugcuucuaagggggaauuggggccaucagagagcagacauguggagagggugguaugguucauaccuaggugagccuuaacuucaaauccccugucgccuuaugucacucguuguaucuccgugcuugcuauucaagauucgaggcuuuagaauaggaagugucuuaugcccuggccugaaggcaaccagagucaagcccucuguguaacauuacucacccugugaagacuuucauuauacaugguggucuguggucccgugcaauucuggcauuugucagcaugccugugucauaacccacaaugaggucugucuguuuggucauacguccugucgcucuuaugaucggcuccagaacucagaggaaggaguaccuguuauauuuuuggauuuuuuuuuuaaaccagauuuuggcaugaggcucagaauuugagcuuguuuuuaguaaucaggauaagcuuugugagugugaguguguguguguguguguguguguguguguguguguguguguguguguguaugugugugagugugugugugugagugugugagugugugugugugagugugugugagagugugugugugugugagugugugauugugugagugugugugugugugagugugugugugugugagugugugugugugugugugagugugugauugugugagugugugugugugugagugugugauuguaugagugugugugugugagugugugugugugugagugugugugugugugagugugugugugugugaguguguuuguuuguuaccuguuaauuaauaaacauggauugagaaacagaaauuaucacuuagaucagcaucacucagaaguuugggguaauaaugauaauacuccucaaagcugaacaggauucucugauugaagggacugcgguugguucucagagcaaccuucaaauagcaacaagguaaaucugauuaccauauguuaucgagaaauaaaaaagcccauccacagugcaggagcugcccagcugcaauacuuggaaacuggaauauccuaaccugggugcgguuuuugcaacuccacucagaaaaucuagacauuugcucuuuggcacugugacugguaaaucacagggauggcugugagugaaccaucaaaauaugccagaagaaucuuuuaaaaagaaaagguagauccagaaguucccaacgagugcuggaugacugaaucgagacaagcucugcaucccugaugagguaguagcaguugugcaucuugguaauuaguguaauaaaaaccugccuuguaaaagagcucagaagcucaacauuuccuuuuucuuucuuuuauuguuuuaguuuuucccauuuccaacgaccaaaaaucauaaaaggaagaagagaaaaaucauuauuugagauugagcaggaaauguuuuaagguguaaauuaauaagauaaugugagucuuuagaagaauaucuggggaaguagagguggagccuuguucauggauccuggcaaugcacucaucccccccuccccaauauacauagaaacagacccaaacuguccaacuuugcagcaucuuuuaaaacaaauauuacuauuuuacuauaugcugaaaaugaauucaacguaugacuuuccucugcaaacucuggccacccuguagacgguaagaucucucugaaacucauuugcaauuaugaagcaaugcaguugcacuugugguaagggcuuauuguauuaucugagguuuacuucaaaaucaauaugucauuaugaauuaaagaaaugaaaagcuguaguaacuacuuaguuuauacaacugguggugggaauugucuauuaucgaauacuuuacuuuugagucucagcccuuccucucuguuucuuggggcugccuuugggaagaggugguauccucacguuagugcccugggauuacuaaugauaggccugagcuccuagagaugcgacagaaggucucagaguacuauaaaaaguucuagggcaugagagguggguaacagagagacggagacagacaaacacaguggguuccucaacugcaguugaauaauuugugucucauccuuucugaauauuuauggcuuuaccggugguggugacagccaaagcucuuguccuagggaaauggaacacauugguuucaauuuuuuccucugcuacagugugaaaauucguuauuuucuagucuauauuuauugccauucuuuuuuuuuuucuuuuuuuugguuuuucaagacaggguuucucuguauagcccuggcuguccuggaacucacuuuguaaaccuggccuggaacucagaaaucugccugccucugccucccgaguacugggauuaaaggcgugcgccaccaugcccggcugccauucuuuucauauauagacauuuuguauauaaauaaauaaaaauaaaaugugccaccauugauaaaauagcaccaaacugcagcaaaacauaguuugugauuauugaauaaacaaugcuuugaggaacugcgccuacacuugaauguuucuuacuuucuuuucagcacaguuuuuuccuaaaacugcuuuuauuuaauucuaaguuaaagugucauuaauaaaaucuacaguccuacuucaugaacuggcuaggcuugaaauauuuuucaacacugaaaaauaaaaaaaaaaauuaaaagauagaaggaacuuaaguggggaagagcuuauuggggcuuacauuuucaagaguguauuaguuguuuucuugcugcugugaucagcacaguuauccacaaagcuuaaggagaagagacuuucuucaggcuuauuguucugguagggaagaguccauuauggugggccaguggcuuagcaucaagcagcagucauggccguaagacuagcaagcugaggauuacaucuuuuacaagaacaaagaaagggagaacuguaggaagggugaaccuuuaaaaucauaaagcacaacaccauugacauacuugcucuaacugcuccuucccauaauauauugaaacagcaagcagcggcacugacugaggaacaaguauucaaauuccugagucuguaagagauguuucccuuguaaucuaccaaaaggaggugcauugcauaauaguaagaaaggaauggguaauggcugcggcagcaggagcuugcucacaucuggaugauuuaggaagcagaaagagagacagaucuuaccaggauuguacuaaaaccucaagaccugucuccauugacccacuucuucuagcuaguacucaccucccaaauguuccacaaucuccugugauggugucaccagcuggagacaaaauguucaagcauaugggccuaugggggacauuucauguccaaaccuaaaaauaccagugcacaugcacuacaauguaagccuuggaccauggaauuaacccagucguuuagcauuacaggaacuuuaccuuccuaaauguuaguuucucuugcagaacuuugaauuucacaugggccacucacuaggguuauucuuaagcaucucugagaugauauuggaaagcacauaugauacggccuugacaaaggacucuaaagagaccugcauagaaccuucuuuugugucucaacagauucuucuuuauugggucauguaggauugcccagcauggugggcauguugagaaacugaugccacacuuagaauaaagagaaaucacuagaguugcuuauuaggguucucuagaauaacagaacuuuguguguguguguguguguguguguguguguguguguguguguguguguuuguguguguuucauuagaaauauaggcuuuguuccagcuaacuuaacaauggcugccauuugacaucugaagauccaguaguuuugcaguccacaaggcuggaucucucaccuagucuaaugauaugcaggaauccugaagaaucaggcucuaauguuaauaaaggaauggcaguccuuuacauggacaagagcaagcaggcaaaaaaagcaaacuuccuuccauguccuuuauauaggcuaccagcagaaggugugguccaaauuaaagguggaucaagucuaguccucugcucauugcacauguucacccucucuccuuucagggccuaaagugugaauagcccugacccugcuauucauuggaauccaaggggcuguuuuuuguaaagugacuauuccaagacucacaaaagaaaaaacgaucccugugacauuugaagcaagaccuagaaaauagaagcaugacagguguugaaguucuaugcagaucucaguccuugugcacuugguggucagaaaagcgugguucaggguaggaacucuguaaauccugcugcuucagaauccuggaagcuucuugcagaaaaacagcuucugccuuggugaacuuuaauggcgccuagugaucucacuuacaugccaaaucucacuuuuaauauuucuuguuuucuucaacuuucaaaacaacacagauuuuaauuccuuguagaagaaucagauucagcuuuggacuuaggaucugugacauguauccucccaguauaacuuguaaugugcagugaauaaaugggaauaaaauuguuccuguuucuaugacaaaggacccaaaggaagaguuuuuguuguuucuuguuuguuugggaucucguggguuaagggacauauucaauuaugacagagaagauaugucagcucuaacuguaacauacuugaguugguugucccauuacguccauagucuagauucagaaagugcucuggaaugaccaucacagauaucucaucaaggugacaggcaagauuuaauagcacauaauguuucauuuaaaaaugaaaccuagagagaggaagagccaccaugucaggagaagguggaggagaagagacauuggaccugauaagaugcagaagaccucuagaauguggcucaagccacaucaacccacauuuggccauuuuguuuaaagucauauggccuugccugauacaacugucuccugagagguucugccugauccugaccaauacagagguggaggcucucagccaaccaucggacugagcacauggaccccaauggaggaguuagggaaagggcugaaggagcugaaggggcaucaaugggacgugaggcccuugguccugugaaggcuugaugcccaguguggaggaaugcuagggccaugaggcaggaguggguggguggguggaggaguacccucauagaagcaggauaaggggggauggacggggcuugcagaagagaaaacggaaaaggggauaacauuugaaauguaaacaaauaaaguauccauuuuuuauaaaagaguaauguaucuugcugguuaagguuuggggauuuugugacagggaaaagcaauauagucaacucaauagguuuacugggaaaacagaaccuugcaaagcuuauaaaaaaaaauccagcuauugcauauguuguacauguuggaauauucaguaugucauuaugaacuucuaauuuauuaucuuuaauuacuaacaauggguaaagcuaaccuuauguggaaccuuuguugaaaauugacuaaauuaucuuuuuauacuaucuguuuaaugugacaauauaugacuuuaacauccaacucuguuauuaaaaauaacucuuucuaaaaaaaaaaaaugaaaccuagagaaucgaacugaacagcaauuauguaaagugccuccaucccauccgaggggcaugcaauauaaaucuuggagacaugacucugguuaacaguuccagagaagucccagaacauagauccuaucaccauuuuauaaauaagguaaaugaagauccaagaacuuacccaagagaaucuuucagguguggaagagcuagcauuugaaaacagguaagaacuuaauuaugguucagugaaagccagaauauccucucuguuugagaugcauaggugggguaagaaagaaagagugagaacgaagccaaccucagagaacuagucccuccuccgaucaugugucuugucuaucucagucaccuugugaaugcaucuuucaaaggagaaucuuauaggauaauugcugagcucccauggcucaucugagaauguauuaucugaaagugucuggaacugaacuucugaggcaggugcugugaaacauacaaguucauaaacaguccaguuccuucuauuccuugcuguuuaaauaccuuuugugcacaucuucucaggagacgcguugguauuuuacacagacuuacuagggguacccagggcagagcagcuguucuuucaggauguuuaauaaauuguaccaugauaaugaauguuuuuucuuauuuuagacauccuacacucaggcauggccuaugaaaggccuucuauccaaaaguagccuguuagaauaaauaugagguuguagagcauugucagguucccuuugauauucagggacaccagguuuuaauauguuaauauucacugaugauauaagcaagcacagcuggcuuggugugcagcagggauuggcaguauuucucaguaggcuaaagcuuuucuggaagugggagauggagagaguagugaagguaccuuauguauuauggugaagggccaucaagguugguuuuuguggauauuauacuuuuuuauuauaaauuuucucagccaguuuaucauuuguauaaaggagggcucauuuuuauauccugacacuuugcugaagcuauucaucagcuguagaagguaucugguaaaaaguucugggucauuuguguauacuauucuaucaucugaaaauagugauaauuugacuucuucuuuucugauauguauccccucgaugucuuuuaguugucuuauuguccuggcuagaccuucaaguacuauauugaacauaugcggagaguaugcagccuugucuuguuccugauuuuaguggaguugguauaaguuccuuuccacuuagcuucauguuggcuauuggcaugcuguauauugcuuugauuauguuuagguaugugcauuguaugccugaucucucuaauacuuucaacaugaaaggauauuggauuuuaucaaaggauuuuuuccccaucuaaugagaugaucaugugauuuuuguucuuucacuuuguauauaugguagacuauauugauggauuuuauuuuuuuauuuuuuuaauuagauauuuucuuuauuuacauuucaaguguuauccucuuuccuaguuugcgauccgaaaauccccuauccucuacccccucccccugcucccaaaaccacccauucuuacuuucuggcccuggcauuccacuauacuggggcauagaaccuucauaugcagcuagaugcacaaguccuuccauguguuuuuuguuuguuuucguggggguuuuuuuauuggagguuuagacccagggagcacugugguuacugguuauuuaauauuguuguuccuccuauggggcugcaaaccccuucagcaccuugaguacuuucucuagcuccuucauuggagacccuguacuccauccaauggaugacugugagcaugcccuugcagagccacucaggagacagcuauaucaggcuccugucagcaagggcuuguuggcaccuacaauaugucuggguuuggugguuguuuaugggauggauccccagguggugcagucucuggaaggucauuccuuuagucucugcuccaaacuuugucucuguaacuccuuccauggguguuugguucccccuucuaagaaggaucgaaguauccauacuuuggucuuccuucuucuugacucucauguguuuugcaaauuguaucuuggguauucugaguuucugggcuaauauccacucaucagugagugcauaucauguguguccuuuugugauuggguuaccucacucaggaugauauccuccagauccauccauuugcuuaagaauuucauaaauucauuguuuuucauaucugaguaguacuucguuguguaaauguaccacauuuucuguauccauuccucuguugagggacaucuggguucuuuccagcuucuggcuauuauaaauaaggcugcuaugaacauaguggagcauguauccuuauuacaaguuggagcaucuucuggguauaagcccaggacuguuauugauggaucuucaguaguacuguguccaauuuucugaggaacugccaaacuaauuuccauggugguuguaccuguuugcaaucccaccagcaaugcaggaguuuucuucuuucuccacauccuugccagcaucuguuaucaccugaguuuuugaucuuaccauucugacugguauaagguguaaucucaagguuguuuugauuugcauuucccugaugauuaagaauguuaaacauuuuuuuaggugauucucagccauucguuauucucuuaaacgcguucucacgaccggccaggaaagacacaacaaaccagaaucuucugcggcaaaacuuuauuucuuacaucuucaggagcaggagcgcaaaaccccaagccccaaaaacgaaagcccccuucuaaaacgaaagcgaaaccccccgucccuauuuaggagaguuauccuucgcuuaggacgcaucacucccugauuggcugcagcccauggccgagcugacgucacgggaaaggcagaguacaaguagugguaaaauacccuuggcacaugcgcagauuauuuguuuaccacuuagaacacaggaugucagcgccaucuugugacggcgaaugugggggcggcucccaacaucucccccuuuucuuuuaauaagagcaauaagccacccauauuaaugagaguggagauagaggucaaauccccaguguguagguaaaggagccauguacaggauuagcucuuaggcucacaggcuuuuacccagagcaacccugaccugcucccgugucguuuugccuggagagaaggacacuuggacacucaaccuucuugaaagaugacaugucucccuagaauaggcucauauaugccgcagagcccuucuacugcagugcuuagccgugcaacucucucgggcugcugaagcacacucacucuaucccguucaaugagucuagccucgugggauguaagagcugaguggccagcgaccuauugccuaagcauagauauaucaggggaagcaccauguucuagagcugcaagugccugggcaaaaaccaccuugucucuccuaguuuaggccuuaagcuuacagaccaaccaaagaagcaacacuaauccacagcaaaguguaucuccaaauaauaucaaucccacccauucuuuaaagaagggaaaugcugaggagauccaauuggguaauccuuuggucagggacagguccaagcgcguggaguugaccugaagucucaauucccgaaggaucuguucaaauucagccguccaauucuguaacauauacugaaaaagacuuuuugacaaauuagcugcccuaguaaauuucucauacugaauggaaguaacacacaaucccggaaacuuuuguucacaucccagcugagcuauuugccauaauacaucuaguuguuucuggacaagaucuaugaguugauuaaccagcaugagaccacccuguaucuagacauuagcugaggccuguuuaucuaugacuguagucacugaggcugacaaaguguuaauggugucagucgucuggaccuguccagacagagccaaggcugucugaaucaaggcuaaacccaguuccuaguuagugguaaaaaagcaggggaauacuugagcauuauacaucaccgucauugggaguggaaaugucgacauuaucccccaacgcugcucucucuuuauuauugacgcccuggacaucaccaagacgagggacaucaguauucccuuggucagucuggauuuuucgggugagucuuucugguauccaaaauggguugucuucauucugugggaaaacacagauagcuccccuggaucuuaucaaaauaggauccgggccauaccauuuauuaucaaggacauuuuuccauuuaaccaucucauugggccuaucuggcucugaacaaugacguucagccgcaguauggccaugagcaucaauauuuaaaaaauugaguguaaagagugccauagacacagacacucuuggugcucgggguagagucucgauuccccucuucugcuuuauaaaauaggcuuugagggugcgaugcgcacgcucaacaauacccuguccuugaggguuguauggaaguccagucaggugggucacguccaucugacggcagaacugcuggaauuuuugagacguauaagcugguccauuaucagucuuaaggaguuuggguuucccccaagcacuccaugccucaaggcaauguugaaucacaugugaggccuuuucuccgguuaacggagaagcaaacaugaugccagaacaugugucaauggacacauggagauauugaaguuuuccaaaggaagaaacauguguaacauccauuugccagaccuguagaggucgaauaccgcguggguuaauucccacaugaggaacuggcaagaacucacagcagcuuugacauugaguaacaaugucacgggcuucuuuucuugucaaggagaaacgacugcguaauguuucagccgucacaugaaaauuguuaugaaaauuuuuuugcagccucuaccggggaugauagggcagcagccaccacuuuaguggccuuaucugccaaaucauuucccagagccauggggccagguaggccugaaugggcucuaacaugaguaauauaaacaggaaaucuucuagauaacaaaacuaauuguaucugcugaaaaauauuggcaacucuacuggaaggcuuaaucacuccagccacuucuaaaagauuuacugcauuaaccacauaacaggaaucugacacaauauuaagggguucuaaaaagguuuuuaaaacuucuaaaaccacuaaacauucuaccacuugaggugaauuuuuauuauauuguuuggauaccacuuuaccauuagccacauaggcaccuaugccaguuuuugauccaucaguauauaccacaaucccauuuuuaaguggguuucuuacuguuauuuguggaaacacaacagauugauuuugggcaaacuguaaaauuggguguuuuggauaaugguuaucuauuuguccugaaaaggagguaacuaaaacugcccaaucauuagauguggcugccaagguuugaaccugugcagcgguauaagguacaauuaaaagauauggacuucgcccaaagugggugauugcugcuuuuaggccuuuaagggcaagcugugcaauugcaucaggauaccaaucuauuauuuuagcuggggauacguuuggauggauccacaacaauggcccauucugccacaaaacugcgguuggcaauugugcugucuuaaagacacacaaacugaaaggcugcgaauccucaauacguuguaauugugcauucuguaaggcuuuuuccaccuuuuguaaggccugguuagcagcuagaguaagagcccuaggggaggagauaugaggaucuccuucuaaaauaccaaacaaaggccuuaacucagcggaaggaaucuuuaaaaaaggucugagccaauuaauaucucccaacagcuuuugaaaaucauuuaagguauggaggugaucucuucuuaucucuaccuuuuggggcacaaucuuaucuggggacaccacagagcccaagaauuguccuguaucagaaauuuggaccuuuucuguggcuaucugucaauagaaacauguaaauauugauuucucccaaaggaggaaauaugugugacauccauuugucagaccuguaauggccugacgccacgaggguuuaccccuacgugaguagauaaaauuugacaacaaucuaaaggcauuauuaaguaaucagaaucauuuccaguagaaccaaucucucuggcagcucuaggaauaccagaggaagaaaaaacagccauguaggcuuggcaaaauuauuaguugagcuauuuuguccccuugugauauagaaaagacaacuugaggacaagaacagagaaccugaaguuccccuuuauaaucuugaucuacaacucuaggguggacaauaagaccuuguaggcuguaagagccugccucugucauacuggccacaaaaucugagaaggacuccugaggucccuggaugaucuuaguuaauuguccaguggcuucaccugcucaggagagcgccuuuuaggcccuaauagccguggaggaaauuugggcauaagcuccccaaugguaguuugucugaucagcagaauaagcucccugacccguuaacaagucaaaaguccaaucucucugcucuggagucaaagcagcugcauuuguucgggccugcgcuugugcagccucgugccaaagcgcucuccauuccauauauuugcccauacuagggagagcggcuuuuacaaucguuugccagucggcaggaguuagugccaugccggcaagccugucuaacugcaccaagguaaaauuagcauugguuccguauuuacggaccgacucggcgaguucuuuaaucugcacguauucuaccggagcguggacacgcccacccucggcuccuucaaagaccggaaaugccuguuguauuuuccuuuguuccucucugggaaugaaugagucugcgcauugccucucugcgcauugucucucugcgcauugccucucugcgcauugucucucugugcauugccucucugcgcauugucucucugcgcauugccucucugcgcauugucucucugcgcauugccucucugcgcauugucucucugcgcauugccucucugcgcauugucucucugcgcauugccucucugcgcauugucucucugcgcauugccucucugcgcauugucucucugcgcagggcugacgcacuacgcagggcgggggcuccgcauagggcggaccuugaagccgacugcccggaggcugaacaguaugcuggcuuucgccagccgcuuuuggcuuuuuucuuaacugauuagcuggcugguaaugagcugcuucuuccucccagucuguuuccucagaggagaauucuucaucugcuucagagcuacuaagagcuggcuuccugagcucaucuagugacgaguaucuccuagagaccuccgcuaauugaucuuuuuucuuuucuuuuuucuuuuccuuccuucuaaucucuccccagguauucuuaccugaccuaaacuuuuccucggguucaagacccuuggaaaggccuguauacuuauuuugugaaccauauuuucucuuugcuccuauucucucuccccgcuuuacuucugauagauuguccugaacuucauccagaauuuucagcccuaucuuaaucaccugauaacaugugaaaaagaacaaaagggcuccuaacacuagaaaaaauucaaggccaaacauaccuuguaaagcuauuuuccacuuuacuucugauagacugucuugaauuucguuagaaaguucaagaccagacuuaccuuguaaagcuauuuuccacuuuacuucugauagacugucuugaauuuccuuagaaaguucaagaccagacuuaccuuguaaagcuguacucacugguacuucuguuccccagcugaaaaguucugaauucaugcaguugaauccuucucaacagucuguuuuacgggaaccuuuauuaccgugacccgcaguucugguuccggaaugagggaucuuccuugcgccggugaugguaauuuucgucccagguuuucucuucccggguucucggcaccaacucuuaaacgcguucucacgaccggccaggaaagacacaacaaaccagaaucuucugcggcaaaacuuuauuucuuacaucuucaggagcaggagcgcaaaaccccaagccccaaaaacgaaagcccccuucuaaaacgaaagcgaaaccccccccccccgucccuauuuaggagaguuauccuucgcuuaggacgcaucacucccugauuggcugcagcccauggccgagcugacgucacgggaaaggcagaguacaaguagugguaaaauacccuuggcacaugcgcagauuauuuguuuaccacuuagaacacaggaugucagcgccaucuugugacggcgaaugugggggcggcucccaacauauuccucaauugagaauucuuucuuuagcucuguaccccauuuuuaauuggguuauuugguucucuggaguacaucuucuugaguucuuuauauuuauuagauauuagcacccuaucagauuuaggauuggugaagauuuuuucccagugugaugguugccauuuugucuuauucacaguguccuugaacuuacagaagcuuugcaauuuuuuuuuaaucuuuuuuuuccaauuuuuuuaauuagguauuuuccucauuuacauuuccaaugcuaucccgaaaguuccccauacccucccccccgacacuccccuacccacccacucccacuuuuuggcccuggcguuccccuguacuggggcauauaaaguuugcauguccaaugggccucucuuuccagugauggccgacuaggccaucuuuugauacauaugcagcuagagucaagagcucugggguacugguuaguucauaauguuguugcaccuauaggguugcagaucccuuuagcuccguggauacuuucucuaucuccuccauugggggcccugugauccauccaauagcugacugugagcauccacuuauguguuugcuaggccccagcauagucucacaagagacgaagcuuugcaauuuuaugaggucucauuuguugauucuuaaucuuacagcagaagccauugauguucuguuuaggaauuuuuccccugugguuguauguuugaggcucuucuccacugucuccucuauuagauugacugucucugguuuuauguggaguucauugauccauuuggacuugagcuucauacaagggauaagaaugaaucaauucccauucuucuacaugcuaaccaccaguucagccagcaccauuuuuugaaaaugcugucuucuuuccacuggauggcuuuagcuccuuuaucuaggaucaagugaccauaauuguguggguucauuucuaggucuucaguucuauuccauuaaccuaccugucuguaacuguaccaguaccaugcacuucuuaucacaauugcuugauggugauuccaccagagguucuuuuauuguugagaauacuuuuugcuauccuagguuuuuuuguuauuccagaugaauuugcaaauugcccuuuccaacucaguaaagaauucaguuggaauuuugauggggauugcauugaaucuguaaauugcuuucgacaagauagccauuuugacuauauuaauccugacaauccaugagcauuggagaucuuuccauuuucugagaucuucuucaguuucuuucuucagagacuuggaguucuuuucauacacaucuuucacuuccuuaguuagagccacgccaagguauuucauaugauuuaugacuauuauuauggguguugauucccuaauuuuuuccucaaccuguuuauccuuugugucgagaauggccacugauuuguuugaauuaauuuuauguccagcuacugcacugaaguuguuuaucagguuuagaaguuuucugguggaauuuuuagggucacauaaauacacuauuauaucauuuguaaauagugauauuuuuauuuuuuucccuuccaaauuguaucccuuugaucuccuuuuuuugucuaauugcucuagcuaggacuucaaguacuauauugacuagguagugagaaagugggcagccuugucuagucccugauuuuagugggauuacuuccagcuucucaccauuuacuuugauguuggcuacugguuugcuguagauugcuuuuaucauguuuagguaugggccuugaauuccugaucuuuccaagacuuuuauaaugaauggguguuggauuuugucaaaugcuuucucagcaucuaaugagaugaucauguguuuuuugucuuugaguuuguuuauauaguggauuacguugauggauuuccauauauuaaacaaucccugaauuucugggaugaagccuacuuggugaugauggaugaucauuuuuauguuuucuuggaaucagcuugugagaauuuuauugaguauuuuuguauugauauuuauacaagaaauuggucugaaguccucuuucucuguuagguuucugugugcuuuagguaucagaguaauuauggccucuuagaaugaauugaguagaguaccuucuguuucuauuuuguggaauaguuugaggaguauuggaauuagguccucuuugaaggucugauagaacucugcacuaaacccaucugguccugggcuuuuuguuguuguuguuguuguuguuguuguuguuguuguuguugugagacuauuaaugacucuuucuauuucuuuaggggauauugggacuguuuagaucacuaaucugauccugauuuaacuuugguaccugguaugugucuagaaauuugucuauuucauccagguuuuccaguuguguuagguauauuuuuguuguaggaucugaugggugguuuuuuguuuuguuuuguuuuguuuuguuuuuugugguuuuuuuuuguguguuuuuuuuuaauuuccucagauucuguuaugucucucuuuuuguuucugauuuuguuaauuaggauacugucccugugcccucuaguuaaucuggcaaaggguuuaucuaucuuguugauuuucucaaagaaccagcuccugguuugguuaauucuuuguauaguucuuuuucuuuccacuugguugauuucagcccuagguuugauuauuuccugcagucuaguccucuugggugaauuugcuuccuuuucuuuuagagcuuuuagguguguugucaagcugcuagugugcgcucucuccaauuucuuuugggaggcacucagagcuaugaguuuuccauugauauuaagaaauauuaaggaaaagucauuguugcuuccuguuauuuuuguuguuagaguuggaauucuguucaugugucugucuucuuuuagguuuguugaaaaauuacuuucuugcuuuuucuagagcauaguuuuccuccuuguauggagucuucccuuuauuuuccuuugaagggcuagauuugcuggcauggaguuacuuauuucccauguuuucuuggauguaguauccuccuuggguuguaguuuucuuucuaguauuuuauguagggcuggguguguguguguguguguguguguguguguguguguguguguguuuugagauugcaagauaucuauccaagcccuucuaucuuuuaaaguucuauuaagaaguugggugaaauuuugauaggucugucuguguuuguuaccugcccuuuuuucccuugcagcuuuugauaauccugcuuuguccuguagauuuguuuucauuauuaugugcugggaggauuuucuuuucuguuccagucuaguugguguucuacaggcuucuuguauauuuauaugcaucucuuucuuuagguugggaaaguuuucuucuaugauuuuguugagaauauuuucuagaccuauucuuuuuuuuuuaauucgauauuuucgcuauuuacauuucaaauguuauccccuuucccaguuuccuccccaaaaaucccauauccccuucccccuccccuugcuccccaacccacccacuccuacuucuuggcccucgcauuccccuauauugggauugggacauagaaccuucacaagaccaaggcccucucuucccauugauggcugacuaggccauccuuuguuacauauucagcuagagccauguguuuucuuugauuggugguuuaguccagggagcucuggaagucuuuucaugguauccuagauuuccuggauuuuuugugucaggaauuuuuagauuuaauauuuuauuugacugauuuaucaauuccuccuauuguauuuucugcaaccgagauucugucuucuagccucuauagucugcuuuugauacuugcaucuauuuuuccuguucucaucccuagguuuuccaucuccaggauuuccucaguuuguguugucuuuguugcuucuauuucuacuuucaggucuugcacaguuuuauuuauuuccuucaucuguuuaauuguauuuuccaguguaauuucuagagauuuguuuccucuuuaaagacauuaccuauuuguuuguauuuuccuuuauuuuuuuuagauuuauuuauuuauuuuauguagaugaguacacuguagcugucuucaaacacaccagaagaucgugucagauaccauuacagaugguugugagccaccaugugguugaugggaauugaauucaggaccucuggaagagcagucucugcucuuaaccacugagccaucucuccagcccucuuauauuucuuuaagugauguauuuauuuccucuuuaaaggucuuugucaucauuauaaaauuguaucuaagguaauuuucuugugcuuuacuucuucugggauauccagggcuuacuguaguaggcuagguaugaucugaagguaucaguauugcccuagccauuauuaauuguauucuuccaaggcccuuuagccauuuaaauaucuuuugugccuggauguuccuguuguaguaaguauuggaagggugguugacaaugauguuccugguguggcaggacucugaugauuaucuuugugcuauauuuuccuguaucucuguguguauaugguucaggaucugcaggucuguuaugguucaggagccucagaucugauccagguagggagagagguagcauugaauggagguccaccugggcuaguaggcuacucagggcagcuuggugugcccagagggcucagagagcaaggaagaugaaugggcuaaaggacucaagcuuuagcaggucuuaugaagggaggaggaaaggcgguaggagaauuuaauagcaagcuguucaggauagcuugguuugcccuagaggacucaacaaacagggcgaagggaagcuuaccuguaugguucaaaugucugcugaaaguaggcuaagagguaggggaaagaauggagaaucaauuucuucauucuuuacauuugaaaaaaaaacuccaucuugucuauauaccacauuuucuuuguauauucaucucuugguggacauacaggcugauuuaaucauagaguaauugugaguagugcuguaaacauggauauucagguauuucucugguuugcucucuacaugucuucucucauaugugaaaccaagguuggauggauagauaaugucucaguuaggguuuuacugcuguguacagauaccauggccaagacagcucuuaaaaggacaacauuuaguuggggcuggcuuacagguucagagguucaguccauuauuaccaaggcuggagcauugcaguguccaggcaggcaugguacaggaagagcugauaguucuaugucuucaucugaugucugcuaccagaauacuggcuuccaggcagcuaggaugagggucuuaaauaucacacccacagugacacaccuauucuaacaaggccacaccucuaauagugccacucccugugccgagcauauacagaccaucacagacacagauagauagauagauagauagauagauagauagauagauagauagauagauagauagauaggaugagcaagauagagaaugaaaaaggaagugagcccuguggaaaaaagaaaaaaaugagcaaagaugaaaaagagggacaggagaggguaguagagggugaaugaauauggucaacauacaugauauacuuuuauuaaaauaucuuuaugaaacuuuucacuuucuacaacaaaucugugauaauaacauuaauucauuaauuaauuagugcauauauccaucccucugucuuugccauagucauguuuccuuccuuacagaacaguugcuuagccucaccuuccugugugcuauaaguagcagaauaacucucugauccuccuuccucacuucccucucacccccuaaccuaacaucaggaauucugcaggggccaguaagugaagagggagacaagggaguuucuggccuggagccauccaucugcuggcugacaccaacagcaaagcuccaucaguauagcaagcuuguuugcucuugucugguuguuaauguugauauaugaauaagcaagaagacagcuucauuuccauaaguuagaguaugcguagaguacagaagacugagaacagcaaaguuaaucauaaccacagggcuagcaaaaaacaauggcaaagccuuucuguuagucacagugcuuuauguuaauuucuuuggagaugaagcaggcacugcagaauucugagugugucaagagagcuguauaagccuacggcauuccccagaggacucccagggaauucacuucuugauggcauggcagaccauugagcuauuuauauaaacaaggucagcucuuuggacugagacaucuggaggccaggguguuguugccauucaguccugagcugggaugcauggcucacuuacccagacuccaggcagcagaaggaacuucuguucuagauggauguuaaugaacaguacuuagcagaagaguuacugaggaagcugggaucugugagguuugcaugugaggggaggggguguuugggaggggucaugauagauagauucagggaagaaauugagugccagacaggucuccccaacacuucacacagaaucaauuacucuaugcucggcauuccuccaacuuaucacagcuuuugucacuagagugccacacugcuucauaacuguuuaucuuucuccuugucuaacagccucugcaucaaggacuguguuuuauuuauauuuaauuucuuuguauuuugugugguaucugacaccaagcaaauccuuaacaaauaaaagccugagccagugcuucagcaaaccaagagccauagcagcuggggaagggaggaaauggaggagauuaacagucuggacacauagagcagcagagaccaccagggggcuuuuauaaugauaccaccagaugcccaaggggauuuuuugcuaucuauauauaugugaauguuugcuuguauguauauauauauaugcaccauguacauacaguacuggcagaaacuggaagaagacauuagaacuccuggaacuggagugacagauguuugugagccaccauguggguguugggauuuaaccaccagccaucucucucaacccucucuugagauucuucugaguggugugaucugaauuaacaugaauaauucugacauauuuacuucaugacucuucacagaugacuaaagaaggaaacacagauagguuaagaaacuucccuagucacacaucugggaaauagaaaaagcacaguuugaaucauuacaauauuuucgugucuauuuucuucucuuaucuggguucaagaaguauaguucuugaagcuagagaggugguucagugacuaagagcaugaauucuuuuuccagaggaccuguguuuaauuccccauacccacacaauagcucucagucaacuauaucuccagucuccggaaauauaacaguuuucuggccccugggagcaucaggcauacauauauuauaucuacauaccauguauacagauaauucuacagacaugcauguacacuaaaacacccuuauauuuuaaaaaagaaaaugcauuuaguacuggaguacgucacuggauucugcuaguuugugagcuggauguagacacuaccauauaagcuaauuguaucucaggcccugcaaugucuuaggcccugcagaugaaccuaacauuuaacuaagucagagccuaaccuaccaggcaugucaauaauuugucuucaguauacauacaaauuuuguagugggugguuuaguaacucagauuacaaagcccugggaucagaauugaugcucagaaauguuaauaucuaaggguguaagagugcacagaaagacuaaccacauauucacucauaccucacauccacauaccaacuuucucagacauaaaagaaugaaagcaacaugucaccuuuugaugacaccuauugaugagggugccaaugugcauccauaacguuuucuuaaacuuaguuucauaauuacaauuguuaaccuguugugcugcauccugaauagugagauccuuuucaggauagggccgccccauaaaaccuaaaacauagaagagcacauugaauacacaccuugacacacauaggaggaagggguagagaauuaggaacgaauagggcugggggauaaaaggaagcuaaauuggaaagcuugguuuacucaaacuccucaccaguaaaauaauccacaccuauggaaaggaaaagguuacaaaaaaacaggccaggaaguccuuccucuugggacuggaucagcagagggauacagccuuccauuagcuauugauuuuuauuuuguagcucaaugaccuauucccaggggguguaggcagccuaagcacuaugcuaguagauaaccaaagaaaccuguguagcauuugacacauguaaaaucauuuaaauguguauauuuacaggagucaaaaugaugccaaggcaaugaaaaguuggcguguucuaaaagaagaacacagagaacacacaguagucuagauucuauacccuuccuuccaacaguauugcugcucacaguuaacauugugaacaguauugcugcccuguccauagccauagaccucaguagguuugggagacacacaccaagcagacagcuuaggggauuaacaagucuacaugcagaacccaaggcugcugagaaacuaauaagaaaaaucauuucuggccacuuuuguuuuaauaauugguauagcagcuaaugaacacacuuaaagugaaaugaagucuucuagcuguugauuauugugcuuuucucacacagugaauauaaaccuuauaauuaucuuucuagauaauucuuauuuuuuuauagaacauugaaugagugaguggugugcugcccugauauagcugucucuucugagguuaugccggggccuggcaaacacagaaguggaugcucacagucagcuguuggauggaacacagggcccccaauggaggagcuagagaaaguacccaaggagcuaaaggugucugcaacccuauagguggaacaacaauaugaauuaaccaguaccccuggagcuugugucucuagcuguauauguagcagaagauggccuagucggccaucauugggaagagaggccccuuggucuuacaaacuuuauaugccucaguaggggagaacaccagggccaagaagugggacuggguagguaggggaguccgggguggagggucugggggacuuuugggauagcauuugaaauguaaaugaagaaaauaccuaauuaaaaaaagaagaagaaacauaguuuaggcuugagagaaaaauuauuugaaugcuauccauggagauugcuuaagguuaucccuaaagauucuuaaguuuaagcuuuuugugacugauauggcugcugcuucuuucauccuugcaguucuccaagugagggacacugacuccugagaucaauaguuacauaaaaaauuugauagccagacagugauggcgcucaucuuuaaucccagcacuugggaugcagaggcagguggauuucuaaguucaaggccagccuggccuacagagugaguuccgggacagccagggcuauacagagaaacccugucucaaaaaacacacaaaaagaaagaugcauugauguugggaauaggagaggguaaaauggcaugucccuucaaaaaaguccuagcaagggcuggcacuguugacaccaccaacugacagcacagugugcaaauuccuacgcuuaugggagggcauuugacauugauggaacacuugccuaccaugcauggggaccucugugcaauccccauuauaguaaaaaaaaauaaaccaaaguaaaagaaaucauucacuugcagauguuuggauuguauugauaguacuuuaucaggaugagaacuauaauagcucagucaguaaagugcuugauguucaagcaugagaaccugaguuuauucccagcaccaauggaaaggccugaguaugggagagcauaucucuaagaaggcugggagacagggauaggaauguuucagggacuugcuggccuccagucuagcuggaacagcaaagucuaaguucauuggcagacuuuauuugaaaauuuaauguggggaacaaggcaaggagacacuugaugucaaccucuacccuacccucacccauacacacccauaggcaagcauauuuguaugcauacauaugcacacaugcacacaaagacauucagggacacuaacacacaaauacaaaugggcuuccuaguuaagagaaauuuaaccaaagacucauuuguauggccacauuuauuaaacacugcuaugugaaauacuacucagaucuugcccauuugcuaauguagaaauaugggacaguuacuuaggagaugcaaguauguuuacuauuacccacucauuaauuuaagggaugcuaaucaccugaaggcacaaauauugauaggaaguacuaaauaaagacaucugccacaaugccaugaauacaaaguauagcugagacucaggguuuuguguuaagugucaagcucaauauauuccuugaaaggagugugggcaaagacuagcaggugcaacuauggucacugcugagagaguacauagugagcaagaggcaagaacacaaauaacacucuacaguuuuguuggguaggaaugaagcuaugaaaagacuuguuugaagcaauagguugaguacaaaucaaauggagaugguacaaaaauacaaaauuuggauuuuuagauauuaaaaauucaucuuucuugagaugcagguagccauccacaaugcaaugaaaccucauucccuguuugccaguucugaguaugugguaccuguauccauuacuuuucuguuuccaugauaaaaugccaugaucaaaauucacuauggaagaguuugguuuugauuaugacuccaggggggauaagaguucaucaugccaggaagguaugauugcaagcagcaggaaugggaucaggagccagaagcuaggagaucucaucgucagccacaaacaugaaggggagagagaaguaaaagucuauaaacucucaaaacccacccucggugauauaguuuccucagcaaggcuguuccaccucuccaaacagcauuaccaaccggugaccaaauuuucagaugccuugagccuaggagaggcauuccucaaucgagccaccauaccuuuauuuggucuugguuuuugaugccuguuaucaagccaaaaauguuggugauccuaacccaggcuccuuaagccaugaccuccaaguacuacuuugguucuguccugugcuccuauguaaaguaaccaaauuguuauauagugccaggauuauaaucccagcuucucagcuaaggggggcaagccuuuuucagcugguuguucuucaccacaaccccaaaacuaguguaugagacauugguuggaucuuguacucuuuaaauugcauauauacuuucccaagggauuaugcaaguuugggaugugaucuccuacauugacaaauugaguaguaguauuuuuucccugcuucuaauuuauauguuugugcuaggaaaaugauugagauagcagagauagcagcucaauaaauugaucaaauaaauuacaccaaacccuugcaccaucauuucagagagcugucaucguaccaaggagguccuauaucacccagcaugguguuccaacaguacuguuauguuuucuuagcaugcugguggguuuucauuugguuagaaagcucuuuauuuaucagacugacaaacaaccuaagaaguuucacucuagaauguuagcugugaaagccaucaauagcuagguuugugacuguuaacacauuauuuaaaggcacuaagccucuuucucuuucuaugggauaaagauuaaugauaccuaccacaaaacuuguaagaguaauucauuaaaaagaaaggaaucuugaugucaaacaaauguagauucacauacuagcuccaugaggacauauauuaaucacugcucauaugagagccucaaucccuagucaauaaauucuaaauuuuuuauuauagguaauucuaagacaauacguuuuauugaagucuuacuagaucaucuuuuguuguuuuuuuuuuuguuuuuguuuuuguuuuuuuguuuuugggguuuuuuuggguuuuguuuuuuuguuuuuguuuuuguuuuuuuuuuuuuuuggagacaggugucuuaguagucaggguuucuauuccugcacaaacaucaugaccaagaagcaaguuggggaggaaaggguuuauucagcuuacauuuccacauugcuguucaucacuaaaggaaguugcgacuggaacucaagcaggucagaaagcaggagcugaugcagaggccauggaggcuuuacuggcuugcucggccugcucucuuauagaaccaagacuacuagcccagagauggcacaacccacaaggggacucccccccuugaucacuaauugagaaaaugccuuacagcuggaucucauggaggcauuuccucaacugaagcuccuuucucugugauaacuccagccugugucaaguugacacaaaacuagcuaguacagacagaguuucucuguguagcccuggcuauccuggaacucacucuguagaccaggcuggccacaaacucagagaucuaccuaccucugccucccaagugcugggauuaaaggugugcaccaccacugcccagcuuacuagaucauuuuaaugaagccagauagguuugauaacauucuggaaggcuuagaaaugcaguccuaccugcauuccagacacacaucccuaagugauggacuacaaaccuaacucauaugugaugucauuauauaccagagacaaggccaacuauagugacagaagaguaauuauccccucagaugacacucuuggguugacauggugcuuauugacauagguugauguauuuuaggaguaguaagaauagacacauugugagaagugugucccuuaugggcucucagcucaucaaaugaggauaauuacccaugcuuugauguuaaaacaaaacaaauaaacaaacauuugcagcucagauucaaaaaaaaaaaaccaguaaaucaauauacagugaaaaacaucagauugaaaugcuuaaagauuaacaugucaggcuauauggauaugccucauaucccaugauuuagggaaugaaagcaugcauggguggauggaugggaggguagauggguggguggauggauggauggauggauggacagagacuuugguuuuaucagaacuagaugaccuucgacaaaguaaucaccuguucugagaagcagucuaauuguaaaaaugaaauauguuaaugcgaguuaaacacuuaggucaggacuugauacuuaguuuaaaagcccccaggggauacaaacuguuauuaugauggucugcauaaucauuccuuuuguuccauacucuccagcucuagaugccugacugcugcuucuaagauaucuauguacucuguguuuuacagggcaacagguccugggcuugguagagaaccagagugacugguaucuuggaaaucucuggaaaaaccaccguccauggccagcucuuggaaggggcuauaacacagguaagucguaagggcaguggcggggggggcgcauagagagugaugcauagacuuacucuuccuuccucaaagaaaggagaugaacagcaacauggaaaaggccgccugguuuucugguuuuuaucagggcacaagauauauauacagguaacaccuccaguuauuauuucaugucaugcuacaagugaugaagcaguuaaacuguggaagccuuggcagaaguugucuuucccagccauauuacacaaacaauuuagaucuacacucacaauagguaucaccauuuaucuugcugcagucuuccauguacaggcugcaaaaguagcaggcacucauauucccucugaccguuccucucauuaaaagguccauguauagccuacccaggagguagcaggagaauagguagauguauuuggaccuugguacuucuaaguacaucauuccucaaauaucauaugucuaaaaucagguuauuuauucuacuuuguuacuaacaccaguccugcauguucuuuguuguuucugucuccauuauucuuagucacuucuagugcagccauucucuauccaacagcugacaauccuaagugcccuagauggaacccauggcuucaugaaaugaauaaguaaggaaaguaaaacuccccuuuuauuuuuuuuucucucccaaguacagcuucucccuaucuguuuccaaaaugccccuggauccuucucucucuuccaugcucauugccauugaugccauccuuguuuuuuuuuuuuuuuuuuuuuaagagacacucaguauuuuuaucaggauuagaaccugggcuacacaauuucaggucccaaaaugggcugguaccucuuaagaacagaauuggagccgaugucugagaaaugcccuaccugaauaugcugcauagacagauccuagagucugaccucaaacucuacagacaaaagagccagaaaauuaacccugagaccugaugaucugauuucccagaagucagaauuaaauaugaggcggcaauagugucugggucuggugguuguuuaugggauggauccccagguggggcagucucuggauggucauuccuucagucucugcucugaacuuugacucuguaacuccuuccauggguauuuuguucccccuucuaagaaggaucgaaguauccacacuuuggucuuccuucuucuugaguuucuuguguuuugcaaauuguaucuuggguauucugagcuucugggcuaauauccacuucucagugaguacauaucauguguguucuuuugugauuggguuaccucacuuagaaugauauccuccagauccacccauuugccuaaaaauuucauaaauuuguuguuuuuaauagcugcauaguacuccauuguauaaauguaccacucaugucucuaguugcauauguagcagaggauggccuagucagucaucaaugggaggagaggcccuugguccuaugaaggcucuaugccccacuauaagggaaugccggggccaggaagagggaguggguggguuggagagcaaggggaggggggaaggaauaggggauuuuuggagggaaacuagaaaaggggauaacauuugaaauguaaauaaagaaaauaucuaauuuuuaaaaagagauauaaagaugaaaaaauacaaaaauaugaggcccagaacccaaaggaaaaaagaugugagccaagguucuggaagugcaaguucagaaauggacccuauuaaacuacaguuugaucuguagcuaccuugacuauugauauaaaccugaaaucaauauugugggaguuaaagcugguagaagacagggaaagaccagugucaguguccagccaaggaaccuauguugaaggccauacuugaagaauagugagauuccauugcugacaguugccaggucaucaguccugcugcaccccauuuauguucuauaagucuccuaggcauaacagaaguuacagcugaaguuaugccaguccacucuucacagacccagaguuugugcuuucuugcugaccugggcauuacccuuuaguugcugaauagaagaugaaucugagggcucucucgggaggugaggaaugggggaaguugagauaaggaggacuaagacagcaaguagcgaaguauuuccaaacuucaggaauaagugaggcagcaccuaucgucuuaccugcaguguguuagucagacacugcaauucaagguaauauuaucagaucuucaugcuagucuuaucuguuuuuuguauuagaaguaaauagauauuuuaagaguacagcccuaauuaaggaagcuugaaagguuagcuacugaccuuucuagcucaaaccuaaauggcuucauaaucaaauacuuuuuguuaggguuugguuuuauauuuuugagacagagucucaauacauagcccaggccagucuagaauuuccuaugcaucccaggcuguccuuuaauccauaguauaccugccuuuuccuccaaguccugacauugcaggccauacugacacaaauacucuuuuaaaaucaaguauacuaaguuuugcccauagagcgucucaugggucuguagaagaguccagacugcacuuguaggaagccuuugggauguuucuggagcagaauagcuaaagcucuucuguaaugaaauaggauauauuguuucucucccagaaagaacacuaagucugggccccucagagaugcauucauguauguacguauauguauauguauauguauauauguguguauauauauacacacacacacauuguagguuagucuuugacauauauauauauauaugugugucaaagacuaaccuacaauguugugccauccgucuuguuuuuugaaacagggucucuuauuaggaccuggagcucaaugauuaggcuagacugccccaucugcaagcaccaccauacauaaaaauaccucccuugagcugagaauguaaucauacacacacacacacacucauucauucauucccucucucucucucucucucucucucucucucucuccugacuuuuuacauggccaagggaaggcaagcacuuuguuaacugaacucucuccccagcuuuaugagcacugucuucugacuguuuuugagguuggaccauauuugaucucacaguaagccaaugagacgcuucauguaccuaucuuugggaagcaaauccagccagcucuucauaggugcccagccuuuuggagucuuagacaacucuauauuuuuagauguaaaagaugaagccuguugugcacauuuccuguuucucagggccuauaguaauacaaaacgucauauagagguaaacuauagcacacugaggauguuguaucaggucaugguuaucugcauuaaacagaaaguacacugguccucaauuuagguuuguaaggagaagaaaguuguaggaccauggagaauuacuauggcaagaaggguagauacguuccuucccaccccuccuuauacuacuucauagcacgauaauaaacaauggucuuaaacaccuucaguuccuauugguaucuugagacagugaguuugccuucugaaaggucgugaaaggacagagcagguaaggaaaagcccugugagaucugacaggucuauuucaauaacccuaugacaccaagugaucauuauaaaaggaauuaugcagcaucaagaugccuaacuuucauaaugggaaauugugauuuaagaccaaggagugugccauacaucagcagaucagucauccaacucucagggaaaggacucugcuggugagaaaucucucuaaauuccagcuaucuccagucuuuaaugaggcuccuccaguaaaccaucuuguugauguuauuggcaaacuccagcacuuuugaguuggaaccacagcuggaccacugagccuuucuauggacuuggccacucaacuuggccagcuugguuauucuccaacuugugagguaagaaaaugguacccucauguugugaauacuaauugccagggaagaaacuuauuuaagaucccaaccuggugucaaguacaaagcaagcacucaguucauucuagucuuugucuucuugcauauaugaccagugauucaguggguaccaaaccgaugagauauuuaccacacagucucucaaguacugaaguugggaaagaaccaguagucguuuuauuuuuauacaaauuuauagccaccuuuucccacugucuacaaacacuuagcuuuuggugcuauuuuaagagaagaaaucaccuauuuuaaguccuauacuaacuucccaacuauauuucacuuugaaaauuucccaaaacaaagcaugagauguuugagcugugagaucugccuccuaggccugaauucuuuuuuaaauucucugcccuuuacaaaucuuauucagaauugugagcccaaacuccuuugucuauaaacucaggagauuggguuggaauaugggcaugccauuuuaacuaccuauaaaccaaagaguuuuaggaaguuacuuuggcuguuucaccucagaaccauccugaguaacuauuugucaaggcaguacaauucagcaauacuccuuaaacccauuugcauuacgccaggccccuucucuuacaccucagcaugugucauuucugaugucuguugauuccuaggguuguauuaucauuauuauuauuauuaucaaucauuucauuuguuuauauaucaaaugauaugccacuucccgguuagccccuccaccaauuccccaccccacaucugcccuucccccuccccuuugccuguugaaagugcuccccuacccacccauacucuacugccccucuggaccagguugucuuuuaauagagauguucuucaaauauucagcuaaauuucuacuucucucuuuuauguuuguacucuuuucuaauuugcuuucacaaagcacagagagucuuaagaaauuuggggaaauaugccuuucaucucuucucccuucuuguuggagauauuuggggcaggaucucaauauauagccugaacuagcccagaauucacuguguagcccaaauuggucucaaacguagcagaaaucccuuaccucaguuuuccccaccugugugcuguaguuuccgguaucaacacuacaccuaacucuuaguggagcuugcuauaacucauuugccugcucgugucucacugaccuggagcagcuguagaugagaugacgacaaacaacacucuugccaguagcugcucagggcaccuuccauauccuuggcauagagacaguaugucuccaaauacucugucuaagcauuaccuccugagugcaaaaagaugcuauucacucagcauucagcugucacugggaaaaccaaacaaacagguuuuggccagcuaaugugcaagaggguagcauacuacaugaugcauuccauggcagagagucagaaagacaaaccaguugacaacuugauuaagaacugaaacaaccugacacauaggugucuccugacacuuuccucuaccuccaauguccccaauuucaaaaccuugaggaacugcuauaauuaaagauuccuguaauaauugacauccagagaaaguagacuuacaugucauucccucauucccucauuuauucagcauaggcaugacagcagcagcaaccaaaugauauggucagguguuucuuugccugucaucaagacuagagccuacugcaucauugugugaaguacuaaacacucuuggcaaaggagccaugugagcccuucauuugaucuuuaaacucaguaucuguucacuuuaaacuuuccucauaagccuugagaguuucaggcuuugauauuuagaacaauacuuauagucaaccauauaugugaaugggucauaugugauaaaaauccauucuccuuagggcuaggcaagugaaggccucuuuaggaccuaggacucugcaaugcuguugauauccaacaaguugacuccguuucaaaacauuauugggcccagggucuuucuugaggucacugaauaaacaaacuaaugcucccuacuuccagguuuuguacaaccagcaagaagugucuuuagcaguauagcuacaaacuuguuuuguccacuuaaccuuuaccugagucugugacauuuccuaaaagcuugucuaguccacucguaaagcagagcguucucuggccucgguucugccuguggguuuuuuauggaauacaugugccccuuccuggccaccuaucaaauaucuaagugaaaacacaaggagccucguccuucuuucuuguauauaacugagacucagucacuccuacacaucccagccugugagccacaguucuuucuucuaggagaugcagcugguucuagaacuugccaaggacuccaguaccuaguauaaagagagcugugcagagcccaaguaaugauuccauuugcccaugaugcauuggauagcuuugggcaaauuccuucugaugacuuuccauuucuaauagacucacaggauuucuggaagaauuacaugaaugggaaauuccugguacguagagaacauuagauaauugaugucuaagacuccugguacagcuaugccgaguaagagaugagaaugucauaugccaucaguuaccuggcagauuagcaauuaggcaggucgcucugcacaucuacaucucuacucugaaugcuaaguagucuuuucagcccuguccaucaugcuagggaguuuaaaugauguuacaguuucucuccugacccuuggaagaagcugcuugcacccaauaucccauuucccuuugauucucaguuuaugucuugucccugauccaaguuuucaugaugguuggaauaggaaugguacccauaggcucguauauuuaaaaguguucucaguaggaaguaguacuacuugacagggauuaaaagguguggccuuguuggauaaaguauaucacugggagugggauuugggauuucaaauguucaaaucaggcccauuguuacucucuuccuguugccuguggaugaagauguacaacuuucaacuaccucugccugcaugcugucauguuuuacaccaugauaauaaaggacuaaaccucugaauguaagcaagcuccaauuagauccuuucuuuuacaagaguugucacagucguggaguuucuucacaacaauagaauauugacuaaaacaacugcagaugcuaugcaaaacaucaucagcaggcucagaguacuuaaccuaucacacugcaagcugucagcuucaucagaucuuaugaagcacccuagugaacagccuagcaagucagagcccuuucuuccuggaccucaugugaggccucuaauuaaaauuaguuacuaaggaguuuccccagcugcgucuuugaaggacauaaagaugucuggaacucuucccucaugagcuaaugccacacagcuccugaagccgcuguucaccauugcuuccccaaggccuuggccucagagagcgggcauuuaacucuagauuuccacagccccaauucuuuuauccugaacuauuuucccauaugaaaggaugcaucaaguuggucccauuuccuagaagauucuggccucagaaucucauuuuucccuaucauuuugcuaaguaaaucacaaaugcugaacagaaagaaaguagaauaaacaaaauucgaaagcaagaagaccucggcugagcuggcccucaagauucucagauauggagguauuaucaccugugggucuggagcacaggugcuguccccuccuccagcugucugccuuaggccuucuccagccugacauagccagaccacgucucuacugugaguuaagagaacuaaugcugcucuagugcauuaucgcuccuuaguaauacagugaacagcagggaugaaauucucuucauuuagaggcuaaaacaucagaugcagguauauucaacaccugaugagggcugcuuuucagucaugguuggcaccuucuacuguguucucccuugaaggggaaaaaagaugaaauaucucuuuauauccuguucacauccugaccaccuccaggagaccucaguaaugacuuuaguggugagacuuucaacuucuaaauuuaaagacaaaaacauucugacuauaacagcacaucccugauagagaagcaguguuccacauaguaauacugagaaaaagugagauggcgcagguguaugacaugaguaucagccuguucucuacaucggaaugagagucaugagaccucaacaaguccuuuauuagcaacuuauuacccacaugcucucuugcaauuacguagcagcagcacucucaaaccugcauuuuauucuaacaaaauggcacaauuuguuuugugaugcugguuuuuaaucacaggcacuguguguuguacaacagauuccuagaaaucuauucaucuuccauaggagaaaguuuggucauugagaaaugccucucguuguccccaaacuccagccauaaagcucuaagaagauguauggcucaucuucacauauuuguucagcgacguugcauuagaagcacagacucugugguggcaugauuauauucacaccaugggaaucaguaacaccacaaaugagacugucugaagugugaaaucccucggccccucacacaacugacaggauuauguaguuucuugguuauuccugacuuuugauuuuucaugugagcaauuaucuccuuccaucuguaucuguaucuuuuaauuagauguaugcacuaucuaauuaaaaauaaaauacuggguaucuuucuagauucauuuagaacaugaagagcuauuuuuauuucuaauacugcauuguuuuuucauuugacagaccauaauguauuuauuucucacuaaaugguauaguuuuuccuacauuguccccaucccaauuauaauccauaauauacaaauucccuuauugguaauauuuguuugguuguuguacuggcuaguuuugugucaacuugacacagcuggaguuaucacagagaaaggagcuucaauuaaggaaaugccuccgugagauccaacuguaagacauuuucucaauuagugaucaagggggaaaggccccuuguggguggcaccaucucugggcugguagucuuggguucuauaagagagcaggcugagcaagccaggggaagcaagccaguaaagaacaucccuccauggccuuugcucagcuccugcuuccugaccugcuugaguuccaauccugacuuccuuuggugaugaacagcaguaugaaaguguaagcugaauaaacccuuuccuccccaacuugcuucuuggucaugauguuuguucaggaauagaaacucugacuaagacaguuguauaccaacauacaaagaauucuaagagagcacuguuguuucaaauguuauuaauauuuuaauuuuauaauacuucauaauuaaauagauauauuguagguaaguauucacacauuagacuugacacauucuuguuugcugucuauauuagguacauuguuucuauauucuagaagaauauaguacuuuuguagaaaaacuguuaauagggagccagccucagcuucuuuagcucagaaagauggucucuaacaggccucugaaaucaugggcuacauaccagaggccaggugaagcacagccagugcuggccaugaguaaccaugucuggcucagcauuucucuugaccugaauaacaguaacaagaggggugaucuuuccugaaaauaucgcugccuuaugcuacugacccaugcaaagucagguuaucuccaugauagcaaccuuaucgucugaagaacagaagcugugaccugucacccagacaccuaugcagagaagaagaaaggaugcaauccagagcuuucuucccuggagaaaauugucagcauucauuccguguaugguuuucacaggucacagagauuuaugauagcaugagacauuucauuucuuuggggucuuucaaguucacagcaccaaucauuagacuugaugcauccuuucaugugcauuugcucauuuaauccccauuuuacagaggaguucaugaaggcucggugagguuaauugguuucacgaguuaacagagccaguaaauuacagagcccagggcuuaaaccuuacuuauaagcucuuagccugucagcgcauagcaaugguugguagagcaguuauauagcuuugggaauuuguccagcccgauuccucaauaaacuagguuagguagcuaugaacuaaucgccuuaacaacauugcaccaucucccagauaaauaguaccugcccguguggcuacauaugagaaucaccuggagagucuuaaaucauagccucuauuuuguaaaccccuuaguaguuuuuguuuuuugguuuuuugguuuuuuuuuuuuuuuuuuuuuuuuuuuuuuuuuuuuuugguuuuucaagacaggguuucucuguauagcccuggcuguccuaaagcucacuuuguagaccaggcuggccucaaacucagaaauccacuugccucugccuuccaaguacugagauuaaaggugugcgccaccaccgcccugccccuuagugguuucuaagacacagcaggugauuccuguuuauuaaacacaacuggacaucauuuauuccagaacucauuauaaagacagcaccauucuuuccaucuuacacauuucuuucuuaccuacaccuuuguggugguuugaaugaaaaugcacccccauagacucagauauuugaauacuugguccccugguaguggugcaguuugagcugguuuaggagguguggccuuggcugaaguaaguaugucacuaagggaccagcuaugagauuuuuuuuuuuaauguaagccauccccagugcuuuuccucugcuuuaugcuuguaauucaagaugugaccucauaguacacaguuucugccaccaugccuagcuugcugccaugcuucucuaccaugacagacucuuaucacucuggaacccuaacccaaacuccuuccuucuauaaguuuccuugccuuggccaaugguguuuuaucacagugauaaaaguaucuaauaccaccuuuuuuuuucugucacuggguucuugggccucauagccacuugacuuuuguagacacacauucagcagagaugaaaugguaaauaagaguacagaguauccaucacauugcaagggcuuuggggacacuucaguagaaagagaagccuggccacagacugcuaagacuaucaagaaaaacaaggcagauacuaagggauggggagaugagugggauugggguaugcgguaugaaauccacaaagaaucaauaaaaaguuaaaacaacaacaaauauuuaccacuacuccucgagucaauuuuugucucuuagugaauaucugacugucugcaauaaggugugaccaaaauuucuaguuuauguccuacuaaaaccaaagguuuuugcauuuuuagauugcuaagggggaaaagcaaagaaucuacuuugugacacauggaaauuauaugaaacugaaaucucaguguccauucauaagacuccugacacaucauuggcuuugcuugcccauggcugcuuugggggucaugguggcagaacuugagagaugccaucagaaaucuugugguuucuaaugccaaaagcaucuucucucuaacucuuuaauaaugagagugccuaccaacaacacuuuauaguagagcagaauguuguguggcagggaucugucagaacugaguuaggaugcugucugugccacuuaucuucccccaucugauaaaugagaauaauaacccagugauaauaugcugcuuggaggacuaacuaagguguuguaaauguaacauaaaagccacagauguagaaccauuauugcugcucaguaaauaucaggcaccuccaucccauuuauuauauauaguuuccuuauggaggcaccaaaagaaugaaacagcaaggggcuaaugguacacuugauuggagagcuacacacacaagauacagcagaaaauaaugagaaugauguucucaauuuggucuuaaagcaucugcuuucacagacuccucacuuaccucuguauuaccuucuguguacaguagguccugacaaauggacacccaucagucaacaccuuugaaugagagcaugcauuuucaccucuaagcucccuaagagguggugcacccaucaaauccuguucuguggacauggaaaaagcacuguaguauaaacuuggauuucuuggccuaugugaccgaaaaaugcagaucacgaggaaccaaguagcacaaauuccucccuagaaccagaaguuucaggccugcaagaccuuuguguagcacaaaagaggaaaaugcauaaaaccuaaguaagccuacaggcauuuacagugggcacuagcauuuaaaaccccagaugucuuucaaguauguccuguugaucugauaaugaucagaauuucuggcaagcuagcucucagaauggcguaagagaaaaauugcaaugugaaaaugugcccuaagaacaggacccagcaagucaggagcagcugagugguacagaucuuuggggaagggggcacaaggaugguugaaagaaagauggacagagaagccuaugcauauagagacuagcuacaggugcugguauggcuagauggcaugauggaaagacuaugggcaaaaaggaaccuucauguaagauguaagagaccaccagagaccaaaugaaaaugugucuucuggacccccuauagcuuaucccaugcccauuugaaugaagcucauaguuuuuuggucugauuucaaaauuuauuucuaucuuucacauuuucuggauucauuuuagagugucuuuuugggugguaagacaugccauuccuacugcagcuaauaaccuauccagcaauuccuuuguacuaacuuuacauuaaguagaguguguugucuuagccacugauggguuaacguugucccccugucuuaacauaggguaaauaugaaaguucaucuucauuaucaacuugacagaauauggagucaccuuaaagaaaaaaaugccaggcaguggaggugcgugccuuuaaucccaguacuuggaaggcaaaggcaagcagaucucugaguuugaauccagccuggucuacagagugaguuccaggucagccagggcuauacagagaaacccugucucaaaaaaaaaaaugcacacacacacacacacacacacacacacacaccucugaguguaaggaugcuuccagaaggguggauuaaggugguaauauuaauugugccuauaggcagcacaugucaaaggccuggggauacagacugaauaagaaggaaaaagcaaacugaacaugaacaucaucuucucccucccucccuccuucccucucucucuguucucuaaguuucaggaaggaaaaaaaagaccuaagcaaaaaguuugucauggaacccuuuaauuuuuauaauugaaaagugagucccagguaaacucagcagggaacuuaaauugagucguuuuuuaauaaacuuaccuacauuauugugucaggcuuaucaugaaacacccagugcuucaaggcaaaggggagaaaagccaugauuugauugcaagggcuacuuucauaaacauuucaaggaagagagcacacaugcuaucagagcuucccuccagcaucuguuuagugcccacaggcacuuucauuggucugaccagcaaagccacaagaaccaccaaaggacaaggaacaacucauuuucagguguaauagugaucugaggaauuauagauggaagaaacaacaacuaucaaauuccugguaaacaccuuugcaacucacuguacauauguugugucgaguauuuuuuguuuaucacccugucuucucaacuuguuuaaccguguuccccaaacugacauucuacacugaccuaaagaaaaugauguuuccaaagccugcuuugaacuugucuucucuguuggaguuaugcagcuacuugggaaucucuauuucuucugaaucaaggaagcauguggucuuaauuaaccaagccaguccuaggaugauucuuucauuuagcuuaaucaugaaacuagacuacagaaagaaacugagagaagggaagagaggggagaccuuccucuuaacaaaggucuuguucaugcagaccuaugauauuauuuggccugguauaaugguugguuuugauuaucaaugugaguauuggguauuagugaggcaugccuuuggauguggguauggaggccuuucuggggaaaauuagcugagaagagaaccagaauagggcagcaucauccagugggcuggaguuacaaucugaaaaagaaguggggaaagugaaugccagcuggacaucagcauucucauuuuucugcuuccuaaucuccugugauaugagcaaguagccucacaccccuauugcuauggaaccaaaaacuuuccccaccauaaggaaccaaccauuguggggcauugggcuauacacagacagucugguuuccagucgagcugagguuugaaccccgggacccggucaugauaauucaccuacaugggacagaaggaguucucucaugucuccuggaacucuggcuccugucgaaguuacugccgcccccccccccacacacacacacacacacacacagcucccacaggagaagcauggcuuuuagucaaguaggcaaugucccaagcuucuaaccuucaggcuaaacuccuccccaguuaccuagcaacaaaaaagaaagcagcauacuuuaagaggggcuguuuggccccuccucgcucucauucaauguuccucuguugaaaauguuuuauuuuucaaauaaccccauuaaaaaugggguacagagcuaaacaaagaauucucaacuaaggaauacagaagggcugagaagcacuugaaaaaauguucaacauccguaaucaucagggaaaugcaaauuaaaacaacccugagauuccaccucacaccagucagaauggcuaagaucaaaaauucaggugacagcagaugcuggcguggauguggaaaaagaggaacacuccuccacugcuggugagagugcaagcugguacaaucacucuggaaaucagucuggcgguuccucaaaaaauuggacauaguacuaccggaagauccagcaauaccucuccugggcagagauguuccaauugguaauaaggacacaugcuccacuauguucauagcagccuuauuuauaauagccaaagcuggaaagaauccagaugucccucaaaagaggaagggauacagaaaaugugguacauuuacacaauggaauacuacucagcuauuacgaacaaugaauuuaugaaauucuugggcaaauggauguaucugaaggauaucauccugagugagguaacccaaucacaaaagaacucacuugauaugcacucacugaugaguggauauuagcccagaaacuuagaauacccaagauacaauuugcaaaacacaagaaaaucauaaaggaagaccaacacguggauacuucauuccuccuuagaauagggaacaaaauaccauagaagaagauacagagacauaguuuggagcuaagaugaaaggaaggaccauccagagacuaccccacccagggaauccaucucauaaucagccaucaauugcgacacuuuugcauaugccaguaagguuuugcuggaaggacccugauauagcugucucguauaaggcuauggcagugccuggcaaauacagaaguggaugcucacagucaucuauaggauggaacacuaggcccucaauggaggagcuagagaauguacccaaguagcugaaggggucugcagcccuauagguggaacaacaauaugaacugaucaguacccccagagcucgugucucuagcuacauauguaucagaagauggccuagucggccaucauugggaagagaggccccuugguauugcaaacuuuauaugccccagaacaggggagauaccaggccuaagaagugggaguggguggguaggggaguaggguggggggauaguauagggaacuuucaggauagcauuugaaauguaaaugaagaaaauaucuaauaaaauuuuuuuaaaaaaauaaaauguuuuauuuagaucuguaccccauuuuuuuucuuuuuuuuuccauuuuuauuagguauuuaacucauuuacauuuccaaugcuauaccaaaagucccccauacccacccacccccacuccccugcccacccacucccccuuuuuggcccuggcauuccccuguacuggggcauauaaaguuugcaaguccaaugggccucucuuuccagugauggccgacuaggccaucuuuugauacauaugcagcuagagucaagagcuccgggguacugguuagcucauaauguuguuccaccuauaggguugcagaucccuuuagcuccuuggcuacuuucucuagcuccuccauugggagcccuaugauccauccauuagcugacugugagcauccacuucuguguuugcugggccccggcauagucucacaagagacagcuacaucugcguccuuucaauaaaaucuugcuaguguaugcaauggugucagcguuuggaugcugauuaugggguggaucccuggcuauggcagucucuacaugguccauccuuucaucucagcuccaaacuccgucucuguaacuccuuccauggguguuuuguucccaaaucuaaggaggggcauaguguccacacuucagucuucauucuccuugaguuucauguguuuagcaaauuauaucuuauaucuuggguauccuagguuuggggcuaauauccacuuaucagugaauacauauugugugaguuucuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuagguucuuuccagcuucuggcuauuauaaauaaggcugcuaugaacauaguggagcauguguccuucuuaccuguuggggcaucuucuggauauaugcccaggagagguauugcuggauccuccgguaguacuauguccaguuuucugaggaaccgccagacugauuuccagagugguuguacaagccugcacucccaccaacaauggaggaguguuccucuuucuccacauccucgccagcaucugcugucaccugaauuuuugaucuuagccauucugacuggugugagguggaaucucaggguuguuuugauuugcauuucccugaugauuaaggauguugaacauuuuuucaagugcuucucugccauucgguauuccucaggugagaauucuuuguucaguucugagccccauuuuuuaaugggguuauuugauuuucugaaguccaccuucuugaguucuuuauauauguuggauauuaguccccuaucugauuuaggauagguaaagauccuuucccaaucuguugguggucuuuuugucuuauugacggugucuuuugccuugcagaaacuuuggaguuucauuaggucccauuugucgauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacacgauaacaaccaguugugccagcaccaauuguugaaaaugcugucuuucuuccacuggaugguuuuagcucccuugucgaagaucaagugaccauagguguguggguucauuucuggaucuucaauucuauuccauuggucuacuugucugucucuauaccaguaccaugcaguuuuuaucacaauugcucuguaguaaagcuuuaggucuggcauggugauuccgccagaaguucuuuuauccuugagaagacuuuuugcuauccuagguuuuuuguuauuccagacaaauuugcaaauugcuccuuccaauucguugaagaauugaguuggaauuuugauggggauugcauugaaucuguagauugcuuuuggcaagauagccauuuuuacaauguugauccugccaauccaugagcaugggagaucuuuccaucuucugagaucuucuuuaauuucuuucuucagagauuugaaguuuuuaucauacagaucuuucaccuccuuaguuagagucacgccaagauauuuuauauuauuugugacuauugagaaggguguuguuucccuaauuucuuucucagccuguuuauucuuuguauagagaaaggccauugacuuguuugaguuuauuuuauauccagcuacuucaccgaagcuguuuaucagguuuaggaguucucugguagaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguaugggccuugaauuccugaucuuuccaaaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauugaggauuuuugcaucgauauucauaagagaaauuggucugaaguucucuaucuuuguuggaucuuucugugguuuagguaucagaguaauaguggcuucauaaaaugaguuggguagaguaccuucuacuucuauuuugugaaauaguuugugcagaauuggaauuagaucuucuuugaaggucugauagaacucugcacuaaacccaucugguccugggcuuuuuuugguugggagacuauuaauaacugcuucuauuucuuuaggugauaugggacuguuuagauggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucauuucugauuuuguuaauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagggcuuuuagauguguugucaagcugcuaguaugugcugucucccguuucuucuuggaggcacucagcgcuaugaguuucccucuuagaaaugcuuucauugugucccauagguuuggguacguuguggcuucauuuucauuaaacucuaaaaagucuuuaauuucuuucuuuauuccuuccuugaccaagguaucauugagaagaguguuauucaguuuccacgugaauguuggcuuuccauuauuuauguuguuauugaagaucagucuuaggccaugguggucugauaggauacaugggacaauuucaauauuuuuguaucuauugaggccuguuuugugaccaauuauauggucaauuuuggagaaggucccgugaggugcugagaagaagguauauccuuuuguuuuaggauaaaauguucuguagauaucugucagguccauuuguuucagaacuucuguuaguuucacugugucccuguuuaguuucuguuuccacgaucuguccuuugaagaaagugguguguugaagucucccacuauuauugugugaggugcaauguaugcuuugagcuuuacuaaagugucucuaaugaauguggcugcccuugcauuuggugcguagauauucagaauugagaguuccucuuggaggauuuuaccuuugaugaguaugaagugucccuccuugucuuuuuugauaacuuuggguuggaagucgauuuuauccgauauuaaaauggcuacuccagcuuguuucuucaguccauuugcuuggaaaauuguuuuccagccuuucacucugagguagugucugucuuuuucccugagauggguuuccuguaagcagcagaauguuggguccuguuuguguagccagucuguuagucuaugccuuuuuauuggggaauugaguccauugauauuaagagauauuaaggaaaaguaauuguugcucccuuuuauuuuuguuguuagaguuggcauucuguucuuguggcugucuucuuuuugguuuguugaaugauuacuuucuugguuguucuagggcgugauuuccguccuuguauugcuucuuuucuguuauuauccuuugaagggcuggauucguggaaagauauugugugaacuugguuuugucguggaauacuuugguuucuccaucuaugguaauugagaguuuggccggguauaguagccugggcuggcauuuguguucucuuagugucuguauaacaucuguccaggcucuucuggcuuucauagucucuggugaaaagucugguguaauucugauaggccuuccuuuauauguuacuugaccuuucucccuuacugcuuuuaauauucuaucuuuauuuagugcauuuguuguucugauuauuaugugucgggaggaauuucuuuucugguccagucuauuuggaguucuguaugcuucuuguaugaucaugggcaucucuuuuuuuauguuugggaaguuuucuucuauuauuuuguugaagauauuagcuggcccuuuaaguugaaaaucuucauucucaucaauuccuauuauccguagguuuggucuucucauuguguccuggauuaccuggauguuuugaguuaggauccuuuugcauuuuguauuuucuuugacuguugugucgauguucucuauggaaucuucugcaccugagauucucucuuccauuucuuguauucuguugcugaugcucgcaucuaugguuccagaucucuuuccuaggguuucuaucuccagcguugccucgcuuuggguuuucuuuauugugucuacuuccccuuuuaguucuaguaugguuuuguucauuuccaucaccuguuuggcuguguuuuccugcuuuucuuuaagagccuguaacucuuuagcagugcucuccuguaagucuuuaagugacuuaugaaaguccuucuugauguccucuaucaucaucaugagaaauguuuuuaaaucugggucuagauuuucgguuguguuggggugcccaggacuagguggggugggagugcugcauucugaugauggugaguggucuugauuucuguuaguaggauucuuacguuugccuuucgccaucugguaaucucugaagcuagcuguuuuaguugucacuguuaagagcuuguucuucaggugacucuguuagccucuaugagcagaccuggaggguagcacucuccuuaguuucagugggcagaguauucucugcaggcaagcucucuucuugcaaggcagguacccagauaucugguguucgaaccagacuccuggcagaaguuguguuccacucacuagaggucuuaggaucacguguggaauccugugugggcccuugcgggugucaggcgacucagcuggcaagguagccggggcucgaguggaguggaagggguuugugccccagaucaagcccggguagccugcuucccuauguaccgcagucucaaguuccaccuugccagaggucuuagggucccguggggagucccgugugggcccuugcggguguugggcaagacucugcuggcaagguagcccggggcucgagucucgagucgagcggaagggacuugugccccagaucaggcccggguagccugcuucccuauguaccgcagucucgaguuccgcgcgauuggauuggggcaggcacugugauccacucaccagaggucuuagggucccguggggagucccguguggacccuugcggguguugggcaagacucugcuggcaagguagcccggggcucgagucucgagucgagcggaagggccuguaccccauuuuuaauaggguuauuugguucucuggaauucaacuucuugaguucuuuauauauauuggauauuagccuccuaucggauuuaggauugguaaagaucuuuucccaaucuguugguugauguuuugucuuauugacaguguccuuugccuuacagaagcuuugcaauuuuaugaggucccauuugucgauucuugaucuuacagcacaagccauugguguucuguucaggaauuuuuccucugugcccauaucuuugaggcucuucccccacuuucuccucuguuaguuucagugucucugguuuuauguggaguuccuugauccacuuagacuugagcuuuauacaacgagauaagaauagaucaauucgcauucuucuacuugcuaacugccaguugagccaauaccauuuguugaaaaugcuaucauuuuuccacaagaugguuuuagcuccuuugucaaagaucaagugaccauagguguguggguucauuucuggguguucgauucuauuccauugaucuaccugucugucacuguaccaguaccauucaguuuuuaucacaauugcucuguaguacagcuugaggucaggcauggugauuccacagagguucuuuuauuauugagaauaguuuuugcuauccuagguauuuuauuucuccacaugaauuugcaaauugcccuuucuaacucguugaagauuugaguuggaauuuugauaaggauugcauugaaucuauagauugcuuucggcaagauagccauuuugacuauauuaaucuaaccccaaaaauuccaccagagaacuccuaaacuugauaaacaacuucacugaaguagcuggauauaaaauuaauucaaacaucauuuuccuuucucuacacaaaggauaaacaggcugagaaagaaaucaagaaacaacauccuucacaauagucacaaauaauauaaaauaccucgaugugacucuaacuaaggaagugaaagaucuguaugauaagaacuucaagucucugaagaaaaaaaucgaagaggaucucagaagauggaaagaucucccaugcucauggaauggcaguuaauaauuucuuauaaacaugaaggccuugacguuugugcuaaaggcuaaacaugagcacuucacuccuauugauuguuguugagucauugaaggaugugcugaagucaaggacacuaaggaaaggguguguggcuagugaguaacuaucaaauaauagaugaagauguaaucagaaagggcuagaaugauggaucagagguuaagagcacuuguugcucuuggauaggacuucauuuucauucccagcucccauacagcggcucaggaccuucuguaauucaaacuccaggggaucaggcacccucuucuguucucuguggguaccaaaugcacaugcacauacauggaggcaaacauugauacauauuuaaaaaaaaaaacuuuuauucguucuuugugaauuuuacauuguacgccccaaccccacucgccuuuuuaucucauaccuacccucagcccuuacaaccuaccuacccaaagggggaaaaaaucucacugugguuguuguagugucucaguaguauguacuaugguguacccuuuuguccacacuucuuugcuugcaaauguucauuucaaugagucauucaucugguaugaggccucuggcuucugcuacauuaucaauacuggaaccucacugggacuccucuuggauauccuguccaugcccugugucguggagauccuguagcuuuggcuuuguaggaccagccccuucacaugcucuauuaauucuucaaugagguagauaacucugguccuggaagguauuugagcuguccagccugccagcucucccacacccacaccacuauggugagcucuccagcacugcccugccuagcagcacauccagagcugcagcugcaaaggggagagucagcccuccaacucuaaugcccucaggucagacugaccugugccuacaccaucagggccagaucuacugugccgcccaggugaggugcagggccaaucuacuguugucaugacuucagggccagcuccccaguucaccacaggcgacuagagguaaagguaggggagagcaucucuuccuugucaaugccagugcaaagcagacaaguggcagggccaguccgcccauacucacaccuucagggccagcucuacugugugcuaccugggagagaugagagacccacucuccugaguaucacugaggugagggacagggacagcaaucccacaauacccagaugagggaugggaccaguuuugcauagccuucagaaaucaacauggccccaggcagcaacccaaggcaggggcaucugccuguccuuugaugguaacauacccaccaugcugcagggccauggacucauggcccucaguggcaguacagcccaagaccccacccaccaugaccuuagguggcuucgccagcuacuuacaucagucuguucuucacuacucuccaguccccaguuccaccucucuucauuguguacauauccuucugcuucucuuucucuuucaugucuucaccacuuacuugaucaucaaggcccuuggguuuguggcguuaucucaggaguacugugccccaccuaggcaguguggcuucaagcaggguuugucucaggcaggucugccugccuaggccugugcuuugcuggacugguaguggacucaagcuuguuuuccacucaggcccaugacaccagacuagugguugucucugauuugucuugggcucucuuuccaccugggccaugugaccugaacuaggguuaucugagggugaucugacugcccaggccuuggcaccgaguuaguauucaccucaggcuaccuccucacuugggccacauggcaccaggcagggcucuuuuguuguuguuguuguuguuuguuuuuuguuuuuuguuuuuguuuuuucgagacaggguuucucuguguaguccuggcuguccuggaacucucacuuuguagaccaggcuggccucucauuuuuuuuuuuaaguaacuaaaacuaaaauauguaaucagaguaaaauuguagaaaagcuguuuuauuuuuugccaagcccagugugaccaugaugggaacagagugauaggguuccugccccuaagacagcaccacugugaaccuccacaaguauagauagcugcuguuggcauaaggcuguguguguguguguguguguguguaugugugugugugugugugugugucucugugugugugugucugugucugugugucugugucuguguguuagcaauaauguucauacuuucuaauuccuucaagguaugucuucccuguaaacauuaaugcuccaugauaauuaagucaguaucugacagagucugguguugagcccaagauucuucaucuccaagcuaugcacccuguguggugaaggcucacugccugagauuugggagggaaaacucaucacugaagauaguuagaucuuaucucaguacagcaagcuguccccgaguggcuaguguuucuaguuccauuucacuguucuuguucuucuguccuauacuguuucccaggagucauacuacugcuucuggacaagcuucggaagaugaaaugggagcagauguggagacugacagcagagagggaacucaugggcauguugucuacauccuuggcugaccaggugagugaccagugacaaggacucuuagaucugaguacucuccaauuaauauauucuguguuaggacaguaaacacugagaaaaggguuuuuguuacaguuuaguuuagcuccuugcuuuuucugaaacaaguucucaguauauacaccagacugccuugaaguagcaauuagcuugccucaguuucccagauucugagauuuaagguaggugccaccaugccuggauuaagagguucauuuugggucacaguuuaguaggcuuuaacccauaguugguugaccacauuguucuuugucuaauagcaaaacacuacagagcacauggagggucauaucuguucaaccacaggauaauaacaccaaagaagauacugcagccccacaauuccccucacauguauucucccagugacuuuaaaacuuuccacuaaauucuaccuaucaaaaguuuaaauaucucuaguggggaagccagggaacacuugugaucaguaguuuagcacauggaccuuuggaagaauauuccagaccccagauuacagcagaucuggugcuaugucuaaaagaauccuguuagcaauuggacgggucucaauucauuggaucacucauguacucaaccaagacagucacugagcauuguauacuaugacauguagaaagacagcagagguaaacaaagaaccuaauuauuuucuuuauuuacuuuuucuauauggauauuugccugcauguauguuucugaaucuuaugugugucugaugccuauggaggccagaagaggggaucugaaacagaaguuuaugcuucugagccucccuaugggugcugguaaucaaacucagcuucucuggaagaacagucaaugcucaaaaacacuaagccaggucuccagcaauagguucuuuaccucagaaaguuuauuguuuauggaauaugacucgcaaguggaugacagucugcuauguuaaaagccaucaguaaccaucucuaccaccaguguagaauacaccuguuccccaaggucccaaaauaccacgguauauuuccccaaauaugucauauauaucugaaaagcagcauauaauguauaaaucauuacugugguccuuauccuggucacccugaacucaagggaauugcacuaaagcaagaaagaccaacuuuaaccagacagucugaaaaggcccuugaacuccaacaaauuguuaacuaauguucauuaaaucauauuucucauuuugauugggaaaggcaugggaccuauuugaccucagaacucaggaucacuccuuguugaccauguugaggugugauguagaugcuuuuucuggacuuuacuuauuucuuucuuuccuauucauacugagaucaugccacauuuuuauucaugauucacuugucaacuuucaacaaaguuuucagauacagaggaaacaagaaagucuuaaggguuacaucacuuuuuuuuccaucauuauuauucaguauuucccaaguuaccaaaacugaucucccuuccuaaacaaugagauacaacauaaggaauaaaugaagaaaguaauaacucaggugcuaaaaccugaggggauaguugucugcuauccucauauuucaagucagguaacaaugaccugaguguauucccuauugcugggaacuguaugucuguguccagugaggauaguuuguucagccaacuuaugccaugaaggccuguaauucaccucccuguaccaccugucaaauaguugccuaauaagugaggcuucauguuggguuuggaaagagagcucaaacccuuuuuuauacacauacacacacacacacacacacacacacacacaaguguaggagggaucuuccuggacaaguggaguuugaaauaugaagcuguacucuggaugcuguggccuguagaaauccaaggaacauccaucacuaggcuaaccaaaagccccaagaaagagcugcugggagucaguauauguaauuugucucaacccucuagaugaugugagucacuugucaucucauugguucccuuccggaagucucaggauagcauagggcuccaagcuaggaugggggaaggggagaaaaagagacuucauucauuuuaugauagucagcaugggaaagucauucccuaucugcucugugugaacucucuggaugaugaccaccuagacucauaagcaccaagucgccuagguuggccugugacauuccccuguuccuuuccaaaugccaccccuuaguuucuguagaaaacgggcaggauacucaaaacaugucuuccucuaaacugaacuagcuauuagcuucacugugucuuugacuuuuauuccacaggauauuuucaaugcuguuaucaaacaaaaccccuuucugguguaucagcuucccugcuucuggaaugugcagcugucagaccacacccgcucugagcagugcuacagagaugugucugauuuaaaggugggugaagaagugucauggcaggguguuguucccaucuucaacauaguacugguugggcauagggaagcugggugugguaauuggcuggaaacaguuguccuugagccugugggaagugugguggaagauguaaggucccaggagaacagaaagaacaugacuuuuaucucuauuggcuauuuuuuuuuucacacucuucuuugacuuucuggaaaucacaaagcugccagaguaaagaaccagcuuguguggauuuuccucuuuccaucugaugccaguucaaauucaugucaaauucccaaguccauugauuuaauucaagcaaaaauauuuguggagagguccacuccaugucaggcacuacagaagugaugugaauaacuucuuacuuucaagucacacuguagaagggcagagaaaccuggauggaaauggguauaaauaaacacugcagaagccaugacaaguguaggagggucagagugaagaaagcaagcacaugucucaccuuuucuuguagauggggcaguggcagaaaaguuuucauugugaccuucugaguaugaacuauugaagaaggccucacuuuaagaaaacuacagggcaggguauaugagcuagcuguacauaaugugauguaacauucuucugaucacacuugaaaugagcaacuauuauauggucaaugacucuauauuggaugggaauucauucauuuucccugaccaaguacaaagauuggccucagugcaggaugaugucuaggacauuucagaugucuccagucccuuguaugaugucaucaaguaaaacugauauacucuuagaacaaggcacauuuggaaagagaaguccuagugcuucuaugcaggaagccaugucuugguacuguuaaugacccuccacccaacauagucaaaagaaaaaaguaucucaaaccuugccuuucuccaucacuuucuaucuuauuucuuaagguagaauacaaauugaacauguagcuugcugauuggcuggauggacugaccagugaauuuucagagaucucuacuacucauguuuuuguuuguuuguuugcuucacauacauacauacauccacacaugcauaucacacauacacacacacacacacacacacacaauaaccaaguaacuugaauuuguuaaggacaggcccucaauaauaucuacuugccuguaaucuuaaaucuaaaugaagaauucuggguaauuuuagcaaugaaauuguuuuccagauucaagaguaaauuauauguagcacauauucuuuaaaaaagauagaccucacuaaugaaaacugaaaguuccccaaaacgggagagacccucacucaagccccaggaucacgcgacgcccaagaacucacaagagacccaucuugaugcaaacagcaagagguuuaaucgggaaaggccagugcacuggggacaacuuguauccuacacagggguagaggagucgacccugagcucaaaggguaagggguuuauaaaggcaaaaacugcacacaccuggcauggggcuauagcauuuggcaagcauaccggguucaagaaacgguugaaguauucuguacgaacauuuccuaaaacaauggagcaagguaaacuucuacuuugugguuaguacauccuggaacaauggggcaaauuaaacuuuuacuuccugccauuagugaggucuauuuuggacacaagucuuagggcuuacauaauuuuucacucuucucucucaggaucuuucaaaaacaugaaagauugacaguaacauuaagcaaaaauaauaucaaaaaguacucaaugaaagcuauauuaauuguacugauaucagauaggacauuaguaggagagagauggguccaaauaaaaaucaaacuuaccagucagguauaagcaccucaaaucuggauaucccuugugcuaugucauauauauuucaaaguauguaaaaguauaaauuaaguauaccuacaauugcacauauauuuuaauuuuuauuucuaucuauguauaaucaagcauuauaacuucagagaaagaaaagcauaaaccucuuauuauaguggaauguuuuaccauccuuuucaaacauggaaagaugucaagaaauaauaaaaauauagaacacuugaguaaccgccaacauacuugauuuauaggguaaauaaagaagcuugugugggcaguuagaauauacauccuugucaggauaucagcuucauauucaacauuaacuauaagguaaccauguaccagaccauagaaaaacgcucagaacaguuuaaagaaucauauuauaccauaaugcagcaagcacaguuaucucaauuugaagccuauuacaauaugaugaaaaucaucuaauugauucaaauugagaauacacuucaacauuccuugugguucuaaaugguaauuguaauugaaacugagagcuacuuacagacuaaaugaaauugaaagcaaucuauguccaaaaauaugagaguaaauaagcauacggaaauaaugcauaagcuucgguguuuguauuaaaauaaagaaaggcuucaaauuaauaugccaaacuuacugccugggaugauacacagugaauauggagauaaauuuaaagaaaauaaaaggacauaaagaacagcagaaauuuauuagcaaauugugcaauaaagucagaagaucuugguuuugaaagcaccaaagagaucuacaaagucagacaguacuccucagacaaaaagaaggaaacuuaacaagcaguggauagccagcaugaacucacuuacugauucagaagguuuuuagcaaguuauuuguucugagaccuaaguauacagcaaagacuaaauuuaucauucucucacucauggaacuuuuaauaugguaugguggguaugugaaggggucuguagcccuauaggaggaacaacaauaugaacuaacaaguacccccagagcuccuugggacuaaacuaccaaucaaagaaaacauguggugaaacucgugacucuagcugcauauguagcagaggauggccuagucagucaucagugggagaagaggcccuuggucuugcaaagauucugugccccaguauaggggaaugccaggaccaggaagugggaguggguggguugaggagcagggggagaggggagggucuagggggauuuucagagaggaaauuaggaaaggggauaacauuugaaauguaaaugaagaaaauauguaauaaaaaauaaagaaaaauauguacacaugugguguguguguguguguguguguauacacaauugugcccauauguguuuaggcacauguacauacacaugcaugcagaggccagagguuuucauuuaguaucuucuuugauuguucuuuaucuuauauauugagacuggauuucucacuugaaccaauagcuuaccaauaugucuagucaaugugauaugaggauucuuuucucuugucuccuaagcucugggauuaaacacucaccugacaauuauauguaugcuagggauccaacuccaggcccuauacuuacacagcaagcacuuucccacuaagcuguuuuuccaguccauacaguaagcuuuccuaaaaggacacagcaucccuaguugucaaguagaaauaagcucuagcaguuguaguuauaaauuuuaaguaagcuuauucaaguuauccgugaucaccaaaauagaguucuaugacauaaaaauuacaagcuaggccaggcagugguggcgcacgccuuugaucccagcacuugggaggcagaggcaggcggauuucugaguucgaggccagccuggucuacagagugaguuccaggacagccagggcuacacagagaaacccugucucgaaaaaccaaaaaaaaaaaaaaaaaaaaaaaaaaaaaaaaaauuacaagcuaguuucauuugugaacauagauguaaaaaucuuaggcaaauuacuagcuaacaaaaucuucuccuguagaaaauagauaauauaucaugccuagguuaggcuuacuacagaaagacaaagaaaauuuaauaccaaaaauuuacaagugucaugagauuauauuaauggagucaaguagaagcucuguguacucccaaauggauaugagaaaguuauuuagugaaaucuaaacacuuuuucucguuauaaacucucauaaaauuggcaacuaguaaaaaaccaugugugagcaugugcauguguguguucgggggauaccagugaagucacagaguagaguggguauuucaggaaugcuuaugcaucuaugggcaugugauaacugaaaaggugcuauuccggaucauuacagaaaggauucaguacaccauaaaaagagauaccagguuuuccauauggaagaaaaaauuagcacagacuccaucucacacguagauucauuccuggugggugagggauaaaagacuuaaaagcaaaauguaaaacaaagcaagcaaacaaacaagaaaggauuuuacuuugaaacuugaaagaugagaguccuaagaccucaaaauagggaggaauuuauucagcaagaugggucauucaucguaggugagcugccucaguuuacuuucuuuuucacugugacccagguguuuugaucuugcuguugaagugcuagauuauuuccuauuugaacuacccuuacaaggcaucuucuaggaccaucacaacccuuucuuuuaaugugccagggaggcuauaaggggccuugcaaagcaaaggacacuccuagauuauuuccauuuucucccauucuuuaccuagcccacacccaauggaaagcaacuauuuuagugacuuaucaucaaguuauagccaaauauucuguuugcuugucaugaaagucauggcucuucuucuacaauuuuauaccauuaguucaaauaauuuuuaguuagauuuccaguucuguuagaaacaugaaugcucuugguagccaacaugauccucuuccuguuaaauuaguccuugcugcuauuaccuguuugaguuaaaguuuguuaacuguuaguuacuauuggagacagagaaugggaccugggaucuacuuacccucaauaggccuguuagagaaaaagcugaucauuuaauguggucauguugggaaaaggaucaaaaagugacacucccauguccaucguugagguccucaagugaaguuuagacauuauacaugacuuaucaguucuguucaagauguggucuuuccuaucaucaugggcugagcuccaggcucuccugcuugguaguaugacagauugucagaacuaugugaguuucuucuuaggaaaaaacauccccuccagcugguacugaacccccagccucuucuauccccagcauaaaauuccugagggaauguauuggggaccaauauuugaauagucucaugaccgaccaaagggaaggaaacaagucucuuuagaauauuuugguuccuccuaguauuguugcaguaugcuagagcagaacuccccucauguccuacuugaauaaacuuccugaccuuuuguauuuuguccaucuuggaaccuuccuucaugcugacacuguccuucaaaaaacuucaaauaggaaaaauguuucccugacagaaacagaaguguccaaguguuuggagacaacaguucuuuaaauguugaugacaguuuuaguucuuaccaguucaccuauuugaauaaaucccuugccauucccuaggaucaauuauguucucuguaaaauagaaaccauuacuuuuuggcuuguucucaaccaggccccuugagggcugagagcggugcauuuuacauuaccuccaucuuuuuuguuucaaagaccuucauuuuuaucucugaagauugauggcucagccuucccagaccuaacuuauaagaagaaaaggggagcccaaaggaacaccucucccccuccccacauuucuuugccaggaacacaaacugaggagacaaacaaagaaccuggggagaaucuccuggacuuugugucaguccucaugucaucugggacaauuacaacaugaguugcuccccagagauagcccaguggguagaaacaucugcuguguaagcugcauucagucuacauuucccaccugggagaaagauuaacuucuacugguuuuccucugacaucuucauuugugcugggccgugagcaucccuaugcauauacacauuuguuauaaacacacucauccauauacaaggugaugauaaauaaucguucuuuaaaggagaagagaaggggcucauuccgucagaaaugggaucuucaccccuauucuuuucucagcuucuguucuccccuaguuagccccaaacuguccuuucugucuuucuuucauaugcuauacaaacuaucaucccugccuuguuuguguccaugaagcuaacaauuauagaccuauacaagaaagaauggaaauacaaauaugaauaaagauuagugaaguugagcagggucaucuguguaguaugugcuguccuuuagaguaaacagaaagugcuuuucuuucuuuguuuuuuguuguuuuuguuuuuguuuuugcuuuuuugcuuuuuugguuugguuuuuccaagacaggguuucucuguauagccguggcuguccuggaacucacuuuguagaccaggcuggccucaaacucagagaaauccaccugccucugucuuccaacugcugggauuaaagaugugcaccaccaccgcccagcuagaaagugcuuuucaaagcaaaccaguagacauggcuucauccucaaaaggugaauggagauuucuaguuagauuagauagaauggcauucuagggaugauuucacuuacagccaggugaaaagacucuuacucaugaaauuaaguauccuccagaguaugucagcuaaauauaaaaagcugagauuccaguucuucccuuucugaccucaaaaccagaguucuuucuuuuaauauaggucuagguuuuaccugaacagguuuuccguagcaaacacauugauuugguggagugcaaagcucuagauuuucaaucuagcaucagacaagcucaacauggugguacacacauaauucuagcacaagggagguauaugaaaaagaauaaaaaguucaaggucaucucugguacaugguuagauccaagcccucuuaaacaaugauaagcccuccucagaggcccuugguccugugaagguucuaugucccaguauaggggaaugccuggacuaggaagcaggaguggguggguuggagaucagggggagaggugagaggauagggaauuuuuggaggggagacuagaaaaggugauaacacuugaaauguaaauaaagggccgggugugguggcacacaccuuuaaucccagcacuugggaggcagaggcuggggaauuucugaguucgaggccagccuggucuacagagugaguuccagaauugccaaggcuacacagagaaaccaaaaaaauaaauaaauaaauaaaaaguaauaaagaaaauaucuaauaaaaaugggaaaaaaaagcccucuucauuaauuaguaaagaguggggcuggagacccaucucuguccuuccagagcaccuuaguuuaauaacuaguaccaauguggcagcucacaauuguccauaacuccaguuuuuguggagucugaugcccuguucuggccucaugagcacugcacacagagagugugcaaacacucaugcaagcauuacaucaguauacauuaaaucaaauaugcuuuaggaaguaaacuaaagaggaugaucuuccaggacaaucccaggacuguuuacugugaaccaccuuuggaguaaauggcuuccaagagcucacucacauaaagacacuuuacucaacauugucucucugagagaacauuuuaauuuuaagaaaaaaaaaaaacaccaaaaggaaucgugacaucuacauggaaaagugaaauauuuguauaaaggaaauguauaaaaucugcauuaaaaagaagcucauuacagaaguggaugcucacagucaucuauaagauggaacacagggcccccaauggagaagcuagagaaagcacccaaggagcugaaggggucugcaacccuauauguggaacaacaauaugaacuaaccaguacccccagagcucauaucucuagcugcauauguagcagaagauggccuagucggccaucacugggaagagaggccccuuggcauugcaaacuuuauaugccucaguacaggggaaugccagggccaagaagcaggaguggauggguaggggagcaggguggagggacgguauagggaacuuucgggauagcauuugaaauguauauaaagaaaauaaucuaauaauaaauaaauaaguagcucauuacucaaguuugaaaacauguuauaacucuuagagauacaucagcuuccacaucuuuugaggaagaugagggaccaaugcacauuagcauauugggcaugucacuaccaggcagauagcugugaaaaacgaggcagaagaauccagagagaagguaauaagaaugauugguggaaaguuugacucaugaggauuaguauggauugagggagaaaaaccagcugguucacuggagaauaucugaagucugaaaucaccaccuucaccucuuuuguguuucgccagcuccugguuaacaagcaucauugugugaccuccauacagggcucuagguauuuugugaucuggguguuauugggguuaagcugguauacuuaaggcgugcucccaggaauauaugagauaucagcaccuaguuugguugccugcuuugguugcuguccuacugugacuagagccuugaacucucacauacguccaaaauaccuuauagaucauuuauggcuggccaagcuauguagcugucauuguuauauuuguauguuugagugugcuaaggugguuguacauacacaaaugcacauaaauguaaaggccaccugucaauuuaucauugacuugaggcuugucauuggaccacccagcuaacaccaccugucucagcuuccucauuaucgaaagugcaagcucucaucacacacuucagcauuucauaugugagcucuagggaucuaauucagauuccccggcuccacuguacaacauuaaauuacuuacccuauucuaauuauaucuccuuaucugggcaaaugggaaaacaaucauuauuuugcauaagugcuuaaaauucaagaagauggcacacaaugcaauuaugacagagcuuggagcuauauagaaagccuacuggucuuacuauuuagaaauauguuuuaaaagaucacuguugaaauaauuuucagccaacugaggaaagaaauaugucaacacauuucuucucguccauuugucacaacucucauuucacauauagaaaaaagaagcauccaaagagaggaagugaucaccccaggguagaaaaacagguugguggcauagcuagaauaagugucugaauuugguggcaugugcccuagcccauguuuaaaugccauacuaagcagacaggacuuugauaauauaagcaaauguucuuuggcucucaacucccaucuguucuucacucuuugguaauuucuggcaccuaacuccuuggguucuguugacguaagcucucugccaugguuuugguacacacagcuguuaaaacuuagaagcaguuacuccuauaaaagucagcaacauucuuagagauacagugguacaccugagaaauauacuguacuccagcauguuuagcaagguauauguaaaacagugugaggagcuguugauggcaguuccuuuaaaguggagggauccuggggaugugcagacuucuaggaacucugaauggccgguugucucuauaauucuauagucagaaaccugguugauauuguuuauuccugccauuugccauuuaugcucuaucucagcacagagaggccuaugugauagcagacugcccuguggaacagguaccuuagaagucagugugggacaaacugcccacauaaagcugugcuccuugaggaagaacaggguugaaguaaggaaguacaauauuuggugauuggacaaugacacacuaaccuacacuggggaagguuugguucuccaccuuagaggacuucacaaaucaagcagguuggacaaaggggagaauucaaagaucuaccuucuggaaauuacuguaacucaaguggauucuagcauuacaaucauuuaaaaaggauaggagaguagucaaguccagaaaacccuguaugauguccaaccuuuuucuuuuuuacuagauauuuucuucauuuacauuucaaaugcuauccugaaaguucccuauacccucccacugcccuccuccccaacccacccacuccuguuuccuggcccuggcauuccccuguacuggggcauauaaucuuugaaagaccaagggccucuccucccaaugauggcugacuaggccaucuucugcacaaaugcaacuagagacacgagcucugggguacugguuaguucauauuguuguuccuccuauaggacugcagaccucuucagcuacuugauuacuuucucuagcuccuccauugggggucccguguuccauccaguagaugacugugagcauccacuucuguauuugccaggcacucaaauagccuaacaagagacagcuuuaucaguguccucucagcaaaaucuuucuagcauaugcaauagugucugcguuuuguggcuguuuaugggauggauccccacguagggcagucucuggaugguccuuccuuccaucucagcuccaaacuugaucucuguaacaaucuccauggguauuuuguuccccauucuaagcaggaacgaaguauccacacuuuggucuuccuucuucuugaguuucauguguuuugcaaauuguaucuugggaaaaauuccugaacagaacagcaauugcuugugcuguuagaucgagaaucgacaaaugacaccucauaaaauugcaaagcuucuguaaggcaaaagacacugucaauaagacaagaaggccuucaacagauugggaaaggaucuuuaccaauccuaaaucagauaggggacuauuauccaauauauacaaagaacucaagaagcuggacuccagaaaaucaaauaacugccgcagaccuuuugggucccugugucugcguggugaaagacccccgaagggagacccucacucaagcacucaagccccgggacagccgcggacccaagaagacacugagaccguacucaaaauguagaaggcaagauuuaauagaacaacagcaagaaagcacauggaacauagaccagagcucuggggucgaaacucaugcaccuagugguguagaggagaaucgacgaccagccaaauuuuucacaggcuuauauaguaaaacucaaggggggagagcugggcagggaaaguacaaguuuacaucacuaggggguucugccaagggacaagggguucugccaagggaaucuacguaacuaaggggucaugucuuaucauuuggcauuguacccgguuuauuuugagguuauuccaggaggcccuuaucucaagaauguucuuggaacagucuuuaguugggaggguucgaacucuagggugaggaguucaggaaugcauucugggguaaagaguucaggaguguuccgggaacaaucucuagaugggaggggucggguucuggggugaagaagaguucaguaaaaauuuuuauucuucauuccccacuucuuuuaggagauagcucuaaucuuagagcgaguuuucaaccuccugaaggacccgauauuguugccuuaguaccauaacuuggacugcguuuauccuuucucugauaaaagcuacuaacuuauuaaggaugcaugggccaaaaguaagcaaaagcauaaguguaauuaaagguccugcuauaguggagaggagaguggugagccaaggggacuuauuaaaccagcuuucaaaccauccuuguuggcuuucucuuucucuuuuacguauaucuaggcguucucuaaguuuagccauagaaucuuugauuacuccugaauggucaacauaaaaacaacauucuucuuuuaaggcagcacagaguccuccuucuuuaaggaauaauaagucuaauccccuucuauuuugcagcaccacuucggacagggaaguuaaagauucuucuaauuugguuauagacuguucuauaguucuaagaucaauauccauagcugcacguaguucuucauaguauugggggguuuuaauuaaggcagcgguuccuguaccuacuccagcugcuacucccaauccuaauagaacugccaaaguuaagguaacggguucucuuuuccagcggacccgauguucaaauuuaucuaaaaaagagcuaucaucaugauacaagagucugggaauaagcugaaccaaaaugcagaaaucuuuggaacuauuaaaaacagacauagacacacaaggagugagaccgguauugcaagcccacacugugucuaggggggcacuagauacugaccacuuuugcuagacuggauguucugggucugauuacagaggugcccuuuauccugagguaccuggcccaagcaaagcccucuuccugaaacugcugcuagagucaacuuucuguuuucuccccaaagacauugagaaugaucuuaagugauauuauaaguucugaucugagcuauuccuucauaauaaggggggcuagagguauagcauagccagcaugauugagucauauuaggguuaguucuauuuagaacuaaaaaagcuccuuggacuagacugaccagacgguccucuguuccuagggacgguggggaagccaagguaggcuuuaugaggagaguauuaguuccuagggaggguaccacuguguugggcuguggaguugguggagcugguacagucgggaccuuugggggagccaguacgacuggggggcccuguucuauaaggaccuuguugggcccuacgagugucacugccgggucucucacugucagucugaucgugaaaaugaacccaggaucucuuaguggaauguauacucgccaaccccaccuauuuccuuuaagccaacuuagacgguguuguuuuccguucucggugaaccuuauacguaggggguugcaguauuuaucuuugcaugguccugagggugcucuguuuuuaaaagcgcacccacucucuugauauuuauagggguuucuuucuccuucguuugacuuaucauagccacuaccucguuuuaccgugauuaggucccauuuagaggagggcuuccaguaagcauccccugucguuucacauguccauuuaccacaaaaguaaucugaugcccccccgcauucuuguugaagccuuuugcucugacccugaccagggcaaacauaaaaaugugcagcucuaagauuagcucgguagaacugccccgaacacccauaugugcucccuaucccauuugggacacaccgcuccucgggguggguugcuaagaucaguaugaucugagaggucccaauugggggauccugcugcuaacuuacagaugucaggcgugagaucaggccaccaaguccagaggggauggacugcagugguugcccauacuauguuucccuuuucauugagcacuucccaggacuguugaauuggagcaugaggguuaugguucccuaaguucaggguggcgccugcggcgcaaacgaagcuuaagaggauugucagcagcugccacuguccaauugucuucgugguuuucuucaucuugacuggcggcccucuugacgugggaggcguggauccaggaggcgauuccgucaacuuuuaccgcaguagggguugucaguaacaccaaauagggucccuuccaccguggcucgaggcugccgguucgaugccgucugaccaagacuuugucuccaacucggaacccgugggguacugcaguggucccugggguauaggcugccuucaguuggucccaaaucuggguccuaaucacuucuagggccuuuaaaugaauaagcaaagaggaggguaagacagggucagaguuggaaaccaauguuccaccagcuuccaucaaugggggagguccuccauacagaacuucaaaaggagugagcccgaaacguccagggguguuucgggcucggaagagcgcaagagggaggagagccacccagucuuuuccgccggucucaauggcuaauuuagucaaggucucuuuuaagguccuauucauccucucuaccuguccugagcuuugagggcgguaagcacaguguaauuuccaaucgaugcccaacugaguggccaagcccugacuuaccugggcaacaaaggcugguccauugucggacccgauuaccuuagggauuccaaaucuuggcaggauuucuucaaggaucuucuuggccacaaucugggcagucucuguuuuagugggaaaugccucaacccauccugaaaaggugucuacaaauacuaaccagauacuuguuaccauacauuccagguuuaacuucaguaaagucuaccucccaauacacuccaggauggucuccccguugucucuuuccagguucucuguaggcuuuagucgcauuagugaaugcacaugguuugcaggagucuauaaucuuuugagccacugacuucaguuuggggacuugguaucgggaauuuuuaauuagucucaucauuuuuucaacucccaggugggugaauugguguaguccuuucacaaauuuuauuccuucuucgggagucaauucuauuuucccuucaaaaaaauaugggaggggaucacugguccaccauaguucuuuuauguuauaccucucauccucagugcuuuugggcggaucaccuuuuucaguuaagaucauggccccuugagcaacuuguuuugccacuaagucugccauucgguugcccuuggccaccaagucuucuccuuuuugguggccggggcaguggaugauggcuaccuuuuuaggugcauguauggcuuccaacagggccagaauuucuucuuuguuuuuaaugucuuuaccagccgaggucaauagcccucgcugccuguagauggccccauggaugugugcgguagcaaaagcauaucggcugucaguguagauauuaacgaucuuaccuuuagccucucggagggcuuguauaagcgcuauaaguucagccuuuugugccgauguuccuucaggcaaagcgcuugcccaaauuaccuuuuucccgucuaccaccgcagcuccagccuuucgcuuccccucuaucaggaaacugcugccguccguguaccaacugggagcuccaggccaggguuggucagucaggucacuucuggucccaguuucuucagcgaggauguccauacauugauguacugggacggaaucauuuguuagagggagaaggguagcuggguugaggauggcagggggcgcaaagguuacacgcucauuuagcagcaggcucugauagugugucauucgggcauuugucauccaucugucagguggcugccgcacgauacuuucuaaggcaugaggggccacaacagucaccuguugucccauugucaauuugucagcaucuuugaucagcagggccacugcugcaauagcuuucagacaugugggccauccacuagcaacaggaucuaauuuuuuugacaaauaggcuacaggucucuuccagggucccagugcuugugucaacacuccccuggcuacacccgcucucucguccacauauaggacaaaaggcuuagucaagucugguaaugcuagcgcgggggcagucauuagagacgacuugauagccucaaaagcucuuugguguucuucuuuccacucgaaaggaaccccuuccuuagucaaaggauauagaggugcugcuaggguugcaaagccuggaauccagagucuacaaaagccagcaguccccagaaacucacguaccugccgugggguaguuggcgaugggaucaucauaacagucuucuuccgggccucugugagccaucuuuugcccccucggaggguauaccccagguagguuaccucaguuugacagauuugugccuuuuuagccgaaacucgauaccccaagucacucaguucugcgaggagccucucaguucccuggugacacagcuccuucgaggccgccgcgaccaagagaucauccacauacuguaguaggguaagcugaggguuucgagcgcgaaaaggcgcgagaucccgauggagggccucgucaaacagggugggggaauuuuugaaccccugugguagccuaguccaaguuaguugaccagucuguccgcccucugggucgcuccauucaaaagcaaacaggagcugacucuuagggugcaaacgcaggcaaaagaaggcaucuuuuaaguccagaacuguauaccauguucucucaggugggagagagcuuaauaaauuguacggguucgggacuguggggugaauguccaggacccuuuuguuaaccucccggaggucuuguaccgggcaauagucauuggucccugguuuucgaaccggcagaagugguguauuccagggggacugacaggccacuaaaacuccuuggccuagcaaccucuggauaugaggccggaugccuucucuagcuuccuugcucaugggguauuguuuuaccgaaauggggguggcaucagcuuuaaguucuaccacaaccggaggcacuuguuuagccaaccccauuccugcuuguucugcccagacauuggggaacgcaguuagccaaccugaagagacuacauuuuuggguuguucuucaugcaaccgguacuuuuccucuguguugaggacaaggcaggcaacaggggccuuuccccagcuuacuugugggccuucugaaguaaauuggacuugagccuuuaguuugguuagcagaucgcaccccaagaggggagcagggcacucagguaucaccagaaaggagugggucacuauauucuugucuaucugaagagcucguuuggucguccagggguaaaauuuacuaccaguggcuccaauuaccauggucuuuuuggagccuagcuugccuaggggguuagugaguacugaaugcucugcuccggugucuaucaggaaguugacgggaguccccuccauggacaaaguuacccuaggcucagggagggggucugagccccgacuucccuaaucaucuucuagggucaggaccuuggaucgcucccguuuuuuagggcaaucucuagcccaguguccucucucuuugcaauaggugcauuggucuuuuuccagugguauuuuucugccaccuggcgguuuuacugcccuguugcccaggagcccuauuuuaccuuuuccugacugucuaucauucacaacugcggccaaaauuuuacucagauuucucuccugagggcgaucccgucuauuuucccucuccuccauuucuuucuucucucucuccugccucucuucuucuguuucccucuuaugauagacuuucucugcuucuuuuacuaaaucuuggagcguauaaucuuggagccccuccagccucugcagcuuuuucuuaaugucgggagcggacugaccaaugaaggccauggcuacagcggcucucugccccucugacaaggggucaaaagggguguaucuccuauaugccuccauuagacgcucaaggaagacugagggugguucagucugccccugcaagaccucucuuaccuuagccaaauuggugggccgucuagcggcuccucugagaccugccacuagaguccggcgauagacaaggaggcguccccuaccuuccgcgguguuguagucccaguuggggcgguucaaggggaaagccucguccacgagguuagggagggcagugggugugccguccucuccuagaacauucuuucucgccuccaugaggauucuuucucuuucuucugugguaaaaagaaccugcaaaagcugcugacaaucaucccaaguggguugaugggagaacauaagugacucaaggagcccaguaaguccagagggguucucugagaagggagggugguuaguuuuccaauuauauagaucagaagaggaaaaaggccaguacuguaaaggaaugagaucauuagguccuggugcuggcccucccacaugugcucugaguggcaaggcaacuguugagucuggccccccuuccuccccggggcuucggccucggcgacuccgagucccccccgccggucccugagccccucucgcuauuggucccugugguggggcagcugcagguggcuguuggggcaggggguaagggggcgguugggaguccauccagagaaggucgucaaucucuggauagaucuuggggggugcugaugggccggacuuuccggcugcaucagacugggcaaccgcgaccgucaguuucgaagaguuugggguccaaggcuugacccacggaggugggaauuggacgagauucugccaggucacaauguaggggaugugaucagggugacccccuuccuccugaaaaacaauucgccugacggcggcgauuagugacaagucaaaagcacccucagguggccagcccacuccaaacguuggccacucggaggcgcaaaaggucugccacggacccuuucugaccuccaccgacugguugugggcucugacccgcaccuccucccaaugcuccagagucagagaaaggggaguggacacagauugucccauuucuagaaaaacaguagacacaacaagagcgggacacgagacuaagacaaaaaagaaaccagaaacggcggcgacucugcgucgaccacaagcaacucaaagaaucagauggccuuucuaaggccggccgauugagacccucugcacgaggugggacucgaacccacgaucccgugaccaaacgcgaggcgggacucgaacccacggucucgcaacaaggcgcgaggugggacucaaacccacgaucucgcaacaaaacgcgaggugggacucgaacccacgaucucgcaacugggcacgaggugggacucaaacccacgaucucgcaaccccaaauggucucuuggccuccaaagggguccaccaggcgucccugguccuccccuguuccuccugggacgucucccagggugaacggacgguggacaccuggacacgucuauccuuauccaccccgcguucccucucggagcgcggucucacugagcguccgcaaaaccgaaacugcaaucgcaccaaacuuagaaacagaacacaaacaucagaccaaaacagaacaaagaaucuuaccucuaagugggucuaggaccucuggguggucgcgcugauucccggccaaugcaccaaaaugaaagacccccgaagggagacccucacucaagcacucaagccccgggacagccgcggacccaagaagacacugagaccguacucaaaauguagaaggcaagauuuaauagaacaacagcaagaaagcacauggaacauagaccagagcucuggggucgaaacucgugcaccuagugguguagaggagaaucgacgaccagccaaauuuuucacaggcuuauauaguaaaacucaaggggggagagcugggcagggaaaguacaaguuuacaucacuaggggguucugccaagggacaagggguucugccaagggaaucuacguaacuaaggggucaugucuuaucauuuggcauuguacccgguuuauuuugagguuguuccaggaggcccuuaucucaagaauguucuuggaacagucuuuaguugggaggguucgaacucuagggugaggaguucaggaaugcauucuggggugaagaguucaggaguguuccgggaacaaucucuagaugggaggggucggguucuggggugaagaagaguucaguaaaaauuuuauucuucaguggaacggggucucucgacgcgggugggcaaagcguggaugaaugacagacagacacacacgcaggagaguuuguguggaaucugaauguaauuuuacaacucgagcaucagacuuuuuaugcagaggacaauaaggaaguugggugacauauucgcaagguacaauugagguaaccggaaucuuacauaaaacagaggaauguaaacacaaaaggucuaacgggaaccacccaggauagaauacauugauaacagcugggaucaacaagggcuccaccuaaaauucacuaaucuuagaagccagggucaagggcuucgcguccuugccacaguuccuauuuuagucucuuguauaguccaccuuccccuuaggccauuguaaauauguguauggguguaacucugcuauaguaucuauucugguuucuccuuuggucugaaacuuccuucuuccuaagugaugguaaauuccuguguaagggagugacuuagcuuuuacaaucuugcugaauuuuaaacccuugaucuuggucaaggaugcccuuggacuguuggaacacuggcggaaggcuuuacccaugucagagcacuuauaggaaaauacugaaagagagcacguggauccauacucuagacuagcgugguacugaaacucgggaauaaaaaauuaauguauggguagagaacacuagccuccaggaggagagcuuccuugaaacucuuuugccucaugagugacuuuuaagccuuucggcuuguccaguugacucgaccagagagcguagcaaauaaccccauuaaaaaaugggguacagagcuaaacaaagaauucucaacugaguaauacggaauggcugagaagcaccugaaaaaaauguucaacuuccuuaaucaucaaggaaaugcaaaucaaaacaacccugagauucuacuucacaccagucagaauggcuaagaucaaaaauucaggugacagcagaugcuggcaaggauguggagaaagaggaacacucccccauugcuagugagauugcaagcugguacaaccacuuuugaaaucagucugacgguuccucagaaaauuggacauaguacuacuggaggauccagcaauaccacuccugggcauauacccagaagauguuccaacugguaauaaagacacaugcuccacuauguucauaacagccuuauuuauaauagccagaagccguaaagaacccagaugucccuuaacagaggaauggauacagaaaaugugguacauuuacacaauggaguacugcucagcuauuaaaaacaaugaauuuaugaaauucuuaggcaaaaggauguaucuggaggauaucauccugagugagguaacccaaucacaaaagaagucacuugauaugcacucacugauaaguggauauuagcccagaaacuuagaauacccaauaauaauaaugucuaaccuuaacugaggacuaguaguagaaacaucuggagcuucaaacuacuucaaaaguagccaugcaaaucaaacaucuucuaaucauggaucacauggaaauucacuucuuuuaaaugcuucuuugacauauauaagucugucagccauuaaauauaaaacaaauuagcauuuuaauuaaauggauuccauauuuuucauauggaauuuaaauaugaaugaauauuugauaaugcaggacacaggacauuuugauguuuuucauauuuguugaauauuuugguuuucugguuccccauacugagaacagugcuccacacaaauacauaguauccaaaugcagagauacauuuaaagcugguccaggcacuagugggaguucugucucaauagaaagccagaacucaacacuucuuuuuuuuuuuuuacuuuuuuuauuaauuuauuuauuuuuacacuccauauuuuacucccccuacccccaguccacgcucagacuauucuacaucccauaccuccuccccacccaccuaucucuguguggauguccccaccccccaccccaccugaccucuaaacacucuggggcuuccagucucuuaaggguuaggugcaucaucucugaaugaacacagaccuggcaguccucuacuguauguguguugggagccucauaucaacugguguaugcugccuuguugguguuccaguaucugagagaucucggggguucagguuaauugagacugcugguccucccacaggauugcccuucuccucagcuucuuucagccuucccuaauucaacaacaggggucagcugcuucuguucauugguugggugcaaauaucugcaucugacucuuucagcugugugucugugugugugugugugucugugugugugugugugugugugugugugugugugucugugugugugugugucugugugugugugugucugugugugugugucugugugucuucaugaaucuaaagagcuccugggcugguacagcaagcaagugcaggaaacccaccggaagcaaagugaauuaggcuaauuaccucuacaagacaguuauucaaugcccuucucuuucucugaaguauacguucuagacagauuauacaauuguaugugcagcucugcauucacagccccucagccagugcuugacacagaaucauagcugauuuuuauaucuguugaaugagugaaugaaugaaugguacaauaauaagaaauguuuuuaaggaaaaaccuucuauuuuuuuguuugauuguauuuuaccacugacuagcuguuuucccacggucucacaaguuggauuuacuaccuugcaacccaugccuagucuuugcuaucucugcacuggauauggagcauuaaaaggcagaagugcugcagagguucucugaauauugguaaaggugucagcagauuucaacaguguagcugaaggagacagcaaauggguccaggagaaguuaaucugcuaaaggacagcaggaccagggaagggcuggcuccaaaggggcugcucugugauggcggcucccaucacuggucacauuuccagugucuacagaagauaucaagaaagaccgauccuugacaucgagugagaauaagagcuagacccacaggggccugugaggaacaccugaaaggguucagggaccuuggggugagugcuaaaaugugucccaagcagagagcuguaucuugaaagcucacuaaaagguuugcauuuguugguacuguaauuugaaagcauuuccuaaaauguauguguugacagcuugagacacagguucuuuaagagggaacugaaacaagggagcaaaugccuuuauagagaggcaggcaucugauaacaggagaguuuggucacuauggcgauuaagaguagagagaagaggugaagaaaauguguguccuuuuucaggucucagguguccuucuggacugucuguaucaccaagcagguuucuuaucugcagagucccagcuucuguuuugcauagcuggagguucccagagaugaaagucuaauacagcacaugcaggaacuauggaugcuccuaugacacagagaagaagggaacuuccccaggauuaaaugacagcuuagaacagaggcaaacuugguucuauccccagcacugguuccccagugcucugccgaugauguagaaugaaugagugagugaaugaacuucagacccauacaucauauuuuguccaguccaagccuuguucuauggcccuugccaucugauagccuccuuuccaaccuccaggucauccacuggaacucccccaagaagcuccgugugaagaacaaacauguggaauucuuccgcaaccucuaccugaccuucuuggaguaugauggcaaccuccugcggcgggagcuguuuggcugccccagugagacugaugucaacaaugaaaaugugaguguuccacagaucaucagggagauuggccauacucuuauuugucuguguuggguccuuguuggguacuacauccagcucagggaacaacuuagcugccauggaauccaugacccaguacaucauuuggagacuuccuguggaucacuguugauaugggaggagauauuagcucagcugaauagauaagcaugaguuuacaaacaaaagaaacuauccguuaucuaugucugcuucauggccaguaaacucccaagcauguagugguaaaggcauccacauagaacucaugauuaaucuugguugguaccuagggugacacagaaggagacucccacagggacuggcaucuucccaguuaguuuggacaaggaaaacauugagugaauaguuugaagcuauuggguguuuugguuguuacuguuuuauccaguuuuucuuuucaauauguuauagcuuauguuuauucauugggucacuuuauuauggaaaauguugaaguagagaaauuaagcaaguugcucauguuuacacaacaaacaaggaggacagcugugaccaacucuuaagaaaaggagcaugguagccauaggcagcagggacauagaaucaagcugaccugagucugacucuaacuauuaguuuuguugacacaaaaauccacaagucucaucuuaaagagaauaaaagauaguuuauuccagaggcccagaaacacagauuauguuaccucaaauucaauguuccaauguagaaguacuuucauuaaguuuauaaaauuucagaauuaggaaaaucauaaaucaaggugaguuuaaaauguguugguggguuuaucagagaagcagguauagcaagaugggggaagcuuuucucuaggcugaagaugcucucugaacauuuugguugauggaaucuaguuaauggucugcuaaaagaauagauucuaaaaagcuuuaagucuauuagucacaauauguuaguucacagagaugaacaaggaaugucuuuccuagagaacuagaacuagccuaaaauaagguaauuagccucaggggcauguaauauuuuaguaucucuacaguccuaaaacucucaucagccaaucagucccugcaaacacagcuucuuuccuagaauuuuuguucagacuuucuuguuacuucuguuucuauugguuuuggagagacauugaccucuuauuaaagaaaacauuucacuggaucuggcuuacauuuugugaguuuuaguucacuauugucauggcaggaaacauggcaauauguaguacauaucaguacaaucaguaguacauaucaugugaguucuuuugugauuuggguuaccucacucaggauguuacccuccagaugcauccauuugccuaagaauuucaugaauucauuguuuuuaauagcugaguaguacuccauuguguaaauguaccacauuuccuguauccauuccucuguugagggacaucuggguucuuuccagcuuauggcuauuauaaauaaggcugcuaugaacauaguagagcauguguccuuauuauauguuggagcaucuucuggguaaagaucuuuccccauucuguggguugccauuuuguccuauugacaguguccuuuggcuuacagaaguuuugcaauuuuaugagguccccuuugucgauucuugaucuuagagcuuaagccauugguguucuggucaugaaauuuuccucugugcccauauguucaaaguucuuccccuacuuucuccucuguaaguuucaguguaucugguuuuauguggagguccuugauccacuuggacuugagcuuuguucauggagauaagaaugugucgauuugcauuuuucuacaugcugaccaccaguugaaucagcacaauuuguuaaaacugcugucuuuuuugcacugauucuuuuaagccccuuugucgaauaucaagucaucauaucugugaggguucauuucugggucuucaauucuauuucauugauuuaccauccugucucuguaccaguaccaggcaguuuuuaucacuacugcucuguaauacagcuugaggacagggauggugauucccccagaaguucuuuuauuguugagaagaguuuucaccaucuuuaguuuuuuguuguuccaaaugaauuugcaaauugauuuuucuaacuccaugaagaauugauuuagaauuuugauggggauugcacugaaucuguagauugccuuucacaggauagccauuuuugcuauauucugccaaucuaagagcaugugagaucuuucuaucuucugaggucuucuuugauuucuuucuucagagacuugaguucuuagcauacagaucuuuuacuugcuugguuagagucacaccaagguauguaauaaaauuugugacuauugugaauggugucauuucucuaauuucuuucuuagccuguuuauccuuugaguagaaaaaggcuacugauuuguuugaguuaauuuuauauacagccacuuugcugaaguugucuaucagcuuuaggaguucucugguggaauuuuuguggucacguaaguauacaaucauaucugcaaauggugauauuuugacuucuuccuuuccaauuuauauuccuuugacuuucuucuguugucuaauugcucuagcuggaacuucaaguacuauauugaauagauagccuugucuagucucuaauuuuaaugggauugcaucaaguuucucuccauuuaguuugauguuggcuacugauuugcuguauauugcuuuuacuauguuuaguauaggucuugaauuccugaucuuuccaagacuuuuaacaggaaucgaaugaaaugaucauguuguuuuuuucuuugaguugguuuuuguaguggauuauguugguggauuuucguauauugaaccaucaucauucaucccugggaugaagcauacuuguucgugguggucguuuuguuuguuuguuuguuuguuuguuugguguguguguguguucuuggauucgguuggcaagaauuuuacuguguauuuuugcaucaauguucauaagggagauuggucugaaguucucuuucuuguuuggucuuugugugguuuagguuucagcuuaauuguggcuucauagauuaaauuggguagaguuccuucuguuucuaucuuaugaaauacuuugaaaaguauugguauuaggucuucuuuaaaggucugauagaauuuuccacuaaacccaucugguccuguaguuaccuugguugggagacuauuaaugacuguuucuauuucuuuagggguaaugagacuguuuagauuguuuaucugauccuguuguaacuuuggcaccugauaggugucuagaaaauuguccauuucauccauauuuuccaauuuaguugaguauaaacuuuuguaguaggaucugaugauuguuuggauuucuuuguuuucuguuaugucucccuuuucauuucugauuuuauuaauuuggauacgucucugugcccucuguguagucuggcuaagaguuuguuuaucuuguugauuuucucaaagaaccagcuccugcuuuuguugauucuuuguacaguucuuuuuguuucuguuugguugauuucagcccugauuuugauuauuuccugcugucuacucuucuuggguguauuugcuucuuuuuguucuagagcuuccauguguacuguuaagcugcuaggauaagcucucuccaguuccuuuuuggaggcucuuagaacuauaaauuuuccucuuaccagugcuuucacugggccccauaaguuuugauaugaugugucuucauuuucauuaaauucuaaaaagucuuuaauuucucucuuuauuucuuccuugaccaaguuaucauugaguagggcauuguucaucuuccaaguguuuuuguguuuuccauuguuuuuguuggaauuuaagaccagccuuaguccguggugaucugauaggaugcauggugauuauuucaaucuucuuguaccuguuuucuggccaauuauguggucaguuuuggaaaaaguacccuuggguucugaagacaaaguauauuauuuugcuuuuggaugaaauguucuauaaauaaucuguuagauccauuuaguucauaacuucugugaguuucacugugucucuguuuacuuucuuuuuccaugaucuguccauugaugagagugggguguuaaacucucccaguauuauuguguggggugcaaugugugcuuugagcuuuaguaaaguuucuuuuaugaaugugcccuugcauuuggagcauagauguucagaauugagaguucaucuugguagauuuuuuuccuuugaugaguaugaaguguccuuccuuaucuuguuugauagcauuugguugaaagucgauuuuuuucauuauauuagaauggcuacuccaguuuauuucuugggaccauuugcuugaaaaauuguauuccaaccuuuuacucugauguagugucugucuuugucacugagguguguuucuaguaugcagcaaaauccugcagccuguuuaaguauccagucaauuauucugucuuuuuauuggagaauuuaguccauugguguuaagggauauuaaagaaaagugauugucacucccugcuauucuuguuauuguuguuguuguuguuguuguuguuguuguuagagguugcauuauguuuguguagcuaucauuuuuuggauuuguugaaagauuacguucuugcuuuuucuaggguguaguuucccuccuuguguugguguuuuccaucuacuuaccuuuguacggcuggauuuguguaaagauauuguguaaaauugguuuuguuucggaauaucuuguuuucucugucuauuguaauugagaguuuugcuggguauaauagucugggcuggcacuuauguucucuuagggucuauaugacaucugcccaggaucaucugucuuucauagucucuaguggcaagucugguguaauucugauaggucugucuuuauauguuacuugacuuuuuucuuuuacugcuuuuaauauucuuuauuuaauauauuugauguuuugauuacuaugugaugggagaaauuucuuuucugguccagucuauuuggaguucuguaggcuucuuguauguucauugccaucucuuucuuuagguuagggaagcuuuauucuauaauuuuguugaagauauuuacugguccuuuaagaugggaaucuuuacucucuucaauaccuacuaucuuuagguuugaucuucucauuguguccuugauuuccuggauguuuuggguuaggagcuuuuugcauuuugcauuuucuuugacucuugugucaauguuuucuaagauaucuucugccccugauagucucgcuuuuaucucuuguauucucuuggugaugcuugcaucuaugacuccugaucucuuuccuagguuuucuaacuccagaguuaucucccuuugugauuucuuuuuuguuucuauuucuauuuuuagaucuuggaugguuuuauucauuuccuuugccuuuugauuguguuuuccuauaauucuuuaagggauuuuuguguuuccccuuuaaggacuucuaccuguuuaccuguguucuccuauauuucuuuaagggaauuauuuauguccuucuuaaaguccucuaucaucuucaugagaaauuacuuuagcccugaauuuugcuuuucugaugugaugguguauccaggacuugcuaugguggaagaguuggguucugauggugucaaauaaccuugguuucuuuugcuucuauucuuaugcuugccuccugccaucuaauuaucucuagugcucccugcccucauuauaucugacuggauauaaguccuguaagcccaguugagucagaacucuucagaguccagcugucucugugugauucugggauccugggauccugagauucuugguaugucagaguuccugggagucaagcugccugugagacccugagauccuggugugaacaaguuucugggauccuaagauccuggucauguuaaagcaccuaggaguggagccuccucugcagacuguggaacuagccacugccuaguuugugcccaagguagacucacgcagaccagaaggaaccagagccacugguuggaugaggucccuacaucccuggauccugcuagucccaguuacucccuguaguguuggaacagauguuguguucuacucaccacugauccuacgauccugggcaugcuagagcuccugggaguggagccuccuccuagacuagacucuucauuaggucaguaggaaauggaaauagaacuaaagaugcuuuucuacuaaugaggacagacuuucagagaguuggaaaagguaagagaaagagguuguccugacuaauuuuauguuagaaaaagaaaagaaaagaacuuugugcuauuaaugcauuuacuugguucuucuuuucauaccugacccaaagguugaaauauguagcuccaggaagauacucagaagcccuucccguuuggaauuucuugaucuacacauaucuucguuguguuaauuaacaccaaaccaucugacuguuuuacccaggaaaacgcuguguuuuguuuguaaggauuugcauggcucugcauugucagcuagcaucacuugugugucucuuggccacaaggaggcucaucucccauauggggaaaacucaagccucugugaccaccucuuggaguuagaguaaauugugaggaaauaaaauggaaguccuuucuguugaaccaccagcaagggaacaagacuauaacaggcaggcuucuggccccuuuggagccuugcuuccuauucccaagccuuuuucuuccuuugcagcuucagaagcagcugucugagcuggaugaggaugacuugugcuaugaguuccggcgagagcgcuucacuguccacagaacccaccuguacuuccugcacuacgaguuugagccuucugcugacaacacagacguuacccuuguugcucagcucuccauggacagguauggcaaaugaccuuacccaccacaugguccucauaacuaauacucuuuaccccauggaacagcagaggauaagagauggucuucuaguacacuugagguugaucucagucucaucuccagugcugcacagcagaggcauccucuuuuaguugcugguguugcuugaugguuggcucauuaugaguaaaacucuacagaaaaggcugcacacuggagccucuuagucacuguucuguugcugugaagagauaccacaaucaaggcaacuauuuuaaaagaaagcauuuaauuggagguuugcuuacaguuucagaggaucuaugaucacccuguuaggaagcauggugacaggaauguaggcaugagacagagcuuacaucuugaucugcaggaaggaagguagaacaagagaggcacugggcuaggcaugggguuuugaaaccucaacucccuacucccacccuaccuacuuacaacacacuucguucaaaaaggccguacuuacucuaacauggacacauccccuaaucguuuucaaacagugccacucucugaugucugagcacucaaauauaugacccuauagguacugccauucuuacucaaaccaccacaguggccauaguaaaacaaugaccauuucuucuucucacauguguucugauguaacgguccuucauggauguuucccaguggcacugcuauuaggcuugccuuuucuuaauuacugucugguagguugacucucaauaugaaaagagacaaauugagucacaguggggagguuuugaaauaaauucauacucaggcuccauagcaaacuagccaagacagaaucuuugucuugacauuguuuuaagcuugcaguguguaacccaggauugaaaauguagaccuccauggacaauuuaauaaaauuauaacugcaacaaaggcugugaagggacugggagagaugauaccagucaggucaggaauugucuguagauaaugucauugcgggaagucuuucugagaaggggacauuaucuguagagaccuagaaggaaaggaagaacuauguucauagcagccuuauuuauaauagccagaagcuggaaagaaccuagaugccccucaacagaggaauggauacagaaaaugugguacaucuacacaauggaguacuacucagcuauuaaaaagaaugaauuuaugaaauuccuagccaaauggauggaccuggagggcaucauccugagugagguaacacauucacaaagaaacucacacaauauguauucacugauaaguggauauuagccccaaaccuaggauacccaagauauaagauauaauuugcuaaacacaugaaacucaagaagaaugaagacugaaguguggacacuaugccccuccuuagauuugggaacaaaacacccagggaaggaguuacagagacaaaguuuggagcugagaugaaaggauggaccauguagagacugccauauccagggauccaucccauaaucagcauccaaacgcugacaccauugcauacacuagcaagauuuuauugaaaggacccagauguagcuguuuauugugagaccaugccggggccuagcaaacacagaaguggaugcucacagucagcuaauggauggaucauagggcucccaauggaggagcuagagaaaguagccaaggagcuaaagggauuugcaacccuauagguggaacaacauuaugaacuaaccaguaccccggagcucuugacucuagcugcauauauaucaaaagauggccuagucggccaucacuggaaagagaggcccauuggacuugcaaacuuuauaugccccaguacaggggaacaccagggccaaaaagggggaguggguggacaggggaguggggguggguggcuaugggggacuuuugguauagcauuggaaauguaaaugaguuaaauaccuaauaaaaaauggaaaaaaaaaaaaaaaaaaagaaggaaaggaagaaagccaggcauaacaguuucuaagguuuuuccagacagauaaacuaguuagcaccaagggcccauggugggaagcaugaucuguauauuuccagaaccugacuugaguaaagccacacaauuuuuguugagugaaguucccagagaggccaaaagaagguguuggaucuccuggagcugaguuaagaauaguugugagcugccugauaugggcacugggaaccauauacucagguccuugaaagaaugguacauagucuuaauugcugagccaucuaucucuccaucucuuuuuuauaauuuugcaagccucacuggcuccagaaagcgaguggauuugaagcuugaaggccacuucccagagcuaagcagcuuuccucuaccuacguuacacagcugacucccauacuggcugagcagcuuccuguuuaaguuacacgagcccccacauuggcugcccuuacacaguauccauuaggccaugcuguaucauuucaacaggacguuuuauugauugucuaucaagcuaccggacaugccugucuguucucuggaugaagaugccuugggauugcucuaagaaugaaaugaauccaugcacaaagagcaggagcaggaaugcaaucaguguuccguaaagaccacuguuauuagucaggggugaaugaagaaugcaaaaccuggaggagcaagaccccagacauacagaagcucacagaguacuauccaaggaagcccaggaugagugggaauuugcaugccauggcugucugggaauuacccuuauugaguguaacuaguggauugagugccuuucuuaaaauaagguugagagaaagcuuaagcaauucacucaaauuuaccucugacuuacacacaugcacacacacacacacacacacacacacacacgacuaguauaguuaugcacaagaugugacccuuggaggcagacucuguguguuaucagugacucugacuuucuugaguuugacuuuuuuagacaaguaaucuugccucccuaagccccaguuuccuuaucaguuaccugggaacaauuauauuauuauuguaauuaucccuaagguuauaauaaucaugagaguacacaggcccaguacauacugauguauauacaaaaaucuuaugaaauaguacgaacaugagugaccagaauucuaauguauaugcuguguugugcagaaggcacuaggccuaaggacaaagagcuuaacuucaaaucucaccugcuccuuuuccagcugaugauuuuggcauuucauucaaaaucuuaaauuucuggauuuuuuccuauuaaauagggcuaaaauaaugguuaggguuaaaugagagaaccugcagaagcccuuguaacauauuugccauccagaaaccauuggcuagaucugaauacacugcuggaaacguauggcugugcguuugcuuuucugcugcugugauaaaacauucugaucaaaagcaauuuggggagggaaagauuuauuuugcuuuguuuccaggucauagcucaucauugaagaaaauuguggaaacuuaaaagcagaaaccaugaauaaauacugcuuuuuuuuuuuugcucacugucuuacaggcucacacucaucuuuauuauauagcccaggaacuccugucuagggauagugccacucacagucggcugggccaucuuacaucaaucacuagccaaguaucauaucucagagacaugaccgcauaccuaucugaucuaggcaauuccucauuugagaaucccuuaaaugacucuccauugugucaaguugacagcugaagcuaacuaggacaggaugguaggcauuuagagacaauaaugaggggaaagcaaaccuauacuaggcccacuguaccacugccuagauuuguggauuugagucaaguacuugccucuuuucaaccucacugugugaaguagugaugauacuguaaagucagcuucauugauuguuguuuggauuuuauaucauaagaggauguaaagugcugaaaauguaacuauauaagcaaauauuagcuaccuuuuccuggguguguucacauccauauugccuaggauuuacaaacugauaguaggggaauguguuggguuuacagugcagauucauguuuuuguucacaccuguuaccaauaguaauauugaccaagcaaagcuccugcacccacugacaacaggaguaucaccuuggccaggucuuagugaccagucaguuccuucccucacagccccuuacagaaagcuccagcuacacuugcauuaggagcaaauauugaucacagagcccuucccuucaaaugcacacaucacaaacuuaggauauacagggugaccucuaauucauggugacaaauacuacuacccagacaacacuccauaguaugcacagcaaauggacugugccaccaaacagacaaucugguaagguugaagcagguucaaaacccugguuaaucucauaauugagaaugguaggaauagaacuagcuuccaacaagucuguaccuguccuggaacgcaggaccacaacaccccaguaggaggaccaugacaacuagucacauggggacaacaucugaaguucuuuccuaugcaaauaaaacaacccuaacaucucagacugagccaauggaaagcaccuaccccuauaucccaccuuaccccccaaauguuuauaagguccccaucuacaaggaauaaaguguacaaguuauuucaccaagaaucaucugaggaugccugucuuauugagcuauaaaacuccagggaaaauguuucucuccugaagcauuuaucacuggaccuaggcuccaccuagcagacuggguuauuguuugcagucacaucuugccuauuaacucuagcuccugcuucuggcugccucuaugucucugcuacugcugccuuuagugcaggggcugugaugguagcagaagaggucuggccacuugcccugcccuagcuuccccucagaaagcuguaacacuuuugccaggccaggccagagccccaccugggcuagggauccuugaauugcauuuugucucagaacagcccaccugcuguguuccaucaugcuggcugguagcaaguggccuaaucuaacugaaaccagaggacauaagaaguuguaaaauuccaugagagaagcauguagugaaaagcaauaaaaauuauaaugcagcacuaaagccaaugcagaaguuuucccaaccauuucuacuccacccuguccaucuaguuaaaacacaguauacugaauggugucuccuggguugguuuuuaauuuaagaaauauuucaguaugcuuauaaaccuuugauucagagguagguucuaugugaauggcacagugaauuaggggagcuaaccaacagaccugguaacucuaccuccagaauuacaauuagaaagugugucacuagccaccaauguggaaugggcagcuuuuucugcccuuuaggauccuggcagaggauaggaauggauagagagggcuaaacaaaacggcaguuugcuuucuauugcugugauaggcacugugaccaaaggccacuggcagaaaugaaaggagucgggggauugauuucccuaccacgaucaaucacugaagaaauucagggcagaaccagaagcaaagagcauggaggaacacuuuuuacuggcuuccuucacauggcuuacucagcuuucuuucuuacacaacccaggaccaucugcccuggaguggcaccuuccacagcaagcaauucucuccauaucaaucauuaaucaagcaagugcccccacagacuugccuacaggcuuuauacaccagaaacuuuugauaucuuugagauagaaucuucaugauugacugccaaaccuucuugccgccucauuccugcuggagaaaccuuuuuguucuuucucuggauuuuguuccaugccuucaucuccucagcucuuugcaguaucccugcaaaacuguuuuguguuuuuguuucuguuuugucuguuuuaauuuauuuuguuguuguuguuguuauugcugcugaugcuguugugguuuuuuguuuuuugagggagcccaugcuauaucaaggaggucacuauguagcccagacuagccauacaacaguucucuugcccugaacagagggcaugcuuagccaucaggcccaacucugccuugcaaagauggucagaauguccuggagcaggaaaugcugaaaauugaagaugguuccacccacaguaucccauauaccauuuaguuuuuauugucuuuauguuuuuuucuguaucuuuugcaaaacacuaauuuuguucuuuucucaccaacuuuaaggcaccugucuaucaauauugaaucaaaaauuucauaaaucaaacuagagcugcaauuucuucaacaggaaguugcauaggagugcugugagaauucuggaaggugguuggcauaccagauuuuugucaauaauuguaguuauuuaucauuuagugcuuguuugaauguuccuugggaccaagcuucuggagguggugagugcuuuaggagacugguaauuguuuuaaaggcuuugcugagagaaaacaggaguuugggcuggaaaaguucagcccuuagucuauagucacacacauacucagcccaccucuuuuacaauauuuauucuguugcuguggcaaaauaucugaaccuaaguacuuauaaagaaaagaaauauauuuacuucacagugcuacaagcuauaacucaaaccauaacaagcaauucagacucuggugaacgaaauauuugcugauaggaacagaaaugcuugugaauguugggagccaaagggugccuuggcugccaaaacgugacaaugaagccaaaaaagaaacagcuacauacagaaaaggaaucaagaaaacccuucuuccgggcuggggaggcggccuaagccacagcagcagcggucgccaucuugguccgggacccgccgaacuuaggaaauuagucugaacaggugagagggugcgccagagaaccugacagccucuggaacaggcagaagcacagaggggcugaggcagcacccugugugggccggggacagccggccaccuuccggaccggaggacaggugcccgcccggcuggggaggcgaccuaagccacagcagcagcggucgccaucuugguccgggacccgccgaacuuaggaaauuagucugaacaggugagagggugcgccagagaaccugacagcuucuggaacaggcggaagcacagaggcgcugaggcagcacccuuugugggccggggacagccagccaccguccggaccggaggacaggugcccgcccggcuggggaggcggccuaagccacagcagcagcggucgccaucuugguccgagacccgccgaacuuaggaaauuagucugaacaggugagagggugcgccagagaaccugacagcuucuggaacaggcagaagcacagaggcgcugaggcagcacccugugugggccggggacagccggccaccuuccggaccggaggacaggugcccacccggcuggggaggcggccuaagccacagcagcagcggucgccaucuuggucccgggacuccaaggaacuuaggaauuuagucugcuuaggugagagucuguaccaccugggaacugccaaagcaacacacugucugagaaagguccuguuuugggccuucuucuucggccaggaggagguccaaauacaagauaucugcgcaccuucccuguaagagagcuugccagcagagagugcucugagcacugaaacucagaggagagaaucugucucccaggucugcugauagacgguaacagaaucaccagaagaacaaucucuaaacagagucaacuauaacuacuaacuccagagauuaccagauggcgaaagguaaacggaggaaucuuacuaacaggaaccaagaccacucaccaucaccagaacccagcacacccacuucgcccaguccagggaaccccaacacaccugagaaccuagaccuagauuuaaaagcauaucucaugaugaugguagaggacaucaagaaggacuuuaauaaaucacuuaaagaaauacaggagaacacugcuaaagaguuacaaguccuuaaagaaaaacaggaaaacacaaucaaacagguagaaguccuuacagaaaaagaggaaaaaacauacaaacaggugauggaaaugaacaaaaccauacuagaccuaaaaagggaaguagacacaauaaagaaaacucaaagcgaggcaacacuagagauagaaacccuaggaaagaaaucuggaaccauagauuugagcaucagcaacagaauacaagagauggaagagagaaucucaggugcagaagauuccauagagaacaucggcacaacaaucaaagaaaauggaaaaugcaaaaagauccuaacucaaaauauccaggaaauccaggacacaauaagaagaccaaacguacggauaauaggaguggaugagaaugaagauuuucaacucaaagguccagcaaacaucuucaacaaaauuauugaagaaaacuucccaaaucuaaagaaugagaugcauaugaacauacaagaagccuacagaacuccaaauagacuggaccagaaaagaaauuccucccgacacauaauaaucagaacaucaaaugcacuaaauaaagauagaauacuaaaagcaguaagggaaaaaggucaaguaacauauaaaggcaagccuaucagaauuacaccagauuuuucaccagagacuaugaaagccagaagagccuggacagauguuauacagacacuaagagaacacaaacugcagcccaggcuacuauacccagccaaacucucaauuaucauugagggagaaaccaaaguauuccacgacaaaaccaaauucacgcauuaucucuccacgaauccagcccuucaaaggauaauaacagaaaaaaaccaauacaagaacgggaacaacgcccuagaaaaaacaagaagguaaucccucaacaaaccuaaaagaagacagccacaagaacagaaugccaccuuuaacaacuaaaauaacaggaagcaacaauuacuuuuccuuaauaucucuuaacaucaauggucucaacucgccaauaaaaagacauagacuaacaaacuggcuacacaaacaagacccaacauuuugcugcuuacaggaaacucaucucagagaaaaagauagacacuaccucagaaugaaaggcuggaaaacaauuuuccaagcaaaugguaugaagaaacaagcaggaguagccauccuaauaucugauaagauugacuuccaacccaaagucaucaaaaaagacaaggagggacacuucauucucaucaaagguaaaauccuccaagaggaacucucaauucugaauaucuaugcuccaaauacaagagcagccacauucacuaaagaaacuuuaguaaagcucaaagcacacauugcgccucacacaauaauagugggagacuucaacacaccacuuucaccaauggacagaucauggaaacagaaacuaaacagggacacacugaaacuaacagaagugaugaaacaaauggaucugacagauaucuacagaacauuuuauccuaaaacaaaaggauauaccuucuucucagcaccucaugguaccuucuccaaaauugaccacauaauaggucacaaaucaggccucaacagauucaaaaauauugaaauugucccauguauccuaucagaucaccaugcacuaaggcugaucuucaauaacaaaauaaauaacagaaagccaacauucacauggaaacugaacaacacucuucucaaugauaccuuggucaaggaaggaauaaagaaagaaauuaaagacuuuuuagaguuuaaugaaaaugaagccacaacguacccaaaccuuugggacacaaugaaagcauuucuaagagggaaacucauagcuaugagugccuucaagaaaaaacgggagagagcacauacuagcagcuugacaacacaucuaaaagcucuagaaaaaaaggaagcaaauucacccaagaggaguagacggcaggaaauaaucaaacucaggggugaaaucaaccaaguggaaacaagaagaacuauucaaagaauuaaccaaacgaggaguugguucuuugagaaaaucaacaagauagauaaacccuuagcuagacucacuaaagggcacagggacaaaauccuaauuaacaaaaucagaaaugaaaagggagacauaacaacagauccugaagaaauccaaaacaccaucagauccuucuacaaaaggcuauacucaacaaaacuggaaaaccuggacgaaauggacaaauuucuggacagauaccagguaccaaaguugaaucaggaucaaguugaccuucuaaacagucccauauccccuaaagaaauagaagcaguuauuaauagucucccagccaaaaaaagcccaggaccagacggguuuagugcagaguucuaucagaccuucaaagaagaucuaacuccaguucugcacaaacuuuuucacaagauagaaguagaagguauucuacccaacucauuuuaugaagccacuauuacucugauaccuaaaccacagaaagauccaacaaagauagagaacuucagaccaauuucucuuaugaacaucgaugcaaaaauucuuaauaaaauucucgcuaaccgaauccaagaacacauuaaagcaaucauccauccugaccaaguagguuuuauuccagggaugcagggaugguuuaauauacgaaaauccaucaauguaauccauuauauaaacaaacucaaagacaaaaaccacaugaucaucucguuagaugcagaaaaagcauuugacaagauccaacacccauucaugauaaaaguucuggaaagaucaggaauucaaggccaauaccuaaacaugauaaaagcaaucuacagcaaaccaguagccaacaucaaaguaaauggagagaagcuggaagcaaucccacuaaaaucagggacuagacaaggcugcccacuuucucccuaccuuuucaacauaguacuugaaguauuagccagagcaauucgacaacaaaaggagaucaaggggauacaaauuggaaaagaggaagucaaaauaucacuuuuugcagaugauaugauaguauauauaagugacccuaaaaauuccaacagagaacuccuaaaccugauaaacagcuucggugaaguagcuggauauaaaauuaacucaaacaagucaauggccuuucucuacacaaagaauaaacaggcugagaaagaaauuagggaaacaacacccuucucaauagccacaaauaauauaaaauaucucggcgugacucuaacgaaggaagugaaagaucuguaugauaaaaacuucaaaucucugaagaaagaaauuaaagaagaucucagaagauggaaagaucucccaugcucauggauuggcaggaccaacauuguaaaaauggcuaucuugccaaaagcaaucuacagauucaaugcaauccccauuaaaauuccaacucaauucuucaacgaauuagaaggagcaauuugcaaauucaucuggaauaacaaaaaaccgaggauagcaaaaacucuucucaaggauaaaagaaccucugguggaaucaccaugccugaccuaaagcuuuacuacagagcaauugugauaaaaacugcaugguacugguauagagacagacaaguggaccaauggaauagaauugaagacccagaaaugaacccacacaccuauggucacuugaucuucgacaagggagccaaaaccauccaguggaagaaagacagcauuuucaacaauuggugcuggcacaacugguuguuaucauguagaagaaugcgaaucgauccauacuuaucuccuuguacuaaggucaaaucuaaguggaucaaggaacuucacauaaaaccagagacacugaaacuuauagaggagaaaguggggaaaagccuugaagauaugggcacaggggaaaaauuccugaacagaacagcaauggcuugugcuguaagaucgagaauugacaaaugggaccuaaugaaacuccaaaguuucugcaaggcaaaagacacugucuauaagacaaaaagaccaccaacagacugggaaaggaucuuuaccuauccuaaaucagauaggggacuaauauccaacauauauaaagaacucaagaagguggaccucagaaaaucaaauaacccccuuaaaaaauggggcucagaacugaacaaagaauucucaccugaggaauaccgaauggcagagaagcaccugaaaaaauguucaacauccuuaaucaucagggaaaugcaaaucaaaacaacccugagauuccaccucacaccagugagaauggcuaagaucaaaaauucaggugacagcagaugcuggcgaggauguggagaaagaggaacacuccuccauuguuggugggauugcaggcuuguacaaccacucuggaaaucagucuggcgguuccucagaaaauuggacauaguacuaccggaggauccagcaauaccucuccugggcauauauccagaagaagccccaacugguaagaaggacacaugcuccacuauguucauagcagccuuauuuauaauagccagaaacuggaaagaacccagaugccccucaacagaggaauggauacagaaaaugugguacaucuacacaauggaguacuacucagcuauuaaaaagaaugaauuuaugaaauuccuagccaaauggauggaccuggagagcaucauccugagugagguaacacaaucacaaaggaacucacacaauauguacucacugauaaguggauacuagcccaaaaccuaggauacccacgauauaagauacaauuuccuaaacacaugaaacucaagaaaaaugaagacugaaguguggacacuaugccccuccuuagaagugggaacaaaacacccauggaaggaguuacagaaacaaaguauggagcugagaugaaaggauggaccauguagagacugccauauccagggauccaccccauaaucagcuuccaaaugcugacaccauugcauacacuagcaagauuuuacugaaaggacccagauguagcugucucuugugagacuaugccggggccuagcaaacacagaaguggaugcucacagucagcuaauggauggaucacagggcucccaauggaggagcuagagaaaguacccaaggagcuaaaggaaucuucaacccuauagguggaacaacauuaugaacuaaccaguaccccugaacucuugacucuagcugcauauguaucaaaagauggccuagucggccaucacuggaaagagaggcccauuggacacgcagacuuugugugccccgguacaggggaacgccagggccaaagggggggaguggguggguaggggaguggggguggguggguaagggggacuuuugguauagcauuggaaauguaaaugagcuaaauaccuaauaaaaaaaaaauaauaucaaaaaaaaaaaaaaaagaaaaaaaaaaagaaaacccuucuuccuccuccuccuuuuuuucuguuucuucuuuucuucuucuuccucuuccuccucuucucccuccuccuccugcuucuccuccuccuccuuuucuccccucuuuuucuuugggggagcugguuuucugagacauaguaucucucuguguuuuguucugguguucaaucuguagaccaggcuuugaacucccagagauccaccugcuucugccugcugccugcugggguuaaaggugugcucccuuauguccaucuucacaugucucuucaaugaaagucacuggauuuacacaaggcaagaucucuggugagacaggaagccaagggugucacuuucuuuuuuuaguaguccacacuggucggaaucaacugagaucccaugagauauacgcccaccccuucuagguaaggauagcaacccaaauaaaugauugagcuacucuccccucagucccauuucuuaaagaucucagcaauaccacacuguagaccuggcuucuaucacaugaacccuugggguaacacccagccaauccauaguaccuuugaggaugaaugugggacuuagaguaugugugacuguugaugucaugcagucaguugcaagcagagaaaaacuagaaucagcaagguacuuguucugugucugcuuuacugaugaggaacggagucauauuuaguuaagagaguugguuuuauagcugguugaugaagagauauuggagacaggggcuggaagaugucccuuucugaugcugcuuucuuccccucucuuccagacuacagaugcuggaggccaucuguaaacacugggagggacccaucagccuggcccucuaccugucagaugcagaagcccagcaguuccuccgcuaugcccagggauccgaggugcucaugagccggcagaacgugggcuaccacaucguguacaaggagggucaguucuauccugucaaucuucugcgaaacguggcuaugaagcacaucagcacacccuacauguucuuaucugacauugacuuccugccuauguaugggcucuaugaguaccucagguaaggaacccaggggaccuugcuguucuguccucucuucagacugguggccacacagguucaggaaaagcuggaaccucaaggcccucaggaccauugucuagucugccacuuaccuuuuauagguaggacaacuacaacccaaaaggggacagggaccuguccagugauggccacuaccuacaaguuuggaauguguguacuaagcucuauuaucccaugcacagacuagacccaauuuccauagugacauuauuugcucuugaaacaucucucuugcuuaaaauuucugccucuuuuccaacuuugcaguagacaggcuuccuaucaucauucucaaaagcccauugccuguuccuuaaaacaaaccuaaauaauagugaugcuuaacauguauugaagcacuuaagcauaugccagaaaaugauggacagguaagauuucauuuuguuuccuccucucacaaaccccugcuaugggcaacauugaugucuucauuauacaaacaagaaacugcagaacaagacugaaagaugcuggccuaucuuauauaacuagugugggaggaaguggggagucauaacacaggacacccaacuacagaacaccuaaccacagaaaacccaaccacagaaccauaggaauauccaguauccuucuccaccuuucuucacauagcagagcagaaagcaguacacuccuuuaagcccgggugguucaauuaauauaaauaguaugaauugaaauguauugcagaauucacaugacucaaaauuguacaugggagaaauauaaagucacaugguccaacaucaucaccaugguccuuuuccaauugucccuuaucagcauggauuuccccugugucuaagauagugccuuccaggauccacauaucccuaaagaugguucauauaucuugucuuuuuaggaugcacaaacuaagucucaaccgcuuguggggcugccuuaugcuacaccaugggccaguaaggcuuggagagacaaaaugacaggcuugaguccagacagaugacaaucauaggaguugaggagugucugacaggcuccuaccuugcccaacuacucugggguuucugaucccagacaggcuguauaugaacucccaagaucucuguccccaucuccgucccuguccccacccccacccccacccccacccccggucugucucucccucccuccacccucucucucuguagcaagagaggguauccuacacuuuguauucaaccucaauagagugucauuacaaaguguuguguaacauaguaugacaucauuuccuuccugguaaacacggaagauccucaucagcugucagagagccaaaggguaaguggccccaucagcaauauaagcuccaccauacaaguggguagaacugugacauaacacccugugaaugaguuccugacugccagacuccauucacugauuuuuuuccuccagguccagcuccaacuaggugacaauaucccagucuguagaacaagccccgcaccccccccccuccaauguggucagacuaaauccucagcucugcaucaucccucguagcuuggaaagcuuagcagucagcaagaugcuagccuacuuacuagaugaauaaguaagcaguuaggagcagccucaacuuagacugagaagagaggauuguacccuacccacccuucaccuucugugauuuuccucagaagcaccuaaggggucuucacugcaaagaauuuaaaguaaacaggccugacccuugccucagcugcccuugccuuaugggcagcauguuuuacauggcacacaaggaaauuguauuuauguuuccucuuuauguguuacugacuuaaaauugcugauggagaccauacucagugcuaagcaacauguaacacacgguaacaccacaaguuauuuugcuuaguucaaguucaccauaugaaucucaucagggauuuugaaauauugcagguuuccccucaaauugucuuuacagacccugucugaaaaguacuauuuaagagaguucauagaucugucuaaggaagcaccaucucuccagguguggagucauguugccguuguggcagaauugcaauuuauauuuuugcaaagaaucugaaucuuuauguauuuuaauguuuuaguauuauuaaauaauugggagcuggcgagauggcucagcaguuaaaagaacucauuguucuuacagaagacucagguacaguuccuuguaacacauggauguucacagagggcuggcacucucugaacaccaagcacaugugugauguacaugcauauauauagucagaacacucauagacauaaaauuaaaaucuugcuuaaaaaugaacaaauaauuuaaaaugaguuuuaaaugcuauggagucacacuauauccccaggcuagauuagccccccucucaccugcucaccauuugcaaccucugaccuaggauuguuucuagaugcuagaauuuugacaaccgguaauaauucaaucagcuggaugcauugagcuggaucccaagcucaagggggaagucccaaggccugacacuauuacugaagcuguggagcacucaccaugacugcucuccaaaagacccaacaagcagcugaaagggucagaugccgauauuugcacccaaccaauagacagaagcagccaaccccuguuauugaauuagagaaggcugaaagaagcugaggagaaggcugauccugugggaggaccagcagucucaauuaaccugaacccccgagaucucucagauacuggaacaccaaccaggcagcauacaccagcugauaugaggcccccaacacacauacaguagaggacuucugggucuauguucagucagagaugaugcaucuaacccucaagagacuggaggccccagggaguuuagaggucaggcaggguugggguuggggucauccauguggagacagggugggguggggaggagaugucagauguggagcagacagaggauggauggggggagggagcagggaauggaauauagaguguaaaaaauaaauuuaaaaaaagaauucagucauaaggccaaaauaaacccacuaucauuuuuuuguauguagacagguauauugacuugccuuccuuaaaaguuuuuccagugagugacagcuauuugcuucugaugugugagucacucauggcuacccuugauuucaguauacucuuacugguuuaggauggggucaagggugcuauuuccugcaauagcuuugauguccaagaacgacagcauacccuugcagaaacucacuuuuucacacuuaaaucuaacaaaauguuuuacccaaagucuguuaaccuucaaauauuaaauuaugauaacaauaucuuauaggaacccuucaacacacuggaagcccuaccagcuacuugacccccuuaacauucuucucacuucuuuaguggauaaacauuuccccagaugaccaaacuuaggucucaagagaggugaaggaaucauuucugagagcggaggagaaagucgccuuucauccacacagcuugcuuauugcauaagacccaggucaccuuuguaccccaaauucuugcuuaugucauacuucuugaggucuuccccgguuucaaaaaaaaaaaaaaaaaggcggggggggaugcaaaaaaaaaaaaggcagcuuuggaguucaccaagcaguugcuuagcaacgagcuaauacaccaaaaacaaacagcuuaauuagaaauaauugucaggucuauacauaggcaaagcugcagagugucaccaaagucucuuuuagcccuuaccugugucuuguaacaaagcugauagagaaacagcuuuuacucuugauugcagaacuguuaaguaaggucaggggacauggagaaaucacacucacccgaauuugagcacguacaugacuuggggcagcuugcuccacuuccuagcacuacuuuuuucuuagcuaaugaaggggcacuaacagaccacuacuggguuguaguaggugcucugcaggaguuaauucugugucccauagcaugcucacaacuguauuggacuaauuggccagucaucacccuagcaccuccccuugcaaacucccugccaccuucaggacaguuggguaacuacauggagcuaucucacucuuuccucucauggacaugagaaacagacaaauggucucugaucuacuaugguucaauuucugacuuuuucaaugauauaaucaugauccacagaaaacaaaguuaagacugaauuuuuuucccagcuagcaauaaacauacaguccugucuuucgaugcuagcaugaacagugacagaagcucccagacagaugugucggcauggggaaacgcuguuaugacaccccacacugugcugugaggcuaagcuauggugucaacuagaguacagcauguaggugugguugggcauggaaggacucagaaagaucugguagcugagauuaggcugagaugucaaugggucugaaggcaagagccgucagaacacuuaggagcagcggguaagaccgauggguuaaagggcagagguguuggaagggaaaaugucagacuguuucucagccaagacuguucacaucaugaaacugggcagguuuccaucacugaucaaaacuugcaccacuaauaaucaccuauaagccacggguauuuccauuuccuucccuuuauuuauguuccaggaaacacacaugguucccuagcagacacuguaucuuguagcauguguaaaugaguaaucagucuaauuccacucuguccaaugggacacauagcuacuuuucuucauauuuucuuugguguguaauggaaaaguguagaaguggugucaagugagucagucuggaugccugccaauagacauuaaccagguggcauuucuuuggguccauacauccuuuccauuuugccuuaucuacauuuaauauuuauugaguacuuguuguuugccaagaauuguuauaauuaaucccucugcauguguuuuugcagaacagcaccuccauucauuuuacugauaaggguacucaaagugagucccccaccucagggcucagcauugcuaccuggguaccuagcuuucuaugaacuuuccuagaagugcucucuuuuuagccugcugauugauccagauaccugauggucucauauccauauucaucagaauuguaacccuuacaaaacccuacagaguacacauuaagugcagauucuauccaacccuggggccccagggcuugcucaagaguaccaucuggugauuaucuaggauaaaucugaacucaaggcacuggcaacacaacugcacuucugguagcuccugcuauaaccuacaacccagagugcacgugugguaaacuuucccugauauguagccauuauugcuaacacugaaaaaagguaauuauuuauuggagaugcugaggauauuaacagaugauggcuaauagaggccacaggucagagccaugcucauggucaauaugcuguaguuguuauuauuauuauuauucauuacuguuugcucuuggauuuauuuugagcugcuuuuuuuaaccuacucuucacugacaggcccucccuuugaguauguuaucaguuaaauauacccaucuuccuggggcuugggaaauccuccuucugguagaugaccuugacugucugaccucaccucucaugggucugacuuguggucuugacagucugaccucauuauaagccuaucuucugcuuucugugauuuccuccaugacugcauauacagauauccgucuucaucucucugucucccuaccuucacugcccuggaacacuauacuuauauuugcucauucaagcuuggugcucaaugucuauguaucuggcuucauucauguuuauuaguugaagaauguuaccuuaguucucuuaauauccaagcacauaaagcuugguuaauauuaaaauaagguguaaaaaaaaggcucagagaaauaaggaaauuaaauguaauuauacuggaguccaaauauaguagaaaucaucuuauuuaaaagauuguacaggacgauacuuaucucacaguuuagccucccuucaaacucauaucuuaugggaggcaucagaaaaccuuuguugaaaaccuucuuaguugucuccucuugaaacagaaguggccacacuucucuaguacacacauauauauagcagaaucaaaauguagcugccucucugugcugggcacaggcucccuagcauauucuguaauccacuauuauugaucuuguuugcauccuucacaccagaaaagacugauucugaggcuaucaucugucugggucucucugaguggggagugacuucaaacugcugugaagccaaggccagugcuaucaguacuggucaaagugccucucacuuuucuggaccuccaagauauuuuguuuuccuaauuuucuuuucacaaagaaaauaguaagcuggguuugugauauuguuauaccagggaaaaguuaaugaucccccaaaacacacacagaagccaaucugaugcaucucacagcagggucuuuauucuauucaagcuagcucggguccccccaacauaccacugucacacaggaugguuuuuuuggggggggagcccugaaugucuaucagggaaaggcuuuuaguaagcagcaagcaggggauacgugugcaagcaucugauuggaaagcuccuguggccuuuaacauaauugacuggugccgagagucagaucauaaacuuaacuucugcuccccucugcauuggugguuguuaggcaaggguugggcuuguaaccuggagugcagguuuguuggggggauaaccugaagccacugaucuuguuaggcguuagccuagagacuggagcuaagcucagguuuuguuggggagcaccuuggaaacuaaugcuagauaccaccagccuguuagucuaccugaguucaaacuuaugucagguucuccaaaauggagucuguagccuugucuucuccaugaagacauucagauuuccccuuguuuguaugaggcacucccccauaaucucaugcuagaaccugaguuguuuuccuaguuauagaaacaccuaauuccauggcagugggugaagugaaaagguggacagagaaagaaauguauauguguacaugagaccagcugcuaggaucugggaguucuaaauacugggacuccaucuagcuuagcagucacccuuuuccacugguccuaggauuugcacuagucuucauaaaaguauagagucuuuacuuccuuggugggcauagaaagccucaauacucacccacauuucuuccucugcuuaccacuucuuucacguaugaguauuuuggguuagggacuauuugccuauucuggugaguugagagaaagaacuggaggaaaaauaagacacagaaguagagacaaggaaguuggaaaagcagguaaauugacuguaacagauaacuaagauguuuugauauagagaaggaugcaaagggcuggcuggaaacuaagagguaauacucugcauuuccauaggcagccagauaucugcccuugcucuaacagugagcuccuguuuugaauuucccaugaucucccgcuuuccugcuucaaguuuauuguaaguugagcaauagaagaagagggaacucacuauuucaagccaaacacuccauuggucucuuuucugagagaaaagagagagacucacuaccuccauugucauauggggacucugugaguacaauaggcuauacaauguauccagaaggucagaaaagagauagacagauuuugaagauagugccggauucauacuguucuccauuuuaucaguaguacccucagcauuuagguagauuccuauguguucccaaauacaaacuguugcauaaaaguuaugaauauuuugcaaaaauuguagaaaagaagcaaugcucuccagauauggacuacaugagaaaaggucaugcaaaauauggauggauggauggauggauggauggauggauggauggauggauggauggauagauggauggauggauauauagaaaaagagauagaacuuaaggacugggaagacugugagacuggcaagccuagaugugagagcaggccugcagcugagcugcaugaagaauacagcccugagacaacagccuucuuuucuagaaaagauugggucuguuuauuguaaagacuuacaguguauccauuagccuuguuugaugguaaguaacagaaaccauucaagaauguaauuaaaguaaaaacaaaucaaagggugaguaucgcuuacaaaauugaaauagaauuggaaaacaagugcacugauuccaaaguuaaagugagcaacucuagguaucucuacagcaguaguucaaaaaccugcagagccccaacaaugcaagucagcugcuuggucuuccagacucuguuucugugcaaguuaccacuggaauuacuuacuuauauugcguucaauccccuagacaacauguucuagguagggguucaugaaggguagcccaagcucugagagcugcugcuaucuauagugcccauaaaaaagagaauuauuuuugagcaaaacacuuuuaaaaauggcuuuuaggguagcugcaaguggggaccaagagcucauucaguaaaggggcuuucuaggaaagcuugagggccugaguuuuauucaagaaucaacaugaaaaugcugaauguaguaaugcaugcuuaaaauggcagcacucuggaugcagaagcgaguggguuacuggagcuuguuggcuuaaccuacuuggcaagcuccaauucccaguaagagacaauguuuucaaaaacaagguggaagauggaaugacauucugaggcugacccuguacuacacaaguugcaccaacacauauguagugacacauacauauggauaacugugauuguaacaguaacuguggcuuauauagagaacccaauuuuuauauauauucuauauggauaaaugcccugaucccuucauaguuuagcccuccccaccuccuacucuauuuuuauagaauuuauaucuuuaaauaacuacucacauauucagucuuacccccaauuuagagaucuuuguccucaaacuuuuaguauauugagccauguaaauacaauucagacagucuggcuggcuggcuguauuucucuguagcucgagugugcuggaugcaugcauagugacuacugaaugagaagcagucucccauuaacauuuuucccaugccccagaguccuugggacucaagaauauuuuuuagacauagacucuuauucauucauucauucaucauuaagugauguugcuucauauggcuauuuaaguugcuucuuucagaagugucugcuauucccucaagccuuccaaacugcuuucuuuguuguagugauagacacagaagguccaugauugcaucaugauccuaaagucagucaguguugugacuagaaagccugaugaaauacuaagauaauagccaaaagaaaggacaauaucucaggccacaggguaaugacagcauuguagaugauauccacuuacacuacgugccugccucuugccagguucacuaaugacaugauaaugccucacccaucccaucuccgggaagcagacauuauugucacuauucugggcagguggcaugugagguagcaagaagcuuauuuacuuggccaggacaaaacucaaaguagcauuuccagguuuugaugguuguuuaugggacggauccccagguggggcugucucuggauggucauuccuucagucucuucuucacacguugucuuuguaccuccuuccauggguauuuuguucccucuucuaagaaggacugaaguaucugcuuuggucuuucuucuugaguuucauguguuuggcaaauuguaucuugaguauucugagcuucucgguuaauauccacuuaucagugagugcauaccuuguguguucuuuugugauuggguuacgucacucaaggugauauccuccagauccuuccauuugucuaagaauuucaaaaauucguuguuuuugauacucuauuguguaaauguaccacauuuuccguauccauuccucuguugaagaacaucuguguucuuuccagcuucuggcuauuauaaauaaggcuccuaugaacauaguggagcauguguccuuauuacuuauuggagcaucuucuggguauaugcccaggagugguauuauuggauccuccaguaguacuauguccaauuuucugaggaacuaacugccaaacugauuuccagagugguuguaccagcuugcaaucccaccaguaauggaggaguguuccucuuucuccacauccucaccagcauuugcugucaccugaguuuuuuaucuuagccauucugacuguuguguggcauaaucucaguauuguuuugauuugcauuucccugaugauuaaugauguugaacauuuuuucaggugccucucagccauuugguauuccucaauugagaauucuauguuuagcacuauaucccauuuuuuaauaggguuaguugguuuucuggagucuaacuucugaaguucuauauauauauauauuggauauuaguccccuaacauguuugggauugguaaagaucuuuacccaaucuguugguugcuauuuugucuuauugacaguguccuuuaccuuacaaagcuaugcaauuuuaugaggucccauuuguuaauucuugaucuugcaguacaagccuguucuguccuguguuuuguucaggaauuuuuccccugugcccauaucuucgaggcucuuccccacuaucuccucuauaaguuuaaguguaucuggucuuauguguagguccuugauccacuuggacuugaacuuuguucaagauaagaauggaucaauucgcauucuuuacaugauaaccaccaguucagccagcaccauuugcugaaaauacugucuuuuccacuggaugauuuuaguuccuuugucaaagaucaagugaccauagguguguggguucauuucuggaucuucaguucuauuccauuguucuacuguugcuguaucaguaccaugcaguuuuuaaucacaauugcucuguaguacagcuugaagucacagauguguuuccaccagagguuuuuauugagaauaguuuuugcuauccuagguuuuuuguuauuccagaugaauuugcaaacugcccuuucuaacucugugaagaauuguguuggaauguugauggggauuacauugaaucuguagauugcuuucugcaagauagccauuuuuacuauauaaauucauaaauagauucaugagcauuggagaucuuuccaucuucugagaucuucuucgguuucuuucuucagagacuugaaguucuuauauacaucuuucacuuccuuagagucacaccaagguauuuuauaauauuugugacuauugugaaggguguguuuuccuaauuucuuccucaucuuguuuauuaucuuaugaguagagaaaggccacugauuuguuugaguuaacuuuauauccagauacuucacugaaguucauaucaucugcaaauagugauauuuugauuucuuccuuuccaauuuguaugccuuugaucuccuuuuguuuucuaauugcucugacuaugucuucaaguacuguauugaauagguauggagagagugggcagucuugucuagucccugauuuuaguggaauugcuucaaguuucucuccauuuaguuugauauuggcuacugguuugcuguauauugcuuuuauuauguuuagguaugggccuugaauuccugaucuuuccaagacuuucaucaugaauggguguuagauuuugucaaaugcuuuuucagcaucuaaugagaugaucauguggucuuuuuucuuugaguuuguucauauacacuaccuagguuugcuaacuccaguguugucucccuuugugauuucuuuauugauuuuauuucaauuuuuagauccuggaugauuuuguucaauuccuucaccuguuugguuguguuuucacguaauucuuuaagggauuuuuguguuuccuuguuaagggcuucuacauucuuacccauguucuccuguauuucuuuaauguaguuauuuauguccuccuuaaaguucuguaucaucauuaugagaucugacuuggaaucagagucuucuuuuucugguguuuugggguauccaggacucccugugauaggacaacugaguucugacaaugccaaguagccuugguuucuuuugcuuauguucuuguccuugccucucuuuauuuggguaucucuaguguuagcugaucuucuuuucucugacuguggcuuguuccuccugcaagccucugugucagaacuccugggagacaaauucucucuggggugaauuuggguauggauaacuguggcacagguguagcuuugggugcagacagaaaccugaaggauacuguccccaacuguuccuuaguucccuuguccugauaacucuggggugguccccuugggccaggaauuugaacaggaguggugguaugcuagcacuccugggacaagagcuucuuuccagagaccaguuccuuccuagcaguguuuggguauggagcgcuccagcacaagaucaguucugggguguagacagaaaccggaaggacccugucucaggcugcuucucaguuccuguguccugaggucuccaggcaggucucucagagcagaaguggugguuuuaccugugcuuacaggugugccaucacuccugggaggccagcucucuccaggcacaggaccagcuccaggcacagacucagucuguauuucuucaaagcuucaugcuauguugccaucuuugagccucucucccuuuuuaagaggaauuaucugagcugcaagcugacaauccaacacacagguggucagaaacuaggagacagguccugagggacagaagacugaguaggagucaaugaaguuguuugauuccaagaaauccaucagacuccugacuuaccuggcuagguguugguucugcguggaaaggguuucuacauacugugcagggcuauguucuaggccauuccagagguugaugggucaugguuggucuuuccucucaguggcuucauaucacuggucuucuaugcccugucuuauaggacagguagacauaagucuuuuuagacugcccugcucuguucuuggcucuaauauuagcacacucuguaguuuugcugaaaguagacccaaccuguauggacuaaccugauaauacuguuggucagccauuguaaccugucaguuccucuauuuguucccuaugagggauuuaaauaguugcuuagccucccugggcugaccaucagcuauccucacaaugaagggacuugaacugacaucaaaggcacucuguaucucuaucuacuucucuuucaggaaaucugucauccagcuugaccuugccaauaccaagaaagcaaugauugucccagcauuugaaacgcugcgcuacagacucucuuuccccaagucaaaagcagagcugcugucaauguuggacauggggacccuauucacauucaggugagugacccccacagcaauuaucuggggugcacaaaggaucucucucccagaacaucuagaugucaaagcuguuggcaaagaggucaguugguuguauuaacuuacaauaaaaccaaagaaagauacucagcccuuugaccuugggacgcuaucuauucuccuuuucuggcauguuauuuucucugcuuuauacauggaugauaggcacuauguucagguggaaggagaggccugcuguggcaaacaaacacuguuuagggcccugucauuauccuuuggcucagaauucugccuuugguacauacauagcaguuuucucuggaagaaaaaaaugguagaaugaauauauauuuacagugaauuuauuagacuaucuuuugcaacacaauccgauugguccaacagugaagaaucaagaauuugguaguuggaaauccaggaggcugaguacaauaacaaucugauaccaaggaccggguagauucuugcucuucagcauacauuggauaccugaaaacacuaguucucauaucacagaggagcuguugauggcagcagcaacaggaaagauaaauuugucaguaaaugugaaaaugcaguaagcaaaauuuuuuugucuuccaagucuggccacugugagaaguugucacucacauuuagaauagguguuccauaucaauuaaggcaaucaagacaauucccacaggacaucccauggaccaacuuaauguauacaauuccucauugagacauucuuguaucaauuugacaauuaaaaccaugauguauacauuaauucucuuacugaguggguuuuacucugagaucccuuguaggcuucuuuuuccuguuguguguguguaaauagucuaaucucgaaacucuuagggcauggaacagacaucuaaggucaucaccugcaacuaaagucaucaucuaaagucuuuaaugggacuccauaguuacacacaacugauauaagagccaacugcccagugauagcugcaaccaaaaaacuauugguuuucucauucccagaucucagugccuccaaggguauucagggagcugugcuguccagaaugucccaguacucaucugcacaguauuagugagcucuagacucuaacauugacuguuugagucaggacuagggaaguaggaauccugcuaaucucuuugagacgaaacaauauguacagaaccauugcaucugccuguuucugcucacaguucauauuccucuauuccauacaauguaauagugaccccuccucccucugaguaaaaagaaugcaauuuuguacagccuaaauugggcacaaguauuuuaagcauaacagcuggguuguacagauacuacaaauccucugaaagguauuuuuaaacuguuuauggguaaugauauucauuccauggcaucaaguucaugcaucuuuauauuuuauggggaguugagagugucugguggagcaaggacucaaucuucagccuccaucuuccguuuaggacucugaaaaaggaaccuagaauaauuccucuccccaacccaaagcuuucuacuucccauaaauugcaugcuuuguaugaaccaagcauugggaugaacauaauccugacaacaacauaaagugaauuccauuuuuuuuucugcaguggaaacacuaaugugaguaaugaaauaaucugcucagugacacauggcugaugagugguagaaccugaggaaccaccaagccugucuucuuaacugaaauagcauugggcugcugacaagcccuugauuuucauaucaauucuuguuugaaaacauaaaaaaucacaaaucagugcuggaaaucgagauuugaagccaaacuuucaucugagucucccacaguuacuauagcucaguagccaaauaccuaucaaauguccaagguguucuuucugcuaccccaggugaugugagagcucauuucaaggccauaucucuaggccugcuguauccaugauuacugcucuggcgagcagcuugcagaccaccauaccaagugcuaaguuacagacuuucccucugagaaauugcuuuugucaccugcucuccaaagagaccuccucuucaccacgucuggcaugagaagcuucuguaccucucugcauccuccaggaacauggugcucagaguauguauggccaaguugucugggaccuucuugucaauauagucucagcucucaucccgagccauaaacccugcuguuaaaacuaguuccucacauugcucuggcacauaucaaguuugaagacacugcucagagcuugagguugccugguauggcuagacccugugacccagugucugcuggaacaacaguagacagaagguuccccaggcagucuuuagguuguggugugaguguguguauugaauucguuguuguaacuucacuccacaucuucugcccagcuauuugucaugcugucaacaggccagacugagugaauagaaacugccucucuaaccacauaagcagauauggccaugagugcuuugugagaauucacuucauguuaaaaauugauauuaugccaggcaguggucacacacaccuuuaaucccagcacuugggaggcagaggcagaggcagaggcagguggauuucugaguucguacccagccuggucuacaaagugaguuccaagacagccaggacuauacagaaauacccugucucaaaaaacaaacaaacaaaaaaaugauauuauuaccucuugcuuuccuaggagaaagaaacaaggcaguuaaccuguccaaccugcuaaacaaaaggaugcaaaucccagcaggcugcuguuaguagccauuauuagcugucuaguaaggaaacaauauuugugggaugucuccugcauguuagcccugugccaauguuuauaccauugucuugcuuaagcuccugggcagcuuuucaugguagguaugacuuucccagcucacauaagaggcaacuauuaaguacuugauuguucagggucugcugcucauaagugguagaacugagaugugaacccgaccaauggcuugucuuuguuaugcuuggaaccaaauacgaauucccagucaucuaugguaugcccauuuugucaaaaguaccacauaucaaagcugccuguucagcaaauucucaaauagaaaaucaauuguuccauggccuaaucucuagauuagaccuaucacugacacaucuuuaaguaaccccuacccuuuccguuuaaauaauuggcuuugcuggacacuacuucauugaugguauugaacucaaaucccugccucuacccagccugccuguccuacacagcaacacacugagucuguuagauugaguuuguaugcuggucuggcagaaauucagucucuuugaugaaaugagaguuuuagggaagaguuuuagccuugccacuggaaugcuaccugccauggggcacucacuuucacagccuuguuugcuuuacagagaugcucccaggcuaccugggaaacauuacuauuugcaaacccaggaucaggauaaucuuuagaacuuaaaacaauaugcaucugcagcauuuaaaaucauccuaacacauaguaaaugccuaauaaauacaaucucaucagagaaacccauuagcuguauuucucucucuggcagcuaagcuaagguccuuccuuuuguuuuauucugucuaccccuagguuaccaucuuuccuaaucccguucuguuaccuucaacuguacauucauuucauucugugcguucaccuuccucauuacuuguagugacagcaucccaccccacucacugcucucuuucucuuucugacaccucacaaguuuuauauuauucauccucucauuuuuccaauguauuuuccucacaucauaaaacugaauacaccaguaagaacagagcacuaacauagugcugagggaggagaaugccauggaucuuaaagcugcaaagaaagcauugagaugaggugggaaagagggauuuaaaagggaacaugguacauucaggaacauaacgugagaacagaguccuaaucugcaagucuuucugccuugccccuuguuccuucuacccuuguauacauguugaguugaguagcacacaagcagacccuugagccagacuaccuaggauucauuacuauuuccaacugagcaucaggaucauuuuuagaauuuaaaacaauaugcauauacaacauuuaaaaucaucccaacucagaguaaaugccuaacaaguacaaccuucaaaucgucgugucguucauuucucauugccagauaacagaguagcaccaccacaauacuguaaagcagcagucucacaacuugacugucucugucugcuuguaugcaauaaccaacucucuguccaggcuacugcuguguggaaagcaaauguccaaagaaauucaugucuucuccagugccacaagacccucuuccuguuugcugggugcugauaggcuuucuuuucuugauaccacaggcugaaguguucauuuuccuagcuuuuggauauguacgccauugguuccuggcuccuacuuuuuacccugucucuauaaacagcucacgacauaauucuuuacuuccuuccagauacgaaagaucaugacuuagaucauacucaccuugguaaucucaauuuucauuaacuucagaggcaccugcuuaguaacuuuuaugucuauaaaaaaauccacccuugccucauaauauaauauaaucagaggggucuccuacuccuaaauucugccccaucauugaggguugaucaggacuaccagugggcccugauaggaaugaccagagauagauuucuuggaaaugauggcaagugcucaaaaguucauugaucuuucuauggagucuuuucauuaaugacagauaacuggggacugcauuaguuuccugaggcugcuguaacaaaauacuacaaaauagguggcuuaacacacaguugcuuauuauuuaacaauuuugcaagucagaaaucccaauuaaagguccuaguagauccaugguuuucuaaaggcuccaggaaagaugccuuacuuguuccugucugccuuuguucuuggugauugccagcaauccuugauauugcuuguuucuugauaggucccucauucuagcacugucugaaucugcacaugcuuuacucauaaguaacuugaguauaguuauaaagcuccuguucccugccaggucucauuuacaagcacugaaaguuugaacuugaaugaggguuuugcagggacacaguauaucucaccaggaagaccauaucaacauguacuucuucuuccucuucaucaccagguuugggaaaauucagcuugcaucccuucacucaauggcuuuuuucuacaugucccagguaucacguauggacuaaaggccaugcacccacaaacuuugccaaguggcggacugccaccacaccuuaccagguugagugggaggcugauuuugagccauauguuguugugagacgagacugcccugaguaugaucggagauuugugggcuuuggcuggaacaaaguggcucacaucauggaauuggaugcacaggugagaacaaaacacuggccugguacuaugugggggaggagagauaggcagauauuagagcugaaaaacuaccuuggagacaagauuccaaagaaccuucagaggaacaagauguguugaggaacuaacacaugugaaucuguuuucugggcuuucaaccucaaacauuuccucuucccuugcauaggaacuagguuucuggccaggguuaagcaaaugagagcuuccuacccccaccaucuggugaagaaaauaagcacaggauuacugcuuaugacuggacaccaacguguaugauugccucacuguaaguggcacaaaacaugccacuaaaauguugcuaauuauucugcccuucaauuaaaacaacagagauuuuuagacuauguuccauuugaaagccuuuguucauuuacacaauacguagcaaacaucugcuucagaagacgucuacagaauuuuaauagguuaagcuagguacuauacaguuuugaaaaggacuagaugguaauuacauggagcuuugugagaccugaaagucgcucugcucagcucugccacuguuguucguccauaggugcucucuaaauaauguucauggcuaggcuucacuacugcuucauuuauacagcugaagcaaaccagacaggcuguaguuugucaacuccauuugcuauucaugagacacauguucccuugaagcugagccaucccaggugacugagaaucuaccgacuuuguggaacaguauccauguugagcaaaacaaaacaugauauccaucuauugguacccauguccugacugauaaaccugcuuagagaccaugaauccuagccuaccauugcugcuaccagcaagaacagugguauuucugggcccaacaguguuguguggugaccauucaaaaaaaguuuauuuuuuuucccugucacaaaggccuagccucuguuuuagacacauucacagaauuuuugcaaguggaccauauacuuuccuguauuugccuauagcacucaucagacaucuucauuccagugacuuaagauagugaggcacucacagagccacagcuauagagccugguggaugaguagcccacucuguuucuguguaaaaugcccagacaggugggcccuagagucuugcauguucuucugauuuuuuuuuuaauguuaccacuagcugcugucuucugccugaugcaucugccucuccuguccuuaguuugccuugcugaguuuauucuugucugcucugggcugagaaaguagaugacaugaauccaaauuggaguaaggauauauauagauagauugugcaugugcuggguucuaucuuuguuacauguccuaaacuuguguccacuguucacuuauaagaagucaaggaaaauuuuauuauucuuaaccuuuaauauagcuaaacauuuaguuuuuuauuuggguauuuuauuuacauaauuauuuauaugucuauuuuuaagaaaggaucuuauacuaaggcuuagacugaugaaacuugcuauguuugaccuggaauucauggcagucuucucaugcuggcuuucuaagugcugcguuauagacaugagucaccacauugagcuuuaacauuugcuuuuuuuuccuugccuuuuguuuuucuuuuguccccucuuuuuauacuuuuugugaagacugucacauaaacagaugaaaguucacuguccaagagaagauugcauaguaacguuauuagaguuugacuaugugcuauauggagagccgcuggaguggacauguguucuguuuuucuuuuucccauaaaguaugaguuuuacccucauaaucauacuucaggauagauuuuaucacucucacuuuguauaugagaaaaccaaacuucagaugacucugauauuuuauauaaguucauggacaggacccugaagcgaguuauucuggagcuauuguggccuuuccugguguuauucuccauucccuugauucagaaucauacaugacccaaagcucuuacaagaucucucauuacucuugucuuccuccuucuaggaguaugaguucaccguguugcccaaugccuacaugauccacaugccccaugccccuaguuucgacaucacuaaguuccguuccaacaagcaauaccgcaucugucucaaaacccugaaggaagaguuucaacaagacaugucccgacgauauggcuuugcugccuugaaauaucucacagcugagaacaacagcuagcacuacuagggagagccaccacuagggagagacgugccacaagggaagaaccacuuccugcuggggcccagccuuugaagacaaaagccaacacugcuuuucuuugguuuguuucccuuugucucuuuggccccacaaagcugcucucuucugaagucuuggacagagacccagcccaccaugggugcuuccaggaugggacauagaagaguggaagcaaaugaagaguuuaacaucaucacaaagccacagaccaagucagggcuucuggauauucccauugcuuuuuaacaguuaugggucaaaccuuagcuguugagaaaguaagagcaauaaagcuuccuacgauggaaauguauccugccaccuagcuggguacccauauggacagcaacccaaggacccaaacaaacaucuggagacucucauauggacauuacacaugagggaccugaaggagggaugaauugguuguuuauucucaaagucacucuuguuuuguuuugaguuguuugaauuugggggauuuuguucauuuugaucuagaaaucuaaguuuuuuaaaaaaucuaauccuuaaagcucugaaagaaaaaucaacucccucgaucaacaccccucagcagcaguggcccugcaagucaagcacccguggaggauguuccugggugaacagcuuccuucaugaugaacacugagaccaccugauuccaaguuuccacucucuagauccaguacuaugacagggacuacagaaauaugaguccaaacacuauaugcaacucacauuuucuauggaccaucaccaagccacaaggaaagggcuucauggaacuacuucagcacucacagaagguaugauucccuucuugggccuauagaagaacuugaacaguucacagaaguccaauuugaacacuuguaugacuacauugaagccacuggaagaaaugggucagguaucucuguguucuucccugccucacuguugaaagugagggagcugaugaacuuaguuuccccucaggaccuguccaaguguuggcacgaaccucuucauugugcauauggaagacacuggacccauuuucuuuacucuucacuauuaauguuguguuuacauugaugagaacaagagcuaauggcauacccuguacugggcuguuuguauugaguugacaugugaccagcgaaagcugcauucaauaaaugaaguacagacuguuucuuccucuucucccucccacccuuguaagaagccacaugacacacuuggucuagaaggcaaagucaaaucugugcacagcaccucacacuuucuguucuuauaucucaucuuucucuugucuaaaaugucaccuuuguuucccucccaauucaaggaaaauucagauuuuccauggugcaucugucucaccacuguagccagauguuuuacauuuuaaguaugcaaacuaugauaaacaguaucauucaauugaauagccugucuuuaagggauaucuuguccuguagagucccaugauaguccaaucaaugagaccacuacaugugguauguucaaggguguuccccuaaauuaauacaaaaugaagaaaauuguaauuagaauuaauugucacagugguacagacaaguuugugucuuuauucauuacuucuuuuguuacuaggacaacaucugacaaagguguuuauuuugguucagaguuugagaaucuagcccaucuuggaaggaaaggcaugguagcaggaacuugaagcaacugaucacauugcaccuguagucaggaagcagaaagagaugaggaucagcacucagacugauuucuccuuuuuuguucaaucagggaccccauccaaugggaugauucugcgagggacuuuucacuugaguuagccuaaugua

SEQ ID NO: 4539 - RNA, 39188 nt, Mus musculus
aguuuacggagcuguaaagacuuuggguuggggcagguguuuggcuacauuaaucuaauugccugauauuuuuuauucgcaauuucuuuacagaaagauauuuuuauugaagaauaaacaggagacuuuugaaauuauuuguuuagaccgagaagagauuucuagacuaaaccugcaacggaggaguguauucucaaacgguaccgcgaccgcgcucaacaagcagguuuauucgaugcgcucgacgcucuuucgccggcgcgguagccccgcugcaguaggagucugcgcucugggcucgacugaggcgcccuuguugcucgcgcuuuucucuccuucuccaagauggcggccgucggcggcgcugaggcgggauccgagcgagccgagugaagguagcggcgagcggagcccccaccagacccguccggacccccaccccggggcggcaacggccccgcccggccuccgcccaccgcuccggccccccgacaccguccgggaggcgcuucaggcccgccgcggccuagcucgggggccaagccgggaacuggaguagcggcugcagccgccccggggaaggggcucgagcgggccgcaggaggaaggcggcgggagcuguucaaacggggaaggcgggaaagcugcggggccgggagggggcgugcggccgccccagggacccgcggcccgcgccgccccucccccugcgccgcugucugggcgcuccggggcgccggaggccgacgggacgugggaacacgggucgggcggagcgcggcaugggagccggggcgcgggcuaccuggggcugucaggaagagaggucccgggccggcgggcgggagggcugggcgcgcggugagcggcgagcgggagaggaugcccggagcuuccugcgcugcgcagagcuuuguugaacuagcgguugcagcagaccugccgagguuaucacagcggggaccccgggaacgguggucuuggggacuguauggauaaacgaucucguauuguguguguucuuugcgugcgacucaguuugaacaugccuucuuaauuggagucaucuccauacaggcccauuucccccuccacaaccacuacuuguagguucacuuuaguuuauaucauauagcagacaagauaugucuaccacccacccaccccacccuuguuuccaguacuggcugauucuauacccucguagcaaaauacauuuuuaaaaacugcauccaaaguaaagccuguugauuauggcuugucaaaauuuggaucgcugaacucguggaaccgaguauguuaucagccaaucugugcaguggucgugguuccaguuagcauugcagugagaagauucagugcgccuuucuggcuauggagaucucugcaaguugcgaagcuggcaggggcuggagugcugcauagguggguccuuggaaaaggguguggcaagaacuccaacagauccaagaaggaaggaaacccacugaaguaagaauucaccugugcuauccuagaaguagcaacaaaauaucagaaucugccaacagcuggauguguuucuuccuuugacugcauggacuggcaaucuaaguuccuaaaaacagccuuggaggaaacucccgucuggaggagacagaccuuccuugcccaguuuacuggguggauuuucuuucuuuuucaauucuccgaucuguucugggaugaugauaacgauuagcgauugcuggaacugagauuaccuccaaaaacuuaguuucugaaacuuuuuuuauaguuaacgcuuugaauuuccaaaauaacaaaauucuaccuuugaagauuuuaacuuuuuucauaauuacuuguuaucccaaaagccugugcugaaguuuuauuuucaaguggaauuaacagccugcuucuccuuucuuauacccugaagaaaagccuuggaagagccgagccacgguguucacguuuucuaagcauucgcuaucuauaauggcauaaacaguauuaaacaaugaaugagcuuuucuaugcugucauguuuuugcacacuaagacaaacacuaacuguaagauuauccugccccaagaaguugacagcauagaauuuuguaaacuccaaaauuauggaauucaagagaauggguuuuagcaccuguuuuguguuugcuaacauuugauguaguuguuuucugaugugaaaaucaaaccuaaauuuuugaucuucauuaacucucccaauuuacuuucuaccccugagcccucaauuuaauuugagacauaguguucaucuaaucuuguaugaaugcuccugaacucugcuuucuuucacacugcugcuugagaccuuuucccccucccugguacugucuuuuucuugugaggcagccaccauuuagggcccaucagucugcccauccugggaauauuccauaguauuucucagguucugggcugcccuacauauuggacuuguguucaggguucacucacuuuuccuacaagcaucuagucuuuguuuguuuguuuguuuguuuguuuguuuuuaagauuuauuuauuauauguaaguacacuguagcugucuucagacacaccagaagagggugucagaucucauuauggaugguugugagccaccaugugguugcugggauuugaacucaggaccuucagaagaggaaucagugcucuuaaccacugagacaucucaccagucccuggucuuuauuuuaagaaaguucugguaguagcaggcguaguccuaauacagaaagccagcacgucuguguugaccugccuucaggagcauucccuaauuuuauguuuccaaaccuuuuuaaaauguacuaauuuuucacagcagucaagaaauaacuuuucacaccuaguaaaaaguucagcuggcuuccaacccaauaagacauugccuaauuguaucuuauauuacuuguaauguucucaagggggaaagcuguuuaugagucucuggccugccauuacuuauguuuaaaaguguauugguguuugaccagugacugauggauguauuaugagacuaaauaaggaugugguuggacuggggaggagcggggcauuauuucucaggaauucuaugccaaaauucaucagguacgaaaagccugaaacuucaaucuaaaguuauuuuacuuagugucagcuugugaaagccaagaucaccuguauggcuuucuaauaaacucaucauuuuugaacuagugagaauauugccauuguuuuguuugagagauucucucuagcccuggaauucauuauguagaucaggcuggccuugaauucacaagauagccacuugucgaugccuuccaagugcuggaauuaaaggugugugccacuuggcaaaauuguugucuuuaaaugagugcauaucauuuucaguggcccaccuucacucccuuuuaaguuaauaucgagggguuggaagugaagaacaguuucuauuuaagaaaguguaguaauuaaacacuaaaacaggaaaaaauggccauguauaucuugucaccuuacauucuuacaugaggccugacccuacauuuucuucauuucaugagaaaagcccugugagcaaccagcaugccagcucuuuaaacaauuggcuucauguagauuuacuucccuccagcuucccuuaccuugaacaaauuccuucauuucacauuuuguaauucucagacuuugaaaaucauaacagugcuuuucuuuguauugucaacuuuggccuaccugugcauuguauuuauguggcuuuuaaagaaacauuuguuguuuuguuuugagacagggucucacuugggagcccuggcuggccuggaacucauguagagcagacuggccugagauuuacagagaaccacaugccccugacaugcugacuccugugugcugggacuaaggguauucaccagcaagccucacuaaauuaaaacucuuaaccauuaagucaugaaaauuucccguuaaucagcucguguuuucuuucccacaaacucugugcuucuguuuucuccacaccuaucugaagggcggaauaauguuacagaacugaccuucagucauccuaaagucauuuauuauagugaagguuaaauuaaauuaccaauuagauuaacuucuaagcacuugacugaaugagaacauuuucaaauuaguuauuucagauauccugcaaagcagugaguucuaggccagucagagcugcuacauaguaagaccuugucucaaaaaagaaaaacuaugcaaauauuuucuguccuuaaggugcuuuaaggauuuacuuuagagugcaauuuauaacuuuaucaccuucaaagucaauccagacauuugaacuugaaugcuacaaaagcuuuaaaucagugguucucagccuuccuaaugcuaugacgcccuuuaaugcaguugcucauguggcagugacacccaacuauaaaacuauuuugguugcuccuuuauaacuguaauuuugcuacuguuacgacugaauaucugcguuuucugauggucuugggcaaccccugugaaaggauuguuugacaccccugccuccaaagggauugccugaccuacagaucgagagccacugcuuuaaacaauaaaauauuuagaacuauguaaggugaugaacauuucuuuaauuccaguguucaggaggcagcuguagguagauuucuguaaacucuagagcucucuggucuauaaagugaguuuuaggccagccaggguuauguaaggagacccugucucaaaagacaaaacccaauacuuagaacuuuuaaauuagaguacuucuaaauuaauuuuuaaaaaccuuaaaauuauaaauuuuaucaccaguggauaaauauuucuuucuuacuauccuuuaaaaagggcuuguuaguguuggaaauuuccauauagccaacacauuugagaaguaugcccguauuagugguuaauuuaaauaaauucauaaagcccaauagaaugaaaagcuuuaaauuauuaguaucugugugugugcuguuuaacuuacaagcucagcagacucaucaguaggacuuuguggucuuccacuauugguguacucuguccuccucugcaucuggcuuuaucuguauauccugugacuaugauugaacccggccucugacuuaaugucaguuucuacccugucucaguguuauuaguccuguuagcauuccagaaauucucauuaauuuuggaaguuuuuuuuuuuuuaauuuaaucuuaaauuucuucaaaugucaacuuuaagacacgaauuaacuccaguuaagcuuagcauccucccugcaaguucaacucgaguguaugcacagagggaggagcugacaagacacuccuguguuccagucagcccuuggauugcuuggaauucccaccuggaagguugcuucuccacagugaguucacauuacaggaagguuuuccuuguuuguuucucagaccugguccuguagacgggaaggagccuggacacagugacacaacacauucucaaaggcccugcaggaccaccauggcuuaugaugacuccaugaagaaagaagguaugaccccuuacucagaagcauuccaaagggcauaaccucuuccaucccugcaguccauggauguagagaccaagacugggcacacagccuagaccaagugaugcuccagaggacugugugagacacagccuccacaucauccccagacugagcccauggacaugaaaaccagaacagggguuccuacacaagagucugaaauaagagucuuaguuuuugggggugauccccacagcacucguaguccuugccagcuccagugugcaggagucugggacugggaaucuuacacuggacucccacagagcagcucagcacacgaauccuuacccuuugcagccuucccucgcaagucuguaucuaccugccagaucacugcuaagaaaccaugucugaggacgcacacugggcauuuggauagcauggaagcauuguguuuucagguuugagucuuguguuugcagccaggucgucagaagucgucuuggcccucuggguuuagcccugcauuucaguggacgcacugagacguaacuguaacuuggagauggggcuguuggccuuugguuguugugcacuuuugucauuuccgucccuaaaugaaccugugcuucccagauugcuuugauggugaucacagcuuugaggacauaggacuugcagcuggccgaagccaacgagaaaagaagcggucuuacaaagacuucuuaagggaagaggaagaagucgccgcgcaggucaggagcucuuccaagaagaagucaaaggucaguuccagaugucugucaaagccgggaucccagaagaauggcuccaaaccguccccucgccaucuuauuacucgccaauucuucucccucuuuaaccacaggacagugauuuguucuucuuggggacggacacacacaagaagaagaggaagcacuccccugacgauuacuacuauggagguaagcgagggagugggcugcagguggggucugcacaucucugguucuuggagucgggguaggggaagggaucccagauauugcugacucaguggccuauuuaacaggacagugguucuuguucugagugccgauaaaccagugugaaggaggagagagguggagggcugguauuuuggaggauucagcauagaagaacagucuucauuugugauacacaagguaccagguuccuucuccccccaaccauccacuuaucugugccauugcuacuuagcaucccuuugccagaugcagcccuugggcccucuacauaucuguggggcauuucucagccagcauauaucuacucacaaaaccuguuuucuuagcuaugcucuauguguagcugacgagacuaaccucacuagaaugaguuuguccucagcacaagaaccagugacacucugucugcagucuaaucuagauuggaacuacccuuaaucucacagcucuauccuaaauauguucucugucucuugugaagacucagggaagagaaucagcucuaggggcaagaauggucugcagggccaaaggcugaaucuacuaaggcaagaaguacauggggguucucucugaauguuaggagccaaagugucuccccucagaaucacuccuguuagccuuuuccucauggcaguuggguuuuggugagagggggcacuugcuacaaguuacuuccuguccuauugacaguacuucuugguuauuucuagacauuucgacuuuggaaucaucacagaagaaaaagaagaagucuagcccacagucuccggacacagcaauggaccuguugaaagcuaucaccuccccacuggcagcgggugccaaguccucuaagaaggcaggggagaaauccuccagcucuucaagccauccagagagcaggaaggagcaccacaagaagaagggcaauggcagcaguggagagcucucccuggaugacagcaaugcccacaaauccaaaaagaugaagccacucuaugugaacacagagacacugacucuucgugagccagauggcuuaaagaugaaacucauucucucaccaaaggagaagggaagcagcucaguggaagaggaggcuuuucaguacccugcccaacaagcuucgcugaagaagcccucgaagaaacuagcucgggacgagcaaggugcuuuacuccuagggcacgagcuacagagccuccugaaaacggcccggaagaagcacaagucauccucagacucacacuccucuccuggcccagaaggcugugggucugacgucucccagcuuccagaaccccacagugccaaucucgacaucacagggcuugacccaauucuaguagaguccgaaucguccucagcuggggagcuggaggccggggagcuggugauagaugacucuuacagggagaucaagaagaagaagaagucaaaaaagagcaaaaagaagaaggacaaagacagacacaaggagaagcggcacucccggaccaagagaagcucugccagagagcacgguacugcucgggagcacgggcugauaccuggcccugccuccaguguccccacccugccacuuccugcucuacacacagauggacacggggagaagaaaaagaaaagggaagacaaagacagagacagagagaggggagaaaagguaaggagaaggucuugaugaaacaagaccuuucugaggaaccuguucuugccaccauugagcugaugggauagcacagggcauaaaguauuaccaguggccagauuugccuagggaaaagggauggcagucuaaucauuccuggcuucucuuaauugagcuguucuccuagccuguugaucaaaggauuaagaacaccaugauucuuagacaucauaggaaaggucccuuuugggucaucuuggaggagauuuucuaaacuaguaguaacuaacugaucaaguaaauaaaaugagcucacgucuuugucuugacugguguggguuaagacaguccuucaucuucuucuugugucuaauugcccuaucaguguuugagugcuuacuaugugaugagcugcaaagaucaaccggggacaguucuuuuucauuuauauguacuuugaugugucugacucgugcgugucagaagaaagccucagcccucuggaacugagauuacccaugguugugagcagccauguggauauugggaacugacccuguguucucuguaagagcagccuguguucuuaauagcugagcgucauuccaacccaaagacccaguucuugaccuuagagagcuccuuguccauuggagagaugguugugagagaucagucaccucaccaccugagaagggcuccaacagauguauuuuagggucagguaaagacagucugauuuuguuaccaaauugauaccuauuuucaugggaaauuuacaaacucagagcugggguaguggcccauucaugacacucccaacacuucagaggcugaggcaggaagaagaaaaguucaaaaccaguguagguaagacuccaagaaaaaaagaaaaaagaaauguauaaacucagaaauaaaucaauugaauauacuauaaauguauuccaugaaugaacuacuagagccuuaaaggaaaaauguauaauuuuuucccucaacaauagaaaauacaaauaauuuuguugccuaaaaccaaccauuccauucucuuccuuuguuuauauuuuuacaaaguaaaauauauaaaaucugaaagaaaagcuacuaagaaaaaugauaaccaacuauauuuagaaugucaguaccaucguaguauaagccuggaaccccaggcucuaggaaacugagguaggggaguuacaauuuaugcccagcaucugcuacaaaguaagacucuguuuuaaaaagagagagagagagaaaaggcagaugugaagcugggcaugguggcgcacgccuuuaaucccagcacucgggaggcagaggcaggcagauuucugaguucgaggccagccuggucuacagagugaguuccaggacagccagggcuacacagagaaacccuaucucaaaaaaccgaaaaaccaaaaaaaaaaaaaaaaaaaagugccuggguauggguauaaaagcuauacguuggauacaagagucauuauaagcacagacaacauuuggauauagcagguuuucauuuguucauuuacaaauuauuucaugaaauccaggugaauacucugugagucuauuauuagcccugcuuaugauaggaguaguaggcugcagagauggcucagcgguuaagaguacugacugcucuuccaaagguccugauuucaaauccgaacaaccacaugguggcucacaaccaucuguaaugagaugugaugcccucuucugaagugucugaagacagcuacaguguacuuacauauaauaaguauaauaaagaaauaaauuuuuagccaggcagugcuugcgcaugccuuuaaucccagcacuugagagacagaggcuggcggaauucugaguucauggccagccuggucuacaaagugaguuccaggacaaccagggcuacacagagaaaaccugucucaaaaaaccaaaaaaaaaaaaaaaaaaaaaaaaaaaaaauagaguucucaguugacauuuugcuuuuuuguuuuugguuugggguugggauuuuaagaugggaacuggucguuuauccuucgcuggccuugcacuucagaugguacuucuaccucucccucaagagugcugggauuacaugugugcaccaucauggccagcuucaacuuggguauuuauuaacuugaguugaacguucacuuauuugggggggggguguuuuuuuuuuuuggggguuugggguuuuuuuuuuuuuuuucuagacaggguuucucuguguagcucugguuguccuggaacucacucuguagaccaggcuggccuugaacucagaaauccgccugccucugccucccgagugcugggauuaaaggcaugcaccaccaccgcccugcuauguuagacaacuuuuauaacuugcccagaguaacaguauucagccuagggcugcugaggauuaaaugcauguaaacucacuuagggccugccucagccacugcugcguguuagauguuuuaaagggaagcagccaucccugacaacuuuuaggugccuuaggaacuacucucucaaggccauuuccagucucagcagcuccugaauuccugcuggugucuguaaacauggguuuucugggauuuuugugauaaaaaucaaaauaaguaagugucacauguuucauucccaaaacuucagguucagucccuagcacugugaaagauacuuacaagagaacuaggaaccuuugggaauuuuguuuuugcuuuagguagcuuucaauaaaugguaguuguuaaaaucaucaccuagucggggagugaucuauauaacccagaauuugggagacuaguugaaacuggaguaaaacuaaaugguauaugugcaguaagaaaaauguaugaaugggaaagaagaggugccaugagccuguuucguacuuguauaccagagggaagaagggaaauuauggcugacuuugagaccugcuuucuaugaaauagacacauuauauaauaauaucuugauuuucacuuaaaauuaaucccaccacugggauagaaguuuuccuuuuaaaagcuuuuauuuuagucauuuauuuauuuguguguguguguguguguauguguaaaggguugcuuaggcauugcuuguugauuuacugaaaaaguaaacuugaugauacaguuagaccuaggacaaugcuguauaaguucuccuucuagcuaaaccaaggcugaauaacaagaauaaauuguaagaauuaguaucuguugaguucuugccugugucaggcuucccaaggcauuuuaucuaucagucaucaaucauaauugaucaguacuucacuucacaaaaguaagaagcugggaagcaguguggagccagacuucagcacagauccuuuaacucucuguaccuaaaucuuuccacuuacacauaaagcguuuauaccuggcuacugagcaccauguuaggguuuuguuuguuuguuuguuuguuuuugguuuuguuucuggguuguuuuuuuuguguguguguuuuuuuugagacaggguuucucugugcagcccuggcuguccuggaacucacuuuguagaccaggcuggccuugaacucagaaauccuccugccucugccucccgagugcugggauuaaaggcaugcgccaccacacccgccuccauguuaguuuuuguuccagccgccagcagcucgcaacaugaacgguucgacugagaaggccacucgagcuguaagagagaaaucuagacggggcgaaagaagaaacggagcuaagacaaauucauucugaucaaagcuccaauuuuauuguugugacacuaguuauaaaggaagggggaggggacccgacucccgccgaauaaucucugguccaguagaaaggugcacguguguggcuccgcagguucuagcaguggguguggcagaacgaaugagcaggaagcuccaccccugagcaagcaggcugggggaggggagacuacaaguuuuaauguugcauucuguuguuuucuugugcuagggaacaaaaaacucaaagccuugugcaaauuagacaaacauccuaccacugacuuacauccccaaucuuuguuuuuuuguuuuguuuuauuuguuuguuuguuugguugguuuuaaucuauaaccuaagcuggccuugaauuuaugguccuccaugucaaccuucaaaagcaagcaccacuauguuucauaguucauauuugacaaaacaaaguauuuucuaauuuccacgaaaacgaaauaucagaccuaucacgguggcacauguguguaaucccgguauuuagucugaagcaagaagagcacaaauuugaggccauacuuaguuauauaaccauacuuucagugugggcacuugagcauccugcuguuauauauguucuauugaggaguguaauguuuuuaauuuaagacccaaaguauaaagaguugcaaaaacuaaaaucuacaugaaaacagcuuuuaaaacuuuagacacacugggcagugguggcgcacgccuuuaaucccagcacuugggagacagaggcaggcagaucucugaguucaaggccagccuggucuacagagugaguuccaggacagccaggacuauacagagaaacccugucuugggaaaaaagaaaaagaaaaaaacuuuaggcacucauuucacagacuaagcacagagacuuuuaaagaucauauguaacacauauguaugugaggggaugcaugugccauggcacacauauguguaacacauauguauguggggaugcaugugccauggcacacauguguguaacacauauguaugugggggugcaugugccauggcacacauguguguaauacauauguguauggggggugcaugugccauggcacacauguguauaacacauauguauguguggggaugcauguaccauggcacacauguggagucagaauacgacuuucaggaacugguucucuccuuccaccauggguacggaacucuaggugucagaccugcugagacaacuuguucccaugggucugcuuuuauauaucugauaccuugcuugcuuuagagggaaccaaggucugccauggauuguuuggaggggagcgagguauggauugaaaggaaguaggguugcugagaagcaaaaaaguagguguuauaauauuuccaggaggucacaggaauucaugagagaguccuggucugcagaaggaaugggagguccuaggacccucuccuauuccuacauaguuaaaguagaccuggcaccuaguccucaguuacagaaggauggggagacucacgugggauaguggugcucacugcacucuggccucugccauguacugcucagacucugcuguucauugaauguagucaauuaauacauucaguuguguucagcacuauauagagccaggcacuugccagaugccaaggacagaggaguaagacagugucugcucucccagguuucaggucuagaaaguugaaaguacuaaaagaguuggaccaaagccuuagugugaagaccuaacuagccuccuguagucuuccuuucccuucagugaauucgaaaucuuagucaagugaggucagacaagcagcagauuccuguguggcgccugcuuuccaguguucacaagcuacccugcuggucccagucuaguacucuggcucucagucucuucuuuccagcauaaaauuuaccucugcucagcaaagcugaaauagauucaacugguauuuccuuucuagucaguuguuguauuauuaacgcuacuuccaucguucaaccauagguggugcagcguccucaccgcccaccuaauguauaccagauuuccaaaagaaacacacacacacacacacacacacacacacacacacacacacacacacacacacauagccuuauauuuaauaugccuuaaaaagcacagugacugagccacucccaaacacugcuaaugcucccccuccaauacuccugaaaucucuauucaaucuuugcuacucuagacccaagguggggugggguacgcucuugaggccucucuacccggguucuuacaugguuguaugcucucaugucuccagcucuugggccuaauccuucugcguuuuuuguuuuguuuuuuguuuguuuguuuuuucgagacaggguuucucuguauagccuuggcuguccuggaacucacucuguagaccaggcuggccuugaacucagaaauccgccugccucugacuccgagugcuaugauuaaaggcgugugccaccacgcccggcuuucuacaguuuuaaaaccuccuucuucccucgguucccuuacccgggaaaucuaaagucaggccucugucucucugccuacccauuggcugccagcaacuuuauuuaccaacuagagucaacuaggggcaggccacuaggggcagggacccacagagucuugcaugcagacaugugaauccuauguaauuugggaacccccuuaacauaauguaaacaauaaaccaaauccacaacagucagugucaacagcuuucauauuagagacacugucuacaucuuuuacuuuagggaaacugaaaggauuugacuccuaacuuuccuuccuaacagaagaaagccaacucugcauuuguguaugcuguccaugugcacacguguguaugcacguguguacauguguaugugagugugugcuagaaguugaacccuuguaucucacuugcuuggcaaguacccuaccccugagcuacucuucaaacucccaauuuuaagauucauacuacaucuuaaauuaccauccuaaagagugauuuucauuguccuuuugguucccugauccaaaaaaguucaacaggauugcuuaguaaggucuuuaacaaguuggguuuuuuuauacauccuauuaucauuuucuucaucaaaagugguaaccacuucugccgguaacauuguaucuaagcacauuuagugaaucuacuuguuauaaguacuuuguuuuugguaauuuaguauuccaaguuuugacacuguuaccauuuuauggauccaggcccuguauccagcucuaauuuguuggcccccucuuaaagcuugcuuuguuagcaacuuuugcgaggauugccugccuuuguauuuggaucucauugcagugauuuuguuugcgugaauaucauccuccuuuccugcaguucuaauugccugugcuauagaaaauguucaacccuucacuuugaaaucugaacucuagauccacagauuggguguucuucuuauacagugaguagacuccaaggucagcacaagcugugggaaggcuucacuuugaagaggaacagaucccucccgacagaguaucuccugguggagcccgguuuuucucucuacucccauaucauaucauuggcauaggcucaggaaccauaguuuuauuuuguuuuuaauuacuuuauguguaugggugguuuccugccaugcaaguauaccacuuggaucccugccaucugcaagggccagaauuaggguaucagacacccuggaacuggaguucuagauaguugugagcuuccauagaggugcuaggaaccuaaucagggaccucuggcagagcagccaguguuuuuaaugccuagcuaucucuccagccccaccuccccgcaauuauauuuuuuaaaaaaaggauuauguuguauaaucccuuauuuuaaaaaaacaacaucagaaugcuacuuuguuuuuuuuuuuaaagauuuauuuauuuauucuauguaaguacacuguagcugucuucagacacuccagaagagggcgucagaucuuguuacagaugguugugagcccaccaugugguugcugggauuugaacuccggaccuuuggaagagcagucgggugcucuuacccacugagccaucucaccagcccccagaaugcuacuuugauagugaaagugacauauaggaacuaucuaggaaaggcagauuuauaaauuuaagcccccugucacacuuacucaaauguauagauucuuagguagaaugagugacaggugaggugucaugagacucuucuccccaacccuauauaucaugauaucacauguguaaguguaccauacagccuggggagggugcuguucuaucguggucccuaugaaagcauuugaaaagaagugucauaguuaagauguguuuaggaaugaggcuagagagcagcucagcagguaagaucauucaccacugcagaggacucgaauuccacucccagaagugucuguaacuccaaccccaggagagaagacacucuguccuucacagagcuucccauacaugcaugcgcuuguaugcaugcuugcuugaacacacacacacacacaggcacacacaugcacacauaauuuagaacaaaauaaaucuuugccuaagucagggcuauaaacccguugcugaguaaauaaagaagccccagcucccagcgcuccucuguaacaucucuagaugggacuaggucccuagaaagaugcuaagacacgggaccuuuacucuuugcuuguugcuuagcauguauguugguguacaugcugcuacaugugugucauguagugccacaagccccuacaugguucuacagcaugggcaccaugaacugcgugucaucaggcuugacagcaggcaccuuaaacugcuuagccauuuugcuagcucagaccuuguuuguuuguguauugguuuuucgagacaggguuucucuguguggcccuggcuguccuggaacucacucuguagaccaggcuggccucgaacucagaaauccaccugccucugccucccgagugcugggauuaaaggugugagccgccacugcccagcuauuauuuauuuuuauuuuuguuuguuuauuuacuuuuuguaugcuugcuugcuccuuuuuucuuuuuauugaaaauauuucuuucacauauuacaugcugauuuuuugguuuuucaagacaggguuucucuguguagcccuggcuguccuggaacucacucuguagaccaggcuggccucaaacucagaauuccgucugccucugccucccgagugcugggauuaaaggcaugcgccaccacgcccggcccccugaauuuuagaugucucucacugcauucccucccucagaccccucuuucuucaucugagccucucauuccagcucccacucauaacuauuuauucuauuucccuuucccaaugagagaucugucuauaccucagaucucuaacuugugugguucugugauagcuugcuuauuauggacuugacaguaauacccucauaagugaauccacaccauauuugucuuugugggucuggaucaccucacucaagaugauuugguuuuucuauuuucauccucuuaccugugauuuucaugaugccauuuucuuuaguggcugaguaauacuccacuguacuauauuuucuuuauugauucuuuuguugagggucaucuagauuguuuccaauuucuggcuauuagcaaugaacaugguucaacaaguaccuccaugguaggaugaaacguccuuuggguauauugcugaagcuugagguagaucuauuccuuucuuccugaagaaccacagcacguauuuccauaguggcuguacaagucugcacuggcaccagccauguaugaguguuccccuuacuccaccaucaucacuagcaugaacuguuuuauugaucuuagccauucugacagguauaagaugaaaucuaagaguaguuuugauuugcauuuucugauggcuacggauguugauugaacauuuuuuuaaguguuuuucagccauuuguauugagaauucuuguuuagaucuguauuccauuuuuuaacuuggauuauuugguuucuugauuuguuuuuuaguucuuuauguauuuuggguauuugccuucuauuggaugugguguaguugauaaaaaucuuuucccacuuuuggaugcugccuuucugucagagugaugauacccuucccauauggaagcucucaagucucaugaggucccacuuauuaauaauugccgacuuuaguguuugugcuuucuguucagaaagucuucuucaauaccaguguauacaaggcuauuccccacuuuaucagguucagucuaccuggcuuuauguugaggucuuugguggauuuggaguuuugugcagagugauaaguauaauccguuggauucuucuacaugcagcugccaguuugaccagcauuauuuguugaagaugcuaucuuuuuccaguuuguauuucuggacucuaucagaaaucagguauccaaggauuaaugucugggucuuucuucaauuugauuccauugugccaauaccauacuguucuuuaucuccuacagcuuuguaguacaacucaaaauugggcauagugaugccugucgguucuuuuauuauucaguauuguucuaccuauucuguguguuuucgugugugugugcgugugcgugcauuuucauaugaagcugaaaauuggccuuuagagaucugugaagaauguguuggaauuuugauggggguuacauuaaauguguaaauugcuuuugguaggauagccauuuuuacaauauuaauccuaucaacaaaugaguaugggagaucuuccauuuuuugauaucuucauuuucuuucuucaaagaauugaagauuuaucauacaagucuuucacucccaugguuaguuaccccaacauauuuuauauuauuuguagcuauugugaacgguaucgcuuuccugauuucuuucucagucuauuugccauuuuuacuacucuguauuaggaggguuaauaauuucaguuaaucuuguaucuagccgcauugcugaaaaauuuuuaaaucucacuagucgaucccagugggauuuuuagggucacuuauguauacuaucauaucaucugcuaauaaagauacuuugauuucuuccuuuccaauauauuuccuuugaucuuauuagauugucuuauugccguagaaaacuuuaauagcuugaauagauuuggagaaaguggacagccuugucuuguuccugauauuaguggaauuguuuugaguuuuucuuaauuucaguugguuauagacuugcaguaaacugccuuuauuauuuugagguacauccccuaucucccuaaucucuccaggauuuuuaucaugaaugggguaguagauuuuguuaaaggccuuuucugcaucuaugauaugaucauguggcuuuugucuuuccaauuuguuuauauggaacuuccaauaucuuuuauauuggcuaaaaccaccuggcccugggcuuuuuugguugggagaauuguuuuguuuugugaaacaguuucucuguggaacagcccaagcucuccuggaucuuucuuuguagaccagacuggucuugaagucaaaggggcccaccuuugccucccacgugcugggauuaaagaucaccacaaccagcaguugagagacuuuuaacgacugcuucuauuucacuaaggauugguuauauguuuauuuaaauugauuuucugaccuugauuuaauuuuguuaggugguauauaucaacaaaauaauucauuuguguuagauuuuccaguuagguauggagugcauguuuuuaaaguauguccuucugauucuguagaucuucucagugucuguuguuaugucccccuuuuauuucugauuuuguuaauuuagauaguccugacuuaguuacuguguuuuuaugcuagcaucuggguuugggaagauuguaauucuaggugcugauauugggggucuuguauucuugauauucuaggucuuguuuuggggagggggugccuugguuucuguuuccucucugguucuuaagagaguguacuggcuguguguugccugggaggaaauucuucuaggguccugguagguguggccacuggguguuccaucuaaaaaguuuuuggguauugggagcugacaauuaggaauggggagggguggggggcaucuaccgguagaaggaaagcagcaugcuccuucaggaucugcuuagucaccugggaaaggggcugagugaggaccggccacagcaggagcucuacugcacagcuaaggaugagccuggggugcugggcuuggaagaauggaggaaaaggugacaucugcaauuagccuacuuguuucccuagaguggcuuguggauucccaaggaggaccugcuggaguuggaggcuggaauaaaacaacugggugggaagagggagguuaggaggagaagaucuguaggauccacuagcaaugggggcaggggcugcaacaguggucuccuggagagcugagaaugagacuggggacugaaugugaaagaccugagggaugggaagauguauaaaauuaucuuaccuguuucccuggucagacgggccagagggcucccagagaauguuuauauauguacuuuugagacagucauggcuggccuggaacucaguacuagaucgauuggucuaaacucuuagaaucaaagcuuccugccuuugucucccaaaugcuuaggacuggaucuaacaccucccaagggaccauuacuauuuaaaugaaauuuucuaaaugggggguagugguggggugguggauggguggggacuucuacguuuagaacaguuuguaucagcugccuggaugccacagcugcuauuuuuaaauauacagaggaaaugaagagaacuguucaauuacuucugcaucauaauuuaguggguuaaaacagcagccaugaguucaacccaguuuuguagaguguaagccugaguccuguacuucagaccucagagacucaaguugaauggucagcugauggcauucuuaucugaggcucauucuaguuggcuuucaguuuccuguagcugaagaauccuuaggacuucuauuuuuuucuucaacauuacauuuuaauguuauucuuuuacaucugauauuuugccaugguuuuguggaggguguuuuguuuuguuuuguuuuguuguuuuuguuuuacucuuagauaguuuaccuguguagcuuuggcuggccuugaacuagcaauacuugugcuugggccuucuaaguaagcaaucaccauaccugggaagaaacuuuuaaacuauuuuuguagagcaaaaauuuuuaaaauaaaucuuuuuauuuauuuauuauauguaaguacacuguagugugucuucagacacuccagaagaaagcaucagauuucguuacggaugguugugagccaccaugugguugcugggauuugaacucaggaccuuuggaagagcagucggcgcucuuaaccacugagccagcucaccagcccaagcaaaauuuuuuuaaguuuuaagcaaagccuguggugcaccagaccucuggagacagaggaaaguggauuauuucgaguuccaggccugccaaagccuuuuuuuuuuuuuuuuuuuuuuuuuuuuuuugagucacaguaagauugagaagaaaagaaaaugcagacauuuaccauauauuccuugucucugucucacacuuggccuccuccacuaucaacaccccacuauguaccuguuacagcugaugaacccaaacucagacugacaugucuugucucuccaagucuguagcauagauagguuugcacucaguguugucaugagaaugcucuaucucuuacuguaguaucacaagguacuuuaagcuacccuaaaaaaccucaauucuucaccuguucaccucacccuuuuuuuuuuuugcuccauauuuugaccuuuuuuaaguuuuuuuuucccuuuuugccuucucuuucuuucuuucuuucuuucuuucuuucuuucuuucuuucuuucuuucuuucuuucuuucuaaaaaaauuuuauuuauuucauguauaugaguauaccauugcucucuucagacacaccagaagagggcaucagaugguugugagccaccauaugguugcuggaaauugaacucaagacuucuggaagagcagucauugcucuuaacuacugagccaucuuuccagcccccauauuuugacuuuuuaagaaugccacauaauuagaaucauuuguagguggcauuuuccaggcaaaaguccucuguccucuaaguagugcucuguugucugauuaaaccacaguucauuuguucaccaacugcaggcugcccgggcugcucucaagcuugugcaguugugcaaaaucgagcuuccauacacauccauaugucuaauuuauguggagagauguucucagcuccaguguguaaauaccaagaggcaugaaggacuguauaaugaaguguauuuaguuuauaagaacuugacugucuucaaaauggcuaccccauucuacauuccccaguguacuuugaugccucugugagaggaggucugucacugcuuauauccaucuaguacccucccuaaucagcuaaagucuuagcacacacacagcagccacuaggcaggguggggcaauagaaaacucuuauccaguaauuuacuauuaugcuaaacauaccccucccucugaguuuagagaccuccuccccucacgucuguaaaggcaucuccuuuguucuuggcucuuuuguaccagcuuccuccuuuguagguagccaguguuacuaaaggacugguuaccugaaguugucugggcacuucuacggaaccuggaaagauuauuucaaacauccaccagcugagagcuacugucuuccaccuccuuggagcugcguucguggccaguugucugaaugguaucucaguguuuaauaugugcuucuucucuaaggacaugaauuuuuucaucuguguuuguuuacugucagcuuaucuuuccugggaaggugucuuuuagcuuuuggcccaguuuauauuauuuucuuguuuauuuuuagggauuccuugugcacuguggguaacaguaccucaucggguaggucuuacacaagugcuuuuccugucugugggcucauucuucuaacaguaccauuugcagagccaaugagucucuuaaaagcugaagcuggccuugaacugaucuuucugccuuugcugcacaaguuuaaauucaggcauguaccaccuguacccagauuaauuuuuacuuuaaggaaaucccacuuauaaguucuuucugcuuggguuuaagccuuugguaucuuaccuaaaauacuccaggucguggagauuuucugccguguuaauuuuuaguucuauagauguuuuuuguugggggguacauguugcauuuguuugugggguguguaugugugaggacaacuugcaggaauugguucuuucuucccaucauaugggccccaagaucaaacucagguccucggguuuggcaguacuuuuacccccaccccuagccaucuugcuggccccuucaguuuuuuauguaugccuauuuugagacaaguaucucgaaggguauaaaguccgugucaaagucuuuuugcuguagugaugacuuuucccccaccuugugacuaucuaguuguuccacguaaauagggucucuucucuguuguggucccuuugcuccuuugucaaaggucauuucagugcaugcauugcuguauuucugggcucucuguucuugugccagucaguuacugugugguaagugaugccccuuggguacucuuuuaguaccgugaugguucuucugggucuuuuaccucaguauacaaacuuugauucaguuugucaaagcuacuaaauaacuugguagguuugucuucuuuuguuuuuguuuugugguuuugagaccaagucucacuauguagcucugacuggccuggcuggaacuuacagagaucugcuugccucugccuucagaguguuuuaagggcucaccugagaaagcaggccuuauuuaggaaaacuuuccuuuugauugacuuagaugcagcuuaauuauguaugcaaaagucucugcccuguaauaaaauauacaggagccaguacccuucuuauuuagcacuuuguucacaaaaggacagauacaagacaugcauaccaggaagcagucuuggaagacaucuugaaauucuucaagugagcacuuucugaauguggaacauuugacuaaccccaccuucaaguuaugguauaguacaagauaccuuugcaugcuaggccagugcucuuccauugggcuaucaccucaaacgucuacauuuuauuuaaagaaacuaaaacucgggaacacgaagccauuugugaaccugguguuugguuuguuuacauccuguuaagucuccagauucugccaguuguuguuuuggugugaaagacaggguuuuucuguguagcucugccugucacucuguagaccucaacuuggagacccaccggcuucugccuccgcagugcuggaaucaaaggcgugugcuaccacuguccuucaaauucagcauuauugugucuaauaaccuaucuuauugauagguuguuucuaugacaguaaaauggaccauuucaaaccagauuagauuauaugugauagguuauuucucugcuuuuggugaaaugaaccaauuuaaaccagauuagauuauaguaaaggcaaguuucuugggaagcugcucucaggcaggcaaguucauuggccccaaggccaagggagucaccauggggaaagauggggugggggaaggagagagaaaguggagagauaagagaagggggaggggagagaaaccaaaaugucuggauucuauagggaggagccucugggggagugcaacccagucccugggcugaaaaguucaggguugggggggaagggcaugcaaaguagggaaugugggacgcugggagaacccggaggccaggucugcuuugguauguaaaauaugcauacccugagucagaaaccaaacaauuuguaggcagguuuuuuuaggaagcuguuuuugggugaguucacuggcccaggacagaggccagggaagucaccaugggggugggggagaaagggugcuuaugcggagaaagaaagggagggagggaggugaagaauagagugaucgagggagagcccaaaagauguggauuaucuagggaagagccucuggggaaaggguagccacucccugcacugaaaaguucaggguuggggguaggguguaccagguagggacugaggaaugcugagagaaccuagaggccaggucugcuuucauaugugaaagguucaccuagguccuggggagcucugcaaucggcccucagucugcugaguccugggauuauagaugugaaucacccacccugguuuaaacuuacaacauguaagaaaagcugucagguuuugugugcuuacucaagaucaaccauguagcauagcuggguaagagguggugggccuuuaaaggcaaaguuccacguguucccuacaguugauguucuuccagaaaggucugagauucaaacucauucuacuacaccauuacccaguauaauucuuugguaaauaccaguuuguuuacuauuaaaaugaacaaauuccucuauaacaggggaauucaguacaugugacuuuggacguugaccaaaaauuaugauugauuaugaagguacuucauaaaguuguuaagcucuaaguggcuuugaggcaagggggaagcaacuauuguacuguguuuagacagcauuguuacaaacccuaaugucucuauuuagcagugagauagauuacgcaggagggaaagaucgggaaauguacacauuauuuuggugggagagggguuuagcaugcagauagguuagcaugcagauaggugaggauagacucaugcaaguucagguaaguguugagcaagacaguaaagaacgcuuauguuguuauuuggguuuuagucacaaaucugacccuuaaggcaaagcccauaacuuugaaagcaugaauugaugcuuugugauggucauuacgcuaacuauaaaaggggcucuuaggagaucaucauauuuugaagcuucugcaugaaguagagaggguuuuaguugguugaugguuuucccuguucuuucauuugguuuugagcuucucagguuuccauugguguuuuguugagaaaagccagauugaaaacauuggguggcacaccccuuuaaucccagcauugcaggggcagaggcagauagagcccucugaaauggaaaccagccuggucuacacaguuccaggacagccaggaauacacagagaaaccuugucuggaaaagccuaaaaagaaaaaaagaaauaaagaaaaggaagucauaugauucuccagcaugagagaauuagucuccuccaaagaagauggagaucuuauuuuguuaguacuugaugcuuaaagaaauaugcaacaugggauuuuuacuuaagaaucaaaguauucauagaugcuuagcaugugacuuuuaccuccaaaguuaaaucugauauuaaccucuguauaauaaguaacauagauuaaaaauuaaguuauccucuucagugaggcauaaauggaacuccucugugacuggagaauguuaaauauacuacuuggguccuaaucaauuuuugcuuuguucuauuuucuuuauggcucuagccgaaaaagaagaacaugucugccuaccagguauucuguaaggaguaccggguaaccauuguggcugaccauccagguauagguaagaaccuuucugagcuuuggguuuuguuugguuuuuugguuguuuuguuuuguuuuuacuuucuaguaucugaagcagugcguuugauuaauucgaucacuaggcagcuucacccuauaacauuagaauacaaauugaaacuagcugcaguggcccauaaugucaggaaagcugaaacagcaaccacagccuagguuacaguaugugccccugucucaaacaaaagauaaauguauuuccucaguucugcaaauccuuucauuuacccuguauauuguuuguuuuuguuuuucgaaacaggguuucucuguauagcccuggcuguccuggaacucacuuuguagaccaggccggccuugaacucagaaauccaccugccucugccucccgagugcugggauuaaaggcgugcgccaccaccacccggcaaggcagggucucuuauuuagccuagaacucaucuauucugcuaggcuagagggcuacugaacuccaagguuccuuguauuucugcagugcuaaaauuauagacgugcacugccacaaguugcuuuuaaauucuuguaaaauuuuacauuuacaauuuuggggaaucugaauucaaguuauuaggguuauguggcaaguacuauacccauagagccaucuucuuaguauguauuucuuaaccaauaaaagaggaaaguauaggggacuggcaagauggugcagugguuaagagcgcugacugcucuuccaaagguuccgaguucaaaucccagcaaccacaugguggcucacaaccaucccuaaugaaaucugaugcccucuucuggaguaucuaggacagcuacuguguacuuacauauaauuaauaaauaaaucuuuaaaaaaaaaaagaggaaaguauaaauuaaauagauauaagagccaggcccucuauaaccucugguuagggagacuaaccuaaaaagaucacagguuucagaccaaccugggcuauauagcaagaucuugucucaaaagaaacaauguaucauugcaccuaaauaugcaaaauaugcuuuuuauuucuaauagcauaggcuuuuccuugaauucccuuucaucuguacuguaguguuaguucuugucugugcuagcacuuagaugggcagacaccagccugaccuuacgcaguucacuuuauaucacagucgccuugagcuuauguagaaaaugacuuuccacucuacucugcaaaggugcugugaaaauuagacauugccaggcauggugugacacgccuuuaauccuagcacuuaggaggcagaggcagaugggucucuugaguuugagaccagccagggcuauacaaagaaacccugucucaguaguaauacaagaagaaaucugcuccacccauccuuuucuagugucugcuuccccagacuucuguuuucuuacaguucuguguuuuuguuuguuuguuuguuuuuuaacucuuuuuuaucagauuuuggggaacuuaguaaaaaauuggcugaaguauggaagcaguugccagaaaaagacaaacugguaaguauauuuuauuauguagguuucaauguguuuuaccugccagucacacaacccugagacagugagaaagaagcaauagcaguaguuagcagaggacauggccacuguuauuguuaggcuauucuugcuauaagaagacugccuuuuucuacuggugucuacuuuuuguccccaaaccagacuuaaauaaaauaaaaagacccugguugauuaaaauauuccuaaaagaaaaaucuaaaguuacagugcccuacugcaagugccagucagucauagucuuagggacugacaaccaucaccuucuagauugcuuuagccagacucugggucuccauucucaucaaccauuugcaauauauucuaugaagaacuaauaagacuucuggguaugggcggcucaugcuuauaauuccacugcuuaguagacugagacauaaagauugaagauuggccagcucaggaugggggggcagggagggagagauagauauaaaacaagucugucuuaaaaaaaacaaaaagaaaaguaguagagccagugauagugaagacaauaacaguuaggucugauucauguagucauaucccagucaguguaagugguaguuauggcaucuuaggguuucauugcugugaagagacacuaugaccaaggcaaacaauuggggcuggcuuacaguuucagagguuuauuccauuauuaacauaucagaaagcauggcagcuggcagacauaguguuggaggagccaaggguccuacaucuugaccuaaaagcagagaggaggagacugucuugcgcguuucguggcgcuugagcacuagaagacuucaaggccugccuacacagugacacacuuccuccagcaaggccacaccucuuuacuaguacuacuuccaugggccaagcauauucaaaccaccacauacgggaacaagaauuaucauucuuacuuugaagaauagcuuuuuaaaauaaaaguaacucuuuuccacccagaugauucuugauagcuugcuguuuuccauugccaggcaaguuagaggaaguggcuagccacuggacauuacuguacugagccagauuuuccgcuguaugaccuaccuacauguaaccuuagaguauuuuaacaguacugagacuugacccuuggcacugaagaaugggugcuuguaguccugcugacuuuuaagauaucagcucaccagucuugaagcuacuaagauucaaaguuacuauuugcccacucuccaccuucucccagcuccuugcucccuuucuguuuccucuuuugccuuucuuaauucugugugggugaucuguugcagaucuggaagcaaaaggcucaguaucugcagcacaaacagaacaaagcugaagccacaacugugaagagaaaagcauccagcgcagaagguuccaugaaagucagagguagcagacacuuuucucuacugcuuugcuaggaggccgggagagcagacagcuuauaauagaaguaggccuugauaccuacguauuacugaauaugacaggcuacauaaaaguaguucaaauuuagaaacuguaagaagucacagacuucgcuaaaaagauccagaaaguaagccagggaucaggccuucugccuccauguaaugcaacaagcaggagaaugcaaguucaagccuuagcaacauagcagauguaguagacaagucuggacuacacugagacuacaacuucuuuaaaaauaaaaaggauccagaaagugaauguuacaaccuuuguguguuacaugcauucccagucacacaugcaugugguuuguuuuuguuuguuuguuuguuuguuuguuuuucuuacagcccuuuaauguauacagcuaggggcuagagaaauggccccuaugguugagagcacuagcuguuccugcaaaggaccaggguucaaaucccagccucugacuugcucacagcaggcuauaacuccagcuccuggagcuacaaugcccucuucuggccucuaugggcaaugcauucauguggauagguuagcuaauaccugguacauagguuucaagagggaaaacagucaauauuguugacauugagggccauaggcaaauuuucauccuccucuucucagccucuucuguaggaguacugucaccccaaaagaaguccccacccaccacaaugcuuuugccagccucaccagccaaagcuccugaaacagagcccauugaugucgcugcucaucuccaguugcugggagagucccucagccucauuggacaccgccuacaggagacagagguaagcaccacguucaauggcaggguuccuguuucuuaggaugcuuagaucuauguuuauuuaaugagcaacuacuuuauguaaaauuaugccauggaacccacaguguggugaaaauuuucaaaagauuugggaguuuaccuaucugcucucagaguuuaugguuauaccauccuguagaaaguguugcuaaaagaagucaagauaccuguaguuagguuuuagucuuuaaaaguucaguagaaguguuagagagauggcucugcuguuaaaagcacuggcugcucuucccaaagaccaggauucaaauaucagcacccacaaggaagcucacacacaaccaacucugaucuggugucuuauucaggccuacuuaggcacuacaugcauguggggcacagacaaacaugcaggcaaagcacccauacauauaaacuuguuguuuguuuuuguuuuucaagauagaguuucucuuuguagcuuugacuauccuggaacucauucuguagaccagacuggccuugaacucagagaucugccugcuccugccuccugagugcugggauuaaaggcaagcauuacugcugccaccaccugguucauauaaaauaauucuuaaaaaaaauuaagugggggggcgggggggcuagagagauagcuuagugguuaagagcaaugacuguucuuccagagauccugaguucgauucccagcaaccacaugguggcucacaacgggauuggguauacucacaugcauuagauagauagauagauagauagauagauagauagauagauagauagauagauagauaagucuuuuuucuuuuuuuucugagagagagagaccuauaaauuaaauguuuuaaaaaaaauuaaguagaagcuaggcauaccagcucagcccccuaaucccagaacuuaggagacugaagcacaauuccugcaaguucaagaucagccuggacuacaguagacugaaauacuguuucaaaaauaaauaaauaaaauaaagaagccagaguaaauuaaaaugugaaaagcuuaguugacauccugguacuuuguaagaacaggauuguucagugucauuucuguaguuugaauggucagacaagauuauauagggagaauagcucccaacuuucucugaaaaucauagcauucagaagccagaggugggaggaggaucucaagugugaggucagcuggggcuauacagugagacccuaccuuuaaagaaaggugcuagggaaaagcucacaggggcuaacccuacacagaaaacuacaggcaacuaaggacugcugaaaggagaagaaauagucuuccucagggaagagcacaccauucggauauccaauaccaaagggucagcucugagaacacaccaguaauauagaaaccgagcagauuguaguuauguguuuaggagaaaaauacacaccugcaccccuauaugcauuacaacaguuauugacuuuuuaaaaggcuaugaauuugagggggggcaugggaggauuuggugggaagauaggagagggggaaaugauguaauuauauuacaauuucaaaaaaugaaagauauauauucaccuuaaauaucagcacuugggaaacagaggcaggcagaucuuugaguuugaggccagccucuacauaauuuuagggcagccaggcuacacagaguuugaaaaaacuaaaugaaaaagaaagugggcuggaauaagggcacagcugcucuccagcagacacagauuuaauccccaacaugccguagacccucugggccccuuugucugcguggaacaggucucuagucucagguggacaaagcgucagaugaacugacagauagauguacacaggagagguguuggaucugaauguaauguuaaaucgagcauuagacuuuuuauguagaagacaauaaggaacccaccagcaagguacaaagagguuacuggauucuuacauaaaacagaggaaugcaaacacagaaggucuaacaggaaccaccugggauagaauucauuguuaacaacugggauaaacaagggcucuaccuaagauucacuuaaucuuagaagccagggucaagggcuuugugcccuugccauaguuccaguuuuagucuauuguauaguccaccuuccccuuaggccauuguaaauacguguguauggguguaacucagcuauagucuuagaagccaggugugaggucuuuacucuccuagggcaagggcuuucacacccaagucuugguucuaacuagggaguuccguucuagcuaaccaucucaugaauaauguaauacucuaaaaccaagcccgaucuacuuccuaaaccauuguaaauuccuguuuaugggagugacuuagcuuuuauucaaagugauaguguauuacuagaggcuauucugauuaucaacauucuuacugaauuuuaagcccauggucuugcucaaggacguucuaggacuguuggaacacuggcggaaggcuuuagcuaugucagaauuuaaucuuaagaggcauuuauaauaggguaauacuaaaggagagcacguggauccauacacuagacuaacucgggaauggaaacuuaauguauggguuagagauaaugccagacuccaggagcgaguuucuaugaaacuuuuugcuucaugagcagcauuuaggcaucccugccugacaagcugacucgacuggagugccguggcauuucucucuuucuuucggcucacaaauguccauauugccaauuccagggaauccaaacacccucuuuaaccaagcacaaacauaguacacagacauacagucuuuuggugcuguuuaauuaaaacuaaaggaagaaaagaauguagacaauaaauggagcuguagugugcauuuagguuguacagugcuguggaccugacagaagucuauacuucugagauuuaauuucagaggguucauuucuaacucuucugccccuuagcuaacucaguaguauggcaguucaguuuucagccuggagacauuucagcaaagaaauuauuauaugcuacugaaaaacauuuuuaaguuagucaguguagaaauauaaaagcuaaugacuuguauuuaugcaaaagcuaaauuaccguucaacagacaaaauggcaaaagccacagguguugaaucuauaucuccguucuuaggcuauuuucuaaaaagucaguagauguugaaaaaaaaaaaaaugugugcauucuuauaaauauucaaauaccuggauagguaaaaauauuuccagaauaacauauacagugaucuuuauuguauuuucacauuaaaaguugaaaauuaaaugguuuuauguaccauucauuuuccagauuuuccaaauaguucuuuuuuauuuggcaagaaguuuugaguucuuaggagauuauuccaaaaacuuacuuaguagaaaaaucuaaaugucuauuuguugucuuagggaugcuuacagucuaacuggaaagacaauucuuaugugauuuacaucuuacacacauauauguaagagcugcuuugcggguuugcauauacaccacaggcuccagccacucagcugcaugccuaaaaccacaggcaucacuuacaccucuucagaaacagugauagcauggugcuugaccugguaccagagacggcuacuagaacuaguaagcagauugcccaugcagcguggacauuauuaaugacaucaugcuauuccaacggcauacgugcaguuuagaauugggaauugaagcugaguggcgagcacaccuguaaccccagaaaauaagaggggaaggcaagaggaucacaaauuugaaaccagcagcaauacauaaaaacaaacaguagcaaaccccuuccugccccaaaauccugagcaacugcaaccaugcaaggggaaacugaauuuaaggggugguuaccauaaccagaaagggaaaaaaguucacacauucuauuagcacuuaucuucuguaacagucuucauaaauguuuaaugcgccaaaaguucacccuuuuaucacaaugcaggacuaguggcucuuaauacucuacacaguuuugaacccauaacuaucuaaaacauuuucauuacucuagaaaguaacuucaagcccauuagcagucauuucucauugcguaugugcugugugcaguccuuguaguacauagcccacacaugagaaguacaagaaugcaguguccauggaggccaaaggagggcguccauucccuggagcugaagucacagggaguuaggaacuaccaugugggugcugggaauugagucuucuagaagagcagccugugcucuuaacuccugaaccaucucuccagucccaugauuuuuaucuaauacacugccuaguggauauuaaaauaguugaaguuccuacaugucacuuaacauaugcauaccacacuuucaggaauacugauuuacauaacucauuaauguagacauuaaauaucugagccuuguuaucacaaauuuacacaacugucaguaccaaaaauagagcucaacuguccuuccccuccgugagcagcucuccuguuaguaauugcuguuaguaauuacaagacuuaaagaacagugccaccuaagcauagcacuauaguucugcaugccaggaagauggcugagugucucaaaagugacuucuaggccagcuugagcuaaaaagugagagaaaaaaaaaguagugugccagguuagggaugccaaaggccuagcagaagggagugggauagauaacuggaaagagaaguugcaaacagaagacagcacauuccuguuaacccuggagucuuuugcagaggucuguugaggcuuuaagugggucuuaagaagagucuuccugguuaacuguuacagggcaggcauacaacacauaagguaggaagaggaggugagcaucaaagccaggugucuugguggacacugagguauuuguaguuccuguuuuggaacuguaggggaguuuuugaguaggacggguguaauuagaguuccuauuggccugagaacaucuauuuuagauagugauugaaagaagccagcaccgggaagaagguacagcagcaaugucguguagaggugguagagacucgugguuauugagaucuugcuugguuacauggagugaaucccgguagccuguggguccagccucucacggguccucugcugucuccgcacacugccgucuuaguguguuauugagaggacauaaaggagcgcugaacagagagcaacugagagugugacucaguugucugcuuuucuugcagggcaugguggcagugucuggaagcuugucagugcuccuagauuccauuaucugugcucuuggcccucuggcaugccugaccacacaacuaccugaacugaacggcuguccuaaacaggucuuggugaguuuuuuuuuuugugguggcggugguggugguuucccuuaccuuuggagggcuggagccuuugggagccuuucuaccccuaccuuaaugagcacugcccagcacuccucaugaggugaauagcacuauuacauacuguccacagaccaugacacuguguaucagcugcaugauaugauuucagugaaacuagaaaacaugccguuuuucacaacacuacucuggagagagcaguccagcuuagcccuugaggagccgcagcugaaagcagcucguguguuuuguccacuuguucccaucucucuccugagcaugccuugucucggggacugcagugaggugugccacagcugaguccuuucuccuuauuuacagucaaacacgcuggacaacauugcauacauuaugccuggacugugacuuccaagacgccugggacagaagacugucuaccccuucgcuagucuauguauagaugacuguuccagacccuccacugaccucuggguguagguuuuaaauuuuuauaaucuauauauacguauauaauguacaguauauacauaggauauaacuacuuugcuuuuaauaauuuuaugaaauggcaaagguuuagcuaaaaggaaacuuuagcaugaaugugggcuuggaauuauuuuuuugugaaaaaaaaaucugccuuaaaaaaaaucaguguaauuuggggacuaggggcuuauucugggugccauguauaucuccucauagacugcuaaaaugugauuuuuuuuuuuuuuccaagcuuggguuuaccuccagacccaucacugaccauuugccuuaccugucuuauaaucagaaauguaguaaagaucuugggaggaggccagcugacuacaaacuuuuggacauggaguaaccuggguggggagguggagcuuagguggacuggguaggggacucauuccaauuccuacuaaagagauaccugugucuccaguuuuauuguaaccacgguuccacagagucaucgguaccaucuauagccucagcuaugugauucuuggcagcagagaaauaaauaccuugcagaaaccaaagcuguuggugccaccuguugaaccugcuugucuggccagcaaggcuugguguauaaaaaccaaagcugccaucuuccacuagcagcauugguugcccaacaaauccugaggauucugcugcuuagcuguuuggugguucuugguucagcucugguuccccugguggguacauugugcucugcauuccacacagagcuggaucacaaagaaguucuugguucucaggaggguuaucuauaugugcgugugaguguauauuuuaauuauguguauuuaacucuuuagaauuucuuagauuuuaauuuauccuguaaauuucuguauauauaauuuaauaacaagccuccaccagcaggagcauguggagcauacagauuugucauuucuuaaugucugucuaaaagcuccaagacguccauauguuaagguguugugacucagaaaggaacuucauggcccucaauaauguuaggaaagugaaauagaaaggaaugucaccauuccuaauuucccuuauucccaaagacccagaccugcuuccccauuagagagaagauagcugagugcuccaggguugcuugggaacucggugagagauucccuucccugccaaaaccaagcugaguuaauaaccaugcuuucuucuaauggccuggauggaacgaggcagcaucacaguaaaccuuuggggaccauguagccagcuggcauccuagggaacuccuucccauagcccgacugcugucacagcuaagcuucucacaggacugugucagcucagagcaguuuugagauuuaaucugagaaauagggaaaggaacagaaauaugugggaacugaaaucaagcagagcagaaauuuccauuugaguuaacaugucagaaccucauuugacccugcagaaguuuccugugagaaaugguaucaaggagaggccagggaagacaugugugguagaggaagcagccaguccuccauugcccuugcuacagacaguagugaacuccuaaggagaaccggcuuuuucggguuuguuuuccucugaagccuagcccuguuguauuuguauuaaagauuuguacacauuuguauaauaaucuguaccuugugguauuugguacuauuagaggaaaaauuuuggauucaggccuucuugcuguuuuuauaucauuguuuuauuuuguuuuuuuaaauaaauccuagugguuugauccaaauccuauuacaguuguauaaagaaacaauauuuuguacuuauauuaaagaucucauuuuuaauauuuauaguccagucuuagcugucuuuucccuaauugggcuaaucguagucgguauaacucuacucuacccugacauuucucuauaagggagugggggcugaagagaugguucacuggugaagaauauuuccugcccuugauaaggacccaaguuagaucccaacacucauccaauugaauguaacuccaguuucagaggaucagucacccucuguagccuccuuaggcaccagcacacaagugcauauacccacacagagguacacacacacacacaaacacaaaauuuaaaaauuuuaaaaccaaauccugaaauaaaggucaaguuaccauguuccuaucuauccugggccaugcagcccuugggucucagguugaacacaccuuauauguaaaggcucucaaauaucauuugcauguauuauaaaaggagagaauaugauaguuguggcauagcaaaugaaaccauuuaaaauauugcuauuggccuaaaucaaaaaguauccaucaaucuuuugucagaguugcaugaaaauucuaugccaaaaaacagacaguucauaucccagg

SEQ ID NO: 4540 - RNA, 39188 nt, Mus musculus
ccugggauaugaacugucuguuuuuuggcauagaauuuucaugcaacucugacaaaagauugauggauacuuuuugauuuaggccaauagcaauauuuuaaaugguuucauuugcuaugccacaacuaucauauucucuccuuuuauaauacaugcaaaugauauuugagagccuuuacauauaagguguguucaaccugagacccaagggcugcauggcccaggauagauaggaacaugguaacuugaccuuuauuucaggauuugguuuuaaaauuuuuaaauuuuguguuuguguguguguguguaccucuguguggguauaugcacuugugugcuggugccuaaggaggcuacagagggugacugauccucugaaacuggaguuacauucaauuggaugaguguugggaucuaacuuggguccuuaucaagggcaggaaauauucuucaccagugaaccaucucuucagcccccacucccuuauagagaaaugucaggguagaguagaguuauaccgacuacgauuagcccaauuagggaaaagacagcuaagacuggacuauaaauauuaaaaaugagaucuuuaauauaaguacaaaauauuguuucuuuauacaacuguaauaggauuuggaucaaaccacuaggauuuauuuaaaaaaacaaaauaaaacaaugauauaaaaacagcaagaaggccugaauccaaaauuuuuccucuaauaguaccaaauaccacaagguacagauuauuauacaaauguguacaaaucuuuaauacaaauacaacagggcuaggcuucagaggaaaacaaacccgaaaaagccgguucuccuuaggaguucacuacugucuguagcaagggcaauggaggacuggcugcuuccucuaccacacaugucuucccuggccucuccuugauaccauuucucacaggaaacuucugcagggucaaaugagguucugacauguuaacucaaauggaaauuucugcucugcuugauuucaguucccacauauuucuguuccuuucccuauuucucagauuaaaucucaaaacugcucugagcugacacaguccugugagaagcuuagcugugacagcagucgggcuaugggaaggaguucccuaggaugccagcuggcuacaugguccccaaagguuuacugugaugcugccucguuccauccaggccauuagaagaaagcaugguuauuaacucagcuugguuuuggcagggaagggaaucucucaccgaguucccaagcaacccuggagcacucagcuaucuucucucuaauggggaagcaggucugggucuuugggaauaagggaaauuaggaauggugacauuccuuucuauuucacuuuccuaacauuauugagggccaugaaguuccuuucugagucacaacaccuuaacauauggacgucuuggagcuuuuagacagacauuaagaaaugacaaaucuguaugcuccacaugcuccugcugguggaggcuuguuauuaaauuauauauacagaaauuuacaggauaaauuaaaaucuaagaaauucuaaagaguuaaauacacauaauuaaaauauacacucacacgcacauauagauaacccuccugagaaccaagaacuucuuugugauccagcucuguguggaaugcagagcacaauguacccaccaggggaaccagagcugaaccaagaaccaccaaacagcuaagcagcagaauccucaggauuuguugggcaaccaaugcugcuaguggaagauggcagcuuugguuuuuauacaccaagccuugcuggccagacaagcagguucaacagguggcaccaacagcuuugguuucugcaagguauuuauuucucugcugccaagaaucacauagcugaggcuauagaugguaccgaugacucuguggaaccgugguuacaauaaaacuggagacacagguaucucuuuaguaggaauuggaaugaguccccuacccaguccaccuaagcuccaccuccccacccagguuacuccauguccaaaaguuuguagucagcuggccuccucccaagaucuuuacuacauuucugauuauaagacagguaaggcaaauggucagugaugggucuggagguaaacccaagcuuggaaaaaaaaaaaaaaucacauuuuagcagucuaugaggagauauacauggcacccagaauaagccccuaguccccaaauuacacugauuuuuuuuaaggcagauuuuuuuuucacaaaaaaauaauuccaagcccacauucaugcuaaaguuuccuuuuagcuaaaccuuugccauuucauaaaauuauuaaaagcaaaguaguuauauccuauguauauacuguacauuauauacguauauauagauuauaaaaauuuaaaaccuacacccagaggucaguggagggucuggaacagucaucuauacauagacuagcgaagggguagacagucuucugucccaggcgucuuggaagucacaguccaggcauaauguaugcaauguuguccagcguguuugacuguaaauaaggagaaaggacucagcuguggcacaccucacugcaguccccgagacaaggcaugcucaggagagagaugggaacaaguggacaaaacacacgagcugcuuucagcugcggcuccucaagggcuaagcuggacugcucucuccagaguaguguugugaaaaacggcauguuuucuaguuucacugaaaucauaucaugcagcugauacacagugucauggucuguggacaguauguaauagugcuauucaccucaugaggagugcugggcagugcucauuaagguagggguagaaaggcucccaaaggcuccagcccuccaaagguaagggaaaccaccaccaccgccaccacaaaaaaaaaaacucaccaagaccuguuuaggacagccguucaguucagguaguuguguggucaggcaugccagagggccaagagcacagauaauggaaucuaggagcacugacaagcuuccagacacugccaccaugcccugcaagaaaagcagacaacugagucacacucucaguugcucucuguucagcgcuccuuuauguccucucaauaacacacuaagacggcagugugcggagacagcagaggacccgugagaggcuggacccacaggcuaccgggauucacuccauguaaccaagcaagaucucaauaaccacgagucucuaccaccucuacacgacauugcugcuguaccuucuucccggugcuggcuucuuucaaucacuaucuaaaauagauguucucaggccaauaggaacucuaauuacacccguccuacucaaaaacuccccuacaguuccaaaacaggaacuacaaauaccucaguguccaccaagacaccuggcuuugaugcucaccuccucuuccuaccuuauguguuguaugccugcccuguaacaguuaaccaggaagacucuucuuaagacccacuuaaagccucaacagaccucugcaaaagacuccaggguuaacaggaaugugcugucuucuguuugcaacuucucuuuccaguuaucuaucccacucccuucugcuaggccuuuggcaucccuaaccuggcacacuacuuuuuuuuucucucacuuuuuagcucaagcuggccuagaagucacuuuugagacacucagccaucuuccuggcaugcagaacuauagugcuaugcuuagguggcacuguucuuuaagucuuguaauuacuaacagcaauuacuaacaggagagcugcucacggaggggaaggacaguugagcucuauuuuugguacugacaguuguguaaauuugugauaacaaggcucagauauuuaaugucuacauuaaugaguuauguaaaucaguauuccugaaagugugguaugcauauguuaagugacauguaggaacuucaacuauuuuaauauccacuaggcaguguauuagauaaaaaucaugggacuggagagaugguucaggaguuaagagcacaggcugcucuucuagaagacucaauucccagcacccacaugguaguuccuaacucccugugacuucagcuccagggaauggacgcccuccuuuggccuccauggacacugcauucuuguacuucucaugugugggcuauguacuacaaggacugcacacagcacauacgcaaugagaaaugacugcuaaugggcuugaaguuacuuucuagaguaaugaaaauguuuuagauaguuauggguucaaaacuguguagaguauuaagagccacuaguccugcauugugauaaaagggugaacuuuuggcgcauuaaacauuuaugaagacuguuacagaagauaagugcuaauagaaugugugaacuuuuuucccuuucugguuaugguaaccaccccuuaaauucaguuuccccuugcaugguugcaguugcucaggauuuuggggcaggaagggguuugcuacuguuuguuuuuauguauugcugcugguuucaaauuugugauccucuugccuuccccucuuauuuucugggguuacaggugugcucgccacucagcuucaauucccaauucuaaacugcacguaugccguuggaauagcaugaugucauuaauaauguccacgcugcaugggcaaucugcuuacuaguucuaguagccgucucugguaccaggucaagcaccaugcuaucacuguuucugaagagguguaagugaugccugugguuuuaggcaugcagcugaguggcuggagccugugguguauaugcaaacccgcaaagcagcucuuacauauauguguguaagauguaaaucacauaagaauugucuuuccaguuagacuguaagcaucccuaagacaacaaauagacauuuagauuuuucuacuaaguaaguuuuuggaauaaucuccuaagaacucaaaacuucuugccaaauaaaaaagaacuauuuggaaaaucuggaaaaugaaugguacauaaaaccauuuaauuuucaacuuuuaaugugaaaauacaauaaagaucacuguauauguuauucuggaaauauuuuuaccuauccagguauuugaauauuuauaagaaugcacacauuuuuuuuuuuuucaacaucuacugacuuuuuagaaaauagccuaagaacggagauauagauucaacaccuguggcuuuugccauuuugucuguugaacgguaauuuagcuuuugcauaaauacaagucauuagcuuuuauauuucuacacugacuaacuuaaaaauguuuuucaguagcauauaauaauuucuuugcugaaaugucuccaggcugaaaacugaacugccauacuacugaguuagcuaaggggcagaagaguuagaaaugaacccucugaaauuaaaucucagaaguauagacuucugucagguccacagcacuguacaaccuaaaugcacacuacagcuccauuuauugucuacauucuuuucuuccuuuaguuuuaauuaaacagcaccaaaagacuguaugucuguguacuauguuugugcuugguuaaagaggguguuuggauucccuggaauuggcaauauggacauuugugagccgaaagaaagagagaaaugccacggcacuccagucgagucagcuugucaggcagggaugccuaaaugcugcucaugaagcaaaaaguuucauagaaacucgcuccuggagucuggcauuaucucuaacccauacauuaaguuuccauucccgaguuagucuaguguauggauccacgugcucuccuuuaguauuacccuauuauaaaugccucuuaagauuaaauucugacauagcuaaagccuuccgccaguguuccaacaguccuagaacguccuugagcaagaccaugggcuuaaaauucaguaagaauguugauaaucagaauagccucuaguaauacacuaucacuuugaauaaaagcuaagucacucccauaaacaggaauuuacaaugguuuaggaaguagaucgggcuugguuuuagaguauuacauuauucaugagaugguuagcuagaacggaacucccuaguuagaaccaagacuugggugugaaagcccuugcccuaggagaguaaagaccucacaccuggcuucuaagacuauagcugaguuacacccauacacacguauuuacaauggccuaaggggaagguggacuauacaauagacuaaaacuggaacuauggcaagggcacaaagcccuugacccuggcuucuaagauuaagugaaucuuagguagagcccuuguuuaucccaguuguuaacaaugaauucuaucccaggugguuccuguuagaccuucuguguuugcauuccucuguuuuauguaagaauccaguaaccucuuuguaccuugcugguggguuccuuauugucuucuacauaaaaagucuaaugcucgauuuaacauuacauucagauccaacaccucuccuguguacaucuaucugucaguucaucugacgcuuuguccaccugagacuagagaccuguuccacgcagacaaaggggcccagagggucuacggcauguuggggauuaaaucugugucugcuggagagcagcugugcccuuauuccagcccacuuucuuuuucauuuaguuuuuucaaacucuguguagccuggcugcccuaaaauuauguagaggcuggccucaaacucaaagaucugccugccucuguuucccaagugcugauauuuaaggugaauauauaucuuucauuuuuugaaauuguaauauaauuacaucauuucccccucuccuaucuucccaccaaauccucccaugcccccccucaaauucauagccuuuuaaaaagucaauaacuguuguaaugcauauaggggugcagguguguauuuuucuccuaaacacauaacuacaaucugcucgguuucuauauuacugguguguucucagagcugacccuuugguauuggauauccgaauggugugcucuucccugaggaagacuauuucuucuccuuucagcaguccuuaguugccuguaguuuucuguguaggguuagccccugugagcuuuucccuagcaccuuucuuuaaagguagggucucacuguauagccccagcugaccucacacuugagauccuccucccaccucuggcuucugaaugcuaugauuuucagagaaaguugggagcuauucucccuauauaaucuugucugaccauucaaacuacagaaaugacacugaacaauccuguucuuacaaaguaccaggaugucaacuaagcuuuucacauuuuaauuuacucuggcuucuuuauuuuauuuauuuauuuuugaaacaguauuucagucuacuguaguccaggcugaucuugaacuugcaggaauugugcuucagucuccuaaguucugggauuagggggcugagcugguaugccuagcuucuacuuaauuuuuuuuaaaacauuuaauuuauaggucucucucucucagaaaaaaaagaaaaaagacuuaucuaucuaucuaucuaucuaucuaucuaucuaucuaucuaucuaucuaucuaucuaaugcaugugaguauacccaaucccguugugagccaccaugugguugcugggaaucgaacucaggaucucuggaagaacagucauugcucuuaaccacuaagcuaucucucuagcccccccgcccccccacuuaauuuuuuuuaagaauuauuuuauaugaaccaggugguggcagcaguaaugcuugccuuuaaucccagcacucaggaggcaggagcaggcagaucucugaguucaaggccagucuggucuacagaaugaguuccaggauagucaaagcuacaaagagaaacucuaucuugaaaaacaaaaacaaacaacaaguuuauauguaugggugcuuugccugcauguuugucugugccccacaugcauguagugccuaaguaggccugaauaagacaccagaucagaguugguugugugugagcuuccuugugggugcugauauuugaauccuggucuuugggaagagcagccagugcuuuuaacagcagagccaucucucuaacacuucuacugaacuuuuaaagacuaaaaccuaacuacagguaucuugacuucuuuuagcaacacuuucuacaggaugguauaaccauaaacucugagagcagauagguaaacucccaaaucuuuugaaaauuuucaccacacuguggguuccauggcauaauuuuacauaaaguaguugcucauuaaauaaacauagaucuaagcauccuaagaaacaggaacccugccauugaacguggugcuuaccucugucuccuguaggcgguguccaaugaggcugagggacucucccagcaacuggagaugagcagcgacaucaaugggcucuguuucaggagcuuuggcuggugaggcuggcaaaagcauugugguggguggggacuucuuuuggggugacaguacuccuacagaagaggcugagaagaggaggaugaaaauuugccuauggcccucaaugucaacaauauugacuguuuucccucuugaaaccuauguaccagguauuagcuaaccuauccacaugaaugcauugcccauagaggccagaagagggcauuguagcuccaggagcuggaguuauagccugcugugagcaagucagaggcugggauuugaacccugguccuuugcaggaacagcuagugcucucaaccauaggggccauuucucuagccccuagcuguauacauuaaagggcuguaagaaaaacaaacaaacaaacaaacaaacaaaaacaaaccacaugcaugugugacugggaaugcauguaacacacaaagguuguaacauucacuuucuggauccuuuuuauuuuuaaagaaguuguagucucaguguaguccagacuugucuacuacaucugcuauguugcuaaggcuugaacuugcauucuccugcuuguugcauuacauggaggcagaaggccugaucccuggcuuacuuucuggaucuuuuuagcgaagucugugacuucuuacaguuucuaaauuugaacuacuuuuauguagccugucauauucaguaauacguagguaucaaggccuacuucuauuauaagcugucugcucucccggccuccuagcaaagcaguagagaaaagugucugcuaccucugacuuucauggaaccuucugcgcuggaugcuuuucucuucacaguuguggcuucagcuuuguucuguuugugcugcagauacugagccuuuugcuuccagaucugcaacagaucacccacacagaauuaagaaaggcaaaagaggaaacagaaagggagcaaggagcugggagaagguggagagugggcaaauaguaacuuugaaucuuaguagcuucaagacuggugagcugauaucuuaaaagucagcaggacuacaagcacccauucuucagugccaagggucaagucucaguacuguuaaaauacucuaagguuacauguagguaggucauacagcggaaaaucuggcucaguacaguaauguccaguggcuagccacuuccucuaacuugccuggcaauggaaaacagcaagcuaucaagaaucaucuggguggaaaagaguuacuuuuauuuuaaaaagcuauucuucaaaguaagaaugauaauucuuguucccguauguggugguuugaauaugcuuggcccauggaaguaguacuaguaaagagguguggccuugcuggaggaagugugucacuguguaggcaggccuugaagucuucuagugcucaagcgccacgaaacgcgcaagacagucuccuccucucugcuuuuaggucaagauguaggacccuuggcuccuccaacacuaugucugccagcugccaugcuuucugauauguuaauaauggaauaaaccucugaaacuguaagccagccccaauuguuugccuuggucauagugucucuucacagcaaugaaacccuaagaugccauaacuaccacuuacacugacugggauaugacuacaugaaucagaccuaacuguuauugucuucacuaucacuggcucuacuacuuuucuuuuuguuuuuuuuaagacagacuuguuuuauaucuaucucucccucccugcccccccauccugagcuggccaaucuucaaucuuuaugucucagucuacuaagcaguggaauuauaagcaugagccgcccauacccagaagucuuauuaguucuucauagaauauauugcaaaugguugaugagaauggagacccagagucuggcuaaagcaaucuagaaggugaugguugucagucccuaagacuaugacugacuggcacuugcaguagggcacuguaacuuuagauuuuucuuuuaggaauauuuuaaucaaccagggucuuuuuauuuuauuuaagucugguuuggggacaaaaaguagacaccaguagaaaaaggcagucuucuuauagcaagaauagccuaacaauaacaguggccauguccucugcuaacuacugcuauugcuucuuucucacugucucaggguugugugacuggcagguaaaacacauugaaaccuacauaauaaaauauacuuaccaguuugucuuuuucuggcaacugcuuccauacuucagccaauuuuuuacuaaguuccccaaaaucugauaaaaaagaguuaaaaaacaaacaaacaaacaaaaacacagaacuguaagaaaacagaagucuggggaagcagacacuagaaaaggauggguggagcagauuucuucuuguauuacuacugagacaggguuucuuuguauagcccuggcuggucucaaacucaagagacccaucugccucugccuccuaagugcuaggauuaaaggcgugucacaccaugccuggcaaugucuaauuuucacagcaccuuugcagaguagaguggaaagucauuuucuacauaagcucaaggcgacugugauauaaagugaacugcguaaggucaggcuggugucugcccaucuaagugcuagcacagacaagaacuaacacuacaguacagaugaaagggaauucaaggaaaagccuaugcuauuagaaauaaaaagcauauuuugcauauuuaggugcaaugauacauuguuucuuuugagacaagaucuugcuauauagcccagguuggucugaaaccugugaucuuuuuagguuagucucccuaaccagagguuauagagggccuggcucuuauaucuauuuaauuuauacuuuccucuuuuuuuuuuuaaagauuuauuuauuaauuauauguaaguacacaguagcuguccuagauacuccagaagagggcaucagauuucauuagggaugguugugagccaccaugugguugcugggauuugaacucggaaccuuuggaagagcagucagcgcucuuaaccacugcaccaucuugccaguccccuauacuuuccucuuuuauugguuaagaaauacauacuaagaagauggcucuauggguauaguacuugccacauaacccuaauaacuugaauucagauuccccaaaauuguaaauguaaaauuuuacaagaauuuaaaagcaacuuguggcagugcacgucuauaauuuuagcacugcagaaauacaaggaaccuuggaguucaguagcccucuagccuagcagaauagaugaguucuaggcuaaauaagagacccugccuugccggguggugguggcgcacgccuuuaaucccagcacucgggaggcagaggcagguggauuucugaguucaaggccggccuggucuacaaagugaguuccaggacagccagggcuauacagagaaacccuguuucgaaaaacaaaaacaaacaauauacaggguaaaugaaaggauuugcagaacugaggaaauacauuuaucuuuuguuugagacaggggcacauacuguaaccuaggcugugguugcuguuucagcuuuccugacauuaugggccacugcagcuaguuucaauuuguauucuaauguuauagggugaagcugccuagugaucgaauuaaucaaacgcacugcuucagauacuagaaaguaaaaacaaaacaaaacaaccaaaaaaccaaacaaaacccaaagcucagaaagguucuuaccuauaccuggauggucagccacaaugguuacccgguacuccuuacagaauaccugguaggcagacauguucuucuuuuucggcuagagccauaaagaaaauagaacaaagcaaaaauugauuaggacccaaguaguauauuuaacauucuccagucacagaggaguuccauuuaugccucacugaagaggauaacuuaauuuuuaaucuauguuacuuauuauacagagguuaauaucagauuuaacuuuggagguaaaagucacaugcuaagcaucuaugaauacuuugauucuuaaguaaaaaucccauguugcauauuucuuuaagcaucaaguacuaacaaaauaagaucuccaucuucuuuggaggagacuaauucucucaugcuggagaaucauaugacuuccuuuucuuuauuucuuuuuuucuuuuuaggcuuuuccagacaagguuucucuguguauuccuggcuguccuggaacuguguagaccaggcugguuuccauuucagagggcucuaucugccucugccccugcaaugcugggauuaaaggggugugccacccaauguuuucaaucuggcuuuucucaacaaaacaccaauggaaaccugagaagcucaaaaccaaaugaaagaacagggaaaaccaucaaccaacuaaaacccucucuacuucaugcagaagcuucaaaauaugaugaucuccuaagagccccuuuuauaguuagcguaaugaccaucacaaagcaucaauucaugcuuucaaaguuaugggcuuugccuuaagggucagauuugugacuaaaacccaaauaacaacauaagcguucuuuacugucuugcucaacacuuaccugaacuugcaugagucuauccucaccuaucugcaugcuaaccuaucugcaugcuaaaccccucucccaccaaaauaauguguacauuucccgaucuuucccuccugcguaaucuaucucacugcuaaauagagacauuaggguuuguaacaaugcugucuaaacacaguacaauaguugcuucccccuugccucaaagccacuuagagcuuaacaacuuuaugaaguaccuucauaaucaaucauaauuuuuggucaacguccaaagucacauguacugaauuccccuguuauagaggaauuuguucauuuuaauaguaaacaaacugguauuuaccaaagaauuauacuggguaaugguguaguagaaugaguuugaaucucagaccuuucuggaagaacaucaacuguagggaacacguggaacuuugccuuuaaaggcccaccaccucuuacccagcuaugcuacaugguugaucuugaguaagcacacaaaaccugacagcuuuucuuacauguuguaaguuuaaaccagggugggugauucacaucuauaaucccaggacucagcagacugagggccgauugcagagcuccccaggaccuaggugaaccuuucacauaugaaagcagaccuggccucuagguucucucagcauuccucagucccuaccugguacacccuacccccaacccugaacuuuucagugcagggaguggcuacccuuuccccagaggcucuucccuagauaauccacaucuuuugggcucucccucgaucacucuauucuucaccucccucccucccuuucuuucuccgcauaagcacccuuucucccccacccccauggugacuucccuggccucuguccugggccagugaacucacccaaaaacagcuuccuaaaaaaaccugccuacaaauuguuugguuucugacucaggguaugcauauuuuacauaccaaagcagaccuggccuccggguucucccagcgucccacauucccuacuuugcaugcccuucccccccaacccugaacuuuucagcccagggacuggguugcacucccccagaggcuccucccuauagaauccagacauuuugguuucucuccccucccccuucucuuaucucuccacuuucucucuccuucccccaccccaucuuuccccauggugacucccuuggccuuggggccaaugaacuugccugccugagagcagcuucccaagaaacuugccuuuacuauaaucuaaucugguuuaaauugguucauuucaccaaaagcagagaaauaaccuaucacauauaaucuaaucugguuugaaaugguccauuuuacugucauagaaacaaccuaucaauaagauagguuauuagacacaauaaugcugaauuugaaggacagugguagcacacgccuuugauuccagcacugcggaggcagaagccggugggucuccaaguugaggucuacagagugacaggcagagcuacacagaaaaacccugucuuucacaccaaaacaacaacuggcagaaucuggagacuuaacaggauguaaacaaaccaaacaccagguucacaaauggcuucguguucccgaguuuuaguuucuuuaaauaaaauguagacguuugaggugauagcccaauggaagagcacuggccuagcaugcaaagguaucuuguacuauaccauaacuugaaggugggguuagucaaauguuccacauucagaaagugcucacuugaagaauuucaagaugucuuccaagacugcuuccugguaugcaugucuuguaucuguccuuuugugaacaaagugcuaaauaagaaggguacuggcuccuguauauuuuauuacagggcagagacuuuugcauacauaauuaagcugcaucuaagucaaucaaaaggaaaguuuuccuaaauaaggccugcuuucucaggugagcccuuaaaacacucugaaggcagaggcaagcagaucucuguaaguuccagccaggccagucagagcuacauagugagacuuggucucaaaaccacaaaacaaaaacaaaagaagacaaaccuaccaaguuauuuaguagcuuugacaaacugaaucaaaguuuguauacugagguaaaagacccagaagaaccaucacgguacuaaaagaguacccaaggggcaucacuuaccacacaguaacugacuggcacaagaacagagagcccagaaauacagcaaugcaugcacugaaaugaccuuugacaaaggagcaaagggaccacaacagagaagagacccuauuuacguggaacaacuagauagucacaaggugggggaaaagucaucacuacagcaaaaagacuuugacacggacuuuauacccuucgagauacuugucucaaaauaggcauacauaaaaaacugaaggggccagcaagauggcuagggguggggguaaaaguacugccaaacccgaggaccugaguuugaucuuggggcccauaugaugggaagaaagaaccaauuccugcaaguuguccucacacauacacaccccacaaacaaaugcaacauguaccccccaacaaaaaacaucuauagaacuaaaaauuaacacggcagaaaaucuccacgaccuggaguauuuuagguaagauaccaaaggcuuaaacccaagcagaaagaacuuauaagugggauuuccuuaaaguaaaaauuaaucuggguacaggugguacaugccugaauuuaaacuugugcagcaaaggcagaaagaucaguucaaggccagcuucagcuuuuaagagacucauuggcucugcaaaugguacuguuagaagaaugagcccacagacaggaaaagcacuuguguaagaccuacccgaugagguacuguuacccacagugcacaaggaaucccuaaaaauaaacaagaaaauaauauaaacugggccaaaagcuaaaagacaccuucccaggaaagauaagcugacaguaaacaaacacagaugaaaaaauucauguccuuagagaagaagcacauauuaaacacugagauaccauucagacaacuggccacgaacgcagcuccaaggagguggaagacaguagcucucagcugguggauguuugaaauaaucuuuccagguuccguagaagugcccagacaacuucagguaaccaguccuuuaguaacacuggcuaccuacaaaggaggaagcugguacaaaagagccaagaacaaaggagaugccuuuacagacgugaggggaggaggucucuaaacucagagggagggguauguuuagcauaauaguaaauuacuggauaagaguuuucuauugccccacccugccuaguggcugcugugugugugcuaagacuuuagcugauuagggaggguacuagauggauauaagcagugacagaccuccucucacagaggcaucaaaguacacuggggaauguagaaugggguagccauuuugaagacagucaaguucuuauaaacuaaauacacuucauuauacaguccuucaugccucuugguauuuacacacuggagcugagaacaucucuccacauaaauuagacauauggauguguauggaagcucgauuuugcacaacugcacaagcuugagagcagcccgggcagccugcaguuggugaacaaaugaacugugguuuaaucagacaacagagcacuacuuagaggacagaggacuuuugccuggaaaaugccaccuacaaaugauucuaauuauguggcauucuuaaaaagucaaaauaugggggcuggaaagauggcucaguaguuaagagcaaugacugcucuuccagaagucuugaguucaauuuccagcaaccauaugguggcucacaaccaucugaugcccucuucuggugugucugaagagagcaaugguauacucauauacaugaaauaaauaaaauuuuuuuagaaagaaagaaagaaagaaagaaagaaagaaagaaagaaagaaagaaagaaagaaagaaagagaaggcaaaaagggaaaaaaaaacuuaaaaaaggucaaaauauggagcaaaaaaaaaaaagggugaggugaacaggugaagaauugagguuuuuuaggguagcuuaaaguaccuugugauacuacaguaagagauagagcauucucaugacaacacugagugcaaaccuaucuaugcuacagacuuggagagacaagacaugucagucugaguuuggguucaucagcuguaacagguacauagugggguguugauaguggaggaggccaagugugagacagagacaaggaauauaugguaaaugucugcauuuucuuuucuucucaaucuuacugugacucaaaaaaaaaaaaaaaaaaaaaaaaaaaaaaaggcuuuggcaggccuggaacucgaaauaauccacuuuccucugucuccagaggucuggugcaccacaggcuuugcuuaaaacuuaaaaaaauuuugcuugggcuggugagcuggcucagugguuaagagcgccgacugcucuuccaaagguccugaguucaaaucccagcaaccacaugguggcucacaaccauccguaacgaaaucugaugcuuucuucuggagugucugaagacacacuacaguguacuuacauauaauaaauaaauaaaaagauuuauuuuaaaaauuuuugcucuacaaaaauaguuuaaaaguuucuucccagguauggugauugcuuacuuagaaggcccaagcacaaguauugcuaguucaaggccagccaaagcuacacagguaaacuaucuaagaguaaaacaaaaacaacaaaacaaaacaaaacaaaacacccuccacaaaaccauggcaaaauaucagauguaaaagaauaacauuaaaauguaauguugaagaaaaaaauagaaguccuaaggauucuucagcuacaggaaacugaaagccaacuagaaugagccucagauaagaaugccaucagcugaccauucaacuugagucucugaggucugaaguacaggacucaggcuuacacucuacaaaacuggguugaacucauggcugcuguuuuaacccacuaaauuaugaugcagaaguaauugaacaguucucuucauuuccucuguauauuuaaaaauagcagcuguggcauccaggcagcugauacaaacuguucuaaacguagaaguccccacccauccaccaccccaccacuaccccccauuuagaaaauuucauuuaaauaguaauggucccuugggagguguuagauccaguccuaagcauuugggagacaaaggcaggaagcuuugauucuaagaguuuagaccaaucgaucuaguacugaguuccaggccagccaugacugucucaaaaguacauauauaaacauucucugggagcccucuggcccgucugaccagggaaacagguaagauaauuuuauacaucuucccaucccucaggucuuucacauucaguccccagucucauucucagcucuccaggagaccacuguugcagccccugcccccauugcuaguggauccuacagaucuucuccuccuaaccucccucuucccacccaguuguuuuauuccagccuccaacuccagcagguccuccuugggaauccacaagccacucuagggaaacaaguaggcuaauugcagaugucaccuuuuccuccauucuuccaagcccagcaccccaggcucauccuuagcugugcaguagagcuccugcuguggccgguccucacucagccccuuucccaggugacuaagcagauccugaaggagcaugcugcuuuccuucuaccgguagaugccccccaccccuccccauuccuaauugucagcucccaauacccaaaaacuuuuuagauggaacacccaguggccacaccuaccaggacccuagaagaauuuccucccaggcaacacacagccaguacacucucuuaagaaccagagaggaaacagaaaccaaggcacccccuccccaaaacaagaccuagaauaucaagaauacaagacccccaauaucagcaccuagaauuacaaucuucccaaacccagaugcuagcauaaaaacacaguaacuaagucaggacuaucuaaauuaacaaaaucagaaauaaaagggggacauaacaacagacacugagaagaucuacagaaucagaaggacauacuuuaaaaacaugcacuccauaccuaacuggaaaaucuaacacaaaugaauuauuuuguugauauauaccaccuaacaaaauuaaaucaaggucagaaaaucaauuuaaauaaacauauaaccaauccuuagugaaauagaagcagucguuaaaagucucucaacugcugguuguggugaucuuuaaucccagcacgugggaggcaaaggugggccccuuugacuucaagaccagucuggucuacaaagaaagauccaggagagcuugggcuguuccacagagaaacuguuucacaaaacaaaacaauucucccaaccaaaaaagcccagggccaggugguuuuagccaauauaaaagauauuggaaguuccauauaaacaaauuggaaagacaaaagccacaugaucauaucauagaugcagaaaaggccuuuaacaaaaucuacuaccccauucaugauaaaaauccuggagagauuagggagauaggggauguaccucaaaauaauaaaggcaguuuacugcaagucuauaaccaacugaaauuaagaaaaacucaaaacaauuccacuaauaucaggaacaagacaaggcuguccacuuucuccaaaucuauucaagcuauuaaaguuuucuacggcaauaagacaaucuaauaagaucaaaggaaauauauuggaaaggaagaaaucaaaguaucuuuauuagcagaugauaugauaguauacauaagugacccuaaaaaucccacugggaucgacuagugagauuuaaaaauuuuucagcaaugcggcuagauacaagauuaacugaaauuauuaacccuccuaauacagaguaguaaaaauggcaaauagacugagaaagaaaucaggaaagcgauaccguucacaauagcuacaaauaauauaaaauauguugggguaacuaaccaugggagugaaagacuuguaugauaaaucuucaauucuuugaagaaagaaaaugaagauaucaaaaaauggaagaucucccauacucauuuguugauaggauuaauauuguaaaaauggcuauccuaccaaaagcaauuuacacauuuaauguaacccccaucaaaauuccaacacauucuucacagaucucuaaaggccaauuuucagcuucauaugaaaaugcacgcacacgcacacacacacgaaaacacacagaauagguagaacaauacugaauaauaaaagaaccgacaggcaucacuaugcccaauuuugaguuguacuacaaagcuguaggagauaaagaacaguaugguauuggcacaauggaaucaaauugaagaaagacccagacauuaauccuuggauaccugauuucugauagaguccagaaauacaaacuggaaaaagauagcaucuucaacaaauaaugcuggucaaacuggcagcugcauguagaagaauccaacggauuauacuuaucacucugcacaaaacuccaaauccaccaaagaccucaacauaaagccagguagacugaaccugauaaaguggggaauagccuuguauacacugguauugaagaagacuuucugaacagaaagcacaaacacuaaagucggcaauuauuaauaagugggaccucaugagacuugagagcuuccauaugggaaggguaucaucacucugacagaaaggcagcauccaaaagugggaaaagauuuuuaucaacuacaccacauccaauagaaggcaaauacccaaaauacauaaagaacuaaaaaacaaaucaagaaaccaaauaauccaaguuaaaaaauggaauacagaucuaaacaagaauucucaauacaaauggcugaaaaacacuuaaaaaaauguucaaucaacauccguagccaucagaaaaugcaaaucaaaacuacucuuagauuucaucuuauaccugucagaauggcuaagaucaauaaaacaguucaugcuagugaugaugguggaguaaggggaacacucauacauggcuggugccagugcagacuuguacagccacuauggaaauacgugcugugguucuucaggaagaaaggaauagaucuaccucaagcuucagcaauauacccaaaggacguuucauccuaccauggagguacuuguugaaccauguucauugcuaauagccagaaauuggaaacaaucuagaugacccucaacaaaagaaucaauaaagaaaauauaguacaguggaguauuacucagccacuaaagaaaauggcaucaugaaaaucacagguaagaggaugaaaauagaaaaaccaaaucaucuugagugaggugauccagacccacaaagacaaauaugguguggauucacuuaugaggguauuacugucaaguccauaauaagcaagcuaucacagaaccacacaaguuagagaucugagguauagacagaucucucauugggaaagggaaauagaauaaauaguuaugagugggagcuggaaugagaggcucagaugaagaaagaggggucugagggagggaaugcagugagagacaucuaaaauucagggggccgggcgugguggcgcaugccuuuaaucccagcacucgggaggcagaggcagacggaauucugaguuugaggccagccuggucuacagagugaguuccaggacagccagggcuacacagagaaacccugucuugaaaaaccaaaaaaucagcauguaauaugugaaagaaauauuuucaauaaaaagaaaaaaggagcaagcaagcauacaaaaaguaaauaaacaaacaaaaauaaaaauaaauaauagcugggcaguggcggcucacaccuuuaaucccagcacucgggaggcagaggcagguggauuucugaguucgaggccagccuggucuacagagugaguuccaggacagccagggccacacagagaaacccugucucgaaaaaccaauacacaaacaaacaaggucugagcuagcaaaauggcuaagcaguuuaaggugccugcugucaagccugaugacacgcaguucauggugcccaugcuguagaaccauguaggggcuuguggcacuacaugacacacauguagcagcauguacaccaacauacaugcuaagcaacaagcaaagaguaaaggucccgugucuuagcaucuuucuagggaccuagucccaucuagagauguuacagaggagcgcugggagcuggggcuucuuuauuuacucagcaacggguuuauagcccugacuuaggcaaagauuuauuuuguucuaaauuaugugugcaugugugugccuguguguguguguguguucaagcaagcaugcauacaagcgcaugcauguaugggaagcucugugaaggacagagugucuucucuccugggguuggaguuacagacacuucugggaguggaauucgaguccucugcaguggugaaugaucuuaccugcugagcugcucucuagccucauuccuaaacacaucuuaacuaugacacuucuuuucaaaugcuuucauagggaccacgauagaacagcacccuccccaggcuguaugguacacuuacacaugugauaucaugauauauaggguuggggagaagagucucaugacaccucaccugucacucauucuaccuaagaaucuauacauuugaguaagugugacagggggcuuaaauuuauaaaucugccuuuccuagauaguuccuauaugucacuuucacuaucaaaguagcauucugggggcuggugagauggcucaguggguaagagcacccgacugcucuuccaaagguccggaguucaaaucccagcaaccacauggugggcucacaaccaucuguaacaagaucugacgcccucuucuggagugucugaagacagcuacaguguacuuacauagaauaaauaaauaaaucuuuaaaaaaaaaaacaaaguagcauucugauguuguuuuuuuaaaauaagggauuauacaacauaauccuuuuuuuaaaaaauauaauugcggggagguggggcuggagagauagcuaggcauuaaaaacacuggcugcucugccagaggucccugauuagguuccuagcaccucuauggaagcucacaacuaucuagaacuccaguuccagggugucugauacccuaauucuggcccuugcagauggcagggauccaagugguauacuugcauggcaggaaaccacccauacacauaaaguaauuaaaaacaaaauaaaacuaugguuccugagccuaugccaaugauaugauaugggaguagagagaaaaaccgggcuccaccaggagauacucugucgggagggaucuguuccucuucaaagugaagccuucccacagcuugugcugaccuuggagucuacucacuguauaagaagaacacccaaucuguggaucuagaguucagauuucaaagugaaggguugaacauuuucuauagcacaggcaauuagaacugcaggaaaggaggaugauauucacgcaaacaaaaucacugcaaugagauccaaauacaaaggcaggcaauccucgcaaaaguugcuaacaaagcaagcuuuaagagggggccaacaaauuagagcuggauacagggccuggauccauaaaaugguaacagugucaaaacuuggaauacuaaauuaccaaaaacaaaguacuuauaacaaguagauucacuaaaugugcuuagauacaauguuaccggcagaagugguuaccacuuuugaugaagaaaaugauaauaggauguauaaaaaaacccaacuuguuaaagaccuuacuaagcaauccuguugaacuuuuuuggaucagggaaccaaaaggacaaugaaaaucacucuuuaggaugguaauuuaagauguaguaugaaucuuaaaauugggaguuugaagaguagcucagggguaggguacuugccaagcaagugagauacaaggguucaacuucuagcacacacucacauacacauguacacacgugcauacacacgugugcacauggacagcauacacaaaugcagaguuggcuuucuucuguuaggaaggaaaguuaggagucaaauccuuucaguuucccuaaaguaaaagauguagacagugucucuaauaugaaagcuguugacacugacuguuguggauuugguuuauuguuuacauuauguuaaggggguucccaaauuacauaggauucacaugucugcaugcaagacucugugggucccugccccuaguggccugccccuaguugacucuaguugguaaauaaaguugcuggcagccaauggguaggcagagagacagaggccugacuuuagauuucccggguaagggaaccgagggaagaaggagguuuuaaaacuguagaaagccgggcgugguggcacacgccuuuaaucauagcacucggagucagaggcaggcggauuucugaguucaaggccagccuggucuacagagugaguuccaggacagccaaggcuauacagagaaacccugucucgaaaaaacaaacaaacaaaaaacaaaacaaaaaacgcagaaggauuaggcccaagagcuggagacaugagagcauacaaccauguaagaacccggguagagaggccucaagagcguaccccaccccaccuugggucuagaguagcaaagauugaauagagauuucaggaguauuggagggggagcauuagcaguguuugggaguggcucagucacugugcuuuuuaaggcauauuaaauauaaggcuauguguguguguguguguguguguguguguguguguguguguguguguguguguguuucuuuuggaaaucugguauacauuaggugggcggugaggacgcugcaccaccuaugguugaacgauggaaguagcguuaauaauacaacaacugacuagaaaggaaauaccaguugaaucuauuucagcuuugcugagcagagguaaauuuuaugcuggaaagaagagacugagagccagaguacuagacugggaccagcaggguagcuugugaacacuggaaagcaggcgccacacaggaaucugcugcuugucugaccucacuugacuaagauuucgaauucacugaagggaaaggaagacuacaggaggcuaguuaggucuucacacuaaggcuuugguccaacucuuuuaguacuuucaacuuucuagaccugaaaccugggagagcagacacugucuuacuccucuguccuuggcaucuggcaagugccuggcucuauauagugcugaacacaacugaauguauuaauugacuacauucaaugaacagcagagucugagcaguacauggcagaggccagagugcagugagcaccacuaucccacgugagucuccccauccuucuguaacugaggacuaggugccaggucuacuuuaacuauguaggaauaggagaggguccuaggaccucccauuccuucugcagaccaggacucucucaugaauuccugugaccuccuggaaauauuauaacaccuacuuuuuugcuucucagcaacccuacuuccuuucaauccauaccucgcuccccuccaaacaauccauggcagaccuugguucccucuaaagcaagcaagguaucagauauauaaaagcagacccaugggaacaaguugucucagcaggucugacaccuagaguuccguacccaugguggaaggagagaaccaguuccugaaagucguauucugacuccacaugugugccaugguacaugcauccccacacauacauauguguuauacacaugugugccauggcacaugcaccccccauacacauauguauuacacacaugugugccauggcacaugcacccccacauacauauguguuacacacaugugugccauggcacaugcauccccacauacauauguguuacacauaugugugccauggcacaugcauccccucacauacauauguguuacauaugaucuuuaaaagucucugugcuuagucugugaaaugagugccuaaaguuuuuuucuuuuucuuuuuucccaagacaggguuucucuguauaguccuggcuguccuggaacucacucuguagaccaggcuggccuugaacucagagaucugccugccucugucucccaagugcugggauuaaaggcgugcgccaccacugcccagugugucuaaaguuuuaaaagcuguuuucauguagauuuuaguuuuugcaacucuuuauacuuugggucuuaaauuaaaaacauuacacuccucaauagaacauauauaacagcaggaugcucaagugcccacacugaaaguaugguuauauaacuaaguauggccucaaauuugugcucuucuugcuucagacuaaauaccgggauuacacacaugugccaccgugauaggucugauauuucguuuucguggaaauuagaaaauacuuuguuuugucaaauaugaacuaugaaacauaguggugcuugcuuuugaagguugacauggaggaccauaaauucaaggccagcuuagguuauagauuaaaaccaaccaaacaaacaaacaaauaaaacaaaacaaaaaaacaaagauuggggauguaagucagugguaggauguuugucuaauuugcacaaggcuuugaguuuuuuguucccuagcacaagaaaacaacagaaugcaacauuaaaacuuguagucuccccucccccagccugcuugcucagggguggagcuuccugcucauucguucugccacacccacugcuagaaccugcggagccacacacgugcaccuuucuacuggaccagagauuauucggcgggagucggguccccucccccuuccuuuauaacuagugucacaacaauaaaauuggagcuuugaucagaaugaauuugucuuagcuccguuucuucuuucgccccgucuagauuucucucuuacagcucgaguggccuucucagucgaaccguucauguugcgagcugcuggcggcuggaacaaaaacuaacauggaggcgggugugguggcgcaugccuuuaaucccagcacucgggaggcagaggcaggaggauuucugaguucaaggccagccuggucuacaaagugaguuccaggacagccagggcugcacagagaaacccugucucaaaaaaaacacacacacaaaaaaaacaacccagaaacaaaaccaaaaacaaacaaacaaacaaacaaaacccuaacauggugcucaguagccagguauaaacgcuuuauguguaaguggaaagauuuagguacagagaguuaaaggaucugugcugaagucuggcuccacacugcuucccagcuucuuacuuuugugaagugaaguacugaucaauuaugauugaugacugauagauaaaaugccuugggaagccugacacaggcaagaacucaacagauacuaauucuuacaauuuauucuuguuauucagccuugguuuagcuagaaggagaacuuauacagcauuguccuaggucuaacuguaucaucaaguuuacuuuuucaguaaaucaacaagcaaugccuaagcaacccuuuacacauacacacacacacacacacaaauaaauaaaugacuaaaauaaaagcuuuuaaaaggaaaacuucuaucccaguggugggauuaauuuuaagugaaaaucaagauauuauuauauaaugugucuauuucauagaaagcaggucucaaagucagccauaauuucccuucuucccucugguauacaaguacgaaacaggcucauggcaccucuucuuucccauucauacauuuuucuuacugcacauauaccauuuaguuuuacuccaguuucaacuagucucccaaauucuggguuauauagaucacuccccgacuaggugaugauuuuaacaacuaccauuuauugaaagcuaccuaaagcaaaaacaaaauucccaaagguuccuaguucucuuguaaguaucuuucacagugcuagggacugaaccugaaguuuugggaaugaaacaugugacacuuacuuauuuugauuuuuaucacaaaaaucccagaaaacccauguuuacagacaccagcaggaauucaggagcugcugagacuggaaauggccuugagagaguaguuccuaaggcaccuaaaaguugucagggauggcugcuucccuuuaaaacaucuaacacgcagcaguggcugaggcaggcccuaagugaguuuacaugcauuuaauccucagcagcccuaggcugaauacuguuacucugggcaaguuauaaaaguugucuaacauagcagggcggugguggugcaugccuuuaaucccagcacucgggaggcagaggcaggcggauuucugaguucaaggccagccuggucuacagagugaguuccaggacaaccagagcuacacagagaaacccugucuagaaaaaaaaaaaaaaaaccccaaacccccaaaaaaaaaaaacaccccccccccaaauaagugaacguucaacucaaguuaauaaauacccaaguugaagcuggccaugauggugcacacauguaaucccagcacucuugagggagagguagaaguaccaucugaagugcaaggccagcgaaggauaaacgaccaguucccaucuuaaaaucccaaccccaaaccaaaaacaaaaaagcaaaaugucaacugagaacucuauuuuuuuuuuuuuuuuuuuuuuuuuuuuuugguuuuuugagacagguuuucucuguguagcccugguuguccuggaacucacuuuguagaccaggcuggccaugaacucagaauuccgccagccucugucucucaagugcugggauuaaaggcaugcgcaagcacugccuggcuaaaaauuuauuucuuuauuauacuuauuauauguaaguacacuguagcugucuucagacacuucagaagagggcaucacaucucauuacagaugguugugagccaccaugugguuguucggauuugaaaucaggaccuuuggaagagcagucaguacucuuaaccgcugagccaucucugcagccuacuacuccuaucauaagcagggcuaauaauagacucacagaguauucaccuggauuucaugaaauaauuuguaaaugaacaaaugaaaaccugcuauauccaaauguugucugugcuuauaaugacucuuguauccaacguauagcuuuuauacccauacccaggcacuuuuuuuuuuuuuuuuuuuugguuuuucgguuuuuugagauaggguuucucuguguagcccuggcuguccuggaacucacucuguagaccaggcuggccucgaacucagaaaucugccugccucugccucccgagugcugggauuaaaggcgugcgccaccaugcccagcuucacaucugccuuuucucucucucucucuuuuuaaaacagagucuuacuuuguagcagaugcugggcauaaauuguaacuccccuaccucaguuuccuagagccugggguuccaggcuuauacuacgaugguacugacauucuaaauauaguugguuaucauuuuucuuaguagcuuuucuuucagauuuuauauauuuuacuuuguaaaaauauaaacaaaggaagagaauggaaugguugguuuuaggcaacaaaauuauuuguauuuucuauuguugagggaaaaaauuauacauuuuuccuuuaaggcucuaguaguucauucauggaauacauuuauaguauauucaauugauuuauuucugaguuuauacauuucuuuuuucuuuuuuucuuggagucuuaccuacacugguuuugaacuuuucuucuuccugccucagccucugaaguguugggagugucaugaaugggccacuaccccagcucugaguuuguaaauuucccaugaaaauagguaucaauuugguaacaaaaucagacugucuuuaccugacccuaaaauacaucuguuggagcccuucucagguggugaggugacugaucucucacaaccaucucuccaauggacaaggagcucucuaaggucaagaacugggucuuuggguuggaaugacgcucagcuauuaagaacacaggcugcucuuacagagaacacagggucaguucccaauauccacauggcugcucacaaccauggguaaucucaguuccagagggcugaggcuuucuucugacacgcacgagucagacacaucaaaguacauauaaaugaaaaagaacuguccccgguugaucuuugcagcucaucacauaguaagcacucaaacacugauagggcaauuagacacaagaagaagaugaaggacugucuuaacccacaccagucaagacaaagacgugagcucauuuuauuuacuugaucaguuaguuacuacuaguuuagaaaaucuccuccaagaugacccaaaagggaccuuuccuaugaugucuaagaaucaugguguucuuaauccuuugaucaacaggcuaggagaacagcucaauuaagagaagccaggaaugauuagacugccaucccuuuucccuaggcaaaucuggccacugguaauacuuuaugcccugugcuaucccaucagcucaaugguggcaagaacagguuccucagaaaggucuuguuucaucaagaccuucuccuuaccuuuucuccccucucucugucucugucuuugucuucccuuuucuuuuucuucuccccguguccaucuguguguagagcaggaaguggcaggguggggacacuggaggcagggccagguaucagcccgugcucccgagcaguaccgugcucucuggcagagcuucucuugguccgggagugccgcuucuccuugugucugucuuuguccuucuucuuuuugcucuuuuuugacuucuucuucuucuugaucucccuguaagagucaucuaucaccagcuccccggccuccagcuccccagcugaggacgauucggacucuacuagaauugggucaagcccugugaugucgagauuggcacugugggguucuggaagcugggagacgucagacccacagccuucugggccaggagaggagugugagucugaggaugacuugugcuucuuccgggccguuuucaggaggcucuguagcucgugcccuaggaguaaagcaccuugcucgucccgagcuaguuucuucgagggcuucuucagcgaagcuuguugggcaggguacugaaaagccuccucuuccacugagcugcuucccuucuccuuuggugagagaaugaguuucaucuuuaagccaucuggcucacgaagagucagugucucuguguucacauagaguggcuucaucuuuuuggauuugugggcauugcugucauccagggagagcucuccacugcugccauugcccuucuucuuguggugcuccuuccugcucucuggauggcuugaagagcuggaggauuucuccccugccuucuuagaggacuuggcacccgcugccaguggggaggugauagcuuucaacagguccauugcuguguccggagacugugggcuagacuucuucuuuuucuucugugaugauuccaaagucgaaaugucuagaaauaaccaagaaguacugucaauaggacaggaaguaacuuguagcaagugcccccucucaccaaaacccaacugccaugaggaaaaggcuaacaggagugauucugaggggagacacuuuggcuccuaacauucagagagaacccccauguacuucuugccuuaguagauucagccuuuggcccugcagaccauucuugccccuagagcugauucucuucccugagucuucacaagagacagagaacauauuuaggauagagcugugagauuaaggguaguuccaaucuagauuagacugcagacagagugucacugguucuugugcugaggacaaacucauucuagugagguuagucucgucagcuacacauagagcauagcuaagaaaacagguuuugugaguagauauaugcuggcugagaaaugccccacagauauguagagggcccaagggcugcaucuggcaaagggaugcuaaguagcaauggcacagauaaguggaugguuggggggagaaggaaccugguaccuuguguaucacaaaugaagacuguucuucuaugcugaauccuccaaaauaccagcccuccaccucucuccuccuucacacugguuuaucggcacucagaacaagaaccacuguccuguuaaauaggccacugagucagcaauaucugggaucccuuccccuaccccgacuccaagaaccagagaugugcagaccccaccugcagcccacucccucgcuuaccuccauaguaguaaucgucaggggagugcuuccucuucuucuuguguguguccguccccaagaagaacaaaucacuguccugugguuaaagagggagaagaauuggcgaguaauaagauggcgaggggacgguuuggagccauucuucugggaucccggcuuugacagacaucuggaacugaccuuugacuucuucuuggaagagcuccugaccugcgcggcgacuucuuccucuucccuuaagaagucuuuguaagaccgcuucuuuucucguuggcuucggccagcugcaaguccuauguccucaaagcugugaucaccaucaaagcaaucugggaagcacagguucauuuagggacggaaaugacaaaagugcacaacaaccaaaggccaacagccccaucuccaaguuacaguuacgucucagugcguccacugaaaugcagggcuaaacccagagggccaagacgacuucugacgaccuggcugcaaacacaagacucaaaccugaaaacacaaugcuuccaugcuauccaaaugcccagugugcguccucagacaugguuucuuagcagugaucuggcagguagauacagacuugcgagggaaggcugcaaaggguaaggauucgugugcugagcugcucugugggaguccaguguaagauucccagucccagacuccugcacacuggagcuggcaaggacuacgagugcuguggggaucacccccaaaaacuaagacucuuauuucagacucuuguguaggaaccccuguucugguuuucauguccaugggcucagucuggggaugauguggaggcugugucucacacaguccucuggagcaucacuuggucuaggcugugugcccagucuuggucucuacauccauggacugcagggauggaagagguuaugcccuuuggaaugcuucugaguaaggggucauaccuucuuucuucauggagucaucauaagccauggugguccugcagggccuuugagaauguguugugucacuguguccaggcuccuucccgucuacaggaccaggucugagaaacaaacaaggaaaaccuuccuguaaugugaacucacuguggagaagcaaccuuccaggugggaauuccaagcaauccaagggcugacuggaacacaggagugucuugucagcuccucccucugugcauacacucgaguugaacuugcagggaggaugcuaagcuuaacuggaguuaauucgugucuuaaaguugacauuugaagaaauuuaagauuaaauuaaaaaaaaaaaaacuuccaaaauuaaugagaauuucuggaaugcuaacaggacuaauaacacugagacaggguagaaacugacauuaagucagaggccggguucaaucauagucacaggauauacagauaaagccagaugcagaggaggacagaguacaccaauaguggaagaccacaaaguccuacugaugagucugcugagcuuguaaguuaaacagcacacacacagauacuaauaauuuaaagcuuuucauucuauugggcuuuaugaauuuauuuaaauuaaccacuaauacgggcauacuucucaaauguguuggcuauauggaaauuuccaacacuaacaagcccuuuuuaaaggauaguaagaaagaaauauuuauccacuggugauaaaauuuauaauuuuaagguuuuuaaaaauuaauuuagaaguacucuaauuuaaaaguucuaaguauuggguuuugucuuuugagacagggucuccuuacauaacccuggcuggccuaaaacucacuuuauagaccagagagcucuagaguuuacagaaaucuaccuacagcugccuccugaacacuggaauuaaagaaauguucaucaccuuacauaguucuaaauauuuuauuguuuaaagcaguggcucucgaucuguaggucaggcaaucccuuuggaggcaggggugucaaacaauccuuucacagggguugcccaagaccaucagaaaacgcagauauucagucguaacaguagcaaaauuacaguuauaaaggagcaaccaaaauaguuuuauaguugggugucacugccacaugagcaacugcauuaaagggcgucauagcauuaggaaggcugagaaccacugauuuaaagcuuuuguagcauucaaguucaaaugucuggauugacuuugaaggugauaaaguuauaaauugcacucuaaaguaaauccuuaaagcaccuuaaggacagaaaauauuugcauaguuuuucuuuuuugagacaaggucuuacuauguagcagcucugacuggccuagaacucacugcuuugcaggauaucugaaauaacuaauuugaaaauguucucauucagucaagugcuuagaaguuaaucuaauugguaauuuaauuuaaccuucacuauaauaaaugacuuuaggaugacugaaggucaguucuguaacauuauuccgcccuucagauagguguggagaaaacagaagcacagaguuugugggaaagaaaacacgagcugauuaacgggaaauuuucaugacuuaaugguuaagaguuuuaauuuagugaggcuugcuggugaauacccuuagucccagcacacaggagucagcaugucaggggcaugugguucucuguaaaucucaggccagucugcucuacaugaguuccaggccagccagggcucccaagugagacccugucucaaaacaaaacaacaaauguuucuuuaaaagccacauaaauacaaugcacagguaggccaaaguugacaauacaaagaaaagcacuguuaugauuuucaaagucugagaauuacaaaaugugaaaugaaggaauuuguucaagguaagggaagcuggagggaaguaaaucuacaugaagccaauuguuuaaagagcuggcaugcugguugcucacagggcuuuucucaugaaaugaagaaaauguagggucaggccucauguaagaauguaaggugacaagauauacauggccauuuuuuccuguuuuaguguuuaauuacuacacuuucuuaaauagaaacuguucuucacuuccaaccccucgauauuaacuuaaaagggagugaaggugggccacugaaaaugauaugcacucauuuaaagacaacaauuuugccaaguggcacacaccuuuaauuccagcacuuggaaggcaucgacaaguggcuaucuugugaauucaaggccagccugaucuacauaaugaauuccagggcuagagagaaucucucaaacaaaacaauggcaauauucucacuaguucaaaaaugaugaguuuauuagaaagccauacaggugaucuuggcuuucacaagcugacacuaaguaaaauaacuuuagauugaaguuucaggcuuuucguaccugaugaauuuuggcauagaauuccugagaaauaaugccccgcuccuccccaguccaaccacauccuuauuuagucucauaauacauccaucagucacuggucaaacaccaauacacuuuuaaacauaaguaauggcaggccagagacucauaaacagcuuucccccuugagaacauuacaaguaauauaagauacaauuaggcaaugucuuauuggguuggaagccagcugaacuuuuuacuaggugugaaaaguuauuucuugacugcugugaaaaauuaguacauuuuaaaaagguuuggaaacauaaaauuagggaaugcuccugaaggcaggucaacacagacgugcuggcuuucuguauuaggacuacgccugcuacuaccagaacuuucuuaaaauaaagaccagggacuggugagaugucucagugguuaagagcacugauuccucuucugaagguccugaguucaaaucccagcaaccacaugguggcucacaaccauccauaaugagaucugacacccucuucuggugugucugaagacagcuacaguguacuuacauauaauaaauaaaucuuaaaaacaaacaaacaaacaaacaaacaaacaaagacuagaugcuuguaggaaaagugagugaacccugaacacaaguccaauauguagggcagcccagaaccugagaaauacuauggaauauucccaggaugggcagacugaugggcccuaaaugguggcugccucacaagaaaaagacaguaccagggagggggaaaaggucucaagcagcagugugaaagaaagcagaguucaggagcauucauacaagauuagaugaacacuaugucucaaauuaaauugagggcucagggguagaaaguaaauugggagaguuaaugaagaucaaaaauuuagguuugauuuucacaucagaaaacaacuacaucaaauguuagcaaacacaaaacaggugcuaaaacccauucucuugaauuccauaauuuuggaguuuacaaaauucuaugcugucaacuucuuggggcaggauaaucuuacaguuaguguuugucuuagugugcaaaaacaugacagcauagaaaagcucauucauuguuuaauacuguuuaugccauuauagauagcgaaugcuuagaaaacgugaacaccguggcucggcucuuccaaggcuuuucuucaggguauaagaaaggagaagcaggcuguuaauuccacuugaaaauaaaacuucagcacaggcuuuugggauaacaaguaauuaugaaaaaaguuaaaaucuucaaagguagaauuuuguuauuuuggaaauucaaagcguuaacuauaaaaaaaguuucagaaacuaaguuuuuggagguaaucucaguuccagcaaucgcuaaucguuaucaucaucccagaacagaucggagaauugaaaaagaaagaaaauccacccaguaaacugggcaaggaaggucugucuccuccagacgggaguuuccuccaaggcuguuuuuaggaacuuagauugccaguccaugcagucaaaggaagaaacacauccagcuguuggcagauucugauauuuuguugcuacuucuaggauagcacaggugaauucuuacuucaguggguuuccuuccuucuuggaucuguuggaguucuugccacacccuuuuccaaggacccaccuaugcagcacuccagccccugccagcuucgcaacuugcagagaucuccauagccagaaaggcgcacugaaucuucucacugcaaugcuaacuggaaccacgaccacugcacagauuggcugauaacauacucgguuccacgaguucagcgauccaaauuuugacaagccauaaucaacaggcuuuacuuuggaugcaguuuuuaaaaauguauuuugcuacgaggguauagaaucagccaguacuggaaacaaggguggggugggugggugguagacauaucuugucugcuauaugauauaaacuaaagugaaccuacaaguagugguuguggagggggaaaugggccuguauggagaugacuccaauuaagaaggcauguucaaacugagucgcacgcaaagaacacacacaauacgagaucguuuauccauacaguccccaagaccaccguucccgggguccccgcugugauaaccucggcaggucugcugcaaccgcuaguucaacaaagcucugcgcagcgcaggaagcuccgggcauccucucccgcucgccgcucaccgcgcgcccagcccucccgcccgccggcccgggaccucucuuccugacagccccagguagcccgcgccccggcucccaugccgcgcuccgcccgacccguguucccacgucccgucggccuccggcgccccggagcgcccagacagcggcgcagggggaggggcggcgcgggccgcgggucccuggggcggccgcacgcccccucccggccccgcagcuuucccgccuuccccguuugaacagcucccgccgccuuccuccugcggcccgcucgagccccuuccccggggcggcugcagccgcuacuccaguucccggcuuggcccccgagcuaggccgcggcgggccugaagcgccucccggacggugucggggggccggagcggugggcggaggccgggcggggccguugccgccccgggguggggguccggacgggucuggugggggcuccgcucgccgcuaccuucacucggcucgcucggaucccgccucagcgccgccgacggccgccaucuuggagaaggagagaaaagcgcgagcaacaagggcgccucagucgagcccagagcgcagacuccuacugcagcggggcuaccgcgccggcgaaagagcgucgagcgcaucgaauaaaccugcuuguugagcgcggucgcgguaccguuugagaauacacuccuccguugcagguuuagucuagaaaucucuucucggucuaaacaaauaauuucaaaagucuccuguuuauucuucaauaaaaauaucuuucuguaaagaaauugcgaauaaaaaauaucaggcaauuagauuaauguagccaaacaccugccccaacccaaagucuuuacagcuccguaaacu

SEQ ID NO: 4541 - RNA, 9847 nt, Mus musculus
gaugucgcugcucaucuccaguugcugggagagucccucagccucauuggacaccgccuacaggagacagagguaagcaccacguucaauggcaggguuccuguuucuuaggaugcuuagaucuauguuuauuuaaugagcaacuacuuuauguaaaauuaugccauggaacccacaguguggugaaaauuuucaaaagauuugggaguuuaccuaucugcucucagaguuuaugguuauaccauccuguagaaaguguugcuaaaagaagucaagauaccuguaguuagguuuuagucuuuaaaaguucaguagaaguguuagagagauggcucugcuguuaaaagcacuggcugcucuucccaaagaccaggauucaaauaucagcacccacaaggaagcucacacacaaccaacucugaucuggugucuuauucaggccuacuuaggcacuacaugcauguggggcacagacaaacaugcaggcaaagcacccauacauauaaacuuguuguuuguuuuuguuuuucaagauagaguuucucuuuguagcuuugacuauccuggaacucauucuguagaccagacuggccuugaacucagagaucugccugcuccugccuccugagugcugggauuaaaggcaagcauuacugcugccaccaccugguucauauaaaauaauucuuaaaaaaaauuaagugggggggcgggggggcuagagagauagcuuagugguuaagagcaaugacuguucuuccagagauccugaguucgauucccagcaaccacaugguggcucacaacgggauuggguauacucacaugcauuagauagauagauagauagauagauagauagauagauagauagauagauagauagauaagucuuuuuucuuuuuuuucugagagagagagaccuauaaauuaaauguuuuaaaaaaaauuaaguagaagcuaggcauaccagcucagcccccuaaucccagaacuuaggagacugaagcacaauuccugcaaguucaagaucagccuggacuacaguagacugaaauacuguuucaaaaauaaauaaauaaaauaaagaagccagaguaaauuaaaaugugaaaagcuuaguugacauccugguacuuuguaagaacaggauuguucagugucauuucuguaguuugaauggucagacaagauuauauagggagaauagcucccaacuuucucugaaaaucauagcauucagaagccagaggugggaggaggaucucaagugugaggucagcuggggcuauacagugagacccuaccuuuaaagaaaggugcuagggaaaagcucacaggggcuaacccuacacagaaaacuacaggcaacuaaggacugcugaaaggagaagaaauagucuuccucagggaagagcacaccauucggauauccaauaccaaagggucagcucugagaacacaccaguaauauagaaaccgagcagauuguaguuauguguuuaggagaaaaauacacaccugcaccccuauaugcauuacaacaguuauugacuuuuuaaaaggcuaugaauuugagggggggcaugggaggauuuggugggaagauaggagagggggaaaugauguaauuauauuacaauuucaaaaaaugaaagauauauauucaccuuaaauaucagcacuugggaaacagaggcaggcagaucuuugaguuugaggccagccucuacauaauuuuagggcagccaggcuacacagaguuugaaaaaacuaaaugaaaaagaaagugggcuggaauaagggcacagcugcucuccagcagacacagauuuaauccccaacaugccguagacccucugggccccuuugucugcguggaacaggucucuagucucagguggacaaagcgucagaugaacugacagauagauguacacaggagagguguuggaucugaauguaauguuaaaucgagcauuagacuuuuuauguagaagacaauaaggaacccaccagcaagguacaaagagguuacuggauucuuacauaaaacagaggaaugcaaacacagaaggucuaacaggaaccaccugggauagaauucauuguuaacaacugggauaaacaagggcucuaccuaagauucacuuaaucuuagaagccagggucaagggcuuugugcccuugccauaguuccaguuuuagucuauuguauaguccaccuuccccuuaggccauuguaaauacguguguauggguguaacucagcuauagucuuagaagccaggugugaggucuuuacucuccuagggcaagggcuuucacacccaagucuugguucuaacuagggaguuccguucuagcuaaccaucucaugaauaauguaauacucuaaaaccaagcccgaucuacuuccuaaaccauuguaaauuccuguuuaugggagugacuuagcuuuuauucaaagugauaguguauuacuagaggcuauucugauuaucaacauucuuacugaauuuuaagcccauggucuugcucaaggacguucuaggacuguuggaacacuggcggaaggcuuuagcuaugucagaauuuaaucuuaagaggcauuuauaauaggguaauacuaaaggagagcacguggauccauacacuagacuaacucgggaauggaaacuuaauguauggguuagagauaaugccagacuccaggagcgaguuucuaugaaacuuuuugcuucaugagcagcauuuaggcaucccugccugacaagcugacucgacuggagugccguggcauuucucucuuucuuucggcucacaaauguccauauugccaauuccagggaauccaaacacccucuuuaaccaagcacaaacauaguacacagacauacagucuuuuggugcuguuuaauuaaaacuaaaggaagaaaagaauguagacaauaaauggagcuguagugugcauuuagguuguacagugcuguggaccugacagaagucuauacuucugagauuuaauuucagaggguucauuucuaacucuucugccccuuagcuaacucaguaguauggcaguucaguuuucagccuggagacauuucagcaaagaaauuauuauaugcuacugaaaaacauuuuuaaguuagucaguguagaaauauaaaagcuaaugacuuguauuuaugcaaaagcuaaauuaccguucaacagacaaaauggcaaaagccacagguguugaaucuauaucuccguucuuaggcuauuuucuaaaaagucaguagauguugaaaaaaaaaaaaaugugugcauucuuauaaauauucaaauaccuggauagguaaaaauauuuccagaauaacauauacagugaucuuuauuguauuuucacauuaaaaguugaaaauuaaaugguuuuauguaccauucauuuuccagauuuuccaaauaguucuuuuuuauuuggcaagaaguuuugaguucuuaggagauuauuccaaaaacuuacuuaguagaaaaaucuaaaugucuauuuguugucuuagggaugcuuacagucuaacuggaaagacaauucuuaugugauuuacaucuuacacacauauauguaagagcugcuuugcggguuugcauauacaccacaggcuccagccacucagcugcaugccuaaaaccacaggcaucacuuacaccucuucagaaacagugauagcauggugcuugaccugguaccagagacggcuacuagaacuaguaagcagauugcccaugcagcguggacauuauuaaugacaucaugcuauuccaacggcauacgugcaguuuagaauugggaauugaagcugaguggcgagcacaccuguaaccccagaaaauaagaggggaaggcaagaggaucacaaauuugaaaccagcagcaauacauaaaaacaaacaguagcaaaccccuuccugccccaaaauccugagcaacugcaaccaugcaaggggaaacugaauuuaaggggugguuaccauaaccagaaagggaaaaaaguucacacauucuauuagcacuuaucuucuguaacagucuucauaaauguuuaaugcgccaaaaguucacccuuuuaucacaaugcaggacuaguggcucuuaauacucuacacaguuuugaacccauaacuaucuaaaacauuuucauuacucuagaaaguaacuucaagcccauuagcagucauuucucauugcguaugugcugugugcaguccuuguaguacauagcccacacaugagaaguacaagaaugcaguguccauggaggccaaaggagggcguccauucccuggagcugaagucacagggaguuaggaacuaccaugugggugcugggaauugagucuucuagaagagcagccugugcucuuaacuccugaaccaucucuccagucccaugauuuuuaucuaauacacugccuaguggauauuaaaauaguugaaguuccuacaugucacuuaacauaugcauaccacacuuucaggaauacugauuuacauaacucauuaauguagacauuaaauaucugagccuuguuaucacaaauuuacacaacugucaguaccaaaaauagagcucaacuguccuuccccuccgugagcagcucuccuguuaguaauugcuguuaguaauuacaagacuuaaagaacagugccaccuaagcauagcacuauaguucugcaugccaggaagauggcugagugucucaaaagugacuucuaggccagcuugagcuaaaaagugagagaaaaaaaaaguagugugccagguuagggaugccaaaggccuagcagaagggagugggauagauaacuggaaagagaaguugcaaacagaagacagcacauuccuguuaacccuggagucuuuugcagaggucuguugaggcuuuaagugggucuuaagaagagucuuccugguuaacuguuacagggcaggcauacaacacauaagguaggaagaggaggugagcaucaaagccaggugucuugguggacacugagguauuuguaguuccuguuuuggaacuguaggggaguuuuugaguaggacggguguaauuagaguuccuauuggccugagaacaucuauuuuagauagugauugaaagaagccagcaccgggaagaagguacagcagcaaugucguguagaggugguagagacucgugguuauugagaucuugcuugguuacauggagugaaucccgguagccuguggguccagccucucacggguccucugcugucuccgcacacugccgucuuaguguguuauugagaggacauaaaggagcgcugaacagagagcaacugagagugugacucaguugucugcuuuucuugcagggcaugguggcagugucuggaagcuugucagugcuccuagauuccauuaucugugcucuuggcccucuggcaugccugaccacacaacuaccugaacugaacggcuguccuaaacaggucuuggugaguuuuuuuuuuugugguggcggugguggugguuucccuuaccuuuggagggcuggagccuuugggagccuuucuaccccuaccuuaaugagcacugcccagcacuccucaugaggugaauagcacuauuacauacuguccacagaccaugacacuguguaucagcugcaugauaugauuucagugaaacuagaaaacaugccguuuuucacaacacuacucuggagagagcaguccagcuuagcccuugaggagccgcagcugaaagcagcucguguguuuuguccacuuguucccaucucucuccugagcaugccuugucucggggacugcagugaggugugccacagcugaguccuuucuccuuauuuacagucaaacacgcuggacaacauugcauacauuaugccuggacugugacuuccaagacgccugggacagaagacugucuaccccuucgcuagucuauguauagaugacuguuccagacccuccacugaccucuggguguagguuuuaaauuuuuauaaucuauauauacguauauaauguacaguauauacauaggauauaacuacuuugcuuuuaauaauuuuaugaaauggcaaagguuuagcuaaaaggaaacuuuagcaugaaugugggcuuggaauuauuuuuuugugaaaaaaaaaucugccuuaaaaaaaaucaguguaauuuggggacuaggggcuuauucugggugccauguauaucuccucauagacugcuaaaaugugauuuuuuuuuuuuuuccaagcuuggguuuaccuccagacccaucacugaccauuugccuuaccugucuuauaaucagaaauguaguaaagaucuugggaggaggccagcugacuacaaacuuuuggacauggaguaaccuggguggggagguggagcuuagguggacuggguaggggacucauuccaauuccuacuaaagagauaccugugucuccaguuuuauuguaaccacgguuccacagagucaucgguaccaucuauagccucagcuaugugauucuuggcagcagagaaauaaauaccuugcagaaaccaaagcuguuggugccaccuguugaaccugcuugucuggccagcaaggcuugguguauaaaaaccaaagcugccaucuuccacuagcagcauugguugcccaacaaauccugaggauucugcugcuuagcuguuuggugguucuugguucagcucugguuccccugguggguacauugugcucugcauuccacacagagcuggaucacaaagaaguucuugguucucaggaggguuaucuauaugugcgugugaguguauauuuuaauuauguguauuuaacucuuuagaauuucuuagauuuuaauuuauccuguaaauuucuguauauauaauuuaauaacaagccuccaccagcaggagcauguggagcauacagauuugucauuucuuaaugucugucuaaaagcuccaagacguccauauguuaagguguugugacucagaaaggaacuucauggcccucaauaauguuaggaaagugaaauagaaaggaaugucaccauuccuaauuucccuuauucccaaagacccagaccugcuuccccauuagagagaagauagcugagugcuccaggguugcuugggaacucggugagagauucccuucccugccaaaaccaagcugaguuaauaaccaugcuuucuucuaauggccuggauggaacgaggcagcaucacaguaaaccuuuggggaccauguagccagcuggcauccuagggaacuccuucccauagcccgacugcugucacagcuaagcuucucacaggacugugucagcucagagcaguuuugagauuuaaucugagaaauagggaaaggaacagaaauaugugggaacugaaaucaagcagagcagaaauuuccauuugaguuaacaugucagaaccucauuugacccugcagaaguuuccugugagaaaugguaucaaggagaggccagggaagacaugugugguagaggaagcagccaguccuccauugcccuugcuacagacaguagugaacuccuaaggagaaccggcuuuuucggguuuguuuuccucugaagccuagcccuguuguauuuguauuaaagauuuguacacauuuguauaauaaucuguaccuugugguauuugguacuauuagaggaaaaauuuuggauucaggccuucuugcuguuuuuauaucauuguuuuauuuuguuuuuuuaaauaaauccuagugguuugauccaaauccuauuacaguuguauaaagaaacaauauuuuguacuuauauuaaagaucucauuuuuaauauuuauaguccagucuuagcugucuuuucccuaauugggcuaaucguagucgguauaacucuacucuacccugacauuucucuauaagggagugggggcugaagagaugguucacuggugaagaauauuuccugcccuugauaaggacccaaguuagaucccaacacucauccaauugaauguaacuccaguuucagaggaucagucacccucuguagccuccuuaggcaccagcacacaagugcauauacccacacagagguacacacacacacacaaacacaaaauuuaaaaauuuuaaaaccaaauccugaaauaaaggucaaguuaccauguuccuaucuauccugggccaugcagcccuugggucucagguugaacacaccuuauauguaaaggcucucaaauaucauuugcauguauuauaaaaggagagaauaugauaguuguggcauagcaaaugaaaccauuuaaaauauugcuauuggccuaaaucaaaaaguauccaucaaucuuuugucagaguugcaugaaaauucuaugccaaaaaacagacaguucauaucccaggagcuuuccagagucuugucuauuuuaaauaaaaaaaaaaugugaugucaccuccuugucucugagucaacagccacauggccugaagugaauaugugcuaauacugugaacauugaaauauggaaauuugaccuuucaugguuaaggaaaaaguuaauggaaaaacaaaauguuaaaagucauaaguagcaaaaaaaaaauaauaauaauaauaaggcugcaugcuaugaugcacauacuucuccaauuccaacaccccagggaucugaguuugaggccagacaagggauauugucaaaaaaaaagggggggugggggggacugcagcaccggguuucaguguggcaaaguccuagguaugagcccugccaaaauggaggaggaagugugauggcccacaguacuuguuuaaucucagauuaaauguggugagagaaucgauuccuccacguuuucuucugaccucucuguaugcaccauggaacacacacauauagaguuaaaaaaaaauuuaaaaguuuaaaacauaaugccuuacaaagauacagcaaggaggaagcaaccauuacggaaugccuuaugagugauuuucaugucaccucaauacucugaaagcauuacauuauggauauuuacagcugaggggaacagauaaggaaaaagcacuuuuccgguuugccaggugagagccaaggcagaugagguggcuuaugaggugaaagcauuugccacaggacaggcaguucauucucugucucaagagagcaaaaacccaggcccuugccuccucuggcucuuggagcggggagacaucaaauggaaauuucgaguccgacuugggcaaggaggcugucauccucagggcuugguccccaggacuaaaggcuaagacacuaauacuaauaccugucugaguaugcguaaccugacccaggucuuucccuggccagagacccaguuucaggaugucaagacuuccaggcuccacaguggcgcgcacugaagcuucaggggcguggcuuagaagccggcccucccaggccccgcccugguguggcgucagccacggcccaggggcagccuaguagggggcggggccucguggcugcgcuccagagcccccgccugccggcaccaccccgcgggcuggccaacgggucacguggcgggucggcggcgccggcgguugcugucaccugauucugggagcugguggcagcgguagccgcggcaauggacuuucuccugggaaauccguucagcucuccggugggacaacggaucggugaguccccggagccgcgcgcagucccgccccugugugccgcucuggccuuggcccugggaccugucggaguccgcagucuggcagacaggagggaggcuaggcggugaggcug

SEQ ID NO: 4542 - RNA, 7815 nt, Mus musculus
ugcagaugcccccacagauaugggcaguuccuggguaccagucucagggaguuaggacacuggagcucagacugaggccagaccugggcgaggaaggcaagauaaagagcauacaccuauaaucccaguacucaagagacugagacaaaucaauugccaugaguuugaggcuagcuugggcuacagagacaacuuguguuuucaaagugcacacacacacucacauacacacacaugugcacauacagguagaucuguccuuggauucccaaaaccuccucagccccauagacaugaaucagaaauuaaugaccagcaucaggguccuggggcuccuuuggagcagaggcaggaaacccacagacuagacuguguuguagcuguugggcuggcucaggagaggugcucucagucccugucugcuucugacucuugcagcccuaucuauaauggaacacagaggcacccccacucccucuccugcccaaaggacuggugaacagcagcugaaaagcaauggaaauggggacguguuagugcuacauggcacagaaaggugaugugcuauuccaagaggaagucagagccaggcggcagccaagccuagaccugucagagacuggcuagguaggggucaaagaagagagcuucagaggacucucacuugacugucaggguggacuauaccaggcuuacucuccaaagggccacacaguaaauccucaagacuucagaggccaucuggucucuuaaaauacucaacaagaucauuguugcagagagagccaaagacaauagguaaaagaauagguguggucaugcuccaauaaaacuauaugaccauguauuugaguucaugucauugcuaugugucauuaaacauuauucuucucaggugugguacugcaugccucuaaucccaguacucaggaggcagaggcagaggcaggcugauccaggccagccuggucugcauagggagacccuaucucaaaacaaugucuacguagggcuuugccuuggcuggacaaauucuaguaaugcccaaggugaccuugagucagaacacuagcuuuguuacuugaaguagguuacuaaccucacuaucucugguuccuccucuguaaaaggaggcuaauaauagcaccuggcaggugggguugcuguguauauacuguguggcauuugaagcacuugguuugugccugccugaccagaggcauccacagcuguuagcccuggggauucuuguagguggugucacuguuccuagggcacucuuacugacagagcuaaaguaauaaugcaggacccugacuccaguccagcuuguguuuuggucuuugugucauugagauaugagcagucacuggcuggguggcugcacauucacaggcuggucagguuucaggcagugggguggagccaguucuccuggggauugaaggcucagccugacuguggauugaacugguaaauagguuuuguucccacauggaacacugagaaauaagaguaaaauccuaaauuucuggucuugggggugguguucaggcagcuaaacuaaaacucucaguauguagcuaacuuggggcugccauuccauaacuggaauucaggacacugacucuagcccucugacgagguucugaucuaggccagggcucucaaacugccacauuccucugccgccuccugaccuucuguaucugugugccuccuuuaucauuuccauggugcuuuccuuuaauugccucguuuaagcuccuuuaguuccauccuucauaauuauguccaugaugucaugacagcaagcacccuuaccaaugagccauugcccuccaucauguggaugauccuuaaucagugaagacuuccuuaaaggauuggcauccccagagcaagggaaacucugccagccacacgucucugcagucuuguuagugcgugccuuaaaguuaaaaucagugagcccacugguauaugcacacucauuuauuuauucucucccucucugucucugacucucugucucucuggcucugucuuucucucucuggcucugucugucuaucugucugucugucugucucucucucucucucucucucucucagucuuccauuucucuuauauuuuguguguguguguguguguguguguguguguguguguuacaugguacaugaaugcacauguguguauguacaguuccguguguauuuguguaccuguguauggaagucagaggucagaguuaaaugucuuccucgauugcuuuuuugagaguggcugucucauuaagccuggugcacuccaauuuugcagacuaccuguccaguagcuccugguguuguccugucucugccucuccagugcugugguuacauguacacaccagauacccagcuucuuauguagugcugggaugggaagccacgucauuauguuacacagcaagcacuuagccuuaccuuguuucuccauuucucugagcccuaacauaucucagagcucucuccaccucccauacucaggcuguccucacaucuugcucaaucauggguggaguagagaaaugucaccaagagucagcccuugcauucauggucuuggucccuccugccugaacaguuuaggaaacccuccuuuguguaaccaaaaguuucuucagcaagaacuuauaguuaguuacaucuucuugaaaacuguggacugaggaaacaauaugcuccuuaagguauuuuaagguuucucuuguggccugugguuuaaaaaaaugacaggggagagacagccaggguuuuaagaaaggacauuucagcaacuuaggaaacugauagaaguuuccaggcuggaucuagaaggaaagaauuguugauuuggaaaguaggcuucaugacaacuugcugacuagaaagaaaaaaaaaaaaaguuggcuacuguauauaacuuuuagaguauucuuuaugugaagguuugaaauuuugggcugguuuguggcugauauuuuuggggugaguaacauuuguuuuggugcugaugcugcagucagugggcacaacacgcuuaaccugcauccuuuuuuuuuuucuaaagauuuauuuauuauuauacauaaguacacuguagcugacuucugacucacaagaagaggugucagaucucauuacuggugguugugacccaccaugugguugcugggauuugaacucauggcaugaggaagagcagucagugcucuuaccugcugagccaucuugccagcccaaccugcauacuuucaucuccuucucacaacccuugggaaguggguaccuuaggugcccuauucugcaaaggaagaaugaggcucagaagggcuaaggcauucacucggggucacacagccacugacugcugaagucaggaccuacaaugcaaauugucuauucacaucccauguuucuagucucccuccucaccacuguccugcaggacugaaagggacucacuggucuucuccaugagucacaggguauucaucuugagugaugugugcacuaguggcuccugucuuccugcaucuuccauaccaauguccuccucagggcagggagcucugcugaggguaccagcaguguagaucucuuuaccaggagaacagagcguacagguaccuuccagggacucccacuuuguucaaguagcuaggaaugagugaagaagagggacuaggaaugcaaaacagugugagcuuagggagaucgucugucacaguaacaggucaacaugguguucaugaaugucauagaacagauauccacagaacccuaguaucuauuuugggcaaauuaguugcagccaucuccuugaggauucccacacugcacuucuagcugcacagcuagucugcaucucagaggguuggucauucagaguggcuggauagaaucauguccagaauugacuuucauugggaacaaggauguuagguuagagggcagauuaaggaaccuggaccagguguggugguggcacaugccuauaaucauagcacuugggagcagaggcagguggauuucugaguucgaggccagccuggucuacagagugaguuccaggacagccagggcuacacagagaaacccugucucaaaaaaaaaaaaaaaaaaaagaaaaagaaaaagaaaaagaaaagaagagagagagaaaaggaaggaaggaaggaaggaagggagggaggaaggaaggaaggaaggaaggaaggaaggaaggaaggaaggaaggaagaacaaacuuagaaucuucugauagguugcaauuuuauccaguagcuaugagggaucaggaaugccagggugguacuucuccuaaccacagugcuguacaggugaccgugcuaaaaauacagcaggagcaucacccaguuacuuagcaaacagguccugcaggcuucaucuaguguagagaacuuggagacucaggagacggugcccucagauccacuuucgcccuaauggaagggacagacagaccaagaaaccaacacuguaccauguuccgaggagucuacuagacagagcugagaguugcauucuaugcagagugcugguguaggagcaggcagggagauggcaggguacccagaaagugaucugaccuuaaugcugggcaaggaacugaguuaagagacaagggcacugucccagaagaauugcgcauguucaaaaguccagaaggcugagugcgggccaccaggcuguuucauuccagguaaaaagcugagcuguguaaggugcagaugcaucacagcacuuggguccugacugccaaacuccaggaaaccaggacacuagauucauacugaagguaccuacaacagcacagccacccuguaggaaagccagccaguggggccugauaguguaaucccaagcagcuugcccugcuuugagccacugccaacaggaaaccugaccaauagagccugagccuugcauauguuuaccuauuaagaaauuugggcgcuggagagauggcucagcggguaagagcacugacugcucuuccaaaaguccuuaguucaaaucccagcaaccacauggugacucacaaccaccaugagaucugaugcccucuucuggugugucugaagucaguuacaguauacuuauguauaauaauaaauaaaucuaaaaaaaagaaaaaaagaaagaaauuuggaagcuggguagugguggcgcaugccuuuaauccuagcacaaaagaagaaguuuggaaagacgcaacuuuccacggacuggcagcucauuaauguccuucucacaggucuuccuuguugugagcuuggaggcagaggagugaguauaacaaagaauaccaagguccaggccguagagcugaacugcacaccuggcagccuggagacucaguacacuacugcacaaauacaaaagggcccucuccucucuacuacccagagugugggcugggaggguuaugagcuggacagggagagguggcuuucagcaggcagagcagaguggccagcacucugggguaguagacacucuucagcauuggcuaacccgucagcuagggugcaggagaggaggguuauagagcucugugagugcuggucuuuugauccuuguuuucuggugaucucaugguacuggaggaggcuggugaggugauggcuaaggauggaugugggugagguaaggguugaauguacaucaacagacucauuuccucuucugcauccagcccuacagcuagcucaugugcugacucagccucccuuccugcauuagcugccauagccuccauugggcugcacacuugcugaugguagggccuuguugaccuugcuuccuaaugucuccccagagucuggacauguuucaagacauuugggaggcaugaaaccauggcuacaggucuguuugagccuauaacccaggugggaagcaaaggcaggaggaucaauacaaaucccaggccaguccugucuuacagaguaagcuccaggccagccuugucuacaguaauucccaagccaguccuuuacacaggaaguuccaggauauccauaucuacagaguaaacucuaggucagccuugucuacagaagaaguucuaggucaggggaguaauaauaaagcaagauccuuccaauaaacaaauaaacaaauaaauaaauaaauaaauaaaguggcuuugagaaacagacuuuuuagagugaaucucugcuuugcagcuuaccaaccauguagcuguaggcaagucugagcccucuguuuccccccacccccaguucuagccuguuuugaggggaguaagugucacuguguguaggacauccucaguccuauguuagguucguacugugcccagcgagcauguauguaaggaugaccuucccgacagcacucagggaugugaaagaaggguucagaaggaggggacucuguauugacucuuccucucacucugaagaauucgggucaugacucuuggaagcagagcuacagauaauuaaucaacagaaaagagagcuauuuagaauugcacugaagagcagggaaugggaucacaguuccggcuuggacagguaauggugccgguccagaguuagcccugucacaaaagcccuagcagcuuccggccugugcaggcaaggagacagccgauauggcaacaggaaggcaguuggucauagcuguaaugcuaucuguacuccacugagcacccacagaaugauuccaagggacaggagagcagggcuccucugggaccacaagggaaaauguccugccagggauucugggucaccgcugaagaugaacaguuuggaggcaagggcaagcacccagcaacuacccaaauacaugaauuuuggccaaggcuuauuccuucuuguugucucaagauguuccucacagccuucacaugacuucagauaguugacugcugaggagcuucuucugcuaggaagaaggcaggcucaaccagaucugacacacagacacaugacccauagugaacauguuugcguuaggagguauggucagcaggccagagccacugcccagaucaagucacuaaguugccucugggcagaacacaccugcaucaaacccaacacaggacuagcugcugaucccaggacugcuauccuugagcauuagcaagcuuauaacgauaacagagaccuccaagagcuaggagaaaagagccacugcccagcagcccuugaaagucagccagcagcuagagguagaggagucagcuaugcucugggaagcugguaaggguuuuuauucccuucuuaaaauagcagguuacgccaggcaguagugguacaugccuuuaaucccagcacuuggcagguggaucucugaguucgaggccagccuggucuacagagugaguuccaggacagccagggcuaaacagagaaacacugucucggaaaaaaaaauaaagaagagaagagaagagaagagaagagaagagaagagaagagaaggaaaaaagaaaagaaaaggaaaaaaaagaagaagaagaaaaaaaaacaaaaacaaaaaccaaaacuaaaaacaaaauagcaaguuacuuucauguuuaaaaacaaaacaugacaauccuguucucaaauuccacacuuacacgauaccuugacacaucucagggcaagucagaagagacugcaauucuucaccugcucagaugaucuucuuaccugugccaccaccuccucuuuuucuuccuucuccuguuuaggucacaguccuccuccucucugcuugucaccauaucuccaucucu

SEQ ID NO: 4543 - RNA, 7006 nt, Mus musculus
ucuagugacuguuagauaaugccauuuauuauuucacacagaaguuagagaccaagguuacaacuauuaaauaauucuuucccacccaccccucaaaagauagccccacuuuguuaggaaaaacaagacaaaacaaaacaacaaaauaccauuacucugguagaacuggggaaauaauaaaaaacaagacagaaauacgagacagaaaugucuggaaacggauaucaaaguggccauggcacugggggacagcagucguggucagucaacauggaugcuuacaaccaugggcacugggcucagaacagcugcuuuuacaggccaguuuuggggcucugcugcaggauuuggggcugcugguuucaaaguucaggccacuggcuggaugugcuuuuggugagggaacugugucagguaucucccuccauuccagagagaaaggaaacacagggagugggcuagggaccccaaaagcuuucuuagaggcccaagagaagagagccaggcaagauucucccuuacagagagaaggccacauuggacagaguucacagccccugggggccaguauugcauuuacauggcauaaauucccacugccacuguugccaacaggaagcugagagugaggacccacuggaggagcggugucugggaugagcuagugcugaucugggguuucccucggggugucucugcaggggcaguaucugaaggagaaaaagacaaggucagacucacacagcccgggguggaugacuuuaaagucacacagagcacaggacacucggugucaugucugcuacaguuccaguccaaggccaggaucugcuacagcacaaaccacuagccacugcucaaauaccuuuaaagauaggaguucacgaacucccccaagcuguucauucuucuaugccacaucaaaccaaaguccccugauccaaagagguagcuaauucuaucaggacugaccacauuucagcccaccagaaacaguaccacuaauaacaggguugugggguccggccuccguugggagagccuugggcaaaaggugggcccauucaaguaaucaaguuucacagaacaugcccugcccagcguccaucacccacucccugugccauacugucccaggguaacaggcucagugaaggcacauuuugugucacuuuggucuuuuuugaaacuuucuccugcuccaaagguaauacagcaaggcacaggagaagggcugacacccagagucagguaaguacaugucuccuuugucucuccuggagggucagcaauagaaauagguucccaaauccuugccuuauauggggaccugcuuggaaaccuuuagugggucugaaaagguaaacacacccuagcuuuuuaugaaagauugaagcagagagauuguuugaucucugcuaacaaagcaugacugugccccuccccccaaaaugggaggaggggucuaaauggaagaauuucuaugccagugacuuuuaagggcuuuauaugcaccucagucaaugagcuacauagcccccaacuccuguuuuccaauguggaaaaacugagguagaaaaaucuuauagcucacccacagucacauacuaccagcuuacccugggcgcuuuugucuguacccuauuucugauuuaaaacauucagcaaagaggagaguaaagaagucccagcugggcuaaggagagccagaagcaagaggccaccuuuaccuugcaccaggcuagcaggccucugacgaagugacgccaucugugagggacucuggucuuuguguuccucugucagcaucaccugcagcuccucaaacagcuagaagacaagacaagacauacugccuguuaaugauacucacgggguggggggaccccagccgaaggcaggacuugaagcauguuaugaaauauuguacaaaugacacaaccuaaggaaacuaucacacacccaugugucuuucacuuaccucaucagagaugugaaagguuuaguuggcccccugccugugcccucacuuggaucccaccaguaacacuguccugaaucaggacuucaggaucuuauuugugucccuaugaggagaacuaguuuguuccucugaaauaacacauaauguauggcugcugugcagccuacagccuguucucucuucuugacugugcauuggugaguuccuccuugcuaagccaugugccauggaguuugcuaaugugcuuuugcaggugaggaaaccacaacuccuggaguagggcuugcuugagaucgaccagggaugaggauggagacccaguucucagcugggccuuugucuaaucucuuuucuuggaguuuuguuuuguuucuuuaagacaggguuucuuuguguagccuuggcuguccuagaacuagcuguguaaagcaggcugaccuggaacucagagauccuccugucucugccuucugcgugcugggauuaaaggaaugugccaccacuuuccuguuucuaaacucauucuuuauaccauauccucagaaggccucagauggauggucuagauguaguugaguuuaagagauuugaaagguuacuucucuaacaggcgcuugccugguaggacuuuuaaaggaucucaaggcugaaagugggagccagagggucaacaaauuagaacccugaccaccauagcauccaugguuccaacaggacagucuacuccccuccagcucugucuuucagggccuugcucaaaacaaugaacuaaagacaguucaaagauuaagagcauuaauugcucuccagaggaucugaguucaauucccagcucccacauggcagcucccagcugucuguaacuccaccgccaacagaucugacaccaagcaaauaugcaugcaggcaaaacaucaaugcacagcaaauaaaaaccaguaaauggcaccugaaguaucugggcaucggaaacccuuacagugccaaccuggcuaugcacaagugcacaagcacuccagguccagcugcaccaucucagaggacaucaucucucacaauaagagagcgauagcaucaguaaguuuuacccuguauuacuccucccacagggacugaacuguaucaacggaggauaaagagauuugcccacaaucacccagcuagaaagcagcaaaacaggacccuggucccaagucuuuguacuaacuaugacuccaggacccucccuccaauuaacuggaguguggcucaaagaagcaguggggcucaccucaauguugagcaggaaggcggucuuagccucuucugucacccugugcuugaccucaggugucaucuccagaguguucauucgagcacgauagagcuguuugaacuugguggggcugucgauguucgggaagguaaaaaaagccaggcccuccccagagcugggcaaggccauggccuucugugcaaucuucuucaggaccugacccccugagaggucacccagguagcggguauaugcgugggccaccagcagcucagggugagugcgccccaccucguggagacgcuuuacauagugcuguguggcuggcgugcaagggaugauuuccugccagugaggcccauaccagaaggccauguccugcuccagggcagcccuucggugcagcuccucagggaaguagaguggggcauagacuggguucugcuuguugcgcucuaucuccucuuccagggccguguagauaugguacaaggaagccaucaccagcugaaaaauagagucaacuugucccuagaagagccuacaugacugcauucuggaagguaggccuccuguccccaccacccuccacucccccacccacagucaguguacucuacccugugucugauguuugcuacuggcaucaguuaaacaaccgcaaaaucagucuauuguauauacugugcauuuaagcccggcugucgaaaccccauuucucaggcaagaaggcucggagguuaaaugagguagccaaucucacuguggggacaggacacugcagggcuaaggcaaacuucuccuugccuucagaggcaaguugaaaucgggucaggagaucugggugcagugguacaugccugugguccgaauaggaggcugacacaggagaacugcguguuccugaacuguguagugagacccccaucuaauaacccaagagcucgagcucggauugugggucagugguaaagaacccagccagcauguacgaggcccugaguuaaccaggucaagagcacaggcuccgaaccuaggccaucuuuguuugauuuuggucuuuuccaccuaaagcugacaggauggccucuuauccucgaugagucuucuuccccuuaugcacgucaaagguugagauaagaauauaacgggaccaacucagaauacauguuccuaagccuuaaccauccugcugcacuggccccacccccacccgcaucacaucuucuccucacugagccacaguaucaauguaauaaggugacuuccuuggacaggcccucaucauuccuggcuccaaccuccccguuaaauuauuggcauaagcacugggcauaccugcuauaccccagugcucuggucaaccuacacgucacauaccuuaaagccuucucuggacaccugacccuucugaaaguucuucaugaacucagcauucucggcuuggauguguaccuccuugguggccuccuucaaggccucagacaaauccuggggcaugcuguggaggaggagaggagaaucagcaggggaucaagcgaugucugugaaugauuagaccugcagaauagcuccagccuccaauguuggccaagccaccgucuuaaccaugcaaacagaugucagucauuaaguacuaugggauauuguccccaaaaccacaggcagaaucccuauucuaguuauuuccaguaaaggggaggcaagguauggccugaccacagugaagaaccauacuaguccaaccacuaugcucaaagggagauuuuuuuuuuccaagacaggguuuuucucuauguggcccuggcuguccuuagaacucacucuguagaucagacuggccucaaauucagagaucugcuuaccucugccuccugagugcugggauuaaaaacaugcaccaccacagccuggcuaaggguagagacuuuggugagcuuuuagauccaaccugaagacauuucuuuaaaaaauucagcuacagauuuuacaaccagcggagugugauguuacacauccuuaauuccagcauucaggaggcagagggagggcagaucucuuaguuugaugucagccuggucugucuacauagugaaggaaguucagcacagggcuauauaggaagagucucaaaacaaacaaacaaacaaacaaacccaccaaauccaacuuucacacacacacacacacgcucuauacucaaaguaucugcauuaaauaguuucuguaauccagcaggaggauuggagaguuucagaccaguccggcacgaucuuuaaaucaaaaaggugccgauacuguaccuuagugguacagugcuugccuagaaugucugaaguacuaaauucaauccuuacugcuaaagucagggaugaggauuaaacacuggaaggaggcucagccaggaaaagcacuugccaccaugccugauaagccaaucuuucuuggaacccacaugguggucugagaaaugacuccuuucaaguccucugaccuucacauguuuaaugugucacucuacaugcacaauaaauaaaauguaaugagacacuuuaaauaaaaauauaaaaauaagguuggugggcuggagagguggcucagcggucaagagcacugacugcucuucuaaagguccuguguucaauucccagcaaccacaugguggguucugacaccuucaucugcugugucugaugacagcuauaguguacucauauacauuaaauaaauaaauaaauaaauacauaaauauuuuaaaaaaaaacuuuuuuuuaaaaaaaguaugauuggguuuauuaaaaaaaaaaaaaaaaagagcuggguggaauggcacaugccucuaaugucagcacuagggaggcagaagcagacagaucucugaguucuaggccagccggaucuacagagugaauuccaagacauccagggcuacaaagaggaacucugucucaaaagucaaagaggagaaggaggaggaggaggagaaggaggaggaggaggaggaggaggaggaggaggaggaggaggaggaggaggagaagccaagcauggugguggagcacguucaaucucaggaagcaaagugaagcgaacuggaguucaaggccaacuugaucuacuagggaguuccagaguuccaggacuacauagacccugucuccaaaacaaaacacacaaaaaccccuccucuccccacacacccccaaacaaaaaacaccccaaccucagcacccucuaguucugcuacuggccucccugcaucuuacaaaucgucugagguuggaaauugauaagugaccacuccgcgccagcaaaagacaagcuccccaacccccaaccccaagaauagugaguacggguuccaggacuuagcagugcguucaccaucccucaaaccuggauacuacaagacacucccaaucgucaccuccagcgugucagaggagugaaucacauuuucucccuccagcuucccauagcuacagguagacugggcgguaacucguccccuggccccgcagccugcauucccaggcaggauaagggacaccggucacagcucccuuccccacacagucgcuugccugucgggcuguggacgcuccaucaccggacugggcuaguucaggcugguucugcucgauucaggcuccgggcuaugcucgagacggcucugcgcgggcaggcuccacucacugguuguaugcggaaacucuggaggcgacuggagaccgugagcgagcagcugcccgcgccagcccuuuaag

SEQ ID NO: 4544 - RNA, 18933 nt, Mus musculus
gaacgaaccaauaggagcgcagagaccgcgguggacaaacgcggaggcugguuuuucccgcgaaagucggcuuccucuaggagggcugagguucguguggcgcgccgcugugaggugagggaauugcgggaccccgucuagggaagcucccgccgccccggggugcucagcucucugucucccuugacccagguacagucaugucgggcuucgacgacccgggcauuuucuacagcgacagcuucgguggcgaccccggugcggaagagggccaggcccgcaagucgcaacugcagaggcgauucaaggaguuccugagacaguaccgagugggcaccgaucgcacgggcuucaccuucaaguacaggugcgacaguguccgugaaccauucuuacgggggacgccuuuucuugacagucccucuucaggccuaaauuuaggauagaguggucuacaauuaggugucuuuugagagaggugggggcauuggugccugugaggaccggggugcacaggcacugcugcugacggucccucaaugcacccuuccugucccucugccccuuuguugaccacuaaagagaugaacucaagcggcauuacaaccugggugaauacuggaucgagguggagauggaggaccuggccaguuuugacgaggaacuggcugaccacuugcauaaacagccggccgagcacuuacagcuggugaguagcacccauuucagagccuccuaaacccgggcccugccccaucaucaccagcagcuuaugccuuuccucuucuucagcuugaggaagcugccaaggagguggcagaugaggugacccggccccggccagcuggagaugagcugcuccaagacauccaggucaugcucaagucagaugccagcccgucgagcauucggauucugaagguaggaguuuauugaauggcuagucaggguggcauggccgcuguguggugcagaaggcgucugagacagguagcuuggagcaccagaugugugacccugaccaagacauuugacuuaacuuagucuuuauccuguguaaaauuaccucaaugggguugaugucuuaaagggaaggcagaguugagucuugcagaacaacagugaguuccuauccaucagggagacuaaaaaaauaguaaaugccauccauaacugggaggcagaaguagaagccugguguacaugagacccugucucgaaaagaaaagaacguggggacaauguggcuauugcugagaggguagagaguugaggaagaauacuuuagaggaaguguuguuggagcugaaauugauugauguguagccagucgggucaaaaccuugaagaguguuccaccagacucagucuaaugaaggauugcaacagggaaaccaauggaaaucaucucguagguguccucugguacaagucauuccuugauuuaagccugaaucauaauuaaggcuuaagcccuuuaguuuuguuucguuguuuuguuuuuuuccgagacaggguuucucuguauagcccuggcuguccuggaacucacucuguagaccaggccggcauugaauucagaaauccgccugccucugccucccgagugcugggauuaauuguccuacauucuuaucacuggcaugcuuguggcccuuucauaguuuaagagucuugugcauguguguguucucuaaucuagcccaagaugccccgaguuggagaaaugguagggagauugucucaccuguagacuggugaggcuggcacagaaagcaauggaaugugugagaauguuucacuguguauagugaagauaacagagacuaaaaagaagaggacuugucaucuagcuuaaugauuaguaguaacaggccagccauuuugacuuuacugacuccuaacaguauaugucccugaaaggugaggauuuuauuuugaagcaggguuucauuacauagcagcucuggcuguccggaacuuacuauauagacuggucuggcuuugaacucagauccaccugucucugucucuaaagugaugguaucaaaggugugcaccaccacgucuggcacaaggaaucauuuuuacagcaugacuauuaaugaauggucuaaugaauacauucuaaagagacacuuuagcuaucagaccacuaaacaauugugcccccucccccccgaauuugggauuuccucaggaaucucauucauaccugggaaagaaaagccugaaccacuaguggaaacucuuaucucuagaaauggguuuuacaguagagaaacagugaugggucaauggugggugggaccacacagcuugaucaagcugacuugauagacauaccccugacucuguuuaaacuuugaucuaacuuuaggaugccugaggaugggcucaggggauguggauaaagagucuacccaaucucuuugcucuucuucccagggugacccucuugaacacgucucccccuucugcuuuuuacugugaauauuuuaauuggcuacuugaggaugaguggcuaaucuggcuucuugguauauaggugugacccuuuguuugguaacaugaucauaguaacaucacaauuaacaguuaguguuaguaucuagugagauggagucguuaagauggugaaccugaggcugacagaauguccauagcaguuggugacaaaauugagcuagcaccagggccucugucuugugucaauucucuggaacagcacaggaagcuacugucagggcuggaguuugggucuucuggguuuugucguaaaauauguuucauguuucccuugucucccagucccuugccaugcucugcaaggcccuugaaaagugagugcuuguguaugaggcuccugaaccuggugcccagguuaccucacauuaggugggugcucuggaaagucugagcuaaacuaugagccauggauuugucaccuccagaucuugcccgugucauuccucagcccuucacauaacuccucguucuccuuaaucaucaagucuucuuguggcuuuguuacagucagacaugaugucacaccuggugaagaucccuggcaucaucauuucagccucugcaguccgugccaaggcuacucguaucuccauucagugccgcagcugccacaauacccucaccaauaucgccaugcgcccaggccuagagggcuaugcccuucccaggaagugcaauaugugaguguguagccaaagggacucuggggaaugaccugaaguaucaaaaaagcuggcaacccuggcaagugcugccuguacugcuuguuagagaccuuaaggcaaagacugggaagcacucuauccuugaguuaggcaggaucaauauacccagcccagugucccuucaggcaguugaaauuuugccccaccuggauaauaauccacauggccuguguguggaauccaagguuggggaggaaacaguccaggggauugagucuauauggaaacuguuucucugucucucuaagccccuggcuauccuggagcucacucguauagaccaggcuggcuuugaacucaaaaauuugucugccucugccucucgaguguuggguggcaugugccaucaccagcuggcuuacagaaucuucuaaagcaaacuggauugcugggcuagaccaguacagugugcccacuguacugccuaagaacaugacuauacuacuugauauuuagcauauuguuaaacuauagugguagaauguguggacuuccaguuaguaggacuuuaaaaauuuacuguauaguucuuaacagaaaacauuugccaacuuggaccuaacaaacucuacuugcaucuuggcugcuuuuggcuuucucuucuaguuucuuaucagcuuccacauugccugaggcauacuggcauuguccuagacuguugccuacccucaccugcugccacagaguagcucauuccuauccccuuguccaccuucacugcucuucagucuauucccuauacagaagcucuuccauagccugccuuggucuagugcacuugcauucucuucucccuaaguggucuucacucagacugccacagugucccugcauguccuugucaucuaagaugccuuccuuauccuauguuugcauuugguacauacaugucugcacacucucaucugccuauuuuuacugcaugccuuuauauuaugcagauggucuucaauccugaugggaauuuagcuucacagaccagggacuuuagguuuacugcuauguguccuuaccuauauuugcugaagagacuuacuguauaggccucagagucuguacccucagaauggucuagaagugguaaaauaaaaucucacuagaaaagauacuaggcuaagaauacaguuuaguaagggauuggaugauauagcuccuucaccuaugaggacaagaggccucaugagggaacgaugugugccugccaccucagugugacguggagaagccaagaucccugaagaucugacuuugaaucuagcacccugcccuaggucuuucccagcuguguuccagcucugccuuauaaugcuguugccucucagggcugacuugcugaaugggugugcgugccucaccuuuggguucucaggguaguucuagugaccacuucuuccccugcccagggaucaggcugggcgcccaaagugcccacuggauccauacuucaucaugccugacaagugcaaguguguggacuuccagacucugaaacugcaggagcugccugaugcagucccucauggugagaugcccaggcacaugcagcuuuauugugacagguaaguguaaguauguaggggcuguggguugguguccaugccacucugguacagcauagagauugucuggugcccaguguguaagcuggagcucuugcuuugucuggugcuucucauugacauuggcauuuuuugucucccauagucugcaaagcaugaccacuccuauuuuacaugaguacuguaaacugggggagggggucaggugacuuugugaguagaacuaaggccuguguaucuucagagagacuagcccucucagcacagagcuggauaacuagcagcagugcuagcuccuaucuagcugacauaccaaccuuccuguuaagaccuccugguuugguugaauaguuacaaaaugaccuagaagaaggcuuacaggucccugaguucuuuuuguuuguuuguuuguuuguuuuucgagacaggguuucucuguagcccuagcuguccuggaacucacuuuguagaccaggcuggccucgaacucagaaauccgccugcuucugccucccgaguggagugcugggauuaaaggcgugcgccaccacgcccggcagucccugaguucuuacccugggcucauauaccugaugaugaguacagauguaaaacuuucuggggaguaaauccacaguugucagcuuuaucauuggcaagaaugugccacucgggaucuugggaaagcuauauucuaaguccuuuuuuuuuucaaucaguaaaauggccugaacuauuucaaagugccugaaaaggcauaucaagaguuuaacacaauuccuuagcacaacugagcguauuguauuagaguauucucugaguauccaaagagcuugagaauuacauuguggaaugaguaggaaguuaauaggacaguguagguggcagaaacgguucucggugaaacugauuugauaguauauagaacaccuuugaguuuguuaccuugcuugauucccaacagcugagacaagucaaagucaucucuccaagcucagagaggcacugugauuucucugaagucacacagcuacuuuaugguccuugaaguaacacugauuccagggaaacauggaggcuuuggucgguuaacaucuuauuguuaaaagggugacuaaaaaccuagaggcaaauugacuuggcugagcucagggaguguggcagaggcagaaauggagaguggcacuggcacuagcaaguuauccuuaaggguuugaggagaaaguuuucccaaaggagcuuggucacagcucaaaugaccuaggacuucugaaggcugggcaagggcaccgcgccucaccucuaccaguacagcuucugaccucuugaauuuagugagagucaggccaguauuauaacacuguacuaacuauccagacugauguguagguagcaagaguagagaaagguucucuuacucuagaccaugcaaggacugagcugacuucauagugauacuuaggguagaaauacuaagcugaccacacugugauuugcuuuucuuuaucuucccucccuguacuuuacucagguaccugugugacaagguuguuccugggaacagggucaccaucaugggcauuuauuccaucaagaaguuuggcuugaaccccagcaagggccgggacaggguaggugugggcauccggagcucguacauccgagugcugggcauccagguggacacagauggcucuggugaguugcuuugaauuucuacacuucucuuaacaagcugcucaugugauaaccuggcauucuugaauugcucaaaccauuaggauaggaugugcuuuacuuguguguguguguguguguguguguguguguguguguguacgcgcgcgcgugcaugcguuugugugugcaugcaugucguauguguuuguguguguauggugggcauacuaggcagauaguuuaccacuuagcuauauucccuauccuagaguguucauuuuuacaguaagcaaaaauuuguugcccuaaaaaugucuauuuauugguuuaguuguagcuccugcccugagguuguugauugaguugcaugacucagugcuauagaugggaugugguguguauccugugcugcaucuuaguagguggagagaaaaaagugcaugaggguugagcagacagaaucuaguuggaagagauccccuaaaggauaggugucugacacugagcugcuuuaauugaggucuggaaaaggaacuagagcauugugggaaggcuucaucuaucaggagugucagcaauagcuuugaaggauggaggugcgaaggaggaucuuuucaaguauagaggagaguuggugggaacucaaggcuggugggggugcaaaugacaggaucucuaguaggaguuggguugagugguaggggccaaguaaauagccucaacucucagauggaguagagagcucaugcuuacaucuaggggcagugggagucaccuuggggauuggucccuacauauggucuagagugauggaguuuugaguacuguguccauauucuauguugguagaaacucccuugguuaaaacuggaaaagccacauauucaucuagccauauuccagacuuuaacucuccuugacuugccauaucacuuaauguuaccaucuucugaaacugguucuuccuuagccaucccuucccuugcuuagcaaacccuccagaucuuccucaguucccuuuuuuuuaauccccuaaccucagcaagcaugcuguuuggcugcucuacuuucauccccagggcugaccacgucuuaccucccugcucugagucccacucuuucuccuggauuuggauuuucaagccccucugccacuuggucccacccuaccuucuccauuccucagcaacucaagugaaccaugcuguuuugaucaagcaauuguguugguucucuacucugucugcauuaugagagacuuuccagugguccccaagggcacugugaucuggccugauuguauggaaccuucuuuuccucucuggaucuuugagauuugaaagacugauauaguccuguacucuuaacuuuccugaguaagacugugugcguccuccuggugcugagagcuguugguguguguauguugacagaggucaggguguuccugaucuaggucuaggcccagcaguaggcuggaggagaugccccuugcucauguaugcaccuguucccuccuaggccgaagcuuugcugggucugucagcccacaggaagaggaggaauuucgucgccuggcugcccuccccaacauauaugagcucaucuccaagagcauuucccccuccaucuuugggggcauggauaugaagaaggccauugccugccugcuuuuuggggguucccggaagagguaaggggucugggaggaaggugcugaugacaaggcugcugcaggaggauaucugugugaugaggaccagguguguucuuccaugucucccaggucccucagccugcuggcccuggggagcacagugggaaacucuuuggucuaaugugagagaugccaccuugaaccaaaguuucugaaugagaccugugaaauaccugacacuuagaaauugucauauguccuuuuccucuuccucuuuccuuccuuccuuccuuucugguuuuuuuuucuuuuuuuuuuuuuucuuuuagauuuauuuauuauaucuuaaguacacuguagcugacuucagauacaccagauuucauuacaggugguuguuagucaccauguguuugcugggauuugaacucaggaccuuuggaagagcaacugcugagccaucucuccagccccuccucuuccuuuuucuuuuuccuuaccuuuccuucucucucugucucucucucuccuuuuuuuuuaagauuuauuuauuuauuauauguaaguacacuuuagcuguccuuagacacaccagaagagggcaucagaucucauuacagaugguugugagccaccaugugguugcugggauuugaacucaugaucucuggaagagcagucaguguucuuaaccgcugagccaucucuccagcccuuucuuucuuuuuuaagauuuuauguacaugaacauacugucgcuuucuucauacacacuggaagagggcaucagauaauauuacgacugguugugagccaccaugugacugauagaaauugaacucaggaccucuggaagaguagucuuaacugagccaucucuagccugcuuuucuuucuuucuuuuuucuuuugguuuuucuuuuuaaacaggucuuauuauguaaucaagcugucuuucaaauucaugauccuccugcuucggucucccagauucuaagauuagagauguuggucaccauuccuggcuuccuguguucuuuugaaacucuaaaauaauugagcucaagacuguagcagcagugacagucuauucuaguggcuacuguguaauaugcuuuuuguacuacauucagaacauucuuguaaaugcuucaucuguccugaacccagcccauucucucagcagucuauauggauguuacuguuguauucauuucauagaugaagaagcugaggcacagagaauguaaggacuuacuucagguaacagguugggcuggauucugcccuaugucuacucuucagugugcacagcccucagugccauuuauguuacuucccuuccugagaaauaccuuaccaauguuaggcuaggaaugagagaacggggugugagcuuguuucugggccagacucugucauuuccaccuguucugagacucuuacgggagggugaccagcccacauaaagccaagagugcugauacauaacuauaaugcuagaaucuggaagacuaaggugggaagaucauggauuaguucagaggauagcccucaaguagauucuuacuuugucuucuaccuaccuaucgucucuaggcucccagauggacucacucgccgaggugauaucaacuugcugauguugggagacccugguacagccaagucucagcuucugaaguuuguggagaagugcucucccauugggguaaguggcugcagacaacuuucuaguggcuuagguguuccgcagggaggaaggcuacagaguagaguugccuaguuccuagacaugcauggggucugauucaaccacauccucuuccucauucaucuuggcucuggucaggauggcagaggggguuugaaaaggaagguguguacauagaggugggugguaagagcauuagacugagucaggcuugcuuugcuucucagccuggcaguggacuuggaagagguagccuagauucccugagcaucagcuuauacucauuugcuaaguaaugacgcugcuuaugauaguagcuggaaucaagaaggaccagaugcuugcugaaguaccuacuaaguuuuuacucauuuaacuauuugucuucuugugaagugcuccugcucauguuauguauuggauaaggaguggagcgguaaagugucuugcucaagaucccacugcuggggaacuuuagaacaagguucaaggcagugugucuaaugacccaggugcccugagucugggaggaucagggagaggaggguggaugugacaacugacuaguggucugugaaauggggaaguggugcuuuuggauggagaggagguugcuaaagcuaaccacauuggcacugucucacagaaauaucaaggccugaaaauguaaguugugccauguuaagucuuauagaaaguaagaauagguggaauucauuugugguuuuuuuguuuuuguuuuucgagacaggguuucucuguauaguccuggcuguccuggaacucacuucauagaccaggcuggccuagaaaucagaaaucugccugccucugccucccgagugcugggauuaaaggccugugccaccaccgcccggcuggaauucauuuguauaaucuguuuagccuguagucuaauauaagcuuuuuuuucccuuucaguguaguuaaaccccaaaucuugugcauguuaggcaaauauuuuaccacugaggugcaucccaggcuuauaacaugcaaguauugaguauuuggcauucauguuagcacaaugugaccugaguaugucucacaugcaccucagguaggauuuacuguauuucaagggguaaauaccuguaugcuacagaugauggacucaggauagagaccuccuaaaagccaggaauccccaacccugaggccagcuucaaauauauucuuuucuggggaucaauacuuaaugucaccgggauaugcuguagcucaggugaaccuuccaaagaggaaggaaaggcugaggcccaguuaggccuugaguucuguacuguucaaccaguuuugcagcgugauguggguaagucauagcccucugagcucuugcccuuuggggcuggcacuaaguacugacaccuccugucucccccagguguacacaucugggaaagguagcagugcugcuggcuugacugccucagugauacgggaccccucaucucgaaacuucaucauggaagguggagccaugguucuggccgauggugggguugucuguauugaugaguuugacaaggugagucuaagucuucuagucacaggacugggguguguggccucaggugugguagcagauaccuccugagagacuuauauauaguucuugugcccaucacucugggggaacuugggauagguugcuuugcuucucugggguacucuggaaaaaagugaaagccaagcccgugugauuaucugcuauugacuggccugaagucuacuacagaaugguuacgguuccuagauuuuucugccacucuacccagcuugggaugggauucugauagacaaacucucaaugcagaugcgggaagaugaccguguugcaauccaugaggcuauggagcagcagaccaucuccauugcuaaagugagugacagcuacccuucagcaauccuaaguccuccuaaggcugcacuaaugugugcugccaaguccucuuugcccaacgcugugcuagcagcaacgggccuggaacugggggugggggagcaagagugcacacauguaagcauguacacauauauaugcguguacauaauguaugaguucauauguucauaugugauggagaggccugucccaggauuuuugguuauuugcuccauuuacuccccuuucuacuucaggcugggaucacuaccaccuugaacucucgcugcucuguucuggcugcagccaacucaguguuuggccgaugggaugagacaaaaggggaggacaauauugacuucaugccuaccaucuugucccgauuugauaugaucuucaucgucaaagaugagcacaaugaggagagggacaugguacgucucgggcuaggcuggugacaacagauagguucauggucaugaaauugaauaagagauuuagccacagaaaugcuagugguuagauagucuggaaggaagcauaugaaaugacuuguuaguggcuuauggaguguuggagaggaaccuaggguccuaagaccuagguaugcccuguguguguguguguguguuuuuuuuuuuuuuuuuuaagcaagaagcuaaaaaacugagcucugcucuccacccuuguuaguaaauuucugaaagaaaauagcuuauggaauuugauaaggcuaugaguauaguauggguauaccuauggguauaguucccaugaggcucuagguuguuggaccagcugucuguuucugcuucccuuuuggaggcuuuaauucuuagacaguugcucccugugaugguaaagacaaagccuaucuuggccaggcugaggagugcaggcuuucugaacucuggcuggcuggcucagacuccuuuucaagauggcugauucaaucuggugccucccugcuucucugaauugcucugcuuggucucaaacuaacuuuggcaauauguuuuaauuuuccggcucauucucauuuucuggcuuguucugucuucaucccugucuaguuuguucuuuuucugaaaccuaucucuacaauugucccaguaaaacugccuccuucucuucuuuguacugccccuuaaguagcuucuuuuucuuuucuugugagacuugggcauaucuuuuucugucaaauuuuucucugauucaucaguuugucugccacucaauuagauaucacuuucaaacauggguguuuccuucuacaaauuaauuuuaccuucauuguuugggauuaaagggcugagccaugccauaacacgaaauaaaaucucaggguucauagugugaucaaauauccugcaacauuagcuauugauuuaacuguccugaaaggaagaagaugaagccuuuucuaguaguuauaauagaaguggcagaauagcuuggguauuguccgcuguccaugcuuaaguagauacuugcccuaguuaggacagauaggccaaaaguacuggaacacaagcauuugccguauuauuucaccucauuggcuuggauauguccaguuuccaugcuuaaguagauaguugccccagugagaguggacaggccaaagggacuggagcagaagcacuugccauauuauuuuaucuugucuguuaaaccugugagcugacccaguguucccugugcuccuuagaugcuagccaaacaugugaugacucugcaugugagugcacugacacagacacaggcuguggagggugagaucgaccuggccaagaugaagaaguucauugccuacugccgagcgugagugcugggagauaacaugggcuuuuuggauagagggagagcccaguccuguucugcuccuuaccuaggauuuccugguaacccuguucugaacuuuguucuauucuuaucugucacugugacccucuccaugaguuuaacuuuucucauccucuuaagugagggagguagaguggaggagcugaagacugcugggaagccugcucccuggugggccuccugcuccuguggggcccucaguuucugguggaacaguguacaccugguagcuagacagcauacugcagccagcauugaguaguuuucugggcuggagagauggcucagcgguuaagagcacugacugcucuuccagagguccccaguucaauucccagcaaccacaugguggcucacagccaucuguaauaagauuugaugcccucuucugcugugucugaggauagcuacaauguacucauauauacacuaaauaaauaaauaaaaguaguuuucuguacauauguucagauucacuucccacuaucucagagaggugccaugucugacaccugcugauagccaggucaaguuuuucuuaaaucucuuucaaaugacuuaucagcuauauuaugcacaggaagcuguguuugggaacauucaucuuugagagccgauagaggccugggaacagggugggggcaaccucaagauuccuuucuggcuuuacucuagcucacucugcaaucugcaggagguguggaccucggcuaucagcagaggcagcagagaagcugaaaaaccgcuacaucaucaugcggaguggggcucgucagcaugagagggacagugaccggcguuccagcauccccaucacugugcggugagcaagugggcucaccucagagagcagggccaguuggccacugccauuuucauaaugcaggcccaggguggguugggcaagggagucaucugggaccaugugcugugucuuccuaauuauuuuguuguguguguuugaggcuggagaugccuggguaggucucacuacuuuauuuugccuggcuucccucuuugagaggcaguuugagggaaggggaggacucugaccgacaauguagcuacagggaaauuuacagauuuucacugggucaucauuuauagacaauauaguaagagcuggggccuaccugagcugaauuauaucucuagcauugauugguuacaaguagaucucguuguguauagugaaacccaaagaaaguagcuuaaguuggaaguuuauuuucauuauuaaacuuugggaaguagguucauggugguuuuuuggagcuguaugggcuccguuaaauucaucuuugccaaccuuucagccccauaugguuuuagaagguauagccaucguguccacauuuugagcaacaagaaagacagugggaggaagauaugcuuuuuaauggauauuuucauaugaugcauggauuuagaacuuacaggccacaucuagaccaaaaagucaggaaauaucccuuagcaggcagcaugugcuggaauaaaaauuggguuccaguacuaagaauaaaggguaauagauuaucaggauagccagcaaacuccccugcaguccuaacaaccuuggcccuggucuuuccuggaggaucagaggagggaaugugggcugagcccuuugaguacuuuauugcuccaacaggcagcuggaggcuauugugcgcauugcugaggcccucaguaagaugaaacugcagcccuuugccacugaggcugauguagaggaggcauugagacuguuccagguguccacacuggaugcugcuuugucuggcaaucugucgggugaguaagcgcuggacuguggucuuggacgcuaggauagagauuuaguuagcggguggcuggcagggugcuuccuggauaugcuuuugauaauagccuuuccgcugcgucucuccuggauguuuuagcuauuguaggaggaaggagcuucucucuagaccucuugagucaguucauuaaaaguaauuguaggccugucgcugguaaguaguggcugggaguccucccuguuaagcucagaacuacucuagaguuucccaauuuguggccucggguuucuuuugguuuuuuguuguuguuguuguuguuguuguuuugguuuuuuuugacagccaggucuggcacacuagauugucaguccuuccugucauagagaugagacugacagaucuucugucauggucaccagucuuggugaaauacaugccucuuggccccugagccuuaauguuuacugccuucuuucagccucugagauuggugauaugccaaccagaguuacaucugccuuaaucugacaguaaaucugguuucccauuugccaaucacugucuaaaugccagagcuguaaguucccaagguuccuguccuacccauuccacaagcuuucuaaucuuucuuggugggauaggugaggagguuguuaaagguagugacugaaaggaauuaagaggagcagugacagcugggccagguauguuggaggagugguucucuuucuuaccugauaagauuguacaccucuugcuuacucagggcuucucagauuuguacucuagagggcucugccuucucucccuucuugcucucuuuaacucaaaacuuauacuuccauugggcaugguuguggagaguuaggaaaaucucuugaguuggagauuugaagccagccaaggcuauacaaugacacuguuccucaaaaauaaugaaguaauaaauaaacccaaccaaauaaaaacucugcucccuucagagucuuuucuagggcuguuccuguugccuugguauguguagcccauagggucucgaggcaccggacucucauggugucucugcuaucuagcucugugcuugucgcagggccucugucaccuuucccucugccuagagcacucuuccccauauuacuugauucucacuucccuggugaggccuucacugucauaaugguguucugucuuuaauuuucucugguucaggccacucuaguuagaggcugucaucucucuggcccuuccaguauggaugaacugggguuucuagcacccaguuucccuauugcacucuugacagggguggagggcuucacuacccaggaggaccaggagaugcugagccgcauugagaagcaacucaagcgccguuuugccauuggcucucaggugucugaacacagcauuguccaggacuucaccaaacaggugagugagccuuucuaacccugggucuacaagccaggcccaggauacagaggauguccugcugguucucuuagucugguucccacucagccaucacauacaguguucugugcucagcagaggggugcugggauggggauguuugagccacuguuccuuuuguaggaacugcuacagucuacaguugggguuggcuauuuauagggaaaggaggaagacaggucuguagaaaccaauacccaauuuucccaucucuuagguuuucccuuguuuagauccuuacaugguagggaggaccagaaacagaugaguuagccuugcagcccauugggaagagggcuacugauaacaugcacaggagguacuguuugggguaccaguaggagccugugcccuuuaaaaucaugaggauagcccugguuucuguuucucguucccuucccuguguauccucuccguuugcuccuggaaguaaauuauacaguaacagauacuggcccucuauaagugaagagacuagucuugccugaggcuggggcuggagaaagcuugacuucuagggucacagggacuuaaguccuagcucacuuaauugcuauaugacccaaacaagugacagccugugccuauuucuuccucuguaaaaugagauuauuccuaauacuaggugcauaaagucgauauauguacuuaccuaguacacaagaggcaucaucacauacacacuuuucugaagucaagggagaauggagguggauauuuuuugucuguuuaaaauugucuaugauccggugaugcaucaggucccuugggucauaaugauauaccugugcaucugucuugugcucccuccuacagaaauauccagagcacgcuauccgaaaggugcugcagcucaugcuacgcaggggugagauccaacaccguaugcagcgcaaggugcucuaucgccucaagugagcccauugcccaucaacccucaagccugaaaugcugccaccacccuaucucccagucagugcuccaaaccuccuuuugcccugccucuccaccucagacugcagucugcagcacaucugcagccccuggaaauguacuuuggucuguuggccucauacuguguuugagugucugaggacucucugcucugggugucuauccccugucaugccuucucaacaagaugagucuggagcaggaacaggcccuggaauguagaugggucuguauauuggcucccgggccacucacugccaagcuucuuuguauguacagagguaauaaagcaauugagucccuggcugcuaaggucaguggacccaguaugauaguagugcugugugaauacaagguugacucuuucagcuuucuucagcagcaccuaaugugagaacuggaucauucauugaguugucugccucaguuuccuaaucugcaaacaaauuugaugaagcugagcucagugagugaguggcugucagugaaaacccaaguagacuccaauguagaaugucuccagggcuuuauuuauagcaagugggccucaguggugucuggggaaggaaccagacgucaggguuuaucaguuaaggagcuaugaguaccugagcaagcuucagcacaguaggagguauuagugacaacauuguuaaaagaagacacccaacaccucguauuaccaaaaugccgaaaauuaugauuuuagaaaucuauaauuuauaaaauuaaggaaaagucagugaaauauuuaaguauuuguuauguaaaguacauuuauaaaugggaagcuagugcugaaaacacugcagucaccaacaguaaaguuacuguaggaggaaggcuugagagaacaggaaguacauacacaggccuuucucguagauggcguccugugcugaaauggcuguugcuugagguguuugcuuuuuuuuuuuuuuuuuuuuaguuuuuugagacaggguuucucuguguagcccuggcugccuggaacucacuuuguagaccaggcuggccucgaacucagaaauccgccugccucugccuucugaguacugggauuaaaagugugggccacca

SEQ ID NO: 4545 - RNA, 10943 nt, Mus musculus
aggcacagcuaacaaaccaacuuuaauugauaguguacacagagguccaggcaguagagcuugaccggauggaccaggccauagacuugccuggacaaguaccugguauacucaggacuggggcuggagucauuguaggacagaagcaggugcugaagcaauugugcugagcagcagguguguguauggagucugggcugggccuggugugcagagcaagggugacaaugugcacaguauccacagauagccucagugauugcucugaggaaggcauauguaacaugauccaaaucccggcuacugggagcuccaaggagacaggguaugacgugguguguauggaaggcccauggccgacccagcuugcagggagugaccugggccuugagagaaugcacuauuagauugcugugguuucugauaaucaucagcuucaauaauucaugggggggggggggcgcgcuagggguaccaugauggauguguggaggucaauggaugacuucucuccuuccaccacauggaaccccgggaccaaacucagguugaaagcuuggcagcaggugucuuuacccagagucaucucaaaugggccagcugcaguacuaauaagacuaaagcacagaugcauuaagagguggugaacaggaccuuugguuuucagggucacccccacuccuguguaccuagcauagccugaacacuaggguaaguccugcaauauguccuuccaaccuuuccuggacucggcucuggcucucaacugcuccacuuccuccaacagcugugugcgcagaaagggcaccaugggagggcagaggccggagcuggggacacacaggaccccucgcucucuguugccuagcacacaagggaccaguaucagguaggugcuuggcagauguuuaaggaacuaaagcagaagaaagcugcaucuagucagagcucuguccugaacuaguuaggagugcggaggggguuagaaucacucucucaaagcucagucauccucuccagagggcaggagauuacugcugugacuguggcacugugggcucuuuguaggccgauggacacugggcagaacacagccugccugggagcagggagggagaccccggccaaagcaauggauuugaauugggaagcccggucaaagacaaagcauuggccucuuacaguacaaggacuucaugucuacugcaaacagaacaggaaagacacuucaaaacaaagagaaauaucguauggaggagccugggaguggagccaaaaggcagugaucugggggacaccggucucucucucucucucucucucucucucucucucucucucucucucucucucucucucucucucucucucucucucucucccuuucucucuccccccuccacucaaggucaugauggccccaggggcuaaauuggggggcaguguacacagcugggccagacggcaggagcugaagacccaggauggugguuucuccagggacacugagaccaagcuggucugaacagagggagcagaggccaccagggaaccuggcuggggcaucuggcuaagauguucucauccugugacuuguacugagcaucuugcuuugaugcaggacuccuggccuuuuugcaucccucccacggaaagcuugucucggcaugagugcugucaugucccuagacaugucuccguccucccacaaaggaaccacacucacggcucacaggagguguccaggaaacaagagaaugggcacaggguacacaccuagggcccucugugggaugugcgcagugggaauccucagccaccucccuuaaggcacugcccaagcccccuccccgaugucccugccucucacuggaugcuacacuugucccucucucgggccuggcccucccguaggaccuuggccuugauguacuugaggucacuguugacacuggggcgucgggcaaagggugagaccaugccauaggcaccugcgaccuuagugcgacgcaugcagaagggccgggggugaaaagcaucgccguacugcacggagaucuuauggugcagugcagggcucaucucauggggcagcuuggccaugcugaacagcacauagaacaucucauucacauuaguguucuucuuggcugacaccucgaaguaggcgcaguuuucaucaccagacaccagcagcucagccuccauggcagggaccuggcggcacagcucacuguggucauucuuguucccacagaucaccaugggcagcucugcugccuccuugguuuuauucuucaggcaggacuugaccuccaggaucuguuucuggaggcgcuugaccucaucaaaggacucccggcuauccaggcugaacaccaggaugaagacaucuccugugaaggggaugaggcaaguaaacaagggccaggauggccuggugucccacucagcacaggucccaucagcugccaccuaggaagccugcaaacccugacccggaggcuccuccaggcaucugcuaucacuguccccacuucccaaaagagggagccaggguucagcagggguugugaguagugaggcacacccagguggacucagauauggucagucccuguccuguuuucuuacaggacuguguggcuggccuuacucagccacauccuuagaggcuucaccaauaccuugcccacagucggaauucagcaugugucucuguguggcagacaauguuggugagagggagcuuugguuugcaucuuaccucagcuuaguaacugugugaccuuaaagucuguggaaucucugagcuccucagcuuccccucccacaucaugucaauuaggcugccuugcaggagggugauuagagcuaaugcaugcaguacagcaugcacucaggcaccuggugggagcagaggaguaggcacacauguuuccugggcaccucauaauacucccauggggaagauuuuauuacucuucugagugaaccaauuaaaggcucugaaagggcaaggaagcugcccaaggucacacgacucaaaugugguaggccauggcugcaauccaaugugguccucacccagccugugccucgccugcaggaucugcucucugauucuaggacaaaccauaggauaaguaagaaacugcagcccacacuagauccacuguaacacacuaauggggcuuugagucugauacagugauuaggguguacccuggaagggcugcagguaugugaaccagccucuagucacagucccaagccaaucaccacagagaaacagcuucauccuccgagacccuucccaccuuugcccucaacuuuacaguccugaguguggucugaggucccugauuuguagauagagguccagccauuggguccagccaaacaucacaauuuggaaguccagagaagucuacaaacacauuuugguucgcuacaaugacacacauguacugcaugaacuaggaaguagggcccccaaagcacauugucccauucuagcccagccaccuguccccuggggccugcacacacuggucuucaaugaggucaaugaaaggcugggaugaugagugauugacacaaguccucgacuggcugccaacugcucugguuccugcugccaagccucauucugucccauuagaccagccccugaggaccugcagccuccaaguguucaaaucugagacugcaaaugccaggcauuagagccuggcuggccagcuggcagcugcacaaaaagcugguaagacugagcagcccugugcaucuuuugugcccagaaccaggcuggaaaaugagcucuggccugggacggugagcaaauaaagcaacagacagauaugcucaggaugcaguccacagaaaacagaggguacaaagugaaugucagugcacuggugcuggcuagggauugguggucaccauaagcauuguuuaaugaaaguuugccuuuguaucacuuuuauaauugaaaauuaacauugaaguaugcauauuuccaccagggggcacccaguccucaaauaggaagagcucuuccacgugccauuuaccuguuuugggcagcugccuuacaccaucguguucucacagcuacuuggggagcauggucacaaagccacugacaaugacaucacuaugcuacagaaacaaggucaggauuugaacccaggcccaccuuaaguuccuuaagcagaauguuucuucucagaauugggggccccccacaagcauucugggacagaaagggugaaugagaaaaagggggcaguuugugggguucuugguaguagugucucaauguggaaguguuuuuaaauugucauuugugugugcauguguguguauguguauacuuguguaugugugcaugugagugucuguguccgugucuguguccguguguguguguguguguguuuguguaugugugcaugugagugucuguguccguguguguguccgugugugugugugugugugugugugugugugugugugugcaugugugugugucugucuaccugugugugugugcaugugggugucugugucuguguguguaugugugcguguaucuguguccgugucccugugugucuguguccguguguguguuuguguguguguguguguguguguguguguauuuguguauguguucaugugagugucuaugugcaugggugugugcauguguauguguuggccaccacugccuguuguuccuguggcaccaucaaccuuguuuuuugagucuuucacagaucuagaaauugcugaucagucuagugagccccagggauccuccugucucuguucccagugcugggauaacaaggugcucaccaagauaccagcucuuggucugugugcuggggaucaaacgcuggucccugcucgugaacagcaaacaguuuccuggcugaguuaucucccaggucguaugcucccuucuauuucuauccagggauacagcugagggcauggcuguacccaacagugguaaucaacugaagacuggcuucaaggaaugaccaugacaaccagugccauaugaccagaaggucccugguggcccacaaccggucccucucugaaugcugcuccuagaagggcagacaguccccaggguaggucucucaacagcaaucaugagcuuccaccuggaugagguuacuuaaccacucugccucaguuuccuagacauagccuccuagcucagcgagaggaacgugggugcaggccagcugucccauccccucaguugccucaccugugaggauggagagccggcgcauggcagggaaugggugguugccagagguguccaggauauccagcugguacauguccccguggauguuguacaccuugcgaugaaaguccucgauagugggcguguacugguccucaaagcggccauugaggaagcgggagacaauggagcucuugcccacucgggaggcacccagcaccaccaugcgguaggaguucuuagcaggcacauugagugugcaguucccacuggacaaggucuucaucauggcucugggcuguggcagaagcaagaggcaggagucagggaccucuggccuggggccuccucucugugggcccugucuagguuucugcuuucuauuguaaaauaaaagccauuggcuagggucccugaaggacuucaagguuggaauggcucccuuguucguucauucauucauucauucauucauucaugaucucuaaucucuuuauucuuucucucaacuugcucacuuacccauccucacgcucuugagcacaggaccaaccacaaggucacacccuugcuguucacagugagccucacuucccacuccauccaccgugacacaggugaaauuccuaaauuaccacuagugucuacuaccacuagggggcagccgucucuuagagcagcgcuccuuauuccacagcuucuggugcauggcccagucagcucugcagcucuaauaggaaggagggaaaggcaguccaggccacuuccccaccacucccaggauacacccuggacccaagguuugcaucaugguaggcuccuccucacauacagccuaccacuggcuucaguaacuuuugccucugagcaaccugagcuugagugagaggagaaggggucucaagcaucagacucuuaaaagacugggauucuggggucugaaacucaaaacuuguaugggagugucucauguaaaaggcucuagauccuucgugaacuauguaggcaucugcuccaacagggcaaucaaagggcuguccccaguccccuuccucuguuguuucagcacccugggaucccucagucccaggugagugugagcuaugagcuccuccacaccuuuccuuccaucagcuucucccuagcacacuucucuagcuguggagcucaucccagaugccaccucucuaacauuacaaaagaugcuugcuaaccccaggacugcacauggauacaggccugcagaaacauggguguuccuugccagccacuacaaguuguguaggcuggacacugcacaaaccacaccuuuaguaggcaaauaggggcuucaucccaccacaaagagugucuucaugaauccuauggguuuaagcucuguugcacaaagguacuguacucacugagaccacagccucaucuggauaccucagccauuuuuuuuuuaucauuaucagaccuaccaugagaccagggucugagauggccucucgggcugagugacauccuccuguuugcaagucucuagguaugcacagacucugcucaugccugccagccugacacccuucaccuuuccuaaaagcccuguuugguagccuuugucaauuuccacaauguaaacgcucccagcucccagccugaaacauggccuccaaaaauggacgucagagacacacgcaugggccagcucagcacacuguggaccccaggccuggcaccggaaccaucauuccugggccaagcccagcagcgugccaagcacacgcuaaguauagaacaacaacacugcugacauuuguuuugcagcuaauauauaucacggggcucugagugccaggcauacaucugcuccaucccucagugacccagggggcagacaaugagggcacugaagcacagagucgccaaggucccaggaagaagggccugucccaugcugucuguccugcacucugggggccaccucccaccauacacaugcuuuucuauccaggucacuguggcuaugucagccgcccacuggcaguucuuacaugugguggaguuccgguccuaaaacccugaugucccccacugaacugaccugugagucugugcuuugagguugcacugcugugcauacagaaggugcucaauaacugaucccugacaugagagacauugcagauacuucugcaggcaucaggcucacccaaacuucucacuagccugcucucaaccugcucuggcuaugaggacuucucccuucacccagucuaccugucuggcuccugcugcugugcugagaagaaaccaccggagaccuauggcuuaguuucgcccacccaguccuucugcagggaggagggcugcugagccucucauuagauggaagacaaggagugagccagcagaccccagggaugucuccuugucccagcuucuagccaggccucccaagacacaaugaaugaaaggagagagucagagaaacaaggcagagucagagggcagcagggaaucagagagaggaggaagggagagacaggaaugaaggaagagagaaaacagaagacucacggagggagggggugcggcauggaguuagaaauaagagccggaggaucagagagggguggagacaggcgaggagaaccuauggcuuucucugcugacagaccuagucuuuucacauggcuucagccacguggggcagugugaggcacccagauaccuggaagccaggugacagagcaucuguggcuccaccuccacaggagacugagggaagcccuaaagcccuguaggcagagucuccccugccaccugcccaucucacucugcuccucagcuggcuaacuccacagugggcaaagacaaauccuaaaugccagagugggguuuggggcaggggaaugaaaggguugaauaagccugaagccugcagaagcaucugcaaugucucucaugucagggaucaguuauugaguaccuucuguaugcacagcagugcaaccccaaagcacagacucacagguaugcauucaguggggacaucaggguuuuaggaccagaccuccaccacauguaagaacugccagugggcggcugacacagccacagugaccuggacagaaaagcauguguauggugggagguggccccccagagugcaggacagacagcauggggcaggcccuccuucccagcagccaaccuugguggucuagagagaaguggggaacugaauguaugaagagggaccuggauguaagcagagugcuggaagguaccucaaagauagaaguggggcuguccccagaaauagugcccaucaucccuaggcaugucaugcuggggcugccuuauucuuaugagacgcucugcaggaacagauggggacucuaguucucaggaaaguugaguggcugcccgaguccaaucucaccucuucaaaacaccacucccaccccucuaguggcuucaacuagucuucuccuaauagcucugacucaguggagccccaguuggcacuggacagggaaugacucugugauccauguuauaguccuguuuccucucucccucuaggcagcugggguggcauccugcccaggacucugcauacccugccagcagcucacaagcagugcaacugugggccauucacccuugugucugccccagugcuugaugggagcugaacagguacagauuggucaggaugaguuccuugggugcaccccagagccagguucacuacacuaccugccacaccugugugcacaucccaagccucuuaggacugacacgcuguaguccugacuccuccccuaggcucuggggagucucaggagcuuuacaaagccacccuucccauccuggggaugucaggagggcagagaacagggggcaucuguuucuggaugaucagcugugucagcacagaaccucugagugaucugguuugugcacucagcucaccucucuguuaaacguuggguagaaacaaacgcaacacggucagguacccagaaaccuuuccaauacaagacucuuuucuuugggcagucucucugaguagucaugagccacccggcugcucccagccccguggacgacuugcagggacucuuuuuugucccucugaggcuuaggaggaaccugaaucagagaguccaaagccggucguugcuccagacccuagucuagcuuccaggagguccaggacaauccaauacccuuccucauccuucguggacugguggcagaggugggcaagagaguguggcucagaggccccacacacuggccacuugaguucaggaaaccaugguagcaaggaaacauugcaggaaaugcuccaaagcucaagggacgcuaggauagguuaaaggaccccugaucauucuugcuugagguuuuaucuagggaggguaacugccucuuccucuugagucucaguuuccuccuuuuaaaguggacugucucuuggucuaaaagaaagcucccagggacaaacggagcacacaagagcucaauaaauccacuuuccuacgcuauguaaggggcuaaagaccaccagagguaguaggcuaggcaucuagugagcuuaaugcucuacguguauaaagcaucucagcacguagaggguacaguuuaaguuuccuuugucauaaaaugccagcgucaccgagcuugcgucccucuacugagccggcugccccacuccaccuagcuaccucuccuguucuauugggaugucucccuuaccugagaacagcgggacggaccccgagcacggcuuggagggcucccuggaagcuccuggaggugcggggagccgccugccgcuccgaccgcugagucucccggcgucugcgggggcuccagggucacugcguacggauccuccugcgcgcggcgcccggagcugggcugagcgcgacagggcgaggaggcccgcggaucaggggaugaugacccaugggugggcuccgagggcucggcggggcuggggcgcugggcuggcuccggcucgccgccggcggcccugcccugccccgacaggggggacuccgguugagccaggugcucgaagguuuggggacguccaguacggggugcccccgccuggagcuccgcgcugaaggggaaggggcacgacuccggggauauagaagcgaaccccggagacucaggaggacuuuugggggugacgaucggccuacgaacccgccuggcagcuuacguuaccuccuucucuggacgcaaagcggguggccgcgugcaggguagagggguuugugcgccgggccguccuucccggcugcccucagucgggcagccgacccucgcggaaaggaccgccgcuugcuccucgcccgacgccgcuagcugcgcucagcgcgcaagugggagggggccucgaacgccgccccgaagcucagcagcuccaacuucgccugaagcccacgucgcuccgcacugugccuccucuccccaagcgaggagaaguuucuuaggguggguuccucccucgugcucucccgguggcucaagcucgggcuccagaugcgcaaccuacgccuaccucgggcccuggcgcgcgcuacgucccgagcccaccugcccagcgccgccgccugggcucugccgccugcaccccgcccccgccaug

SEQ ID NO: 4546 - RNA, 5902 nt, Mus musculus
aguugcucugcuccucccuguuccagugacagccgcaucuucuugugcagugccagccucgucccguagacaaaauggugaaggucggugugaacggauuuggccgcauugggcgccuggucaccagggcugccaccugcaguggcaaaguggagauuguugccaucaacgaccccuucauugaccucaacuacauggucuacauguuccaguaugacuccacccauggcaaauucaacggcacagucaaggccgagaaugggaagcuugucaucaacgggaagcccaucaccaucuuccaggagcgagaccccacuaacaucaaauggggugaggccggugcugaguaugucguggagucuacuggugucuucaccaccauggagaaggccggggcccacuugaaggguggagccaaaagggucaucaucuccgccccuucugccgaugcccccauguuugugaugggugugaaccacgagaaauaugacaacucacucaagauugucagcaaugcauccugcaccaccaacugcuuagccccccuggccaaggucauccaugacaacuuuggcauuguggaagggcucaugaccacaguccaugccaucacugccacccagaagacuguggauggccccucuggaaagcuguggcgugauggucguggggcugcccagaacaucaucccugcauccacuggugcugccaaggcugugggcaaggucaucccagagcugaacgggaagcucacuggcauggccuuccguguuccuacccccaauguguccaucguggaucugacgugccgccuggagaaaccugccaaguaugaugacaucaagaagguggugaagcaggcaucugagggcccacugaagggcaucuugggcuacacugaggaccagguugucuccugcgacuucaacagcaacucccacucuuccaccuucgaugccggggcuggcauugcucucaaugacaacuuugucaagcucauuuccugguaugacaaugaauacggcuacagcaacagggugguggaccucauggccuacauggccuccaaggaguaagaaacccuggaccacccaccccagcaaggacacugagcaagagagaggcccuaucccaacucggcccccaacacugagcaucucccucacaauuuccaucccagacccccauaauaacaggaggggccuagggagcccucccuacucucuugaauaccaucaauaaaguucgcugcacccaaaaaaaaaaaaaaaagaaagaaaagaaaaagaaaaugaagaguugauggcuucuagguaugguugaggagauggguuuuauucuagauauucaggccaugagaggaggaaggagaguuaggguaagagagaggacaaagagagagggcaagcaaacaaagagagagguccuggaccaagaggccaagagagagccagccaggacccaagaaauaacauggcugcaaagacuuaguuauugaucuccuaguuagagaucaggcuggggaaggagaagugaagcccaggcccuagccugcagaaguuuaggguagaaggcugggcaagaagugcugggaggagccacaaguacccugaaugagacuugucccaguuucuuugguaccuaacaaacaacagcuugguaaaugagauguuaacauaaccucugacuuaacaaucuaaaacaaaucgccaucucugauuucaacuagaucuccucaaauacccauuuaucaaucacuggucucacucuuguucugguuauucaucuuaaaaucaucaagaaacucuugacuaguccauaaacuuugccccucaaaucuuaaaaaaacaaaaaacaaaaaacaaacaaacaaacaaaaaaaaaaaaaaaaaacaccaaaaaaacucaguauccauggaucucauucuuuguccaaguagguagaauugugcuaaaaaaaauauugccuuacuaauagaggacugauuuugguauucagugugugugugugugugugugugugugugugugugugugugugugugaauauauauguaucugcacauacuaugaaggccagaguguaaccucaggugucauucuuuauggcugcucaucuuuuauuugagacaggcugucacaugaggaacacuagguuacaaguguaaaccaccauauccagcauuuucacaggguucuggaaauugaacucagacucacauguuuauaugacuuucaaguuacugaguaauguacccagaauuauacaauuuuuuguuucacauucagggagaucauuuuaccuggaagcaucaguuagcaagcucauucauucucauagccauuugacuauuucucgugucucucccucaccugauccagaaaacaugcuaauucuccucccuguuuccuuucccuuccuccaucuaccucuuaagagagaugcagacauccgcacccaaacuguagauggagcuuggggacucuuauggcaaaauaggaggaaggauuguggguccuggagggauagaaucaacuaaucuagaccuuuagggcucucagagagugaaccauaaacuaaagaacauaaaugggcuggaccuaggccucccacacauauguagcagauaugcaucuuugucuucauguagguccugaacaacuggagaggagggcuauccaaaaagcuguuaccuguauguggaauucuucuagcuggacugccuugucuggccucagugggagaggauguaccuagccuugugaagacuugaugugcuaggguagggguauacccagggagacucagaggaaaaaggaugugaagaugggaggaaguaaugugggaaggggugaccaggaggagagcagugagcaggauguaaagugaauaaauaaauaaauuuuuaaaaugaauggaauaauaaaaccguauuugagaacugcaaaaaaauuauauuguucauaucuucucuuauuccauauugauuguaaaaauaaaugccauaauuuacauuuuccaaaaauaaauaaaaacaaauaaauuuaacuauauuucauuaaccccgaaauauuaaauagccugcuaauugcucacuuauuuuuccccccugugacaggguuucucuguguagccuuggcuguccuggaacucacuuuguagaccaggcuggccuugaacucaaaucagccugccucugccucccaagugcugggaucaaaggugugcgccaccacgcccagcucuaauugcucacuuuuaauguauaugagacuucagcccuaacuccacuuaaguauuuuaaauuauucucacuaguuguaacuaacucagugacauaauuuauuucuuguauagcuaagacuacuaauaaggucuuuauguauuuuacuuuguaagaagaaacucuuaaaaauuauaucuauaauucugucaccaauaagcgcuuuccuuuuaguuaguucuccauuaaaguccagacacuuuucuuuucuuucuucuguucuucaaauguaaacacuaguuucccaagcauacaguugccaaaagaaacuuaaaacuucaccaccauguugagagcugccaugccuggcaggaaguaugcagagcacgccuucacuagaauucaguagaauucaugggaugcauggauuguaugacccuugucugagucuuacacuauugaucacagaccuaacuguuuuuauuuaacaaggaaauuggguuaucagauuuacuuccacuuuaagcauaaauacaagaaacucaacuuuugaaaguuggauuuaccaaaucuuaggaaaacuagguuagucauagcuagcauuauaacauugaccguggucaaaauuacuuuccaucaaauauuauauacucuucaauguacuaaagaaauuaaaauaaacuggaaagauuggcgaauugauaaaguugucuccacguuuauucuugcaucuuuuuguucacauauuuguguuuucuaauuuaaauaaauuucucuguggguccauaaugcuagugaaaggcuugucaguggauauuucuguauuuauauuuagacugauguuuacauauuuaaaugaagcucuacagaauacgagauaaucugccaagaccuucuuuacuuuaagaguuuuguuacaucacgccguuucuuacuaucaguuuugaggcacauugcucacuugucaucuagcauauuaauaagcaaucacuucuccuuuuagaaagaacagacucacaaacuuaaauuaauggcuuuagcccaacauauuuaguuaguuacaggacaauuguaaugucaaaaacauuacugaugcaauucaugguauaguucccccaucuuacaguacagauuccaucagauguaguaucuacaaaacauaagauggcuuuaugaaaugcgcauguauucugcuaggccacugcauaggucacaaugggcaauaggcuuuucccauuuuaacaaaauguuuuaaagauugcuccacucuguuugugguccucugcuugauauuguucugacuauagccuucaccuaagacuucaucaacauacuuuuuaacuuuaucauguauuucaucagcauugaagccaaccucgucacagggcugguauuacuucaucguagugacuuuggccacagaaucuuuuuuuaagagcuuauuaugccccaagaaauaugcuuugugcugguauuccaacgaaugauuuuguacauggccuucuaauuauguucuagagaaggagauagauguugauaaaacaauuacauaaaucaguguaaaacugcaacuguggcaaagagguaaaaaguuaccauugauacaauaggcaauuuuuaucucaucaggcaugguagaaguauaagcaaucuggaagcuagggaaggagggaagauucuuuucaacagaauggcaguuuguuaaagauguuuguugauaaagcacaugaaaaagugagaguguuaaacgggaggagaagcuagguuacagaaguauaagauacccuauaaauuggguuagguacuuucucuccauuucaaaagaaccacuuauuuuucuaguaguaacauucaacaugauggguguuucauguugaacaguucugugggucuuauguaggacuggguguaaaaugaauuuauaauuuuagcuagccuguauaaaagacacaaaucugguuauucuauuuacaagccauaaguuuauauugggcagaucuggagcuauucuaacuauuucccagcuguaaagucccugauuacuuacaaucuccuagacuggugcucaugauccuucuccucucauggcagccuccuccaucuccaucuccuuucuucuuccucuuccucuaccugcaaccacuucacucaauccuuaaguugcaccuuucuccauccacugccuaaucauaggcucuagacuuuuauuaaccaguuaaauugggaagcaauguuuacacagcaaggaaagaaagggagggagggagggagagagggggcaaggaaggaaagagaaagaaagaaagaaagaaagaaagaaagagagagagagagagagagagagagagagagaaagaaagaaagaaagaaagaaagaaagaaagaaagaaagaaagaaagaaagaaagaaagaaagagagagagagaaagggagagggagggagggagggagggaggaaggaaggaaggaaggaaggaaggaaggaaggaaggaaggaaggaaggaaggaaggaaggaaggcaggcaggcagugggagccaugucauucuagaaggccuaugccuuuauaauaagaaaauaaauucuauaaguaagacucagaaaacacaauuuuuaguucucuguguuaacaaagguaguuuagaaaucagagccacaggucugauccucaugugag

SEQ ID NO: 4547 - RNA, 31947 nt, Mus musculus
cuguccgccgcugggaaggcggggcuuccugcugugugcacccagugccucugugcguccaguugcugcgaccggcccagggaagcgcgccguggagacucuuuucccggacgaggccauccuccuucgugggcuuccgagcgagacuuauccaugccgaacucgaggcccaggccccgccggggcgccggggguggcgcaggugcggccggccgggaccggcugguggcacgguccuugcagagugcugagcacugucuaggugaccaggacuucggcacugcuuaugcccauuaccuucuggugcucagccuggcgccagagcuaaaagacgacgugaaggugaggccuuauuuuuuucaguggcuagcaaauccugugaucugagcaggaacaacaggguaugguguguguguguguguguguguguguguguaacagagacgagagacagggagagacagagacaccgagacauacagagacagagacggacucuccaagcaucgaauuacuauagccuacagcccaucucaauacagccagguuuuaguaacaaaagucaaaaguugucacacaucuguuucaaaauuucugccucacuuaagauuccaaaggccuuuuaaaugggauaggacuggguaguucuuuuuccccuccaguaucuaauuuaaauuagcccugccuuguaggcguugcauuaucuuguguagaaagaaugcuguguauccugagguuggauaaaguguucagucauaaggaacuuuuaauauuuguugauucgucuuacuugcaucaguuaaccgguugaacuacuguauuuuuuuuuuuuaauguuagaaucucaauuucaaaaaguaacuuaauugcauauacaguuuuaagcuguggacagucuugcuuuguuuaguccagaguuucucaaccugacacuggugacauuuugcaccagacaguccugugucuuccuuccuguuucacagcacgguuuguccucugcccacuagaugucaguagcauuaggcuuuuguaguccaaagaaauuucaggaccuguugguuuacuuggaaauaugcuaguauguugggucguuuguuccucuguguagaaaguaguagaauaguguguguuccucuguguagacaguaguagaauaguguguguuccucuaugcagacagcaguagaauaguguguguuccucuguguagacagcaguagaauaguguguguuccucuguguagacagcaguagaauaguguguguuccucuaugcagacagcaguagaauaguguguguuccucuaugcagacagcaguagaauaguguguguuccucuguguagacagcaguagaauaguguguguuccucuaugcagacagcaguagaauaguguguguuccucugugcagacagcuguagauaguguguguuccucuguguagacagcaguagaauaguguguguuccucuguguagacagcaguagaauaguguguguuccucuguguagacagcaguagaauaguguguguuccucuguguagaagacagcaguagaauaguguguguuccucuguguagacagcaguagaauaguguguguuccucuguguagacagcaguagaauaguguguguuccucuguauagacagcaguagaauaguguguguuccucuguguagacagcaguagaauagugugucuguuuucugacaagggacugaggugcauauuuuacauaucaaaguggaucuggccuccagguucucccagcaucccucagucucuaucuggcauauccugcccccaacccugaacuuuccagcccagaggcugggcugccccuuccccagaggcucuucccuauauaaccuagacauuuugguccccucccccuucuccuccuucucucucugcuccuaaacccuuucuuucguuccucuucccaccauccccauggcagcuucccuggccuccuuccuuggggccagugaacucgcccaccugagagcagcuucccaauaaaccuacauuugauuaaucuaaccugguuugaguuggcacauuucacugggagagaaauaacuuaucauaguggaccaacacaauucuuugcacaguucuagcugcugcuucugagaacagacaagauaaauaguguguguugaaaauacauauaaaauuugguugcauguagaucaucaguggagugcuuguguugguaaaauuuuauucaggggaauacauaagcuguaccugcccuuccuccuaaaaucucacagacagacagacaggucucugcaggaagcggugagcucacugggcuuacuuacagaggacagaugagggguuauuuacuggagugugaacgcuccuacuucaaaaggcugcacuggaaagccuuuacugagcagggauaacuuuauagucaagaauagaagggguuacugggacaauugaugcugguuagcuggagugaagaaauuagcggugguuaagaagagacuaguaaaguggaaauuuaugguuucuuuggggacucaguuaugucaugugauguuuugcugaagcagacacaggagagaggauguuuugcugaagcagacucaugaaagcugcggggagauuagaaagaauauaaauaugaccacacagacagugugauggaagcucuugcauugguucaccuugcacugugccacuugucgugauuucguaaagaauaucccaccaaagaccuucccaucauauucuggcugcuucuuguugcuucuauggacugcugcugagccuauggacugcagagccuuaugguuucuucugaacugaacugcuacugcugguucguguuugguguuugucaaguagacuggacugcuaacaaugaagauuggaaucgccucgaagaacuauuuuuaaacaggugcacacccccauuuccuacuaaccuuucuuuuccccuaccucuagugaguggugugcuagaagggagguggaaguguuaaagaacccuuauuaaaguagguuuugaaaaaccuaagccuauagcaucacugaggugaaggauucugggagcuuuuuucugagaucacaaagaaacuguguuccagagauagacaaaauuguaccucguacucuagcuguaauguguaagaaucaccuagguggugcugguuuugaagguaugaaggggucaugaagagcaacugaggcuuaagacugugagaagcaaaggaaggccauggcuaaagguguagccucaguugcaguugacggcuuaggacugaagaggucaugcaaagaagcuagggcuuaguaccaugaagggagccuauaagaggcuauuggugaagccuaguuggcagcagaagacacuaguguauugaagacgccaguaccaagggaugaucaccaagaacaacagcagcaguauggacaggcaucaaccagagccuacagugcuauagaggacagagcuggagaggugacccaagaccuuuggaggagccuaaaagaucauguguggaucccagacauuggaacaagaagcuguaaaguugaguugccuuggagaccccaagauguuagagaugccagagccauaggcuaucugcugaggaaaucugcuaacagagaguggaaccauccaaagagaaaggaauuguguugcagucaacaaagcagaaaggaguuggagaccugaagacggcuuugauaccagacauagaguggcagaguuuggaguaugcccagcugguuuucucucuuguuuugguccaauauuucuucaguaugacauuuuggaaugguaauguauauccugugauauuggaaguauguaaucugccuuuugauuuuauggggauuacaguuaagagacugugaaucucagaagacacuuugaacuuuggcacuuuaaacauuguugagacugugauagacuauggggacuuuuuugaaguuguucuaaauguauuuugcauuaugcuauggcuagguauguuugaacaaacuuauacgggccagggagugguacguggugguuugaauaugcuuggcccaccgaaguggcacuauuaggagguaaggccuuguaggaauagguauggcuuuguuggaggaagugaggcacugugggggugggcuaugagauccagugcuugagcucugaccaguguggaagaggccccuuuucuguuugccuguggaagagaguccccuucugguucccuucaaaucaagauguagaacucuuaacucuucuaguaccaugucugccuggaugcugccuugcuuuacucugugaugauaauggaccgaacuucugaaacuguaagccagccccaauuaaauguuugccuuuauaagaguuacuuuggucaugguguuucuucacagcaauggaaaccauaacuaagauaaacuguauuaaagggucccagcauuaggaaggucuagacuauccaugaguccaugcaguuaggacaguugcauauagcaggugguggggagcagcagaguacucaggcgaggucucaggacccagccugccguucugaaagggauuuaaacaguaaguccaucuggugugaucuuuuguagguggcccagcuaagcuccccucuaagaugucagugguuugucuuggagaagaggccuguacaacagcuugccauagaauggcccugugugugaggcucuggcuucugccugcagcacagaaaaaaauaaauguguaaaaauaaagcauguggcgggagaaguagcucgauuaguagaauugugccuaucauguacgaggucuaaacccaguguggcaguacacacuuguaaucccagcauguggaagguagaggcagcagggucagaaguucuagguuacucucagcuacauaccgaguuugagguuagccuggauuauaugaggcccuauccuaguuauguaguuauguauuaaaaacaaacaaacaaacugguaaugaccagcauucuaguaggacuuagaaacuggcuugguuuuauaugaaacaaaguuuuguuuuuuuuuuuuuuuuuuuuugcaaaagccucauuugcagaaauuugcuuuccugauauucucuucgcuaccuauauccauacuucagucacauuaaacuacuuaaacuuuuguuuuaaaaccauuuuuucuucacuuuauauccugaucacugccccaucaugucucccucccacaguccuuccccgcacccccuucccuucuccucugagaauggauguuccuccuggauagcucuacaccuggcacaucaaguuucugcagcacuaggugcuucucccacugaggcagacaagacagaaaaauuaggggaauggcugccacagaagggcaacggcuuuagagauagcuccugcuucaguuauuugggacccacaauaagaccaaacugcacaucugcuacauaugugugggggaucuagguccagaccauguaugcccuuugguugaugguucaaucucugagagucccaagggaacaguuuaguugauucuguuggucuuccuguggaguuccgauccccguuggggcccucaauccuuccuccaacucuucccuaagagcucccaagcuccagccaguguuucgcugugggucucugcaucugcuggguggagccucuuaagaggacagccaugcuaggcuccugucugcaaguauaacagaguaucauuaguagugucagggauuggugcuuguccauggguugggcugauuauugcuuggccauuccauaguauguaugaguauugcuuaaaucuauguauguauguaugcaugcaugcaugcauguaucugucugccuaucucucugucuguauauguuuguguauauacauaaaaugucucaugugugcaggucuaaggcgaucagaagaggggauuggauuccauggaacuagaauuauagccauuugugagcuguuaaugugggucugggaacugaacaccaagagcagcaguacucuuaacugcuggacugucucuguagccccuuaguuguuuuuauuuauuugcuuauuuuugcuguuaccaugagccaaacccaggaccuuaagcauccuaggaaguccucauucacguuuguugaacaguacuuacuaaagguuaccaguuggaggccaucauucauuucaggcucaguuccacuugcuggagucuucagcuagaguugcguauuccucauucuuuuuuacuaauuuguacuuuuuucuuguuuauaaaggaaacuuuucaguauacacuuuucaagugggcugaagagcuucaugcacugagccgaauacaagacuuacuugguugcuaugagcaggccuuggagcuguuuccugaugaugaagugauuugcaacaguaugggagagcaccucuucagguuugucaugaccucaugaguauaggauuaucucuaucaggccaaagcaaggauaaaucaugcauuaacuuacuugguuugguuuugagauagagucuuaccaccagcucaguccagucuggaacuuguaggcuuacaucuuguuuuagccacagacuacauauauacaccacuauguuuguagauucaguaauuugaauagggaauguuuaauguaaguaauuagcaggauuggaggaaugagugauuagcuagucauaaggagagcucaaaaggauauaggaauaguaaauauguaauaaauaguaaaaagagcaauuuuaaaauugguuuauucugugugugcacauguggguacauuuguauggauaugugugaacauuuguacacauguguaguugccugugccauagagugcaugugguggucagaggacaacuucugagaguugguucucuucuuccaucaaguagguauugaagacugaacuaagguuuucaggcuuaguggcaagaacuuuuacccgcugagccaucuugucagcccacggcagacuuaugauacguuuuauaagagucacuccccuagcacggaggaaguauuuaaggaagaguuuccucacuggacucagauccaguccuugucugaaaaggcacagccgugguucccaggaugccuuggcagaaaucuguucuucggaccauaguagaguuuguccuuucaggguuucugagagagccuaguggggaaguauaaaauuuggagcauacuguuaaugagauccccaguaggguagagcuuuagguaauuugccaucauuggcugcugcuggugccucccagucccacugggaguacggguacuggguaagccccgaggaauggaacuagaaagcaaaaccuucccuccugcagugucuccugcaccuuguagugaucggugggaaacucugauggccagauaagauuucacacagcaggcaaaauggauaaguuugguaguaagucaguaacuggcugucuuaguuugauugagaaguaagacuaucgaaggggaaagggaacacuggcggagucacaaggaacccaaaagcaggccucccagggccucuccaagucacaguggaguuccugccucagcaguaggcuugcagucugggaagcuccauugaggccaacuauacaggguuuuuauuggagguugcauagagaauacauacucagguaccaccaccuccgugugguguauacccaaguccuaggcucccauaguagaagccauauccagcauaaucacauugcuuauauaaacaaugaggcucgaugaauuacucgccagucaaagcagugagagcccucaucagucguuauacccacaugccagucagaggucggccuuguaagauggcuucucagagcacaccagccugaccugccacgggaacucuucguuuccaagcaaucccaggaaccacagugaaagcuuagcguugcuuuugaauuugaauguuuuaaaguaacagggaaagagccugguucuggcaaacugacaaguugcacuuucacaugugagggauuuaauagguggcugucauuucauaugcuccuucucguaauucucuucugcacuguaucuaaagucuacuagcugucaacaaucaaacgaguagucuugucuccuucucccaagggccccuuacuugacuuagaggacugugcagggccagggcucuggggacaggaguauaugcagucucuagaguuuugacaaaauaaauuaauugagcaguagucuucauuguuacauacuuggcuucaucauggugaagcuuuuuacaucaauaccauguauuuucugcugugauaagcauauagacaagauauuuaucucuaccuucaagguagcaaagaaauagcauauacugaccuuaaauucuuucauuuaaacuaaagaaugauugccuacaguuuaaaauagcacugcucuuuugugaguuagucucauugucuuacccaugcccagaauauguagucuaaguuucuuuuucuuuuuuuuguagcauucacuuuauuuuuuuuauuagauauuuucuuuauuuacauuaccuaguuuccccucugaaaaucccuuaucccuuucccacucccccugcucaccaacccacccacuccugcuuccuggcccuggcauuccccuguccugggacauagaaccuucacaggaccaaggcucucuccucccauugauaaccaacuaggccauccucagcuacauaugcagcuagagccaugaguccccccauguguuuucuuugguuggugguuuagucccauggagcuuuggagauacugguuaguucauauuguuguucuuccuauggggcuacagaccccuucagcucccuggguacuuucucuggcuccuucauuggggacccugugcuccguccaauggaugacugugagcauccacuucuguauuugccaggguuuagaacggaugauggcccaacauuguuuuugaaggcaggagugagaagaacgacuuguuccucuguugaauguaugcuccguaaauugcugauucacgacagcuguguauagagcgcacuugaucguaguagaaauccacgucuagucaaggagcuauuaggccgaacaaagaguagacuguuuggaggcugcuggggucugauggcacaugagcuacauauuaguugugagcaacgcaguccaccuaugaugaaccguuguaggcugggccagggagauacaguuugaggaagcacuguuugaugacuuggugguauuuccccuugguuguuacuuuguauuugcucauauucaguucaguacaaguuacugccuuagugccccacuucuaccccaggacaccugagauacgccagcagagugccguccucaaagaaagcgagguuugcagagguggaggacugcucuggccuuugggcuguggcagaggauuuucaggccggguuagugcgugcacagaggcacuguaguuggccacauggaguugaauguacucugucuuucccccuuuagaaugggcuuucgagaugaggcagcuggcuauuuucacaaagcagugaagcuaaacccugauuucaaugaugcaaaggagaacuuuuaccgcguagcaaacuggcugguggagcgcuggcacuucaucaugcuuaaugacaccaggagaaacaugguuuauaaugcagcaauccagaaggcagugugccugggcuccagaaccguucuggauaucggcacggggacuggaauacugagguuuguuguaauuacuauuuucuauuauauuuacauuaguauauaaaaauagcaguuuuucucauaguauguuuaggguuguugauacaacuuuuaguauuguacuuuuuauuaugauuuuacuuaucagaaguucaaguaagccaggcggugguggaacacgccuguaaucccagcacuugggaggcagaggcaggcggauuucugaguuugaggccagccuggucuacagagugaguuccaggacagccagagcuauacagagaaacccugccucaaaaaaacaaaacaaaacaaaacaaaacaaaaaaaaacccaaaaaaaaguucaaguaaacuaagaaauacuugggauuauugaaaaucuccauaaugaaaggauauguuuuauauuaacauucugguggaaucuagaaagccuauaaagcaacugauugccagucaugucuuaauugugugugugcugaucugggugugguggcacacaccuuggaucccaucacucagaaagcagaggcaggaggaucucugcgaguuugagaccaguuugguguacauaaugaguuccaggacagucagugcuauguagagagaaccugucucagaaaaccaaauccaaaacaaaugaauggauauuauuauuuauugaaugauuuguuuuuaaacaaguauacuagcuuuucuccuucuccuuuucuucuccucuucuucucuuccuccucuucuuucucuuccuccucguccuccaucaucauuuugagacagaguuucccuguguagcccuggaacuugcuauguggaccaggcuggucuggggcucacagagaucuaucugcuucugucuaccaagugcugggauuaaaggcuaugcuacuaugcuuggccuuauuugcgcucgaaugugugugugaguguccaagcaugugugccauaguaugcauauggaagucagaagcuagcuuucagucuuuucaccuuccgcuggguuuuagggauugaacuuggguugucagauuugcaugugcaaaugcuuuuaccuggguuuuuuucuuuugucuuguuuuaugagacaggguuucucuguguagcccuggcuguccuggaacucacucuguagaccaggcuguccucaaacucagaaauccaccugucucugcagcccaagugcugggauuaaaggcgugcaccaccacugccuggugcuuuuaccuguugagccauuuugcuaguccuacuuucuuucuuucuuuuuuuuuuuuuuuuaaagauuuauuuauuuuauguauaugaguaugcuguagcugugcagaugguugugagccaucaugugguugcugggaauugaacucaggaccucugcuugcuccagcuccgcucucucuggcccaaauauuuguuuauuauuauacauaagugcacuggagcugucuuuagacacaccagaagagggaucagaucucauuauggaugguugugagccaccaugugguuacugggauuugaacucaggaccuucggaagagcagucagugcucuuaaccacugcgccaucucuccagcccccuaguccuacuuucuaaaugcagaacaaauaaugguuacauuaaagaauggaaggaagaucccauguuuuaagcaucuuaauuuuauuaaaguuggaaaaugauacaauguauuuuucuucuuuuguagcauguuugcuaaaaaagcuggcgcacaaucaguauaugccugugaauuauccaagaccauguaugaacucgccugugauguaguggcugcaaacaagauggaaaaugggauaaagcuucuacauaugaagucacuugauauagaaauuccgaagcacauuccugaaagguguguuuauaagucacuaaaaacauuaugaugcauuuccagcuucuuauguuaacaaaagugcuaacaauccuugguuucugaagauauggguaucauauauggguaucaccuaguuuaauaaaauacaguuuuguuuuguuuuuuuuuaaaugguuuuuggcgacaggguuucucuguguagcccuggcuguccuggaacucacuuuguagaccaggcuggccucgaacucagaaauucgccugccucugccuccccagugcugggauuaaaggcguacgccaccacgccuggcaaaauacagguuuuuauaacauguuuuuaaaaguacuucagaacucaagaaaaauugauagugagaaaugcuccuuuagcaugucacuuuauugugucuuuuuguuuguuuugguuuuuuugagacaggguuucucuguguagcccugucuguccuggaacucacucuguagaccaggcuggccuccaacucagacaccugccugccucugccucccaagugcugggacuaaaagugcacaccaccacaugcagcuaaaucauaugguuuuguucauuaaaguagacagacuuccuguaggucagcagugcuagcuaacuguuuacagugugagcagcucgcccucgguagacaucauguugucaucacuggccuugaccagaaugaaaguuugaaagguccaguagacgagugcuuugccugugaccuucaagggcuguaugcacugucugagaagcccuguguuuguaucugcaucucacuguggucagggucucugacauugaggccagccugguguauagcacuacuuccaugacagccagggccacacagagaaacccugucucaacaaaacaaaauaaaaaaacaagaaaaagagaauuaacuuugagaaggaagggucauugacagagucuguggauguguucccucccugguuuguucuugcuuuuuaaugcaguuucauguagcccaggcuagcaucaaaccaacuauguagucaaagauuaccuuuagcuucugccuuagcaucuugccucuaugugccauguucugggauuacagacauaaaccaccauuccagaguaggagaaaaacacauauuguauuagaguuagaagcuaaauguuuaauguucaggcagggaccaggaaagcugugggugccaauuacucuuaaggacuugggcugugaacaaagucugggagcgcaacccuucugugccuagagcaagagaaaggagcuaaagaggaagagagggacaucucaggacucaggggaagauaaugaaaugaaaugaaauguauuagaaaauuuuaaagauuuucuauaacauauuugcccuuuucccucagcuuugacagcuuuauagaaauagcauaucaguuuacuuacauauaucuuuaaaacaucauucuauagagugucccuaguuguaacagaaacugucgaugcagguguauuuggagaaggaauuguggagaguuuaauucaugcaugggaacauuuacuucugcaaccaaagguaagcagcacaaaaccacuuacaauuugaugaagaauucauuuuuuuaaaaggcauauugaaccccuagaauguuugcaagacauuaaaaauaugucagaguacaaccuguauacauggaaagaaacacaagaaaaagcauuuggaaacaauguaauacaauguguguuguauguaccaguaagguugcagauaaggauucuacugaaaguccugugaaugagagcugauuuguggaggaacucacuaaaacucuugaguagaagagggaagaacuuugaaucucacagccgucgcugccugggauuuuggcagaucucuagaaaagaaggugguaauauuaguucaguaauguuuuaaguacucaguaaacuugggcugcuagagagcacauugaacccugcuccuguagcccacaagcuauauguguaucacagcuaguuuauuauacauuguauauauuaaggaaagucaucuuuauagaagaugacauguauuuaguauagaaaagaaguuuauuuuucuaguaaauaaugaugacuuugguauuuucuuuuuuuucuaaugcuaggaguugaacuuggcaccuuacauauggcuagugcucugcuccugagcuauauuucaagccugauuuuauucuuucucucuaaagauuuauuuauuuuuguuuuauguauuuaauuuuccccugcauacaugcauaccugccaugugcgugcgcacucgcccgccuguagaaugucuaugugccuguugcacaugugugcacaugucaaauguguauaugccuguuggauuugugugugccugucggauguuuauauaccuguuggauaugugugccuuuugaauguguguguauagcuauugugugugugccugucacaugugugugugccuguuguaugugugugugcuugucccauauguauauaccuguugcauaugugugucuuuugaaugugcguauauagcuauuagauguuugugugucugucacguguaugugccuguugucgcaugugugcagugcuguggaagucagaaggcauggcauccuguaggucuagguuagggaggaucacgagcugccuguggaugcugggaauugacugcuacaguagccugugcuuuuuucauuucucauuuuaguuuuucaagacacgguuucucuauguagaccaggcuggccuugaacucagcacucuggaggcagaggcagaagaaucucugagugacauagcuuuauauaccacucuuccucuuuguacuuguauucuaaacauuaaguuacauauauuuguauguauuacacauguacaugcgagugaaauuuuaaaggagaaauuucuuagacuguauacacacaaacacauacacacacacacacacacacacacacacacacauaaacuuauuuguacuuguaauguuuuaacuuuuguuauauuuuuagaccaaagaagaaaauggaaauugcgggaaguaugggaaagugauaccagccggugcuguuauauuugggauggcagucgagugugcagagauacgaaggcaucauaggugaguggguagaagagcacucaggugggggcagggcagaggcaggcagaccucuuuguuugaugcuuaguuuuacuuauuugaaguagaauuccaggaucagagccagcuuuuucuuuuuucuuuucuuuuucuuaaauugaaggauucuuuaaaaaaaaaaaaaaagauuuauuuauuuguuguauguaugugaguacacuguagcuguacagaugguugugagccaucauguggauguugggaauugaauucaggauaucugcucacucugguccaaagauggugcccaucuuguagaguaugugguguggcucucaccucauugugugaugcucacucacaucccuauguacguggugaaggaccgaacgaagugcuuugucuauucuugcuuguccccugcuagcuugccagaauucaaaagcacauuuuuugaauaugaauaggagucauuuguugaauaugcguucuguaaauacauuccuuuuuaaaaguuuuaaaauuuauauuucugcauguguguuugugugugugccauguguauguggaguuugugggaccauaagaggguuuugcuggaguuguagguguuuauaugacauccgacacguggacccagcugagcucagggacucuacgagaacagaaagggugcuuaaccucuagccaucucuucacaaaauuguuaauuuuaauguggcguuaucacuuuuucuucaagugacuauuuauaucuauauuuaagacacccguggccaugagguuuuauuucauuauuauguuuauauuuucucaacuauuagacaaugauauuugauaauuuaccaauccugucuuacaccuuaccguuucuuucaacucuuccuaggguuggugcuaaggacauugcugguauacauuuaccaacaaaugugaaauuucagagcccagccuauacuucuguugauacagaagaaacaguugaacccuacacaacugaaaagaugaguggcauccccggaggauaccugccuuugacggagugcuuucagauuaugaaaguugauuucaauaaucuucagguaaaaacagcacguuugcuucuuaccuuuguuguugucuuguuuguuuguuuguuuguuuguuuccagucaugguuucucugugucgccccaacucuucuggaacucacucuuuagagcaggcugaccuccaacucuugacaucuuccugccucugccucugccuccagagcacugugaucagaggugugcaccaucaccacuacugccuggccaugccuuacuuuuuuaauguacaugagguuuuacuuauagaaaaaugauuagcagcaaauuaaaauuuccuuucgaaaguauucuuuuucagugugacggggaagcucccuggaguuuguuaguguguggugugcguuguacuguucuuuucuuuucuuuuuuuuuguuuuuuuuguuuguuuguuuuuuugagacaggguuucucuguauagcccuggcuguccuggaacucacucuguagaccaggcuggcucagaaauccgccugccucugccuccugagugcugggauuaaaggcgugcgccaccacgcccggcugcuuuguacuuuucgagagcgugcacuauguaaaaauaaaauaaugugugagcuacucagaugaaauaaaagauuuuugccaaggucuuaauaugaaaacacagggacaaacucuccagccuagaucuuugacauccuaucuucucaaguuaaugauuuccuugaaaugaacaauaaucuaaaccuaauaaucuaaaucuaaaaaaaguuguuagggcagugauuuuucaaccuguggguugugaccccuugguuguugaaugacccuuucagaggucacuaacaucaucagaaaauacagauguuugcauuaugauucauaacaguagcacaauuacaguuaugagguagcagugaaggugauuuuauggguaggagucagcacaguaugagaggggcucagcaguaggaaggcugagaaccacucuguuaggguaauggcaucccacuucaccaaggccugaggacuccggagacagagcacgcuuaggucuuuuguuuugcagaggcuagggauuaaacccagaaccugguacuugcucggcaagccuuucuaccguguguguguguguguguguguguguguguguguguguguguguguguauugguggaugauaagaugcauaagggacccaaagagcccaagcacugcuaauuaaaagucuaaugucuuaaagaaagaauacuauugauguacacagguucccgaugcuccugugugcagacugugaaaggaggguauuuuagcaugagauuuuauuuuuuuauuuuauuucuuuuuaaauuuuuauugauauuuucuucauuuacauuucaaaugcuaucccaaaagucccuauauucucccccuacccugcuccccuacccacccacucccacuucuuggcccuggcauuccccuguacuggggcauauaaaguuugcaagaccgaugggccucucuuuccaaugauggccggcuaggccaucuucugauacauaugcagcuagagacaagagcuccgggguacugguuaguucauauuguuguuccaccuauaggguugcaguucccgucagcuccuugggugcuuucucuagcuccuccauuggcggcccuguguuccauccuauaaaugacugugggcauccacuucuguauuugccaggcacuggcauggccucacaagagacauuaguaugagauuuuaaagugcaguugcuucccuuuagcuugccuuuucuugggaauggucugcaggucuccuaaguuuacuuuugugguugcugagcagcgcuguuuuuuaaggccauucuugaccagacacacuguuccaggaaggaaugggaguacaacuauuacagaccugacagcuguucuuuuucuuuucuuuuuuuuuuuucuuuuuuuguauaugaguauacuuugcucucuucugacacacagaagagggcaucggaucccauuacagaugguugugagccaucaugugguugcugggaauugaacucaggaccucuggcagagcagucagugcucuuaacaguagagccauuucuccagcccaccgcuguuuuuuuauuguuacaguuuuuauuugaauuuuuucuuacaccacacaccuuguaaaagguuuuaguuuuaaaacugccugccuguucaacacuucugaggaacacagagcagagugcugaagcccaguccuaccuuuuaaagcgucuccuuuaugccacuuguugaagggccucguucuggcuugcuuuuuuuuuaaacaaugugguaggaauuuggcauuggguuuuauuuauuaauuuaucuauuuauuuauuuuuaaagauuuauuuauuacuacaucuaaguauacuguagcugucuucagaugcaccagaagaggacgucagauuucauuacagaugguugugagccaccaugugguuucugggaauugaacucaggaccuuuggaagagcagucagugcucuuaaccacugagccaucucuccagccccuugcuuuuuuuuuuaauguguguguguacacauacauacucuuucagaauaaaauggcuccguugcuuugcugcacacucgucacccagcacagucacuggggauuugucuuuaacugcagugugugugugucugcuacauguucaguagacgcacaacauucugcgauucccugacugcagggcugugcaguugggcuguggugugacauugaaggaaacgcacagucaguuuauaaggcuucucauucucuuauuuuuuuuuaaagauuuauuuauuuauuauauguaaguuuacuguagcugucuucagauacuccagaagagagugucagaucucauuauggaugguugugagcccucaugugguugcugggauuugaacucaggacuuuuggaagagcagccggugccccucucauucucuuauuauucaaaaauuuuuggcuccuuacuacuuuccugaccucuuuuuuucucauccuuuucauguuucuuaucaggaauuaaaaagucuugcaacuaagaagccacacucucuuaauguuccugcuauuaaagaaggcgugcuagaugcuauuaugguuugguuuguucuccagcuugaugaugaauacagcuuguccacaaguccuagugaggaaaccuguugggaacaggcuguuuauccaguacaggcccuugaagguaaguauugucucauuaaaaaaaaauuuagagacuggagagaugucuuuaagaccacuggcagcuguucuagaggacccgugauaccuacaggguagcucagaacugucuacaccgaugguccuaugggauccagugguuuuuucuaauauguaaacaaaguauccauuuauauuucuaaaaugcauaaauaaauaaauaaauaaaucuuuuuaaaaauucuuuuaaggggcuggagagauggcucagcgguuaagagcacuaacugcucuuccagagguccugaguucaauucccagcaaccacaugauggcucacaacuauuuguaaugugaucugaugcccucuucuggugugucugaagagagcaaugguguacucauauacauaaaguaaauaaaucuuuaaaaaacaacaacagcaacaaauucuuuuaaacaaaaccuuuccccaccaaaccaaucaaacagacaaaauuuguuacuuuaaucaaguaacugucagugaccaaaaagaaaaguauaauuacuuuugagaugaaguuuucagcaaaagaaguguuacuuaaauauuucagaauuauaaauuuauuuguucaaaaguaaauuugaauaaugaacauguaguuuaggacagggauuacagccagcugugguauuguaugauguuaaucacagcaugucagggcgucaggaaacagguaaauaucugcgaguucaaggucagccuggucuguauagcaaggucugggcuuuauugagacccaguuucaaaaaaugauaagagggauuaaaucauuacucuguaaagugggagaaaggaggugagagucucuggagggggcacugagagugccugugauagagaugaguugucuauguguaugaaguuaccaaaagaguaaauaaaagauacucuguuaaaaaaacaaaaacaaaaaccaaaaaaaauacuguguacagugucacauaacuuuaaucccagcucuuuggaagcaguuuggggccagccaguguuacauagugacacccugucucuaaguaaguaaagacuuaggaauuacccuacuucaugcccuucagcuauaacucuuauuaacuauugaaguuucaaaugguaguuaucaguaggugaaagaaugcugcuuuaaaaacaaugaauuugcuuguuguccuugcucagaaaccaugcuaauauucuaaguauuguucuaacuuuagcauaagugcuucugaagugaauacugccucaucuuguuuucaacacaaaggguaauaaaaguauugagcacaggagcacuuaacccauagaugacauuuguacagcccauggguaguggggcuggagagauggcucaguggauaaaaagaugcuugcugccaguccuaaugacuugaguuugauuucuggaacccacaugguggaaggagagaacugaccccccccccccaaguuguccucugaccuccacacaugcuagggcaugugcauauccuccccgccccgacccccccccccccaguaaauaaagaaauuaaaauguauacagcccuagaaguacaaaaucuugccguuuuaagagaaucugagauccaugaacuucucuggggaaagucuguuguauuaaaaauauuuucugucuaggaagaaaguuuaaagcaguuuguuggguuucaguguucuuagcaguuaaguaauggaaaagcucuaaccauuuaaaacagaaaggaaaugcauuuuuguguagucucuugaucaaggaucugauugaccaaggccaggaaacuguagaaucuguaguuugaggauuuguauucaggucuucguucucuuagugaaugacuuugcuggcuggccuugcuguuaaguucucagagcuuuuauugggucauaucugaaaaaaaugacgauguugucuacccuagacuguuguaggaaugauaaaauauauaaauaaaaagcucucagcaguuacauuuuuaaaaucuguguguuuuuaguuucauuuucuuaaauaucucuugaagaauucucaagcaaagaccauuuuaaaugcuuaacacaaaauaacaacuuugguuuuugguuuuuguuuuuucaauuaaaaauaccugugugugucuguuugugugaugugugaaauauuucuuaggggaacacacaucccauggcaugcauguggucaaaggacagcuguuucccucuacuuuacuuggucucuagggauugaacacagggaguuaagguuauaagucaaaauuuaugggcucaaucagucuuucugucucagcuucccagucccaccauaccuaauagauuguauuuucauuugcaacugauaggaagaaagguggucacacaugggugguguagaaauggaucaugugugaagauucaccgaggagcacagaaucguccucacugcaggacuuagucuuccuuaaacugugauguucccaaacaugcaaauuuccauaugcauaggaguauuggauacaaucauguugugcuuuuguucuuuuggaaauuaccuuuaaaaaaaaaagagugucuauucaagcuaaaaugaggcuuuauuaaauuaaauuacauugauuccaucugucuuugccucuagacaugccuccuuuauccccaggucuuccucaguuugucagcacaucuccugauugcagugaaaacaguauaaaccugggcaugguaauacaugucuguaaucccaacacuuaggauguagagggaggagaaccaggaguuucaggccagcuucagccacauggcaaguucaagguacagccaccugcagcaagagaugccaacaccauggcauaacuuccaagaacagcagcagccguguauuguccuggucucaguuuaagcugauaaagggucauuugugauggguaguuuuaugucagcuuggcauaagcuaaagucaucuaagaggaggaaaccucaaugaagaaaaugucuuuauaagauggaacuguagguaagccuguagaauauuuucaucguaauugacggggagggcccagcccauuguggguggugcccucucuuggggugguggugcuauaugaaagucgggugagcugggugguggucauguacacccuuaauccuagcacucaggaggcagaagcaggaguaccuaugugaguuugaaaccagccuggucuacagagcaaguuccagguuagccagggcuacacaaagaaccugucuccagaaagaaagaaaggaagaaagauacagagagagggagggagggagggaagaaagagagaaagaaaaaaagaaaacagaaaagaaggguugaggaagccauaaguagcacucucuagggccucugcuucagcuccugcuucagguuuuugcccugacuuccuuuaaugaugggccagauaaacucuuuccuuuccuuuccuuuccuuuccuuuccuuucuuuuccuuuccuuuccuuuccuuuccuuuccuuuccuuuccuuuccuuuccuuuccuuuccuccccagugcacuuuugaucccaguguuuauuacaguaauggaaauccuaagacaaccaguuuuacauauguaccuguguauauguauauauauguauauauauauauuuuuucucucauuuccuuucuuacaaaugaagacuacugcauacagccuggugaccgagugacaauggaggcaucuugucacgauuguuaccuaagaauccaggggaucaguaucuugcauuuggaacaugaaauggaaguuaugaaagguuuuaccaagaguaaagacuugcuuucucuaggaaaugaagcugaacucuguagugcucuggcuaaccuucagaccaguagaccagaagcccuggagcagacuuguauguuagagcccacagagauugcuuugcuuaauaacauuccguaucaugaaggcuuuaagacagcgaugaggaagguguugucuucacuggccccagagcugcuguggcagcccauggauacucacugucaguacauggagaugaacucugggaguggacagagugaugcugcaccaagcaccgcugacccuuucuaugugcucgaugugucugaaggcuucucucuuuugccuauacuugccggaacacuuggucauguuaaacccuacaguucaguggagaaagaccagcauuguaucgcuuuggaccucauagcugaagccaaccacuucccuaaggaaacacuugaguuuuggcugcgacauauagaggaugaagcugcuguguugcaaaggcccaaaucagacaaauuguggagcauaauuauacuagaugucauugagccaucugggcuuauccagcaggagcugauggaaaaggcugcaauauccagguaaguaaagaccagaagugugagggggagcuuggguuaaaguuucucuuagcuucucuuagguuuguuauuggucucuuuuccccccuuccuuuucuuucuuucuuauuauuauuuuuuucuuuuuaaaauucuguggucaucucuggugagauggcucagcaguuaagagcacugacugcucuuccaaagguccugaguuuaaaucccagcaaccacauaguggcucaccauaaugagaucuguugcccucaccuggggugucugaagacagcuacaguguacuuacauauaauaaauaaaucuaaaaaaaaauucugugggcaaagagggugagacgaauguuuuacuguaacuauuccaugacaucagguuuuguucugugagggaggcccucuaggcagauuugggguagaggcuggugguggccagguuagacugugguugacaauuuagaccuuuccugaaacggaguuacucacaauaacuaagugagucuucacagcagcucugaauggaagguucacgagcuuuccagagugggugaacaguauagcgaagggagaguaaugagccuccugacugugggggcuccgagggccccacuccacuaaagaguugauucuuccucuaagccaccuuugguacaguacucugaugauagcucuacagggauuuaccccccacaccaaccaguuaauucucuaggcacgagcugcuguucuuuaauacaagucaguucuggcccugcugucuggagguagagguagaaccuguaggagagucaccagcuuuaaaaaccuaagccaccagauagagauugaagggucccucagugcauagaacccucuucagauuugguuggauuuguuagagcagcucacaggacuuagggaaaugcuugucuuagguuaaccuguuuguuauagaggaugcugaugaggagccagaagaacugcauagagcaagcgcauggaagggugcagaguguccauggucuuuccggacauucuguccagggugcacacacugagugcacacaagcucuaacuccaucccugggcucuccgcggggcucguuauguguauggcaucacuggguguucuugauagcucagucuggcgcugaggcuaggcaggggaagacagaaaggcccagcucgcugucauuccuuauucuuuccggagaacaaaccugagagucuaggagucccuagauccugagauggucucaguauaacagaagauacucuuaacguucuuuugauuguaagaagacuccuauguuuaggaccuuugugcuaaaaacaaacaacgggacaacagaaaaccaagaucaaacacaguguuaguauaaaucauugccugaugcaugucuuguuuggccauuucucaaugacuuuguuugucuuuaaauuccuuuuuaaagauuuacuuaaguaugcuuugccugcauguauguauuugcaucagauacuuaccucaaagagggaguuauuugaauuccacauguguauuagugguugcaguacaccagaccucaggggguuaggauuggcaucugaagaggggcagucacaugggccugagcccuuuacuggcgugauacaggucgauagugcucgaauugacuggaaucauaagcgucucugcugauguuggagaaugaauauguauauaugaaugagugcuuaucugcauauacaccuguguaccagaagagggcaucagaucccauuauagauggucgcaaaccaccauaugguuuuugggaauuggacucagaaccucuggaagaacagccagugcucuuaacugcugaaccaucucuccagccccugauuaauuuugaauaaaucuuaauuuaaaauuaauuaauuaauuuuggagaaauguucuucccauuuuggugugaaacguuuuaauaaacaagggaaagcacuuguuuggguaaaagucaaaaaguuuaugggauggggaugugguucagugguggcgagcuagcccugguuucccaguacuacaaagggaaaccucguaugacguaagugccugguaagugauccauuuaauaacaguaaaauaacaaguuaaggugcacuguugccauucuuggaacuauucuugagcuucaaauuuuggaaaguuaaagugaauugacagaaaauuaacaaguaaauaggcuaauuucauaauagcucacuagcuaauaguaaugauuuuguugcaaguugugucacuuuauuaagggauaaguaauuucacuaauugagauuggcuccugacuuuccccugaacucaaacaaguuguuaggaacagcauaggaugagcaagucacagacaccucuuaaauguacgaggaucagccugguaggcuacgucaugagugugaaucaggcuaguuccucuuuacucacuguaagcacacgaccguguaagugaguccuauggacauggacaacuuaaaacuagaugccgaggagcuagagaaaguacccaaggagcuaaagggaucuguaacccuauagguggaacaacaauaugaacuagccaguaccccggagcucuugacucuagcugcauauguaucaaaagauggccuagucggccaucacugcaaagagaggcccauuggacuugcaaacuuuauaugccccaguacaggggaacgccagggccaaaaagggggaguggguggguagaagaguagggggguggguaugggggacuuuugggauaguauugggaaauguaaaugaggaaaguaccuaauuaaaaaaaaaaagaauaaccugugaauuaaacuuugaaagauuuaccuguuaauaaauaucuucauucaaaaaaaaaaaaaaaaaaaaaaaaaaaaacuagaugccacccugacuuagugcgugucuuguucuugcuguucuguuucuaauaaguguugaguggucuuccuugcuuacuucucacuaaacacacagcuugcugauuaggcuggucuaguucucgaacuugccaguaagaauaaggaucaccugggugguauggaucuaagcucugguccucccauuuggccugcugcugccuuacccacugaauugucuccccagccucugaggcuuaaugaucuauuuagggaagccauguagcaaacauuuaaacaucuaugcguauuauuuuuagauauguacaaacugguagguggcuaagguaacacagugugcaccucucuguagucccugcucuggaaguucauguaggagauccccaauucucaguacaaguaaggccugcggucugguaagggauaguuucacuuggucuuacagaccuuacucugucuucuaucucugcguccuuuuauggcucaguaugaaaaacaguauuccaugauaguuuuagugcccgcccucauguggaaaccauucugucaaggcauggccuccaaguccuugcuacagaagugcuugguccccaugugcagggagugccggcuucccagcaggcacuugucuucugcucauaauucucuguccagguacagcccacuugagguacuuuuuauagccauagcaguacuguuaauauguuccuguggcaccacagggagagugaggggagcggaaguguggcugcauugcaguaagugcacuuucgugagagagcuuucuguuaacuuuggucuuccuuuccuugcuagacuauuuguuuacauauauauuugcauuuggaggauugaauucuuuauagaaagugaaucauuucagauguucagaaaaguuacagaauuguucagggaacuuaccacauacuuuauacucucgugcacuaagccauuccuagugaugaugcugugagaccuucuucuucccagucagacuuuggccuugccugaaguguuugagaccagcaauguugcagccaguugcauacacauagugaucggguguagaagaucuuaagucuacacauguuauuuauucguguuucauauacaccuuauauucagucuuaaagcaaccuuacaguauuuuuaguguacuuguuuuuauggaaaccuauucaugaagucauauauagaauuucccacauacuuuauuguaugaguuuucaaaaagugcuggauuuuggagcauuuugauuuccaugugaggaugauuccccauuaauaauugugaccuguuauuaagaauuuaccaggcuggagagauggcucagcaguuaagagcacugacugcucuucugaagguccugaguucaaauccuagcaaacacauggugcucacaaacauccguaaugaggucugacacccucuucuggggugucugcagacagcuacaguguacuuacauauaauaaauaaauaaaucuuaaaaaaaaaacaccaaagaacuuuccauucauaaaaagaauuauuauuauuauuauuauuauuuaccuuagucugucuccugaguuaacaguccaaauaugacuucuugggcaauuauuucuagugguuuaaauucugagcuacuagccacuagugacaagguccaccaaacuacauaccaucuauacuuaauuaauuuacaaugcuugcuuauaucuaaggcuuuuaaaaguauuuaccccuuuucagauguuuauugcagucuggaggcaagaucuucccacaguaugugcugauguuugggaugcuuguggagucccagacgcugguagaagagagugcgguucaagggacagaacauacucuugggcuaaacauagcaccuuuuauuaaccaguuucagguaagugucuagagaacugugcagccaggaugucaguaucucccggggucuuugucucuucuuuugaguuuuuaccuaguuagcagguuuaguuggauaagaagggcugucaguuuccuggagcaaaggaacuggucagggaggaaaucaaccugaggguuaggauaaccaagggcuucuguugugaauacggacgaaaguuaauagaguuugcucugcaucgcugucauagaauaaaagaacaacaagagguuuuaggcaugcaguaaacaguuguacuuuuguaacaaagaagcauccagaagacuguauccgaagcuugaauuucuguauugaagcuucagaucggcuacugauuggcaugggcagcuggaguccaggucugggccaccugucugcauagcagggguggguggggcucaagagggaagguuaguaccaguuuaagaaacaaggagucgcugggauuuagaaagagagugacacccacacagaugcacaugugugugcauaaggugugucuagauagagugcccagggaagccacgugggguucaagauggaugaagugggauguugaguacaaagucagagaaaugaugucuaaaggcuccaacuagucagcucuugaggaugcccgaagucuuccuugacuacuuaaggaauaaauuauuuaacuacucuuuuuggggguuggggguguggcuaaccaagguuuuagaguuaguuuaauaucucucucuugugaucuucacaagguagagauguuuaagcuguuucugugcauggucccaaacugccacccaucuuucuauuguaauguuuuaaaaggauuauuuucuuacuuuagugugugaguguuuguuuguaugcauguguaucuugugagugcauugcucauguagucuagaggagauaagaucuggaacuagaauuacagaugguugugagccacccuggcaucuaucugccagagcgguaaccacucuuaacugcuaggacaucucuccaaucccuaucuuucuauuuuauucccacuugaucccgacuccagcagcucuuaauucugucagggucuacaagaugcugguccuguugcccuuucacagugucucccucucaugaccacugugcccuuguggucugugugguuuucaucuaauguaacugggauaaugcacuccaucccucaguguucuugaacgagcaugccuggguuaagccccacccacuguguuucuacagaacauacauaacaccauacaguuggcccguuuaucauggucacuugaccacuuauguaaagacaguccuuaaccuuccuuagcaguuuuguacuuuagagucuauuuaccccauugccuuaguauugucuccucucuuaggaugauugaccacuagaaaacugugucgaucaaugaaacagaaucagagguuguuaaaagaauauaauacacuaacaacuauuccucuccuucaggaucagggcuuagacagggacuacagacuccucagccaacuccucagcuguuccuuggcagaaagagggcaagaccucuaacuccagcauuaacacuauauagucagauaccuccuugcccuuaacaccuaggaugccauuucugauuccagagauggaauuaaaugacuccacacccuagauagauagcugcccaguaugagaaucucugacauggugugggacaugccccaugggguaaaucaggauccuuaggcagcaucacagggggcugggcguggaaugauguaacaaccugcguugaaaagucucuuuggugacuguuaggaauaaaacauuugugaggccagucagagacauccauaacagucaaugagacuuagacuggcuuagacuggcuuagacuggcuuagacuggcuuagaccggcuuagacuggaccuggggccaagugagcuucugcauagauuuuaaaggugggaguuuuauagauuggauguagaauaugagaaaggaccaggaaggcuaguuaccauuuuuuaauguagggaaacaguggagugguaagcuguauuguguauauaagaggugucagagggggucauugagcagcuggauaaggaggauucaaagaaaacuaggcuaagcauguaaaguuggcagucaguaucauggaugucauuaaaaccauagaguggacggcacacuagcggugugcaaagaaaggcuugagaacugaauauagagagcuugcaaggugcuaagcuuuaguguaauagcagcaggggaggcuaggagguuaagcugagaaaaguggagacaggcaguacgaugcaggagagcugugagcaucucagucccaggcagggagaagugggaaugagggucucagggccuggccuaagagaacaggaguccacggcacaguccagggaagauuggagugccugggagagguuggugaauccggccacucaugaagacugagcucagccucucccagaaaggaaagcacccucugagcagcaccaucuucuuaguucauacaaggaacaggcuucagaauccugggccuggcuacaaacugccaugggugagcccugagcagcuuccccagcgacuugaauuuguaggcaagauuuugaaagaaccacagcuuuguagagaagagaucauuuuucugagugaaucuguucagaugaaauuuuguuuguuugugacaagaucucauugguuagacuuggcuauucuggaacucacuguuagaccaagcuggccucucacagagcuaucuuggccucugacucugguauuuagggcaugagccaccaugccuggcugaauuuggugucucugaucaaauacaguaaauacuaaauguuacauuguuugcuuguuaguauacauguucuagguauaaauguuuuuggaaugguuuggccacuugaaaguguaguguguuuccuuccaagaaaaaagccuguaaguaacaaagcacaccaaggugcugaaccugccuacaaaccuagcuuuucaugccuuaggacugaugcgcaaaauaccgaggcauaggaagcauugucagaggagcugauggagugcagaggaagugcugacugcgaaaugaucuaagugaaagugggcucucuuuuuaggugccuauccggguaugucuggauuuaucuucuuugccaugugucccuuuaagccaaccaguggagcuguugagguuggaucugaugacuccauauuugaacacuuccaauaaagaaguaaagguaaggacagcuacaaaugaucacucuugucauuucaagacauuuaccuuaaacggaagguacuaucuuuauuuacacgggcuaucauuuccuuugaagaguuaaaucuuauucuaaacaacaugcaaacauagacuagauaaauauuaguguuuaaaauuaguuacaauuaaauuagaaugaggaguuaaauauauauuuaguuucuguauucauauugauuagaaaggaaaaaaaaaagaccuaacuuuccuugauggaauguucaaaauuuacuuucgacagguccgugugugcaggucuggucgagugaccgcuguuccauuuugguuucaucugugccuggaugacgaggugaggcuggacaccucaggugaagccucccacuggaaacaagcugcaguuguucuggauaaucccauccaaguacaagcgggagaggagcuugugcucagcguugagcaucacaaaagcaacgucagcaucgcagugaagccgugagauugucaucgaacaaugaaugugugaaaaucccuggagucaucaaaaauguuuaaggguugcaauaauaaagcccauguuaaaagucuuaa

SEQ ID NO: 4548 - RNA, 3646 nt, Mus musculus
ucacguuuuaaaagucauuuaauauuaauagcauauuuuaaugaaaaaagcagcauacuuugccaguaaaacauuaaaaucaucucuucaaugaaagacaaugaaacaacacucaaaauaacuuaauacauuacuauaguaaauaacccauuaacaaaaacaagaaacgaggucauauacagaacucagaacuuuggagagccucaaauggaucagcaauuacagcaaauucuguaagaauauauucauaugugcaucauuuugaaugaaauauuuacaauagauaagguaccagucacuuuguaccuauuugugugugugcuccaaaaggauucuaccaaacacugugaauuuacaagcagugcacugucuuucuuauaguuccaaauuuuucccccuacaaacaaaccuccuaaaaggaaaaaaugaaggaccccuauaaaggucaaaauguagcaacaaagcaaucgaaaacugggagauggaaauaccuuggugaaaucuuagaauccagcagaguaagcaccaaguggagacugcaccuaaggcugggaaaguauacacugcucaucguugguaccuccagcugcuucuucucuucuguuagagauguguauguguguuuguguguaggcauguaaggugagugagagagcacgugugccgcggggacaauaugggaauccccauuaaauauguaaggaaguaaacaagacuucggacagugaaucuggucuacacgguuaagacaucaauuauaaagugucagcucacaaauuagaucacuaccagucaaaaacaaagggaagaaacaaucuucauucaaagugagaauauacaacuaggccaaagcgaacacagucuaagugggaagcuguaaaaauccaggaccaaaaagaaaaaaagaaaaauguuuugagcaucacuagcuauacguauccgccgguuuuauuuuucagacuaaagaaguuuaauuaauuaggaugugcacaaaauuaaguugccagagagauaaauuaauaauuuacagaggguuguacggcaauaaucuaauaauagcugucaagaucagugaacacagcaggcgcaacuccuuccauaaguguuaacacuucagagaaggaagaaagcgauaagaaccacaguaaaaauauauauauaauauacaguguaaaugcagaaaaucugccaucuuuuuuuaauucaaaauacuuuagagaugucucuaucauaucacauuaagcaucaacucuagcuucgaguuucaguccugaaucaauuucuauuucugaaaaauagcugcaaaguguacuuuuaaacaugaacaaggugacgucuguaagaacaaaaacaaaucuuacuugcucauucuugcaggguuuucaaaagcuugucccucuaccuuccuguugacagucagcuccucgcuuucucugaugaagccgagcagcccaggugcaguuaaaggggacagcucugcuacaacuugacaaauuccuuuucguguuguguuguuugugguuuugguuuuucuucacugcgaaaccgguucacaaucucucugauuugggcucagcugcuugcuucuuugcuccuggcuuggucuggguucacauuuaccggaauuguuuucugauagccaaaguagaaaggaaagaggcagaagagacaagaaggggguuagaaaaaaagagggcgaagggaaagggccaucccuggagaagggucccuaaaugccggcagaguauuucauucucuucuguuucugccucugguugcagaaccagacgcgcaccacauuuuucuugagauccagcuuuucggcgauggccgcgaucuucuccgaggagggccuuggcuggauggcgaaguaggcuuccagagagcgcuucuccggcgccgcgauggacgugcgcuugcgcuucuucuccgcgccauugaagagcuccggcuuagugagcuucucgcggugggauuucucagcuuccuccagccacgccugcaggaugggcuugagcgcgaucauguuguugugugacagcgugagagacucaaaccugcagauggugcucuggcugagcgagcccacgcccgggaucuugagguuggccagcgccgagcccacaucugccugggucacucccagcuugaugcgucgcugcuugaaacgcucggcgaacgccuccaggucccgcgggucugcauccacgucgcucaugcagcccaugugcgagggcagcccaugugcgugggccaugcucagggcugcuuggugcaugggguucaugguggccauguguggugcgugagccggaguggacaccaccgugccgucggggcccgccauagcucccagggccagcccggggcuuaggugcucaagcagcucgcccuccagcgccuggugcggcuggugaugguggugaugguggugguggugguggugaugggugccagccagagcggacgggugcgagaugggcacagaagaagaggaggcugccgacgugcacgggaugguguucauggugugguaaguggcguccggcuugaaggggcugugguggggcggaugguggugguggcucuuacucugggagacgauguccacggcggccagagccucggcacgggccagcagacucucauccagcccgccgaauauauugcucugcaauuguaaguagaaggcacacauuacgcucagcagggaauugugagcgcucucuccggaagcccccggcccagggcucgccaccgccaccgugccuacagcauucccagaacguuaaaauaauaauaaugacagugauccugaaacucggcagcgagaagagaggggaagccugcgcgagaagccaaugugcagggggaggaaaagugagccacagacaacacaacacaacacaacacaacacgcgcacaggcagcaucccaggucauaaaaauuaauaugaaaggcaagacccguugaauacuuaagagaggggggauugguuggagguguggggugauuugcugugcagacaugaaaaaaacaucaagcagauaaaggaggcugucaaaaugugccuuuaagcggugauuaugcagacauacgcaccggugggguuggaagacaagcucuccgcaucgccuccgagcccccgccgccgccgcugccgccgcugccacugcugcuggaacugcugcuccggccgccgccgccuccgccuccgccgccaccgccgccgccgccagcguugcuggagcugcuaggggaacuggccgagggcgccgcgggcgcagaggagcccggggaggcacuguguagcgccgaguacuugggcuccacgugcaggcugccugcgugaggcaugcugaacgccugcuugcuguucagggacaucaucaucaucuuuccuugcgcggcgcgcucgucgcuggcgcacuccggucccagcuacccgacccuccggagaaguacccggccggagcagcagagggaacaacacugcaaaguugugcucagccgccacugcuuccaggcccgguucucccaguguggccgcuagcuccgcuccugugucucccgcuaggucugcccgagagguugcccugcuccggguggcucuggcuucagaccucagcaccccaaagugcccca

SEQ ID NO: 4549 - RNA, 3646 nt, Mus musculus
uggggcacuuuggggugcugaggucugaagccagagccacccggagcagggcaaccucucgggcagaccuagcgggagacacaggagcggagcuagcggccacacugggagaaccgggccuggaagcaguggcggcugagcacaacuuugcaguguuguucccucugcugcuccggccggguacuucuccggagggucggguagcugggaccggagugcgccagcgacgagcgcgccgcgcaaggaaagaugaugaugaugucccugaacagcaagcaggcguucagcaugccucacgcaggcagccugcacguggagcccaaguacucggcgcuacacagugccuccccgggcuccucugcgcccgcggcgcccucggccaguuccccuagcagcuccagcaacgcuggcggcggcggcgguggcggcggaggcggaggcggcggcggccggagcagcaguuccagcagcaguggcagcggcggcagcggcggcggcgggggcucggaggcgaugcggagagcuugucuuccaaccccaccggugcguaugucugcauaaucaccgcuuaaaggcacauuuugacagccuccuuuaucugcuugauguuuuuuucaugucugcacagcaaaucaccccacaccuccaaccaauccccccucucuuaaguauucaacgggucuugccuuucauauuaauuuuuaugaccugggaugcugccugugcgcguguuguguuguguuguguuguguugucuguggcucacuuuuccucccccugcacauuggcuucucgcgcaggcuuccccucucuucucgcugccgaguuucaggaucacugucauuauuauuauuuuaacguucugggaaugcuguaggcacgguggcgguggcgagcccugggccgggggcuuccggagagagcgcucacaauucccugcugagcguaaugugugccuucuacuuacaauugcagagcaauauauucggcgggcuggaugagagucugcuggcccgugccgaggcucuggccgccguggacaucgucucccagaguaagagccaccaccaccauccgccccaccacagccccuucaagccggacgccacuuaccacaccaugaacaccaucccgugcacgucggcagccuccucuucuucugugcccaucucgcacccguccgcucuggcuggcacccaucaccaccaccaccaccaccaucaccaccaucaccagccgcaccaggcgcuggagggcgagcugcuugagcaccuaagccccgggcuggcccugggagcuauggcgggccccgacggcacggugguguccacuccggcucacgcaccacacauggccaccaugaaccccaugcaccaagcagcccugagcauggcccacgcacaugggcugcccucgcacaugggcugcaugagcgacguggaugcagacccgcgggaccuggaggcguucgccgagcguuucaagcagcgacgcaucaagcugggagugacccaggcagaugugggcucggcgcuggccaaccucaagaucccgggcgugggcucgcucagccagagcaccaucugcagguuugagucucucacgcugucacacaacaacaugaucgcgcucaagcccauccugcaggcguggcuggaggaagcugagaaaucccaccgcgagaagcucacuaagccggagcucuucaauggcgcggagaagaagcgcaagcgcacguccaucgcggcgccggagaagcgcucucuggaagccuacuucgccauccagccaaggcccuccucggagaagaucgcggccaucgccgaaaagcuggaucucaagaaaaauguggugcgcgucugguucugcaaccagaggcagaaacagaagagaaugaaauacucugccggcauuuagggacccuucuccagggauggcccuuucccuucgcccucuuuuuuucuaacccccuucuugucucuucugccucuuuccuuucuacuuuggcuaucagaaaacaauuccgguaaaugugaacccagaccaagccaggagcaaagaagcaagcagcugagcccaaaucagagagauugugaaccgguuucgcagugaagaaaaaccaaaaccacaaacaacacaacacgaaaaggaauuugucaaguuguagcagagcuguccccuuuaacugcaccugggcugcucggcuucaucagagaaagcgaggagcugacugucaacaggaagguagagggacaagcuuuugaaaacccugcaagaaugagcaaguaagauuuguuuuuguucuuacagacgucaccuuguucauguuuaaaaguacacuuugcagcuauuuuucagaaauagaaauugauucaggacugaaacucgaagcuagaguugaugcuuaaugugauaugauagagacaucucuaaaguauuuugaauuaaaaaaagauggcagauuuucugcauuuacacuguauauuauauauauauuuuuacugugguucuuaucgcuuucuuccuucucugaaguguuaacacuuauggaaggaguugcgccugcuguguucacugaucuugacagcuauuauuagauuauugccguacaacccucuguaaauuauuaauuuaucucucuggcaacuuaauuuugugcacauccuaauuaauuaaacuucuuuagucugaaaaauaaaaccggcggauacguauagcuagugaugcucaaaacauuuuucuuuuuuucuuuuugguccuggauuuuuacagcuucccacuuagacuguguucgcuuuggccuaguuguauauucucacuuugaaugaagauuguuucuucccuuuguuuuugacugguagugaucuaauuugugagcugacacuuuauaauugaugucuuaaccguguagaccagauucacuguccgaagucuuguuuacuuccuuacauauuuaauggggauucccauauuguccccgcggcacacgugcucucucacucaccuuacaugccuacacacaaacacacauacacaucucuaacagaagagaagaagcagcuggagguaccaacgaugagcaguguauacuuucccagccuuaggugcagucuccacuuggugcuuacucugcuggauucuaagauuucaccaagguauuuccaucucccaguuuucgauugcuuuguugcuacauuuugaccuuuauagggguccuucauuuuuuccuuuuaggagguuuguuuguagggggaaaaauuuggaacuauaagaaagacagugcacugcuuguaaauucacaguguuugguagaauccuuuuggagcacacacacaaauagguacaaagugacugguaccuuaucuauuguaaauauuucauucaaaaugaugcacauaugaauauauucuuacagaauuugcuguaauugcugauccauuugaggcucuccaaaguucugaguucuguauaugaccucguuucuuguuuuuguuaauggguuauuuacuauaguaauguauuaaguuauuuugaguguuguuucauugucuuucauugaagagaugauuuuaauguuuuacuggcaaaguaugcugcuuuuuucauuaaaauaugcuauuaauauuaaaugacuuuuaaaacguga

SEQ ID NO: 4550 - RNA, 3669 nt, Mus musculus
aaauugccuuuaggaacacuuuuacuuggaaaauuacaacacuaguacaagucaagucuuacacauuuaacauuugcuuguugaaagcaauucauaauaucaaaauuaaucauguuuuacuuuuucuucacaagaacacaaaaaugaagggaaacuuaaaacagaaaauuuaaaaagguaacacaacuuuucuuuuaguaguccuuggguaguuaugacagaagacuuuccauccuuuguuucuuugcauggagaccuugauccaaagucuuauuuguuucuaauaucugcuucugccucccccucuaucagaucggcucccuccacggccaccuccucuuggcgcuccucggcuugaacugcuguaggaaucacguggaggaggguacccccuuuccauagaagggggaagcccucguucuugucugccaacucgaucacggccacuugaguagagaucacuucugcugcuugaguaacugucucgacuuccaccguagccaucacgugagcugcuguaaucaucauagcgacugcuuccuccauaagauggugguggcccucguguagggggugcacugcgugaguuuccauaacucucauaugaaucucuguaggaaccuccacuuggaugaucugaauagucacgaucccgaccauauccaucucuaucaccguagccucuugauggauagucaucacgggaacuggaaugacuguaaucacgguaaguauaaucucuugguggcggugcauaaucucuggugucucgggagcuuggguaaucucugcuugaauagcuaucuuuuguagaauauccaucaucucuuggggacaaauaaacaucucugcgagauggcagggguucccuucgugguggacccccguagcuaucucuuccacgggacacugguguucuuccgcccauuccacugcugcuucgaacugguccggaagguguugaucuuuuaggagggggacccccgcuucgugguggugguccucucuuuacuggaagugguccccuggaagaacucauguuaaaguucauggaauaaccaccaucauccauguauccuccacgugaaggggguccccuaguuccuccacuuccuccucgaagaccucugggagggccccugcuucuuggagguggaggugguccacgccugccacuuucaaaagaugguuugguagcuugcuccaccuugauggcuuuuccauccaaggacuuuccauucauaucucuagcugcaucuuuagcaucugcugggcuuucgaagguaacaaaagcaaauccucuugauuuguugguuucccggucuuucaucaaaaguauuuccacuauucguccauacuugccaaauacugcuucaagggcuuucucauuuguuucuguauuaagcccaccaaugaagagcuuuccugggcgaucugcuucaaccaucuugccuuccagcugagagucggaggggacgugaaggucucaagcuccuccuacaagcucgccaaaucggccuuccaaguagcucaccggugacagcugcugggucucagaacagaacagaaaagccacuaggacuacugcacacgagcaccugugaauauuauuguauuaguuuccucaggcugcuguaacaaugcauugcgaaagggcugggggugggagguguguuauaaaacauugauuuucuuacaguucaggaagucacgaaguaugaagguaaguuucuaucagaagccuuaacaaaaaucuguaccaugacucccuccuagcuuccagugguugucaguaauucuuagacuacuuuggcuuauagauaucucaaucuaguuccucucuccacccuacguggugcuuacacuccaccugcacaccuuuguaugacauucagaagaacugcagcuuuucauaccuaucaacaucugauuucuacaagucaccuucugaggucaugggaaaacgugucuuuuacaggggaugguacuccaguuaaguuggagaaaggauauaggcucauaaacuuaaucuaaaugaauaugacccauuauucuggacuaucugguuaggcuuuaaauccaaggacaaguaucuuuuaaagauacacacagaaaaaagguaaugaaugcucaaggaugcagagagcagccacuugaaacauauggagggagaugugaugccuaaccaggucgagacuggagcaucagaaccuaaaucaaggaagccagggaauauuaacagccacaagaagcuggaaagagccuuuagaacacauggcccuccaauaucuccauuuuggauuuccuuauucugcaacaguaaaacaacaugucuauugucugaguauagcuaacucggggaggggacuauuuguuauagcagcccuagcaaacuaauacaguccuugacaauacaauucacaaaacuacgguuaaaauauucuaugaauuaagauuuuguucuaaacaggucaaaaucucuagaaagacucugugagcagccuuacuuaagcagcacuaucugugaugaccuuuugaguauucgaugacugaggcagauuuuuuuuuccuuuugaaccaagcaaaauuacugaagaaaauuauguuauaaauuuuacuuccuagaacuccacuuaccuugugacugucuuauaauaagccuuuaucacauuucauguacuucuuuugccugguaaauuguuuaaugucucccuauuaaguucuuuuuaucuugagauuagcuuuucuucaugcugccugaugcguaauuaccgagcagugggggcugugcaacugagaacugauagcacaacugcuuaaagcagcuuaguuuuuggauagcgagucaugucagcaagauaaaguuaaauagagcaaauugcacgccgagucucuuucaagcuuugaaugcauucagaaugaaagucugguacaaucccuuucgaacguuacguuccauaguaaacuauucaaguagcugauaccaggcugcuucaaaaugucccacaauacuuuguuccuuucuuucuuugggugcauaaagaggaaggguugaugcucggaagaccauucgugaaacuaugucauagauucgccaaaaugcaaugcaagaaaccgaggguugggggagggggcggacaucagacccuccacccuggaucuggcccucacugcuuuuguucugaguuccuggcccccucucaguuguccuguugcuuuagugguucggggucaggcaaaggcccgcaccacgcggccuccggaaucgcccgcccacgcgcggcacacggguggggaggagccugggucgcucucucaccgccccccagggaagauuugccccaucccggccguccuccccacucccgaggcggguuuuggccgcggaggcggucgggcagaaaggcccgggcaggccaccgaccuggcgggaaggcccagcccgccuuccccgccuucccgccgccgccgcugcgggaaggcggggggccugccgucccggacgucugcucggccaccgauuuucaaccuacccacggggcuaacgcuucccuaacuaggaagccgcuuucccgcgccggucgccacacgcgucugccgccgccgcucccgccgagaaccagaggccgcgaauggcuuccccuccccccgcgcaacgucaacgcgacg

SEQ ID NO: 4551 - RNA, 31373 nt, Mus musculus
cagggcgggagcagugggcggaaggggcggugcucugcugcgcggccucgcgagggugaguguggggcccggugcgcgcggaggccaggagucggggccgcggugcguccuccgcccggggucagccccgcugucgggggcgcccccuggaggcucgcggggggcagccgaggaggauguggcugagucgggggcgggguggaugugguggggccugcaggaaggacuggaagggacugagcgcuuuuuccuuacauaagaaaggcgucgcagucgcugcugucagguucucgugggccgguuugugagcucgucucgggcagcgcggaaggagccaggcccggaggcuguucagugcuaaggagcuccgccugcggaagggagcagcagaccccucagaggggaaggaauacagauuugcagguuauaaagcaggguucacugggagucacaaagcggugucuggguugccaaacaccgucgcgaccgcgccgguagcguuccacagaagacaugccaacuucagauauguuucucauuugaaaaaugaaggagagccuaagaaaaggguuucuuacugucgccuuucuuaacaguucccuugcauauauuuuggagaacaaagaaacuauaaaaaguggcuaagcuaguagaaaaccaauuuccaggagaaacaaaacguuuggaggguuaucuacaaugucucgaaaguucuuugacgaaguaaauauauucaaggaaauaguauuuuuauuaggaugguucuuuuaaggcuuuguuuccuauuagagacuauaaacauggaaaguuauauaaucaugaggaacguaaauggugauuacaaaaugugagggugucauaagaauauauuuggaauggauggagcaagugaaugguuggaauuugccccagcugauugaugucaugugggaaaaguagacauuuagucuugcuguauguaagaaagguguugaacauugcuuuaaaaucagugcuuuaaaaucauucauugccacgggucuucuacagagaucugaguuuucuggaauaaggaacaaguaucuauauuuuuaugugauccucccguugguuuuaaugugauugguguuggguugaguuaacaagcacccucugugagccggguaucaccuaaguuaguauucagaauaauuugauuuagagaagaaagauuuccccaaagccaggaucaucaggagaggauuuaagagaagaguggauuuaagcagaggagaaauguuguagaagaggaaagaugagaccaguuaaaucuggaaugugggaaauugggaaaguaaguacuagguuuggaagaccaagucuccuuagaggaaggaggucugaaaggagaguaugagaaaauugugcagcagaaacagacuauuggacuugguucuagggcaucagugucacacagaaggcuuaagaaugcuugcagugggggcccacuccccuagucagaaugccuggaguggggccugagcguucccucucacagguacuccuggucugguuugggagaucacugugcuaggacgcggaggaauuugaacagaagaagcuagauucauguuccaagauggaucuuacugagcaguccaagggcacuggagaaagaguggagaagggcaguguuucucauucuugaucagcacgaacuuggcaccagguccugcccgagugcacagccauuauucacacuugcuauuccccuggccugcuuauauuugcacaagaagagccugagaccauaagagggcucaguuaccagugcuagucucacuaaugcugcagauuuccagagcaaugaauaacaacauuuaauggugagagggucccagcacaaauugaccucagaguagaaauuuggacaugugacucuuucuggaaauagugaaagauaaaguagacaggaaccucagagaagcccucccgaggcagugaguguguucuguguuacccucacuuaucagcgaccaccuuaaccacucuguaaaaccauuuuaaaacuugaaagggagaggugaagcuuugagcagggguggagaugauaagcaggcuagugguaucugacaacauaguuuccaaaucaaaaucaguuacacaccgggugauuguguggccuguguguauuguacuauaucauagacacugauuggguuuaaaaugccuuuucuugucaugguaauuacugacauuaagaauauucacuugcucaguuccaagacaaauaucccaagucaggcccugcugcugagcaaacucccaaugcagaaaaguggguauggaucagacuuuuaaaggaaaaacacacauuuacaaguguucugcuuucaaaauaucaauuagcagucaguguaauggaguuauggacuaacguaaaauuauuacauauauucuuugauucugcgaacgagcuauagauacagagcacccaugguuuauaguagacugccaucuuaaaaguuaccacuguacauugugaugaggguugucaggcugggggaguaaucacacuaugguuccuggaggaugaagaggguuuugugagauaaugagaaagagcaugucccacauggaaagacuauggugacagccacucugggaaagagcguagcugccucuggagucuguacacacagaauggagacagcaggaaagcaaagguugaggaggagggggugucaagaauucauggaggaauauaagguauuuaugucaucacugcuugccuggauuguaaacuugaugccaccaggagucauuucugacccauaugccaguacauuccaaggucuagcccagggcccugcauaugguagcuucugcauaaguauuuauugacugugccauugcacagucauagaagaaaacauuuuuauuuuuaagguaaggcagggggagccuugaagguagguuugaaggagaguauaugagcaugagaugccugauagcguggaggaugaguagagaaugugugagagguggcguugguagacugugggcuuccagacuucacaguguacucauugcaggcugcgguagaaaaccagaagaaacagugcucgggaggauuaucuauaaaagggauacauguuaucgagugacauuuguguuucaugcauucgugcauguguauuguaaauauaugucuuauagcauacacagcuugaaaccuacaacauuagagagauguggauaauggagaagaaagaauaagucacuuuugugaaaaguagaugugaacuuaaaauguuauuaucuguguaacucucucaggggcaguaugauuaaguuuuguuccuguaacaaagcaaagguuuauuuugguucaguuuuggagacugauucauggccaacugccccuguuggcccugugguagcacagugauugugguggaaguguguggcagaggagcuaccugccucauggagccaggaaugaaggaaagaaggggcugggacucuaauaucccuguuacgagauccccauggcacagcuucugagagguuccacuuccuuaaggcucuacugcuccuaagagcaccaagggcuuagcaccaagacucucgcacauggaccuuuaguacuuuuaagauccaaaacauaacaagaagcauugacagcuuauuucaguauuuaugucuacuuaguauuuuucacuguauauuaaaacucuggcacccugguuuauuagguaugacaguacuuuguaguaggcaacuaaacguuguaaauaccacagaauucugcguuuuaaaagugcuuagucuacagauuguaggaugaagcuuucugucaaaacucaugacaacugaacaguuugguaugguuaauggcuacauucuuuggcuucugcccuucaggcaaaggugcuuaguuacaagagcaagcgagaagcccuucuuccuacuuagaccauuuugucaguauaauggacagaaucugcuagaaugucaauaaaauuacaaacuuauuuuucuguccugccugugacauguauauuaaagauaaaaaguuguucauuaggcuaaguuauauuugcauuuaagaaauguaguauccccuuuaaaucaguuuaauuaaauaauggggcuauguggauuuauugggugugacuuuucugugaaaugaagaacauuuuaaaaugcuuaaaauuuagucuguucuguaccuaacucauuauugggaaaucauguugacuuucuaaauuugacaaaaguaaaaaacaaauuguaaacaaugaacauccagauguaacaaugauagauccaaaugugaaggcuguguaacuuucucuugaggucuuagcguacagaucuguguuuauaaaaucccaccacuaguugugaggccuugagccuccaccucacagugcugagcuucuucacuguacagcggggcuccuuuguuguaggauuauuguaggauuaguuaggaaaguacacguagaaccucaucauacugcacaugaagugaagcagagcuguugcugucugccguucacauagucccaagagauggggcgcacagggugggcugaggggagaucagccuuaaacagccuggaaggugucagaagaaucuggauaauuuuguuaguuuacugggggcagguaaaaugaugccguuaguuauuucuuaguucuuguuucucacuucaaggacuuuuaagcccugucuggguaugaaagaacugccuccagagcaaacugaucagauaguuagcacaggguugucuaagaacgccugcuauuaauuguugugauaguacaucgcaugcaugacauucucagugaauaaaaauacuaucuuaagauuguuuuagggaacugcuuuuuauauauguuaaaggaagcuacacugucuuaauuagacgguuuuuauccauuuuguuuagagaauuuucuuguauuaugaauagacacuucgaucugguaaaguucuuguuguggguuugguucuuuccauauuuuuauauuucuucucuggaagcuugguuagaugucagagaugucucgauugacgguaggugcuuggaagagcaguguguguuuguaaagguucucugcucacacaggcuuuauugccagucaagcucuuccccauaggcugaguuccacugaugagucuaaagaaccguuuugaaaguuggccaugugccaggcccugcucuagagucugaggagguaaagacuacaugcuguccuuucucugggaggaccaucagcugaccaaggagugcugagaccugguuaauagauuucaagacaaagcaacgaauauuguguugcagauaugaacagaaaguuguggaacuagcaugguugacaagcauggcugacgagcacuuuuaacugccugggagggucugaaggaaugcugggugaagcaagggugcugucugucagucaaaauaaaauuucuggcaguggcccauuggguaacaccuuucauggugugguugcauguccaaaucugauucugauaaaaauaauggcuaaaacacuagccacccuuucaccuugcauguaguuccuuuuacuaguuucuuuuuuggaagauaugcuaauauugugucuaauuuggaaguugacaugcacacauauugaauguaacacugaagguuacaauaaauaguaaaagacucaucaaguugauuccuggguuaggaagagaucuaaaugaggaaugaagggucauagguuauggcaaagauaauuaaaucaugagugguuacuagacauuucucauuuuaaaaaaauauaaauuuuaaucuuuaaaaaugauuuagugguugcuauagcaacuguauuaguuucccauuggugguguuaguguauagcaaauuaucacacauuuauuuucuuaauaauuaacugauuuaugggggagggcacacaugccaagucaggcauguggaggucagagagcagcuuaguagagauggcucucuccaucgauuuuuacuuggguucugggaaucaaagacaggugaugaggcuugccugcuaagcaccuguaccugcuguaguaucuggcuggcccaacacuuuuauugucuuagaguuuaguuagucaugccugacacagguugaaguagcuaaaaaucaagguguugauggccuuuaugccacccucuuuucagugacugcugcuucugguuuucucagccucuccuccagucagucagccuucacagguugucucacucuguuuacuccaaccucagagagccgacugggccuccugauguccagcuguucuuuuuuucugccuuucuccucauuuuaaaggucguggugaugcuacggagucaacucuuucuucacuagcacccugaauucuaugagcauauuucaguuccccuuuguaaaguaauauauguucugagaguugaggaauucagacacaugggcacugucagagaugucauuaucauacacuauaacauuaggcugcuuuuuaacaauauggucugccaaaagcagauuagaagcacgccacgauaacccugauguaagggaaguuuuauuuuaaaaaaugcucucaacuucaaucccuaaucaguuuuugguugguugguuguugguuuuuuuuuuuuuuuuuugguuuuuugagacaggguuucucuguauaguccugguuguccuggaacucacuuuguagaccauuguggccucgaacucagaaauccaccugccucugccucccaagugcugggauuaaaggcauucgacaccacugcccggcuucuaaucaguuuuaaaacaagcuuguaucucauggauuuaaauaacauguaaacauuggagauauccaaauuaugucugagcucugauuuuagcaccaaacuuaagacugaaaugcaucugcuaucucaguuagauauccagugggccuucuuaaaaauuaaaucuggaggugggagauggcuuagaugauaaagcauuugccauccaagugugagggcuggaguucagauccucagcucccacauaaacaccucucaggcauggugacaaggcuguauucucagcacacuaaggcccauggagggauccccaaauugagauagcuaacuagacuagccaaauggugaacaaaguucaaauuagagaccuuaccucagucuauaagguggagagcaaucaaaaacaacauuugacaacccucagccuccauacacaugacauauacaugucugaccauacccaugcacacaaacaugucccccaacauacaaaauacuaaaaauaaaaauugaagucauuuuaucuaucuaccuaucauaccuaccaacccacccacccuccuucccauccuaucuaucuucuggucauagcucaaaccuuaccucccauucuucagcuuccuacggcucaggguagaccuuuaccugagcuuuaacaucugcaucgcacaucugguaugagaacagcuccuucagaguucacauggaguuugagcaucaccuguacuugguccaggccaccaucucuucgcaguuacaguaauuccugcacuguuuucucaucuuguucuacaucucacucccugcuaccuacuugggaauuuuacaugaaauagccagaaauucuaaaaacaaagcacaacuaaacaaaaacaacaacaaaaagaaaccaaacaguaaugagcuggagagaugggucagcaguuaagaacacuggcugcucuuggagaggugcuaaguucaauuuccagcacccacaugguggcucacaaccaucugucauggcuucugauucccucuucuguggucaugaaaacaaagcacucuuauacauaggauagauagauaaauaaauaaauaaauauguauaauaaauucuuuguccugccuucccaucucacgcauuuaguacacucaucugucuguaaagccuguguccauccugucuuugacugucucuccugaacuuuucccuguagcucauucagauccagccacagugacugacagacugacagacaguacauugauuuucuccuaagaacauaaacuccaugauggcaguaacacuuuuuguugcugcuguauucucagagccagacuaaugcaugacacauaguaaaugcuuaaacaguuauucaguggaugcuucauaaucuugguuugggguuccccucuccccuuacucccaguaagaccuuuuaauacaaaaggacauauuuuacauaguucuaauuugcuuucagacagcaugugagaaguaaguucagaucagcuguaucuugucucugugguuguuuuaaaguaacuaccgcauaccugaugugucagcuuuauggagucuaacgugcaggaaguucuuuaaucugguuucuguuuucuaucccuuaaugccacacccaaaucuauguucuccacuucucuuuuguuuccucacuaaggacucuuucucucagguuucucauucuguccucuuuugcuagagucucaucacuccucaauucucacggugcuucuacauguuauaugacuguacauugcugcugcugcugcuacuacuacuacaacaacuacaacaacuacuacuacuacuacuacuacugcuacaacaacuacaacaacuacuacuacuacuacugcuacaacaacuacaacaacaacaacuacuacuacuacuacuauuacuaugauugauuguguugcccuugacaauagacaaaagguaguuugggccucaguuuuuugucccgguucaaaccucaucucucaucacuaguuuuguauauccagaucuucugccuucaccgacuuucccaaucuucucuaguauggcaaggacuagaccaaguagcuacacuggauuuacacauuuaaggccucagccuggaaaaccugccccauccuucuauagcauuuuuauucuuuuagacuuaguccuggcauugacuccccagugacuugaauuccucagugagaguuagcuccugugauagugacuuuucccuuagcacuuugugcuuugggccguugcuguuuuguuuuguuuuguuuuguuuuguuuuguuuuguuuuguuuggacauggugugucuuauuucaugagcucuugaaguacuaaggcuccgucacugaagaaaaugaaguaguaaacugcaguagguugacuaagaaucuccauaggauauguccaugucuuaaccccuaaaccuggaaaugugacccuacuuagaaaagcagucuuuuuguuggaauuuagcaauuacuuccaacauuauaguaauuuguuacaacuugugugaggggcuaaguugaagauuaaagcagauggcucuuaucuguuacuguucucaucauugaucaaaaugccagaaaugggugacuuaggggaggaaagccuuagcuuggccuuuguuccaggugaucucagcacauuauggugaggaagacaugguggcuggaacagaugaugggacuccucauaucacccaggcauacagaaggucagagcuugggaccagaagcaaagagaaccaauugucaaagcuucucccacagccagguuccacaucuuaaagguucuacaacuuccuaaaacugucagcaguuggggaccaaguaauuccacacaggagccaaagggaccgggucagauuuaggcuggaguagcaggagcaccuagcaccauuucugucaccaucuguguuucacuguuauucaaugauuugggaacuacauauucucaggaaaggaugacugaauaaaaacaguucuugcccgugaaaucucugucuaguuauacugguaguguugauaagaauuguauauaagaguaugcugaaagaagccuuuaaagacagauuccucuuaauuuuuaaaggauuuauuuuaaacaaauauauaagucuaguguggugauguacaccuuuaaucucaguacuuuugaaaggcagaggcagguggauuucugaguuugaggccagccuggucuauggaaugaguuucaggacagccagggcugcacagagaaacccugucucaaaagcaaacaaacaagaaguacuuuaaaaguacuuuauuaguauggguguuuguuggcaugaaugccugaguacuuguaugcaggacucagaggucagagaggguguaugaaccccuggaacaggaguucggacacuugugaucggccaugugggugcaauccaggucaucuggaagggcagacagugcuguuaacuacuaagccaucucauuaaccccuacaauuuuuauuuuuuaauuccauauugugugcauaugugcaagugagugcagaagagggcaucggaucccuuguagcuggaaguagaguaguagugagugccuagugugggugcuaggagugaaacuugaguccucuggaugagccgaugugcucuuaaccacugacucauuguccugccucccacuuuuuuguuguuuuaaguaugugcaagguagugauggguguuuaauacuuuuuacauacuucuaaaaauuguccuuuuaccucaguauuuucagagacuguguuuccuccuagaagacucagaagucacacacauagucucaccaaaaagacugucuaaacauuagcugaacaaggacaacaauagacauccugacuuggacggcaaagcucacaaggccuccaccguauggcaagaacuacaggcaacucaggacugcugagagagggagagagagccuuccccagggaagagcacaccgauugucuauccagaaccaaauggucaguccucaaaacauacauacagauaacauugcacagacuaagcaaguuauauuuaggaauauauauguauagacacauaugcauguaacaauuaauggaaagaugccacggacuuaaaagagagcuaggaggggucuauggaacagucugaaaugaggaaagggaagggggaaaugauguaauuaucucaaaaauaguuguccuuuuagaauaugguuaauuuuauauaaauagaaguuauaauaccuuuguauuagaguucuuuagaguaauagaacuuaugaaaugaguagaaugauucuauauagguauuuauagguguacccaugccuauauauaccuauguauauacauaaaucauauauaugacuuauuagaauggcuuaaaggcuguaguucagguauccaacaguccaguaguuguucgguccaugaggcuggaugucucagcugguguucagucuacccuggaauccuguagagguagggucuaacacuaaugaaggaaugcuuugcuagcagagcaagaccagucaggaaaagagcuucguucuguguucuucauaggcugccaguggaagguguggcucagauuacaaguggaucuucccacuucagauuauuuaagagaaagucacucacuucucuuaaauagugugcccagucauuuggguuuuaguuaacuccagauguagccaaguagacaaccaagaguaggcaucacaaccuuccucaaaauagaaaagagauuggaaaaaucagagcagcucuaauucuacaaaugaaaaacuuuuacgcauuucaaguaucauuuagagaaagugucuuagagcaauaaaguaacucacugccgcaaaguauagggaagacagcacuuaagugggcagcgucuguaacucucagcuuaccccuggagguugggugugugaccuagcaucacagugccucacacauugguaaacugucaaucuaaugcuagcuaucugggcuuccuacaggaaccaagucauccaacccucacaaccacucugcuuuaccugcucuuuccacugcagagaagagugcaguacagagugcucaaggaacuugcccagagucagaacaccaaaagugacuggcuauggcugguaacuuuugucgcauucugacuuaacauagucaguacagugggaaguuguguugaguggaugugaaaagccucugucucguucugugguaguucuggcuugagugugcuuaccuacagaggcugguauggggcugggaaggagcaucagaacaagcccaggugcuucugaccgucgcagagguacccugcucugcucacuccccggccuacgccaucuacuccacauuaaggcuuauuguuguugauugugugcuuaugucagauuacucagggugccucucugaguacaugcguguaccuaaacuugcaccucaagugccgcauuccuaaucacacuauuuaugcagagaaugaauaagaggccagcggcagagggaaucuucugaaagaaucuuuugugcaugccucagaaucggguauguuaaccugaagaaauccuuaagaugaaugcaagaaaaacauggcagaaaauauuacucuaaugagguuuuguauauuauuuuuuacauuugcuauuuauuccuauuauuaugcgugcacauauacuuuugagcaugccacaaguagaaugaccauugaagucaguucuuucuguugugggucccaggaauggaacucugguuguuaagcaucuguagcaaacacuuuuuaaaaaggcccuguguugguuuuguuuaaaggauaauuuuaauguaaauuuuauuuuacaauaaaguuguuucauguuuugaguuauucucaguacuaacuauggccaagggaguccucuccuaaauuuuagugucuuaguuagguuucuguugcugagauaaaguaccaugacuacaugcagcuugggaagaaaaguuucauuaggcuuacaggucaucaucaagguaagucagggcaggaacuaaagccaguagccugaaaugaagccgagaccaggaaggagugcugcuuucuggauuucucagucuucccgcuggaguccuggaggauuccuggagagcugcuggucuucagucugcauuuaaacccuaaagaaguuggcucuaauaguggccaguagagcucaguagcaggguagaugaacuugccagugagagugagggcaagcaggcaaaaagcaggguuuucuuuuuccauaucuauguuggcugccaccagaaaguguggcccagauuuagggugguucuucuugcuucaaauaaacugauuaagaaaaucucauagggagugcucagcagccuggguuuuaguuauuuccagauggaguaagcugacaaccaaaauuagucaucacauauauuaucaagaacccugaucauucaugucuuagaaugcaggaaagcaauaugcaagaaugcuguggucucuugguuuuacuacuuaaguauuuuaauucuguugaacucaaaaauacauuuuccuuccuucuaggccauucauaaaucacacuaagucagaaaguauccgguuacagacaaaaugacuauuuccacgcugcuacuuucuccuaaucggcguuuacuaaccugccucucaagagugccuuccccauggcuccuucacucaagucacccugcaccgggacccccaggugcucugccaaacuguuuuggacaccauuguacuaagagggugcuacugucugacggcuucaggagaacauuauguguccaggcaaccuugaaggaccacacagaaggacuuucugauaaagaacaaagauuuguggauagacuuuauacggguuuagugaaaggacagagagcuugccuagcggaggccauaacucucguggaaucaacccauacaaggaagagggagcuggcucaggugcuucugcagagagucuuagcccuccagcgggagcaggagcugcggaaccaaggaaagccccucacauuucgaguaggucgguuuucuuuuucuguuguucaggaagugguuuuguaaguucuucuuuugaaauacauccaggagguaugagaucaaauugagauuucuuugcuugauauuuggaugaaauauaaaugcuguuuucuacagguauuaaucuucauauaugguaaaauuaccaugagcauuugaagcaagcuguauacucaggaagaguaagaaucuugcuguggauuccagaacccaaauauacuggaugacuguuaauuggggugcucuuuuuuggcagucuucuguuuuugcaccccauccgugauuaguuacccucgucauguuggaagucugcaucuugguugcuucauuggccuuucuguacacaggccuucuuucuccuucuuuuguuuucuuuagucuugcuaucuaacauaggcccacuuuaacugucuauccuccugccucagcuucuugaaugcugggauuccaagcauguccuauaaccauggaugucgauacugaccccugccacugcauaaccauggacccagacauggcagcucaggcuaggaccucaucauggccccaggugccagggcuguccacucacagcagacugcuccucuccaguuccgucuccuucaucaugcucaagcugcucuacuucucuuucucucucaucugaccgacacacauacacacugugguggcucccacuauaggcuggacacaugguuggaggacucguaggugacaucuucuguccuugugccuggugugguggcaagcugguguuuauugccucucuugugccaugcacuggagagcaggucuguaggugccucuacucauugccgggggggggggggggaaggggggagauacuuuuuauuaagcuucuagggguggcguuuccugucugcauuuaaauguucauuugacuuuuuggauuauuugacuuuguccugagauugugaauaagcuugcuacauuuuugaagccauguaauguugaauaauuuagauauauuuuucagcagcaggaguuaugcagggcaguuuggguggacagagugucccaugacggugaaacaggugcuuugaaccaacucuucuguuaagaagagcuugagauggugggguagugcagggacgugugggcaaugaguagaugcacacgaacauugacguuguacuagacuuugaaucauaguauaucgguaacacagagaaucagaccucauaggauuggauaugaaugcuuuaaagaugguuuucacaaauagcucaccaaccaaucccugucauuguccacacauuucacagcccuuccucuaccuaaaaggagagacucucauuuugagaguacuacacugggucuuaguaguauucuccuuggagagaaaacccagcaugacaaagucugcuuauacucagcuagagaaccuuugaagagacaagaguccuagggauauguuugcuuagcagcucacacaaaccuccucagaucuuucuggauagccuacucugaucuuaggcccgauuaacucaagucuucaguuauuuuaucaucaucguaaauaaaaguaacacagauuuauucagcaucuauaaaggugcuugagauggagaccugccaugaggaguaaggaccuaagccuuccacacacuacauauaccuuugaagauuguuaaaugccuaugauuaauauuuuuuauucaaugggaacagcucucaugcccugcaguguaugugacacacuguacuaaacauaaucucaucuaauucuuaaaacaaccugcaaagacccauacuauugcaguagcugcuguccugagaagaaugcugaggcaccagggaaggugagcagcacaggacagaccacagaccuuggguuugugaggaucucacaaggaugagacacacuggcugaccccuuaccugcuaugaucgacugacucucuaguagggguuucucugccauuuugaacacaaguagguuuuuuuuuuuucagauuuccuuuuauuauauauuuucuuaaaguuaugaguaaaaagaagaauauuuguauggaaaauuacuuucucaaucacuggcaauuucuagaguaauggauuguuuuuccagugggaagaaacagaaggggguggguggaauaauuacccaccgugaugagaggagggcagauguagaaguuccgcacccugcaacacaagcaauaaugucuguucccaaagaucugcauuacaggaaaagggcaaaccacaucugauuggugaaagugaacuuuaugaccauacaaaacuugcaaauuuuccucucuaucucacugcuacucagaaauuagauaaagauaagauuuuucacuuacacuuuaaggcauguuaaaauaugucagucaugauuuucauaggcgagaugaaacuauucaccaugcugauuauauuuauggaagaccuauaagucacucaaggcacagcagcuaggucccacuccaaagacuuucaaacagccauucccagcccauucgaaucagagcaguguccaggauguaucuuauaggaggggggaaaaaagaaaaaagaaaaaagaagcccaaggucaggcuaccacaucccugagcuugccccaagaucagaccacauaacccuuuaauccccggcuacccuggaaagccccaccccaaagaaacccuguauaaagcaagcccccugcucaguucuuugcuccuuguccgaaaagaggcagccgcucugcuguguuuuucccuccuaauaaaugucuugugugagguuuguugugugguguaacuuuguuggaugccaggauaccuuuucaucugagcuguuaacauagaccucuuucuacuauaggacuguccgggcccccuggugcaggaaaaucaacauucauagaauguuuugggaaaaugcugacugagcaagggcacagguuaucugugcuagcuguggauccaucuucuugcaccagugguggugaguauggcuggcuuuuuuuuuaacugaacagcuaguggggacucugauacagguuagugagaauugguaguuggguguccucuaacugucagaugaguuuggucucaugaaaggugccauuucuguucugcagagugauguagaaacucugagacuggguuaggaagaugugcacuacacagaggaggucagcuuguggguagcucgguggcuacucaggcagggugagaggggccagcagaugaggcugaacaaagggcauguguuagccucuuggugaucaugccuaagaccaggcccuaucugcagucuuuguuucuccaguggccucuacuucucuguuauuaucuuuauaguguuguagcaucuauucaauuaaucgugagggaaaaguacaaguguuuauagcgugucaucugucuguucuauggccagcgaaacaaagcuccugaagggcccuguagccuacugcuguucccuacagcgcucaagcacacagugcacugcacggugcuuagcacucacuugcuggagugaggucaugcauucacucaacacuuaauuugcagcucaucagagauaaaaugaauguaaacuuagcucccuaaggaccauuuaaagaaaacauacaaagucuuuccuguaacuacccaggaaccauuucccccuucucucucuugaguuaagcugcucggauuacagcuguucgcugaacugacauuggagcuucuucuguaggugaggcaccaccaaaggggacugugcuauauggugacuaugacacaaugcucuuggccuugcucaguucaugucucaugagggaaccaggcaacauaagcagucgcacuauaguaugugcucugaggggugauacuugguauuuagugaaaguguuugguuuguaugcuguaguauccuucagaaaguaaucacacuugaaagaccuuaggucaggggagaaguagauaacaguucuuaauuacccuuuacugaggaguauggcucagagcagucaaaggguuugguucacuguaauagaacguuuaaugguaaaugaaauuauacucuaguuccaagguuuauccuugucaauuuguugucuagguuauuuacuguuuaagacuauugcuaaaugaaccuagcacaggccuuuagucccagcacucagcagacagaagcagacagguuucugaauuugaggccaaccuggucuacaaagcaaguuccgggguagccagacuacacaaugaaacccugucuugaaaaaccaaaacaaacaagcaagcaaaggaacuuugcuguaugaaaauuaaugaaagguuuucauaaaugauucuaauuuuuguacaagugagaaggccuuuuccuccccaccuucauggucuagaguauuuccauaggaaaauaaaacaguagcuugaaauaguaauuaauaacagaccucauguuauauccugugauuaaagcuucauagcacauagcuaguuggcuccuaaccuuucuuuucuauguguaugugugugcaugcauguguguaagggagacacgugagugaaggucagaggucagccucagugucauuccuugggugcuguccaucuuguuuuugagacagacucacucucuuggaacccaccaaguaggcucuguuggcugguagagagcucuaggaaugcauaucuuugccuuccagugcuaggauuacaagcuugugccaccaggccugguuuucuuaggggugcuggggucaaacucauuuccuugugcuugcaagaaaggcacuuuacugacuaaguugugguucuuaaccuaaucaaacugaaaacgaagguccuacuccuaggguuuuaaaaacguaucuguaauucaagagaaaaaauaggugcaguuaaauggaauguuauaaaugugaauucgcagucuguauaaacauuaguuauucauuuauuugucuguccuugugcuuuagagucauaagccuuccuguaauauagcaucgagaccacccugggaacuacagcuaacauuuuggguucacuggcaagaaaaguucuaugggagaauaaguugcuaaugcuguguuaagugugcuggcauccauagguaauacguagauacagcagauugugcacuucugcagggaugauuucuguaggaagauacuuuaggaaagguuuuaugugaaaaaaaaauaaggaaguuaagguauaugguaggcaugugcccuagaauagugccuauguggaauaauaaaggaaaauggcauaccuuuaaggaacucaguguucgcugucucaugguggggaaaugcccuuaggugaguguaaauggucagguaagacuauccccauucuuuguauguaacuguauggcaaaagguuaagagcacugcucuugcagaggacccaguucaguuccuagcaccuacaauggguaacuuacaaccaccuauaacacuaguuccaggaaauuaagaggccaguaccuccaaccuccacgggcaccugcacuucugcacacauacuuaccuguagacacacacacacacacacacacacacacacacacacacacaauuaaaaaugauaaaaucaaauauguuuuuaauuacaaaaagaggaaguaggaaaagguaguaguuuaaggguuuaaugcuuucagaauuuaaaguauugcuguuugcucaaauacuacaauuaauucaaaaaauauaacuaguccauuuccugggugucaguugaguacuacaguaaccacuuuguuuagcauucaguguacaguagcuuuaggauaaggucauaggcagggaaugcuguagcuagagcaaauuuuucucaacuuugguacuggugacacuuggugacacugauggcaagucuucguugguggcagcgauuugugguauguggugacuguccuaugguggugcaguagcauccugccccguuugugacaggugaagccaucucuagauacagcagaugccuguggggugggugagggacggacccugguuggaaaccaucacaugaaggaaacgaaacagaugcugugaaccugagaugugcuguaggaaaguccccaucccggugcgcgccauggcggugaggggagaaguaacagacuggcauaaggcugauaaaaugcgacaauggggaggagagccuguucuugguaaaaagggaaaggagagggucaccaaaguucucuuauguccucuagggugucaacagauugcagagcaguugcuguguacuguacagauuuacagcaaaggacaugucaugagaaaguuccagaaagacucugaaggaaaagacuuuaguguauguaagauagauauggucuguuauguuaccagguuuugaagcacauguuccauuccuguguaaugucguuugaaccucagcaugacuuauuauuccauuuauguaagaaaggaaggguuugggaggguaaaaauaacaccccaaaaugaaguagcaaggacccugauuugaccucuuguaaauuagugacaagaggacauaccagauguccuaguagaacaccagcaaggacacagccacacuaauguggagauagcagugaagagacacaaugcugggccagaggguuggcuugggccuggaaugccgacauuggucaaggaagguaagguagggauguugccuggagcauccagggcuuagauuugaacuuccggucaauucaaggagaccuuguugguuuccaggagcuugaaaugauccacuacuaacuucaguaugaggauagagagugagcuagaggagaacucaguaauguggcauacaccucaggcuugggaagagauaccguaaaucauguccucuugcaguuugcugguugguaauuagcucguacagcucuuccgugauuguaaaauguaacuguguguuuuagggucccucuuaggugauaaaacccggaugauugagcugucaagagauaugaaugccuacaucaggcccucuccuaccagugggacucuaggaggagugacaaggaccacaaaugaagccauuguguugugugaaggagggggcuaugacaucauucuuauugaaaccgucggugaguguaauacucuacuucauaagagucauguacuuucauaaugagugcuauuuaaagaugacuaacaacugacuucauuuaguucacucagcagauaugaacuauaauuagauacaagguauugccccacagacaaugugaguacaugggcuauguucccuucucacaagagccugccaugaaaaaggugaaagugagccccgagucugcagagcugauaucuaagcugacauguuccgugugccagaggcuaguaagcacuugaaugaccgugggaagucaaucacagcagcacagcacgcaugggauccuggugcuggcuauuccuccguagcacagucaugugcaggacaucaaacgaaaaccccagcacuucacacucuugcggagagacaaccuuuugguuuacuuugugaugaauguauaugauagaacccaaaccaguguuugggggaaucagugaagacuuccuggaggagggagggugggauuugaugguagggggugaagcauauuugcacagacacagugagcaaacaugacuccuucagagaggugcagcuugccugaucaggccacucacggcauuucgggcagagacacuugcaacaggggccaggggaagguuuuccuuaugugcccugccaaagaguuuucauuuucucugaaaggaguaggaagcuagaacaagggaagccacauguacguuuggagggaaccccacagcagaaugaagaaugauuagaacauuuagaguggaaguggaaggcaguuaaacuaugcugucaaucaaagaagggaaauggugacugcuacaucaaguaaacaggaccagagaggaggaaguaauucagaagcauggacagugagcuggaggacucauggaagagaggaggaagggagcuuuccagagcggcagagagcacuguggaagauggcagggaggagaacacauugcugugacauccuucuuagguguccacgugacauuguuuuaggagacugggugauaaauacagaccuaacaacaugggucauaguuccacaccaaguuauaaauuuuguuuacauuaagugaaggaaagugggggauaaaaauagaacguagccauauugguucacuaggauuauugucauaaauaggggcugagcagcuuagaccacgcccaugugccucucacagcucuggaagcugaggguccagcaccagcaggguugcuuugugugcucuccucccuuuuuuugcagauggcuuccuuguugugcccucacauggacgcucucaggauuacacacccuggugccuuccuucccuuucguuagcaccccauccucaugaccucauguaacucuguagagccucauuuccaucugaguucuacugagugcuggaauuuccaugauggaucugaagacaggucuaacagccaccauuuaagauugaauggagaggagucagagaagagggcaauauaaaagccaaguguguuaucucagaguuguguauggcugcuuguccuagagacucaugauaacagcgacucagauaaaagaggguugcugucuuguaagugaagaagcccuggggcaggugcuugagaacaaaucuaguucuacaccuucaguccucaggaugccuccauccuucacauguagucugccucaagguugcucaggacuggaaggugacugguggaacucugacugucccacuggguggcagacagaaggaaggagagggaagaggcacacccggcugacgugccuucuucagaugaccugccugcagucccucucugccuaccuuuacuaucacucucugcucagaugccugacaggacaccucaccaugucgguuugacuugguacacugaacucuagggugaggagagaaaacagacagaaguaggcaccagaaguaucugcaacaaauagagaguuuccaggugagcguugagcuggggguguggaucaaaacauaggcacugagcaucaaguaagguuuuccagaaaauugaccauauagagaaagugagagguucugugguggcugagugaggcuucgggaaaguggauggaagggagcucucuuuagcaugacugcuccaaggaaacugcaagugggugaccuggcggaggcugggauggcaucuguuccuccacggagggaaguacuuccuuagucuccucugugaugugggugcccugguaacagugcaugaaaaauacugaagacacuuagauccuucccaucugucugucugucugucuguccucucucucucucucucuauguguguguguguguguauaaguuuugccugcauguaugucuguguguuccuguuacccacagagaccagaagaggauguuggauccccuggaucuagaguugugagccacuaacuagguaauguaggaacagagcuggcuuugcaaaagcagcaagugcccuugaccacggagcuuccucucuggcucccucggggauggcuguuaugagacccuucagugguacuugucugcaauuaagaggucucuccaagaauguuuaaagagaaaagaacugggaguuugcauaaaggugaaaagucguaaagagaugaacauaguggcaaacgugguuuuagacuagagcccgucuguguucaagccacuuacugaugaaagagacaccaagagaaagcuuuacaagcagagagaauugaagucuggagggucuccauccaaagcauugaccuggugagaagcgggagggugugcuagcaacuuaaucuaaauucaugcuaauagccuuuggggacuaauuaggaguagauaaggugaugaccaugaggccucuguaauggcauuugugaaagcaggagagacuccugcgucagcaugcuugcccugucucccauaugaugcugucuguguagaugcacuugcauuugccacucugcagaucccugagcaaaugagcuuuugucuuuaucaagucgugggugcugaguuauagcaacaggucauaaaucuaugaccaugaagaugaggaauuaagugaaauagaauguaaaugagccaguaaauuggaaaaaaguaaaaacaguauuuuaaauaaaguugugauuuaaauuuccagguguagggcagucggaguuugcuguggcugacauggucgauauguuuguuuuauugcugccaccagcaggaggggaugaacugcagguaagauuuuuggugcuuugguccucccauaauuaccccugaaagaacaaaugcgcaguauaauauuauugcaaauuaaguugaagguaguauuugaguaacagcauucccauuggcuagaggccaugaggccacaggcuguuucucuguacaugugguuuguuuuucucaacuaacaauaauaaaagaugugacucugagcuacauauacaacuuaaacguuucccuauacagcacagaagugacuggaguaaauagagggcuuugguccauagagaccacagcaucauagguguuuguacaacgccuggcucugaaguaaugcaugugguagauacuguuggguagcauacauacuguauaacaguacagcacucuccuccucugucauucuaucaguagccagcccaaguccuucccuuccuucacuucagacaccagcuggguuuccaggugauggguacugccaagcuacaaagcugaagggucccacuucuucucaggugcaauaauucaugaggauaacucacaaaauucagggaaauucuacaaucagguuuaugauaaacucuagccuaauaaaaaagagacacacagaaggggugugugugugcguguauguguuacuuagacacacccacacacugagcaaagggcuggggacucugugggugggagagaggcagacacacccaugauuauaugaaaggguuuuugauucuuuucuuuuuuuaagugauagagccuuucuuggcucuggugggcuuaacccaggggacuaagguguuagguaaugagcagucaccagagugacucacagccaaugacuguggaguuaauugucucauguugaugaagaguaaggacuggcugaguggugaguaaaugaaaacugaucuuauugaggaaaaaggacucuugagugggaggguugucccaagagagggcccgugaugcugucuaauggucugugugggacugggguugggaugugcguggaaccugacaugcuugucccugagacuuacacucgugggcacaucaugcaccagucagugagcaccccgacccuguguguccccugagcucagccggaguaacguuuuguuccucuggucucaguggucacaagucuccaucaccuuuugucucucagcuugccuuacuuacuugguaggcugcugaucaugucacuucccuuccuugugcucgggcuaggugacuagcuuauaaccuaccacucacccucacucccugcagugagcugggccacuagcucuugucuccauaagaugcuaugagcugccuccugucaccaucauguuuuaucuugauuaucugucuacucaacaucuggauagaucucaccaaguuaguuucugaauuugaaagggauuucacagaugacuuccauaguuccaagggcugguacauuuaguuaauucuugucaguuauuaucuggcacaugaacucaggaagacacagaagaaaugacaguagagugacugguguuagacagucauggcgucugcuguugucuuguucucagggucguugggagcaaauaggaugcuucugauaaacaugcugcuucugcucucucuagggcaucaaaaggggcaucauugaaauggcagauuugguuguuauaacuaaaucugauggagacuugauugugccagcccgcaggauccaagcagaguacgugagcgcacucaaguugcuccguaggcgcucggaagucuggaggccaaagguuggcuuguguuccuuucuguguucuucacugaguggacuguguaccuuaggagagaggccauaggucgcaugcuagacauauacucagccuuugcuugaauguacuuuggaaaacuaugacaaagccagauuuguagcacuaauuuuaaauagaauuuuucaaccacaagaugccaaaaacuagagugaagugacagcugagccugcucagcacccauuaaaccauuuagaaguaaaaggagguucguccuaaaggaacuguccuuaagauuauggaauacuaauguuuugaguauguuaggauuuggggagcagagcaaaggcuugcaaugugggaccuucagucauguuauuuucaguaaguuaagaaaaugaagaaaaauacugagggaagcagugcacucacauugacgccagcagcuuaucugcaucgugagagcagugaacccuuuacuacuguuggcuucuccagugacuccugugcauugguggcuaucuuguccauggaggugaugggcacuugcucagccuugcccugauagcauaaggaagggagcuuguccucagcuuggcuucaucucuggccccuaggccccagggaacccucccucccauugccucugcuuaucccaugaggcucaaaaguucucugggauucccuugaucgucuaucuauccaagccauccuaaguuaaaauauauuucugagcuacgaauugggccuuaaauuggugucuuguuucugccaagcuauuaguaauccagugugcaugcugcaguguacgccaguguguugcucugacagcagcagcaucccauucuggucuuuugucuuguuucuauaaaugcugagaauucuuuggcaaaucgcagacauccugugacauaauaguucugcuucugccuucucaauaggugauucgcauuucugccagaaguggagagggcaucacugagaugugggacacaaugagagaguuucagcaccaaaugcuggccaguggggagcuggcugccaagagacagacacagcacaaagucuggauguggaaucucauucaggaaaacguccuagaacacuucaagacccaccccagcauccgagaacagaucccccugauggagagaaagguccucaguggagcccucuccccaggacgagcagcagacuuguugcuaaaagcuuuuaaaagcagacacuaauaaauuuauccugugcgaucacuuuguagaguuucccugagugcugaauauccaaaauaucaccuguguguuuaucuguuacaccuguguaaugccccagcugggaacugcuuguaaccuugaagcugugggugguguggucagacacacagcaucuaggagacccugcuguguaggacugguuccacuguaucccuucuuuaugcccugacaugcuagccugcuaaguaguuucuucucaagacucaaaaguggaggaagcuugggaggagaaagaagaccuuacauuuugaaaugguuacaucaagucucuguucucugaauugccagagaaaauauaagccagaaugaccacauuucugaaaacuuauuugaggccagaacaacacacaccagguuucuuggaauugaaaguccugauuggcauuuaguguaccagacuauucuaagaauuucugaaguggccauguauacuuguaacaagacaccuggaaugaugugaguccaguuuuuaaacuccacuuggcucgacuuggugcccucgccaugacagcggaaagggaaaaugagcuacagaauugggccccaaguucccuagagacucagguagaauuaggacaguucagggucacucaguuugaaaauuaugaacuauuucuguuucuacuugccuuggccaauuuacuucacauuagaccuacuuuugugugugugcauauguaaguguguaaacacacacuguguauacuugcgugugguggcagcaggucaucacuggguauguuuguguucuacugcuguccacuugcuuuguguuugagacagcaucuuacuauguagcccuaacuggccuugaacucaugcuguagaucaggccaaucuugaacucagauccaccuggcucugccuccucaaugcugagauaaaggugugcaccacccugccuggcuuauccaccuuucuuuuuaaaagaaaaugucucugaauaugaaacuuagcaauucagcuagccccaggguccuguccucucugccccuacagcauuacagugguggauuauggguacaaagcaugauacccagcuuuguguggguccugagguccuaaggguccuaaacuuggacccuuaggcuuacauagcuagcacuuuccaaacugagcuguguccccacagaaaaaaaaaguacauuuucuugaugcugaagaacagaugaggucuacagaggaaguacauagcaaggacuacaaggcuaaccucucagguuaggcuuuguguuuaaaccagacccuaucaacuacucuaagccugaacauuguaaccuaacauguaggcuucaguuucuuaccuggcaaaaugggguugguggauaacuauggaguugguaaggauuaaauuauucaggaaaaugauuucauuaucauggaggcauauaggaaauauuguuugcuguuuuaugcuaaaguuguggaucccuaaagcuacauaaaccuuauuuauaauuuuaauuucuccauggucuuauuacuaucaucauguucugaugauauuuuauaauugccuuuacaaccccagcucugcuuaauucuuugaaugacuuaaacuauuugaugguaguuacaacuauguacauuuggguaaaauuauuucuagguauaaaauuucucccaaauaaaacacccuuucagcaguuuuacacauacuguauucuggacucuuuaggauauuuuacacaaugugucagcauuacucuuuccaaccauacugguuccuaccuaaaaucaaauuugagugcuaacaagcacucauugauauuuauguaagaucugugugcuuggcauaccuguauuauagauguagguuauaagaugcucaggcaggugagccaggagaguuucuugauuugagaaaggaccaccauuaaaccuaucagaugaaaacuggaugcuuagaaauguccagagugggcaucucauaauuucucuuaaauaagcuauugcaaggaauaacuaccugcccuggugguaucaguagugacagggugccacugcauuguaaagaaagcuagaagggguggguggcuucuaucagcacuaaauuuagcaaggugaucuccauuugaucuucauacccuuugaaaugacgcauauguaguuauaaaacuaugaaauaugccccucccccuccuguggcucuugugccacaggcugggagacaccaaacucucaaagauuuuucacccguucuuugguuugcuauacuacaguaguauuuauaggguuuuuuucuuuaagucugcuucauuuuacuaagcucaauaauucuugccuuuccauuuguccccaacaggaguucuacaguaguucuauugggcaucuggccuguucaaaugcagcaguuucgaauugcuguguguugauguaacucuaucacguaccagacaagcaaguuaggaaaauuaguucuccacguuuaccaauucucuuaucuguaaaaguuugguacaguagcuacuuuagacaucucucagagaaaugagaacugacgugguugguacuugacaaugggcaggcagugguuaaaauguuacacauaaauguucaucauagcucucucccacuacagaccuucaguuccuuucagauggaccagacuacuuaaucugauaguugcucagucuucccacaguuaagugaaaaugacgauccuguggugguuauacuaauugucaauuugaugacuuuuuaaucaccuagagacacaucucugaccauguauuugagggcauuuccagagaacuuaggcugaaucucacaguaaaugugaaugcuaccaucccaugggcuggaucuggaacugaauaauaaagaaaaagccagcuguuugaccaaucacuugugcucuggccacuacacuugcagcaacucuuauaguaacuaauacugugccaucaaccagagcuguaugcggaguaucuggauacuguuauuggagaauaaauagcaguuaccucuuaggaagcuucagggucaaaugaguacagucuuccuccauuuuaaaaggauaguuuuuuucuagaaaaaaauucuuacagguuaguuucauuaguuaaaaauauagcuaucagggcaggagagaugucucagugauuaagaacaauugguauucuugaagaggacuccguucagcucccagucccuggguggugauuuucaaacaucuguaaguaggaaucugaugcuuucuucugacuuauucagacacguggcaugcacggagcacauauacauauaugcaggcaaagcucacagacauacuuuuuuaaagacaaaguaaaugggggagaucucagcauagugguacccaccuuuaauccaaguacuugggaagcagaagcagggaaggguaaggcagaguagaauauacaaaaaaccaugggaaaagaucaagauaugcuacauacauguuauggauuccaaggagaggaggagaggaaaucauuucugaaauuccuguuagaauucaauuauuuuuguuuuuggagacaaggucucuguagucuggccuggccugaagccugcgugccuggcuuuuguuuuguuuuguuuuguuuuguuuuguuuuguguugcuguguuguuguuguuguuguuuuugagacaggguuucucuguguaggugcuuacauacuucaagauaguaccagaauuauaagcaacaugaacacucacugaauaacacaacuaacuaacaaagugcuaucccuuugguaagacagaaaauguuggcaaauugaaaucuuucuugaugaacaacaaccaggaaguuucuaagauauuuuaauuucuacuuuauuuccuugguuagucaauuacuaaacuuaaggucuuuuuuaaaauccuacuuggagugaacacugaaugauaguuacugucccaugaagcucaaaguuuugguugauuuauuugcuugucauuuaugguauaaaauauaaauagcauaaaaauaauuggauugaauaugauagacuuauuugugaguauaaaauguggaugacauggguuaaaguacauuaauauuuacaccugaugugugguaagauauaaagcaauaguauaaauugggacaauugaucuuguuggccacuuuagucuccugaaggagugaagugaagguguguauacgcacaaaaauucuucuacucuuagcaaaauuaaguguuuaaacuaauguuauuuuuaacuaacagaagaaauccugugaugucaucaucaaaaguguggagaaaauucuauagcuaucuagaagaauaauaaagccacuucuuagccuuac

SEQ ID NO: 4552 - RNA, 13916 nt, Mus musculus
ccgcggcgggcgcaggcgcggguggcggggugugcuugggcgggaaguggguggugagggccgcucugggcucagcguuccccaccuggaaugcguccuggcuucggcuggcccggcccaacccucagcggccgcggugcccaggcccacuccuuccgcgccuggaaacgugagacgggucacugaggacgacguaggcaaacuuugcagagcacguugccaccuguuggaguagccgcuccagccccagucgaaaugcacggccgaacaauggcaguucugaguggcucaggggcccacacuuucuuuaaaaccgaugcacucguaguaauauuucuuaugccccacauccagaggccugugcucaccaccucagcagugcccggggagguucgccaggcgugggcaggcucucccuugaaagcaccugaccugguucuaccuugcacuggggcugaaugguaauuaauuuuuuuauuuguguuuuugagauaaggucucucuggccgaccuggaacucccuaaaaccaugcugguuuacauacuaccuggcucugccucacaaaugcugggguuaaaggugggccccaccgcgccacacuguagcuaauuuaaaaaaaaaaaaauuacugaagucaugagaccuacaaauuucaggcaguccagaaggaaaguguguggagacagagaaagguacgauaguacguuaaaaacaggcagcuuaaacagcagcgguaagugcuccuuuaacucguccaccguaaguuuuaaauguuuaaaagcaaaguuguugggacuggagcuauggcucagagauuaacauuaacguaagaacauauuggcugcucuucaaaggagccagauuggguucccagugcccacagggagguucacagccauccaguuccaaagaaaucacugcccuccucuggccucugagaacaccaggcacacauguagagcacauuccuacuuguagauacauaaaaauauuuuugaaaauuaaaaaccagugaaacuuuguaccuagcaauuauuaaaacauuuacaaagaagaaauacaaaauucaugauacaguaguuuucuuacaaucugaccuuaacaaaugcugcaccaugucuaagagcacugggaaggguuuggaaaugaccucguuauuacaaauaucauauuuaaguccauauauuaaggcuugggaauucaccaaccaacuuacguaaugcauauaaucuuuugguuacugcucagcgcuguuugccaugguauguauaagacuugugagucuuuguaaucugucaguugugacuuuuuaaauuuucauuucaacaaauuugaguagcugccagauacuguucaggcuccuggaacgccugaggcuggcaugcucagucccuuuacagcauggcaucauauuugcauauaaccuauuuccaucuuuaauguguuuaaagaacagggagccagagcaggugcuauaagccucagagaauuggaaaucacaucagcuaggcaacagagggucagaauauggauacuaaucagauaugccuuuguuuccuucaagggaauuacaugggaaucucuuauuguaaugcaugaacagaguaaguacagucaucuauuuguuuucuauuacugccauaaaaguugguacaaacuuagcaauuuaaaagaacagaaauguacuguuuucuguaggucagggugcaacuaacccccugugcugaagucagcuugucagaggacuucauuccuuucuagaaucucagagagaagaguguuaguuuguucuuucuagcuucuagaagccccugaggugccuuggucuguagccccuuuccucuccuuucaaaggcaguagcaucaguaaagaggucuuuaguuuuuaggauugguguaacaaaauugggcccacuuaggauaaucucaccauagcaagguccuuaaucauagcucccacguuccuuugcguuuuguaagaaaauauauucacaggcucuggugaugaaaguguggaaaucuguauugggggaagcuuucccuaccacaccucuggcccccaaagagucauaauguucuuaugcaaaauucauucaguccuuguucccagaggaacugcauaguuucaaagcauuacaacaucuaagucuaaaaagauuaaaucauguaaaauuucuaaauucaauaagggugagacucuggguuucuauccagggcaaaauuauuucccaucuggaccuaagugacuagaaaauaaauucucugcucccaaaguacaaaaauagucauuggaauaagagacagaauuauaagaugguuaaaacuaucuccuauaaaaaagagaagccagaguggggaagcaacagucccaaacagccucaaauccaccccagcagucuccacucaaagucagggcuacaccucuccuccguucaaauaagaaugugauggccuuaagggucauuacucugccuccaacaaccauugcuauauucuuugaauugacuguuuuccuacguaucuguauauuugucuuacccacuucaucucuccauuagcccacaucaaauggcuaguuaccauuaguuaccuuuaaguagacacuugaucaguacuuuugaagugcagcauuuuaagaaacugcauuguaaaccacuucaugggaagugcaaauaugccaucuaguuucuguggaagggaaagaaugcaucuccguuuuguauucaggucacaucuucucugcagcuaauuuacccuaaaaucguucauuucuuucaggcccaaaggcguuuuuuucuggucauuucuauggaauaggcaacaauguacauccaagguuauccuugugaaaccuuuuaaggaugcuggaagcccagcucugccucccagcagguggcagcagaugagugcuuagcacagggcacugacuucacccugguccccagccugguuaauguggugcugaccuuccuuagggagaagagcagagagaaucuggaagccgcccaccuggcaguguaucagcauguugccuggugggggaagcauacuuaaauuacauagcuaaauuuuauuguucauauucuuucucauuuuaucuuuuccuuucaacuaacuguguuaaggcauuuuauguggaacuuuugcuguauuuaugagucauguuggucugugacuuauuuucuaaugucugucagcaguuuuucuaagacuaaugucauugugcuugcugucuaagcuuauaagauugacauguguguuaacguacauuccccugguguugccguaguugaacacacuguccauaaccaucaauacauuaauauccaucagcauuagcuaggaauacaugcaguguagcucaaguauucuuauagacaaacauguauuuuaagccuuuauugaaaaagucgaaggaaaagguuaaagcaucuaagacagggccagcaaacuguggggcaugggacaaguuagugucuagccuaacuuuugugcauuggaaaauccuggggaaguuccuagaggaauaaggauaaagagagaaacucaccauaucugggggaacugaucacuucucuacaggcauaagacaggaagcuuugguggacccagggccagggcaugauggcagugccugggccauauuugguugucacagucagagguauuguuacuaauggagcuguuaaagccagggaggcggguaagcauccugccaugcacacagacaugucccucagcuucgcugaccuccaagauuacucauccuaagguugacaauugcuaguuaaaacugucaaagaagaauaguacaaauuaauuuagaccaauaaagucagaucacaauaaaugaauaaauucauucuaaaccaaaacucucugaagaggaaauagaaauuuugaguuaauaauuuaaaaauauuuuacaaaaacccucuagacucaagaugguuucgcugaugaaauauguaaauauauaaagaccaugugauguuaguuauacauaaacugggagaaugagggaguaaugacagcauaaucuuauaaaaccugaggugucagaagcagucaucagcaaguagcauuggagaugcagauggagaauccuuguacaaaauaccagcagauugucacagcaaaauaagaaaaaaauacaaccgucaaaugggguuuauuccagaauguaacuuucacccaacauaaauaaaucaagcgccugauggcacaggccuguaauucaagcuucucuggaggcuaagguagggucacagacucaaagccugccuaggccagcugaaguccagucagagacagaaagacagacaccccagcaauaaugaacccacucuggauuucuaacccaucaugaaaacaacuaaaacgguaggggggggggcuuuauuacugcugucugugaaugaccaggggccaccagcauacuuauugauaaaucuguccuaggccugaaugaaaugaggccaucuccuuacacaacugcuguugggcuuuguuccagggucucacaagucuuccagagacaaaaauuagaagagaguuaagguugucccuguuuguacagucucauaauucugcuggaauuaaugcuaggucauaggugaaguuugaacaguauauaaaaguauuucaacaugcuagcaagcagcgauuuuaauaugaaaauuuuaaacaguagcaaaaauacuuuaaaaugcuuuuaaugaaagauaggagcuauauccugaaacuacacaaaugcuuaaaugaaaacauuuaacaaacacagugaugagcacauuccagauuguuggccucagaaguccagacugacacccaggucuguucuccuccgccaggggacgcacacgggaaaugagugugggguuuuuaguuccaguuuccaaacaauugcacuaaccugguucugcccugggccaggaguagucuagaaacacccgaagcuggcuguuuucccucuaaauauuauaccagaaguagaauuacagcauauuuaaaagucacaaaauucuuccuugcauccuuucccccugauggcuuuaguugacaaaacagaaaaucuguuuugaugaauuuaauaaguagacaaaauauaaauuacacgcaccugaugguguaacaaaaauucuuugcagaaugcugacucugaggaagcuaccuuuugcaaacuaagcuucugguugacaagaugacucauucuguuuauagacaggcaagguuucaaggagggaaggcccuaggauuuccugggccagcuaugucucucauccuauuauuccaacaaaauacuugaaauucauuauuaagaaaaaauugcagcaucuagcuuuugugcuaacuguaucucuuccaaggguuuaugaagguacaagcuuuggcuuaaucgauuuuuaaaaagauuugggacuauaaauaauuuuuaauauuaaaaaguacuuugaacgugacucuugaaaagguuugacguucugccucucggugcuuuuuuuuuuggacugucaaucaugcuuuauuuagcaagauuacuguucaaacuucacuuuuaaaaguguguguguguguguguguguguguguguguagagccuucagaagucagaagagggugcagaucccauguaaauagauuugugacaguuaugagugagguacuacauggauagugggaauugaaccuagauucucuggaagagcagccagcacuucuaaccacucuugagccauuuccucugcccuaaaacuuacuugcaaauguguucugagcugcuccccacauuuccuucccuucuaaggacguucuuucugcuucuauguuuuacacuauuuuaacucuaugcugacuucugaugguuuugagaguaguuaugcuguugccuacaguuuuccaaacucucuggggaugucuucuuuucugaaagucuucccauugugagucucaccacgaagggaagccagacaugacaguuuacaacuccccagcugaggacuguuguaagcuagccccuguccucacuguaucauacuacugaguguuccuaccaggaucccuaugaaguagaugcucccaggguccauauguuacaugcagacacuucuguccauaggaucagcacugaugccuugugugguguaacaaggccaggcucaugcugacuccauuaucccauacuugaugaugcuacaccccaucagcaguggguuuacuagaguauaacaaagcuauguugauccccuaaccaugcaacuucaacaugagaugucauggacuauacuagcaccugauuggcaaauuuuccaauguuacucaaaauuuccacaugauggggucagugaaauuauccacaugcugcuguugauacuacaauagggcuaaauaugucaauagaaguuaauuaaagguuuuaaaauauaauuuuaaaagaggguccacaaaagacuguaggcuaaggcaaccuuuuuaaauguaaggaaugaaaagauuacaacuaugcauagggguaagaggaauuaaauacagagguaaggcaugaaccucuguaaucagaagguaugugggacagaggucgaagaguuucugcaggaaggaaaacagugaaggaagugaacuaaaugacagcaggugacuuuaaaaacaaagugaggccagcugauggugacguggugccaggcaguaagauuccacacugagcaaaggggcagaagcccaucacaggcauggccauuuccucuucuuaccaggaagagcauuauguuuuuuccugaaaaaucaaagauagcacagaccuuggagaaaugacuaaugccuuuuagaggcugcugaaaccacuccuuuguuauuacaguguggcaauauaacuuaauuaucauuucuggaucagcggaaccaacauuaccugaaguugucaagcgugcauacuccuuggcucuacccuagacuuacuaaaucagaaacucaugucagauggugcauauauucaccccaaagcuaaaaauccacuggcaauuaagaaaacucaaugacacuuuauagugacauaaaaucauugaaauuuauaguacaacauuaaagcaauaucaagcaaaugauagaaugcauuuaaacgugauucugugaguccuuuuggacaguggaaaaugucugugacauuaacagugggaaguuuaaacauuaaauuauucuuccggcuggggguuggugggcuuugugaguauagaacuuccugugccagcaugcagaccugaauguggagccccggaaccuacugaaaagucaggcaaaggcuggagagaccacucauaguuaaggcgcuuguugcacuugcagaaugccuacguuuaauucccaacacccauucugugguuuacaaccauaacuccaguuccacaggaucuguccuuuucugaccucugugggcacuacauagacucacaggaacaugcauauaugcaggccuaacaccuacauguaaaauacagcgaauaagucuaauaguuuuuaaaaggccaggcucagccucaugcaucuguuauaacuccuaggcugagggcacaaagacagaucccuggaguucucuggccagccaguguagccagacacgcaagcccuguuaagugaagagauccuguuucaaaaaauggagguggagugugauagaaccugcugccagccucuagccuucagagugugcaccuucacagaugcacacuugaaucacaucugcacucaugugcacgugcacaccaaagaaaaagcuuguauucacuuguugaaacaucuguagaaaaaauguuccaugcaaacaagcaauuagcaguggcuuuugggcccuuaggguuauaugaauauccccucuuaaucuuauagauacuguuuccaguuuucuuuaagaauuguuuuuugcucuuauauuuuguaacaaucuuaucaacacaaugauuaagaaaggagaaagaaaggaaguagaguaggaauaagagauaaauuuaaauggccccaguuuggugaagagagaaaaaagugaaaucgcaccugagagacagcaguuugccucauagaaacaaaucccugagccagggacuuggaugcagacgcuguuugaggagcaugugcccagagacuauagcagcagugugcaguccugaggccuccacagaugugcugacagacucauugccuccucacacuccccuaccguccccagaagccagccauacacagcucagcaccacugcagccuucuagcgccaagcuaaacguguuccaaacuggucuaaauuguauaaaccguuccaaacaagugccauccccuccauugccccuuucucuuuagagcccugcacuaccuucccccagauggaauacuugucugcaccugucucccaguuuguaagucuguccugugcccaaauacaaaacaucuuuacauuuacuucaacucacucuaugauuuguuuguaagugggggaaaauaacgaaauuccccaagguccuauuuagacacaacauaggaaaaaauaacgacacaaguggccaccaaaugcaugacagacagacagacaccuugauucuucauggaggauccaacauagaaaaccaaguaaccuguguucagcauuggacaggagaaagggaguaaacacccgagagggugggaacaucuuaccgcaacacuacacuugacucuaagugcauuacuaaaaauacuaagugugcuaaagugauguuaugggaaacaucuuuacauuuagguaugcuuacauagcuauuacuccuaggaagaacuacuguuaaauuguguguguguguguuuccaugcacaugagggcucucaagugaaagacagaugacaacguaugggauaugccugguguaugcaacaggcugugcuuaagaacaacaauggccaggcaguggugauggaagccuuuacucccagcacucaggaggcagaggcaaucagaucucugugaguucaaggcuagccuguuuuacagagugaguuccaggacagucagggguacacagagaaacccugucucagaaaaacaaacaaacaaacaaacaaacaaacaaacaaaaacaacaaaaagaacaacaacaaugaaaacauaaaacauguuaaauaaaagccacuaguucaaaaguagacuuaagagccguacuuucagaggaaagcuaauacgaugcacccugggggaaacacccucccccaauacuaccugcuacuaccuaauauaacccaauacuaccuaauauacuaccugcuacuaccuaacauacccaauacuaccuaauauacuaccugcuacuaccuaacauacccaauacuaccuaauauacuaccugcuacuaccuaauauacccaauacuaccuaauauacuaucugcuacuaccuaacauacccaauacuaccuaauauacuaccugcuacuaccuaauauacccaauacuaccuaauauacuaucugcuacuaccuaacauacccaauacuaccacaaagugcugaugcuugaagaaugagaaaggggacaaaaauuguauuuuuuaauuguaaaggauauuaccauuuuaacaauauggcagccugacuaaguuauucaaaucagucauucccauggugggguggggguaggaugaugggcagacuuauaaaugauuaguaaguagcccaucacacaaacucuuuaaagcaguaaggacccagugacaccauaagggaugccaaacaaagccuaagggaguggagugacugcaccagacagaagacacagcucugcuuggggccuuagggauuuucagaaacaauuugcaaagagaaauccaaaagcagcugaugggguaagcaagacacaggggaacaaguuguggugaaguagagcuagggaauaucaaacagcaaaaccuaaccuaagaaauauuccaaugaaacuagcacggcuuuaagaacaacaaaacuucuugaaaugcaaaacagcaaugaaaaugcaagucucagauuuacugacauacaagaaacaacugaaggggaauuacaauguuugaagacagacaagaggagauuauucagaagagagacacuagcagguaaauacaaaggaguggacauaauguggagcagagcauacacauuauaucuaucuacucagaguucuagucaaaaaggaaagagauagccugcuggugguggcacaugcuuuuaaucucagcacucagaggcagguggaucucugucacuucaaggccagccgugucuacauagugaguuguaggacaacgagggcagacaaacagacaaacaaaaaucauaucuagugaugggcucuaauuucaaauaagguaauucauuuuuaaaagauuacauuaauagccugagcuguuacccugaagaauaauucaauuuuuauccaauucuuuguacauuuuugcugaccuuggaaagaugagcuuuggugucuggugucuauuauucaacagccugugauaaauauaccccgcacccuuuagaucuaacacaaaugucuuguuuuguuucuuuucaguuucacaagaaaagggaacaggacuggaccgcuggcuguuccuucuuugaucccaggcaugauuucagcuuguagaauaaaugagaaaugccuguugguuuaauuaaaagaaccgcauuggcugugcuagccugccugccuucuggugcccaagcaaguguacugauaaaggaaucaaaagcugcacacucaauugucccaggguuuucucaucuaucuugacagcuuuugagaauauaagucaauuucucaaaagcgguuuauuguaagccuugaaauauccaguuuccuaccugguaccuuaaaucauuacuuuuuccguagggauaacuggugaacuaucuccaaaauauauccuucuuguccguugacucagauagcucauugggaagaagccagcugucuccucugggaugcuggcuggccuuugaggugggcccuggagcuacugccuggggaucaauguacuaccacaacacagacuaaauuccuggucccuugggauauaccuccaguguaagaccuccaggaaggacuccugcuaggcccaaucacagagacuaguagguguggucagaaagcccggggcacagccugauuggucauuguacaggcgcguuaccacuaaggcugagcuuuaggagaagagcaagacaauaucaauggcuagugggguucacaugaaggcaagacauggacagcugcuccuucauccguguuuuuauccccaaggaacagcuuugugaaagugcucugugcucucaagcuguugccagcagggucugucucuucagcguggcuuuuaagaggaaagugcagcaaacuggagccuuagcaaaaggcugcucgcuagcaugagaagcauuugauuccagcuuggaaacaagggguggggcaaagccuuuuuaccaccuccaccccaucucucccucucucccuuucagaaaggcagauuuaucuaguggugcaucccuugccuucaugucagagugucagcuuugucauauuccugacuguuguuacuagaauuuuuuuaagauuuauuuauuuuaagauguauuuauagauacuuuuugccugcacacauaucucugugggggugcucuggaacuagaguauguggguugugggaauugaaccccaguccucuggaggagcagccaguguucuuaaucacugagccaucucuccagucccaauuacuggaauuucauaugaaagcaaaaccacggcauaaaucuuagcaaauuugaauuccauacuuuuuaccuuuuuccauucaccagagaugagaugcagguauauucacguuaaaacaaaaaugcaaacaagucagauaauuaaaaggaaauccagaugaugcucucaaaccugaagaaacacuuguggagccagauggaagcagaguagaguuggacucugucaccaucccaagggaacgaagcaucaugggcucugauuuguucacuuguuucuuuaugugcguauguacaggaauguauacuugugcuugcauggaagucagaagagagcauccugucucccucuccaucacugucuucuuccucugagccagggucugucccucaacccaaggcucuuggucuucuugguuaggcuagaaggcagcaagucccagcaaucccccagucuccggccccuuaauggaucagucuggggguguagagugucugugggauccaaacuugagaucguagcaagcgaucuuaacuguugagcccucuuuccaacugcucccugucuugacagcaagaaaaaucccaacauauacucugaggucauguuggaaccauguguuuggagacagcagagguuugggacaaucuuuccaaucaggaugacucacagcugugaucagggcuuucucuuuuaucagcuauacuaucagaaaagaagacccuugugagcacagugucugccucaagcucuucaucuuuuccacuguuacaaaaucucugggggaggauuacacacaggaucaugaguccuguguaugaaauuaugaugacuuaugaaugauuacauucaucacaauuacugugaauaaaaaauguuauguuuuaaaggaacacuggggaaauuaugaaaagugaauuaagccaagaacaaaaggacaaauccauauugccugauuuguuuuauaugaggugcuuaagugguaaauucauggagagagagaaacagaaggggggcuguggagacaguccugaagaguuaacaggaccacagugucuucuggaauaaugugaaaauuguaaauguggaugcuggcaaugacuauauaagccuaaaugccccugaaguauauccuuaaagaguggguaaaacaauauacuuuguuaugcauauuucaguaagggcugucuuauucguauuuuuaaaauuauaacacaacugaacuuacauauguccuaaauuguuacuccugggagugccaaaacaucaggagcugcacuguggaggccagcucuggacauucucaguagaaagcauuauuucugcagaacagaggacgugagagcagauggggcaggugggagaggagggaugaccccaaagugcaagcugaagcuccuggaagcuguggacucgcuuuugagacagcugcuagcacccacauguacuucuguacaaugaccuuacugcacacugcacugugcaguggacuacucuccugucuggaaagccacgauguuuuguuacagcaacagaaacggaacugacacauaacaccuacagguguguaacagcaggcuuuuugugcccgacucuuucccagacacaccaaggaacugggccucugaacugagauccucagagagagccauuuucuaaggaauaugcugucuaaauacauucguguacacuucaacuccauuugcaacuguguucacaugucaaaagacccugguugauucagagaaacagagggccuccuccugcuggaggaacauggcuccccaggcagggagagagauggaucauaagagacagauccagccuuugccuuugucccaugguuucucccccaaccccuccucagugacauucaucuuuacuuucugcuucaaggccacucagacucagcagaccugcaccuucccuggacuuaagcuaaugcacaccugagcugagacaguucagaaggccucccugcuggcgaaacaauggguucacuuaaaauccaugucaaguggccacuaacuugaaacaccugaagagcagaggguuugggccuagugagaaauuagaauuguuggggggcuaggaguagagcguguggcagagugcuaguaugugagaggcccugggcuuaaucccagcaccucaacuaaaaca

SEQ ID NO: 4553 - RNA, 151 nt, Mus musculus
caggagaagaagcugucaggugggaaaagguaaggcgggcaggagaagaagcugucaggugggaaaaggugggaaaaggcgggcaggagaagaagcugucaggugaaaagguaaggcgggcaggagaagaagcugucaggugggaaaaggu

SEQ ID NO: 4554 - RNA, 2103 nt, Mus musculus
ggguggggacugcgcgggcggccgcgggcggagcacagagaggcgcggaggagcgcggcaggucgagcgccgggagcgagguggcucagacauggaccgcggcgagcaaggucugcugaagacagagccaguggccgaggaaggagaggaugcuguuaccaugcucagugcuccagagacgcugacggaagaggagcaagaggagcuggggcgggagcuuacuaaaguggaagaagaaauccagacucugucccaaguauuggccgcaaaagagaagcgucucgcugagcucaagcggaagcuuggcaucuccucgcuucaggaguucaagcagaacauugccaaaggguggcaaagacgugacggcaaccaaugcauacaagaagacaucugaaacucuaucgcaagcuggacagaaggccuccgcugcauuuucaucgguuggcucaguuaucaccaaaaagcuggaagacgugaaaaacuccccaacuuucaagucauuugaagaaaaaguugaaaauuuaaagucuaaaguaggaggagccaagccugcuggcggcgauuuuggagaaguccugaauuccacagccaacgcuaccagugccaugaccacaaagccuccuccagaacagacagccccagagcugccgaccuguguccugcugcccacugcaggugcugccggcgacagccaagcacaucuugacaacgcucauggcugcggauuuccaccagaugugcuuuuauuuagcuuuacuuauuucuuugaccaaauaguugaugaaugaaacaaagugaaaucacuugaccuccacuccagggaaacacuguuagcaugcauggaaggcccuuuguauaggaaacagcaucauagagccucugguagaucccugcaggcaacuacuguguuucuccuuaaaaucacuguacaucuggauucuaguuuuaucuuucuuuacuaucuacaugaaucauuguuuuugggucucuguacacuuaaucaauuucuaacaaacuguccuuuucuaaauucugguuauuaagucuuggaauuauuucauuccuuucaaaggagaaacuaccagcuacauuuuuuuucucggauaaacaguucuaugaggaccauaucuuggguuucuaaagacaccagacuaaaguagacagguguguaugcaguucuacaguucuguaaauuaaaaacaugcagacacucaaacuuccaguggggagaguguggguccugcuccugccuugguaacugucauuuguagcuacaucuauuugagcauaucaguuauuuauuauaccauucucacacauuuuuuuuacaagauuaaaauuuaauuucagguaaauugagagaauaacauugugaguuaaguauaugauauuacaguaaguuggaauguucccacauucaucacugauaauuccaaaagucuaaaaaucuuuaggucuauacagcuauaaaaaugcuaaaaaaaaaaaaaaauucaccuuaggggaaauuacugccuccauuaaauccauuuaacaccuuuaggaagcacagaaaguucuaugagaaauacaacuugaauauuucuuauacuaagggauuguugauaacuccgaaggcugugaggcguuacuacgacugagcuuacaggcaguuccuguucucaguguguuagugccugagcuguacuguauguagauuuguucccacucuaacaacugucggggcugugagucaaagcuucccaguggcucugcuaagcccguuaacuguggucacuccugacucacuccugcuuccuuugcuguauauguuuauggccuaugagauuguaucuguuacuucuuucucuauugugguuuuaccaguguccaugccaaauguuaacugccaagcuuggagugaacuaaagccuuuuucagagcauggcuagauuuaaucgagguuucugcaaaccagaauugaaaagccacagugucgguugucacaaaaugacaugcugccauuccugguugcugcucggaugcaauggaaacuaugcuugauuacaugugaaaaucauaauaaagucugugucucaguaaaaaaaaaaaaaaaaaaaaaag

SEQ ID NO: 4555 - RNA, 28301 nt, Mus musculus
caaagaagucaaaaaaaguuuaauaucugauuuuguauuuucaaauuucauuugcacaaaaauacucuuauucacauauugucauuagcauuaagguggaugaacuuuguaucuguaauauucacaaauauauuuuaguauauucccauaacaagauuaaguacauagugaaggaaagaaugaccacacaccgguaagcucagaaacugauaaagggagauuuuauuccauauacuuuguguuccuuuacaacagauacauauuuauggauuauauaaauucauuuuuagaaagccuaauggguaucagucaaaacaaacuuucuaucauugucugcaaauuaaucagaccuauuauuuaaaguucuaaagucuugucaaauacuuucuaauuuuccuguucugccugcccuguucauuguaauccaccuuccucauaauuccaguuuggcauauuaguaaaauguggauaauguccuuuguauccaacaaaugaguaugcacugcagcaauggacacuuuguauugcuauuucccugcacucacuggagaaguuguuuuagguuguccuugguugcucaacagaagacucuggagucuaaauauguagggcuggggauguagcucaguuguuagagugcuugccuagcacacacaaagcccuggguuugauccucagcacuguguaauccaagccuagguagugggcugagaaauucaagguuguccuuggauaccuaauuugaggccagcuugggcuauaggacgacaagcugucucaaaacaaaauuaaaaccgaaacccuaaaauccagauacuuaggcaccaacuauaaagacuguaucgguuggguuuuguguguguguguuggugccagagugucuuccucaauuacuguccacuuagcuuuuaagacaggaccuucuacugaaugugcucauagacuguguuaggcuggcaggccagugggcuuuagggaucugcuggacuucacuucuacuaaagucucaaauaugguccucaugagcgugcagcuuguacuuacugacugaaccaucuccccagcccaagccuauaguucugcaggaagcaaauagucuucagaaaugccuccucccuaaucuugaucagugauuauauauuuauaaaaguaacauuacugugaauguuguuauagaauguaagaacuaaaaaaaaaaaguuaaauuagggcacugaaauaaauuuugacagauguucaaaagcaccaaaaacucauuaaaaacaaugcauaaguuggucaucaacaucuuccaacaaugguguuuguagcagacacuguuccuuggaagcacacacugaacacaaguagcaaauauagcccugaugcuuauguaucagacuuuggcagcaagucugugacuggcuuuuuagaagggggcaguucuguuauacugguacacuuagcaaacagguaaguacagauuuuauccaagauuuuaaagaugggcaacaccaggaagcauuugguacaugaauauaauauacaacugaaaaucuccccguagauugugaaaaucuggagguaacugauaaucugaaaugucuccauguucauguaguaugcacagagguuuaaucuuaagaacaaaauaguucuuaaacaacaauuuacaagacaacuggcuuuuugaugucacauuaagaaaaucauacuucaagcuccagaguauguggggccauaaaaccugauuaaaguuuuauaugauaaaaaucccaguaaguaaauggcuuauaaguucagacucaaucuaaucauccaagaaaaaguaguuuccacucuucuuuuguucuacauccuaaaaagaaagagaagugacacagugagcauuuguccucuaugcagggcugcucuacuagagcaugcgcucugugggacgcuuuaaugcauaaaaauuguacacaaacauaaaucccauuuuuaagcuccugguacaaaaggcaacagauugucagcuugaaaacuaauuagauuuucuuagcacuguuuauagaauaguaauagugcgcuuacccaccugaucagcuagcuucucauuaguguuaugcucuauuacuaucuaaaaugacccagcauacagaagugacuuaauaagcaaaggagaauguuuauuuuaacccuaucuuaaaacaaaaaacagagaaauuguugaaacguauuauaaaguuucauuaauaaaauuccauaaauuuacuuucaagggcacaaacuaagguuucucuaagaaguuuuacucuuuuagacagaagguucccugguuguccucgaacucacagauuaucugccugcaucuuccucucuagagcuggugugcuaccacgugccagauuucaaggcaguuuuaaaugguacaaaauaaacuagaacaccagauaccuugaagcaagacuaaaaaaaaugagaggaaaaacaacccaaauucugagaaucaguaugauaaaagauguauguuuauuuccacauaccuugauugaauugagcuuauuuauucguggccuguaguuguuggggucucuucugaauguaauuucgagcugagacaaaaauuuguucaugccagccaaaagagucugaggacuagggggaaaauggacaauuuucauuaaauuuuaaugaucaagaaucaucacugccuuuuccacucagccaagcaccaaugcuaacauuacaacacaucaucuuccauucaaaccuuucuuuuuuuuuuuuuuuuuuuuuuuuuuuuaagauuuauuuauuuauauguagguacacuguagcuaucuucagacacuccagaagagggagucagaccucguuacggaugguugugagccaccaugugguugcugggauuugaacuccggaccuucggaagagcagucgggugcucuuacccacugagccaucucaccagccccauucaaaccuuucuaugcuuucaucuuuuauagcuaagcucguuccccuccacccccccacagacuuagagguacagagaguugugaguuaucaugggaaauaaaccuguguucucuggaagagcaaccagugguauuacucacuugagccaucucuccagcccuccaaaauuaaaauuuaaauuggcuaaauaacaaaaaaaagaaacauuuuaaagccuucuacaaacacaaaagauuguuacugaagaaacaaauuuauauaucugagaaauuuccugaaauguacauaucucaauaacugaugauagacuuuaacaugaaaacaaagacauauucugggauguauuuuagacagggucuuacuauacagaucugguaggccguccucucucuuacagaaaucugccuggcucugccucucauacuuggcugguacuucauuuuuuugaaagaauuauucaaauagcaacuuaacccuacuucuuaacaucaaaaaauuuugugugagaaccaaauaaaauagauuuaugggcccaaaauauguuuguguauugguaauuuuauaagaugcaacuuaauguaggucuaguacuacugguaaaauaaugucucauagacagacccgaguuuuuaauaugacagaucuagguagaagaagagagggcaaaagacuacaccuaaacuguugugggucaguguuauauauuuggcaucugcuccaacuacaguguuguugggcaagucauguaauucuuuggaaaaaguuaaaaugaaagaaaaguuaaaaggccuguaagauuauccaccugggucaaguauuauauacuaggcugaaaacuacuguaaggcccuacacaguauuaucuauaaauaaguuggggguggggugcugucacagaacaagaaacugacuuaguagcuaacugcuucaaagaugaaagcaguaagacuucgguguuuaugaccuuacuggaaauuuagauagaaugugguaauuuuccauuguuguuagaacuuaaauuuuacuucugaacauuuuuaaaagcauuuuuuuuuaccuguuugcaacuguguucuuugauggaacaccaucaaaaacgaugacgcgaucugcuagauagguggccaugaugaagucauguucuacaacaaaagcugucuucuuugcauggagaaugaaacuggaacacaauugcaaaccuuucagaguuuuuaagucacaaacagauuuguaugucaucacacacaaucaaaaugcuauucuacaaaaaugacauuuaccguuugacgacccgagcugccauuaaucuuugcucagaauccaaauaugcagaagguucaucaaucaaauagacgucagcagguuugcccaaacaaagagcuaaagcuacucgcugaaguucaccaccagacaaugucuguaccuaauuggaaaaguucagaaaacauguaaagacauccaaauucugaaccaaugauguguacagauguagaaggauaauguuaugguaccucuuggucaaugauguuuucaaucuguaggggcuucauuacaucagucacaaacugcggaugcguguaagcaucucugaucuuuucaugcaguaacuggcgaacacuucccugguuuuaaagaaacaaaaacuuuaaaugauaaauuaccaggaaagaacuuuucuguuuauggauauuaguacuaacuuuagaccaaaaugaauucuauuuaccaccaauuucuaucaauuuuauauuuuuucuuuuucuuagacagagugacucacuauuuagccaacuagggugccucugccucugagcgcugguaucaaugggcaucaucaugccuggccagaucuaguuuaaugccuauucaccaucuccuucauuuugaggcuuucucaaaguuuuacauuuauacauaauugccccaaucauguacauaaguaaaaaugcaauaauaaucuuaaaauugaaaagcagaaaggggagaaauaaugaagaacaggaauaauucuaaaugucaaaguggguuuaaaaacguuggauuaucuguagguuuuaacacaaugcacaccaucuuauucucucuucuuaguugaauccuaaaauggcuuuuacuugcuguauggaacagagcugauugugagaacuugaaacagaucauguaaaauacuaaugaagguaaacugaaauguguaacagggucagugcugugaugcugaacauagauuaaguaagaagcgcagcauaauacaagcauuuaauuucccucaugcugaguaaccccacauuugaagacuauauuaaguucucuaccauucaucagcugccugacaugaggguuuguacugauccuggugcucaagugugcacaucgcucaggucuuugcuaaugaguagaauugcuggcauuuacagcucugugcuagaaaugaucugacaagagccagaugugguacuggacacccauuagcuccagcacuugggcaguaugguagguagauugagaaucucagguauuuuauuacauaguagauuccaggccagccugugcuguauagaagcuaauacggguaagaguuuuagaauguucuuuuugugguggagaucaaacucaguaauuuaacucauguuaaacauauacucuaccacugagcuaaugcccaagccccuuacuggagcaaaagacuaaagguacaugcacauacaccaaauaugcauuuuaacagugaaagugugacucacuguugauuugggacugauuuucuguggcuuauaacugacauuuagaacuggcacuucuccugcaaaacaaacaaacaaacaaaaaauucaaaaaccucacaauuacaauaacacaaaaacugcccaacccuuuaacauuuucgcugugggauagaguaaaagggaauguuuacaugacaguaccuccuucaucugguuuaagccuuccagcaagcauucugauaaauguaguuuuaccuguaccugauaauacaacaaaaacaaaauuaaccuuuacauuccaaauauucuuguuauaaucagacaaauuugucuugaagauauuaugugacaguuaagaaacaauucucucacaccugucaaauaguagccuaaacuuauuagaaggaauaccagugcuuuuuaauaaaugauuaguccacacaacuuauggacuaaaaaacugcauuuguuucaguuaucacacaguuuaaggguaccauaggcuauuuuaugauagaaaugccuauucacagcuuguacaaaagauuguaccccuaucaaaaauauuuacugaagccugaucuguugcaaucuccauuuuuuuuuccuuuucccuagagacacaguuucucuguguagcccuggcuguccuggaauucacucuguagaccaggcuguccuuaaacucagaaauccuccugccuaugccuaccaagugcugggauuaaagguguacaccaccacugcccagccacuaauaaaacauuuaugaagguaaacagagugcucugaauuuuauauaagaaaaauucuaaacacaguuauccaaggaaaucaugaaagcuggccugacugagucaccaccugccuauugcuucagucccucugcaggagugacugcuuacuaguuuacuucacagaaaaaucagcugaucagaaacugcauauuuuuagugaaaauaaugauuagccuguuucaacaacaguggggcaauauuaguaaauaccacaaaacugugaaguuaaaacaguaacuguaaggauuuaaacucggguguagccucgagucaguuccccaggagcacaaguuagcacagagccgacuuucagcaucacaaaccacagcuuaccauucucccccagcaucaccaugaucucagaguccgugaacucuccagcuacaauugcuagcucgaacucucccaucuuuuucuucaucccgggauauuuauacaugcacaucuuuuuaacuucuucuucauuugcugucucagcuaccuuaaaaacaagcgacgcaucccugaaccucagguucucuguuggaacauagccauccaaaaauauauuuaugccuguugggaaaaaauugccaugagauuaguaaagaucuaaagaaaauauaaacaaaucuaaaauaaugaugggaggcagaggcaggcggauuucugaguucgaggccagccuggucuacagugauuuccaggacagccagggcuacacagagauacccugucuugagaaacaaaacaaacaaacaaacacacaccaacaaaaaaaccaaccaaccaaccaaccaaccaaaaaaagagacugauuuuugggaauacauacauacauaccuuguaccuuuguuaauauuaagucugcacauaugcaaaaacuagugcuuuuuuugguguguuucgacaaugaacacaggccagguacagagguuaguuaaugccuauaguccaacaguuagaaagccgagcuggcaagugcuagacugugagacaagcaugguuuacagugugagcuccugucucagaaaaauucauuuucuaccaccaaaccaaaauaauucccuuaauccaguguaagauuaauuuuaaguauauauauguaugugaaacaggacauccuuuugauguauccuucuauuaaaauugucauuaugggguaaaacaauggcucaguggguaaagugcuuaucucuaagccugauggcccgagcucaacccugggaccuuacaguauggaaaaagauaaccagcuccugaaaacuguccucuguguacacacauacacacguacucacacagguaaguaaaccaaugaaaauuuaaaaaagcgaaaacaaaaagauuauuauguaugaaacuauaaggaagcacuugguuucaguauauauuaauauuucuauauauuaauggggaaaaguagcuggcagguuuugagaaaguaaggacaggcagcauccccucuggacaugucagggacauuuauacucaagaguauugauuggaaaccuugagaguaauaaaccaacuuuucuaagaguuucauuuuuauucuucaaauauuuaaaaaguggaaauguauaguuaaaaaucaaaacuaaaaccucuggcaaagaaaacuuagucuaagugcuucaguaacuaacuaaagaagaagagacuuugguuaaaaaacaaaagcgauguagucucuacauuuuuucugugcuagcugaccugucaacuugaaaugagucuuaaugauagccaccuguacaguucagagaaccugcacgcauauauaaauuuacauaaagaaauauguguagacagacagacacacugcuuaauaaugguugaaggggaagcaagaaggaugaaguacaaacucucacuucaccauuuaaaccucaccaggaucacugugcagacccagcauuuauaagaggaacuuucaagaaugcccgcugagguuauccauauaucauucuaauucuacauaacuauauaaggugcacaaagcaggcacucaguaguacuugugaguugaaaaaaaaauuagcuacugcuuccaagcagaauguggcauacuacuguaacugcaacacacagaaagcucagguacacaggaagaucgcugaguuuaaggccggucugugucugucugggugucucucucucucucugggguuucucuguguaguucuggcuguccugaaacucucucuguagaccaggcugcucucaaacucagagagccacacaccucugcuucaugaguucugggauuaaagguaugugcuggcauugcccuggcaacuccagucuuuauaaacaaaacaaaaaccaaaggcaaagcaaacgagaacaccccuccaaaacaaaagccuaaaaacuaaauuuaguucuaauauccugcaucguuucagugugcuuguguuugcaagcaugccaugguaugcagacagaagucggagggcaacuccguggagucagguuuuuaucuacuuucccauaaguucaacugaauaaacacaggucuccaggcuagcauagcaagcacugucaaccggcaggcccacauugcucucuuaguauuacuuuuguucacugucugugaguguguugugcacaccaaagcacacauguggagguaagaggaaaacuucagaacuagauccucuccugccacaaaguguauguaguucuggggcuagaacuuagguggucguuauuuagcagccagugucauuguccacugagacauccuaaagguuucaaccuguauuuaaaaaaaguuucuuaagacuauuggcaaggagccaggcaagaagacacuuguuuuuacuccagaacuuggaagcagaagcaguggaaucucagugaguucaaggccaggcuggucuacagagcaguuccaacacagccaaggcuacagaaaagcccaguguacaaaaacaaaaggaaaguaccggcaagaaaacuagggccaccucacuaagcuucccuuaaaauacauagcuauucaucuuaaacauaugcaaauaaguuauaaucacuccuucuccacucacauucuaaacuauugauauaacuagacugugauacaauuccaauaauuuugaauuacuuuucagaauuauucauuuuguuuaaaaacaaacuaucuuguuacauuuuuaaggagucuaaguaucacaaacacaagacagggauuacagauaggucugaaauacggaaaugggaugggagcugaaggaauguuuuaucaaagcugcuggcaugcuaaagggaaguuugaaggugacaaauacugugaugucaaagcauacagauucaugaugaucucuguucucccagaagaaaguucucagaaaagaauccuuuucuguaacaguguauagccuuacaauacacuacguugucuucaaugauuaaaauacaaaaugccaguuucauauacauauuagagcaauauauaguagugaugucaacaguaauacauuuuuaggcauuaaagaaaaaaauauacagcauuaugaacagguuuucaaguuaccuucucuuacacuaaaaggcaucgugacaacaccauaagcacucgguaccccauauagacagcagaugaagucagagagauagucuaauacacuuagaucaugcuccaccacaaugauauaucugaaaagcaaaacaaauuuuuauuuuuaaauuuacucuaacaucauuagcuaagacucuuauuuauauauauauaauuuuuucuacuauaguuguaaaucuuagaaaauggaauaaaaaguauagagaacauaguaaagccacaaaauauuuucuuauacaaggcuuauuauugauguuccuauuuaaaauguuuuccucaguauauauuugacuaagaugauuuaaaaaucuauugcuagagcagaaacuaccaaccagcgcagugaugaagcguuuaugcagacuugguucucaccccaccuacuuuacacguaucuccaaaaccagcuuaaaccauuagcauaaaguucucugcauaaaguucucuuuguauaaacagacuaaucaugcucacaaaaaauuuucagauuuuucaagcuuuuaaauuuucauguaucuuacuauuuauuuauaugcagaaaaaauuacaacuugcuguuuaucuucuugauaaugcauuuuuuuauuuuguauguuuaagggccacuccuuccuuccuaaacuuagucacuuaccaacaguuucacauuuuaaaauuccacuuaguuccuauucacuguagggauaccuuuuccaauaugcaaacguauuuuucuuacucuucaaagccccuucuugccuuuuuuguauucaaauggaacuaacuuaauaaucaaaaguucugauguuuuaggaacacagcaucuguguacucaagaaaucugugcuacaaaaauauagacaauauaugcaacgaaacuuccagcuuauuacuuggauuucuuacuguuuuuuggaggauaugaucuucaaaauuuuuauaccacuaaagagugaaugaaugcaugcuuugguaguuucagaacugauacgcucucuguggcuucuucccaucagccuaccauuacacauagauuucuacaacucagcaauacacacagauugguacaucuacaaaagcguuuuacuuacuguuucugcuugauuaacugcacauguuacgacuaagauguuauccuuucucauauuuaagucuuauaaaaucauuaucaucauuaguuuucauaagaucaguucacuccuguuauaccuuucuuuccuuuuaucuuuuaauugcacuuaguguaaguguggugucuuguuguccagugauuugcuugaauaucuagauacugaaauguguugugacucaccuagcuaugaauucuuuuuucuuuuagcucuucuuuuauuggaguuacaauauuauuugcuauuuaaaagucauagaucaaaguagaucugaucuauacuaaaaggggcuuagauuaagaaacuuagucauuugauucucuaucuuuuaaguuugguauaccaucccugaucucaaucuguacuacagagcuauagcaauacaaaccacaacggauuggcauggaaucgaaucuaagacccagagguacaauccacauaccaauggucaccugauuuuugauaaaggagccaggaauacauaauggaaaaaagaaagcaucuuuaacaagugguuacuggucuaacugaaugucagcauguagaagaagcaaauagauucauuaucucucauccugcaaaaaauucaaguccaaguggaucaaaagaucucaacauaaaaccagauacacuaaaucuaauagaagagauaguggggaauagccuugaauacauuuuuacaggagacaacuuccugaagagaacacugauagcacagguacuaagaaaaacaaucaauaaaugggagcucaauaaaacugaggaguuucuguaagacaaaggacaaucauuacaacaaaagggcagccuacagaauggcaaaugaucuucagaucuucacuaacccuacaucugacaaagggcuaauauccaaaauauauaaaggacuuaugaaacuagacauugauaagccaaaucaauuaaaaaauaggguacagaucuaaacaaaagucucaacagaagaaucucaaaugucuaaggaacaccauccuuagccaucagggaaaugaaaaucaaaacgauccugagauuccauuuuacaacugucagaauggcuaagaucaaaaaccucaacugagucagaugacugcacugcaccccuuuauucccagcacuugggaggcauuugggaggcagaggcagccuagucuacagagugaguuccaggacagcuacagaaaaaccaaaaccaaaaccaaccaauaucgcaugcaccccuccccccccaauucagguugucucucccaguacucucucccuccauccuucacucacuuaucugauccuuccugcuccuauccccggcuacacccagucccaccugcaaaaucuauucuauugcccuuuuccagggagauccauauauccccuggacaagucaaggggacagcucauguuaacaaugauguggaauaagggagacacuccuccacugcugguaggagugcacacuuguacagccacuuuggaaaucaauuuggaggcuuuucagaaaauugggaauaaaucuuccucaagaccagcuauacccuucugggacauauacucaaagaauacucuaccauaccacaaagacacuugcucaacuauguucacaguaguuuuucucauaauagacagaaacuguaaacagcuuagaugucucucaacugaagaauggaugaagaaaacuugguacauuuacgcaauggaauauuacucagcuguuaaaaacaaugacaucauaaaauuugccagcaaauggauggaaguagaaaagagcauccugagugagguaacccagagucagaaagacaaacaugguuuguacccaccuguaaguggguaacuggaaaaguaaaggauaaccaugcuacaauccacagacccagagaagcuaaguaacaaggauugcucaaggauauauggaucucccuggaaaggggcaauagaauagauuuugcaggugggacuggguguagccggggauaggagcaggaaggaucagauaagugagugaaggauggagggagagaguacugggagagacaaccugaaugggggggggggggguugggggugcaugcgauauagaaaccgaguacaguggaaacuccccuagggaagucuccugguaaugggggauauggagccuaaucuggcuauuuucuauaaccaggcaaggcucuuaguaguggaucuuggacaucaacccagccacaaaacuuucgaccuacaauucuguccugccugcaaggugugcuagggucauguuggcacagaacuugugggaguaaugauugguucaacuugaggcccaggccaccagaggcagccgaugacugacacugaacagauggucaggaaagaggcagcccaacccagagacccaggguagaaccaaacagaauuagcgcgcgcacacacacacacacacacacacacacacacacacacacacacacacacacacacacauuccuaaugauaaucuguuauacugaaauguagcauaacugucaucagaguggcuucaucuaacaacugaugggaguggauacaaagacccacagccaaccacuaggaggagccaggagaaucccacaggaggaagagaggaagcauuuuuggagccagagggcccuaaaacaccagggaaacacagccuacagaaucaacuaagcagggcucacagagacugaagcagucauccccaagucuauaugggucucaucaaggucuucuauaccuugugguuguacagcuugcuguccuuguaggucugcagugcgagugugggucucugacacuuuccugcauuuuggucucuuuuccuccuacccgguugccuuguucaucuuugacaugacaguuugugccuaaucuuauuguaaccuguucaguagaagauauccuucuacuacaagaagaggccugcucccuuuuuuuggagggaaagggagaaguggacugggugcgaaaggagauggagaagggacuguaaagaguaaggggaggggaaacugaggucaggauguaagauucuaccaauuaauauucuuagguucaauuugaagcaccuagguguuacugaucauuuguugaaaucauguuugagaaguuggggguuuuaucaauucugaaaacuuaucagccacgaucccuucaugcuucuuaagcauugguaggcacaguggugcacgccuuuaauccagcacucaggaggcaaaggcaaugcaaguuccaggaugucagggauacacagucuucaaaaaccaaaccgaaccaaaaccaaaaagcaaagcaccaccaccaacccgcauccccaccaugugugcagcacgugccagagcucacugacgucagagcuggcuuuauggagcucuugcucuccauccaaucugaucugagcgcuagcuagggauuacuggacuguuugccagcagcgagugacuuuaccuguacuuguaucuuuaccuguaucuugcccacuugucugcuuuucacucuuaaagcaaucaaauagucuucuuacuacaaucaccauuuuucaaaucucccuuauauuucaaugccaucuccucaguuacagccacuaacugugaaaucgagucuuaguguucgagugcuguuccuaacucaucucauuaguucagcaaguugguaacguugugcuuucucucucccucuguguauguuugaguuuucugaguguaggugcaucucuguaacuauguacauguguguacucauggaggacaaaggccaacauucauaucuuuuuaauggcuucucccccuuauuuuuggagacaggauuuuuucacuggaccuggaagucauuggcuagaccagcaagccagggaucuuucugccucugccuccccagcacugaccuuacaguacauacauacuuacauacgugcuuggccuauucuaacauucuggggacugagcucaaguccucauguuugcagggaacacauucuccacagcccucucuacauuugcuuuuuagauauuucugcuuuugaacauuucaaaucuccacguuuugaauacuuuacaacucucacuuacuauuugaggggcucuuucagaaugccagguggaguucuacuacucuaucuugcuguuuauguuguguauguaugcuguguaaguuuagggacagcugcuucugguacucuuaccuguacaaaguuuacauaaucacgaguugcgggcacagucuucccaagugcauuguuauuuguuucuacacaugacaguuuuaagacugaucacuaaguaacaagccuuuuauaagcuccuucaacugcaaaauauaaauccuuucuaaagccccaacaaaauacgaacucuaccuaaagacccaauaaagcuaccagaagcaucagggcaacgaucaacuaagaaacuucggaaauuacaaaguacuguauucaacaaaugguuuugugaaugcaucauauaaguuguuaagaagucuuuuguguuuguauaaaauugugauuuacuuuugaagauuuaguaaaaacuaaggcuguuuuccccaagaacauacacaaaauuuacacaugacuccaaagcauucacguuuaaacaguauuuuccauagaacuggagguaacaauugugaaucuugcacuaaaaaccuuuguucuaaggaagaaaaauucuggugguuacuauaaaugauuaagauggaaaucaagaauguuuaauauuuaaacaucugcaaaauguccucaacauuagaaaauagaaacauacuggauuuauacucaccuaucuggauuuauuagagaucgaaucguaauggcagccuuuaaacguugcuugacaucgagguaacuagaagguucaucaaacauaaaacuaaggaaaaaaaaaagcaagucugaauaacauaacuauaccuuauauccuuuuaaaguaauacaauaaugguuucugauuuaacagaacaaaaauuucauauaccaagaaggaaggcuacuuguaaugguaaaauucuguucuguucagaaggaagaaagaaaauaauuccaaaaugcagaaaugucuaucuacaaauuugaggagagcuuuugaagauuggacuaacuuauuaauagguacuauaucauaaaaaaauauucugauagagucucaaugacuuugaagggcuuuuuuuguucuuaaaucguauuuacuguguguguugaggggugccacuaucugcauguggagguugaagaaaaacuugcccguguugguucuuucuaaacuuugugggucuagggaauuugacucaggugguagggcuuggugucacccccccuauucagcugagccaucuugcuggccccaaaggagccauugucuuaauaggcucaaguccaaaggcuuuaaagcagauggguucucaugcacaggaugucagaggauacuuggugaagacagggcuugauuauacacuagagcaauaacauggaaaaauaugggaauaauaaguaucugagaggaggaaauauuaguaagcaggaaggagacgagccuuuuuaauuccauguccccuucacagaaucaugucauucugacacuaacuagucuacagaaagcuuuaguuuuauguaagguauaaauaacuacuaauaaaagcaaaggacugggcuggugagauggcucaacagguaagagcacccgacugcucuuccaaagguccugaguucaaaucccagcaaccacaugguggcucacaaccauccguaaugagaucugacucccucuucuggugugucugaagacagcuacagcguacuuacauauaauaauaaaaaaaaaauuaauuaaaaaaaaaaaaagcaaaggacuuacuaaagggaaaguggaucauggcaauacaacugcuuuaacacaucaccucaaaauuaaacacuuaaaagucucuauuaauuauuccuuucaagauuacugcugaauuagcaguauuacaaaucuaaacucacaaagacugagaaccacaaaaaguguaaaguaaccuacauaucagccuuuuguaugcaaacgacagcacaagcaaaucucugcaacucuccuccugaaagaucuucgacauuucguucuuuaaggugaguuaaaucuacaaagaauaaucagaagcauuguguucaauguuauaaauuccauuucaccucuucugggcauaaugcacacuggaugucaugacucuaggucugaaugauagauauuccaguguaguauaauaauaaaauaauuacuaaagcuuuccucauuaauuuggcaauccauagcccaucaagaagauuaugacuaagugcaguuuauuaaaagcauguccucaauacuuaccaagcugcugacauacaauugccugugucuuuguuucaucuuuucgguccagaauagagcccacuguccccugucacaauagaaaauuaucacuauauuccuuucaaaaauuucacaaaguaaaguaagucuauuuugauagaauuguuaucguccuaccaauaaucuacaaucuauaacuucuaucuauaagcaaacugaccuuugcagccuugggaauuuggucuacauauugagguuugauaauggcuuuuaggucaucuucgagaaucuugguaaaguaauuuuguaauucagauccacggaaauaagucaaaaucucuugccaaucagguggauccuagaaauacaauuguuaugugaguuuaagauaaaaauacaaaggggacaguuccuaaauaaaauuacauauauuaaauaaaauuaaacauauaucuaaauagaggacuucuaguuuaagauuggaagcagacuuaguuucaaaucaaggcauacuaacucaaaaguuugagagaacuaugaauuuucugguaagcaacacuaacauuuuuauuuugaagggauagaacaugagacuugucacacacacacacaaaugacaacaacaggaaugacaucaguacauggcaguguaaaccagaauugggaggcugaguucaagguccuuugaagcuacacaguaacagcaugucuuaaaaaacaaaaacuaauccaaaccaaacuugggauguauaacaccuuugaacucaacuccauaaauuaacuuaaaaaaagaacauugaaaaaaaguauacccaucacucucauaaaaaauccauaaaagauccagacauauuaauuuccauaaucuuuaauacauacaucauacuuuccaagguuuggcuuuuguuuuccugcuaaaauuuuuagugcaguugacuuuccaauaccauuaguuccaacuaaucccaaaacuucaccuggacgagggauaggcaaccuauuacaauauaggaaaacaaaacaaaaacaacucgcuauuacauggaaaagauacacaacaaccaaaugauguauuuuaaagcacuuguaugccauuaauaagcuaagaaauauaugcuaagcauuaguggcuauuaguggagagaaaacagccaagagaaacuaauuguuagaaauguauccauaaugaauaacuuuauccaguucuuuaucaaaaaugacauuuuucuucauaguuaaggcucaucuuuaacacacuaaauguuuugguaaaaauuucacagcagguacaauaccacauugucuuuuucccccuaaucuccuauugcuguuggcuccuuaagagcgggcagggugaaaauaccuuuuaauuaauaaaaccuagacuuucagauucaauauauuaauauucagcagauaaaaguaagcagugaggcuaggcugugcacaccauuaaucccagcacucaaaaggcagacacaggcaggucucugaguucaaggcuagccuggacuauauagaguauguuccaggacagccaaggcaauacagaaauaccauccugaaaagccagaaagcauuaaggaccuaguuauuuaaugagguccaagucaguacagcauuuccugugggacauaacauuaguugaugacuaaaaccaaagcaacuuucuuuaaagauuauucggaaguaaggguacuacgaaccacugucaacugugaucauauuuuagaauaauuuaagggguuuuaccuuccagacauucuguaucuucacaacacaacucaacugggcauuuguguugcuuuaaagucccucaaaaauuaauucaacuauuaacuagaaugaacugcugccauuuuuuugcuuguuucgagacaugauuucacuauguagccuagacuggccuuaaacucagagaugucucagccucaugaaugccaggauuaaagacaucugcuaccaugccuggcaacugcugacauauaaauuaaccuuguauuuuauaauagucuacuacuuuuugguagaugcgcaagaucauuuucauccauauucugaaaacccuucagggaauuuuacccuugacugaaguaaagaguaauauaccugugaagcuugaaggcauuggcacaguagcgauguguuguuucuuuuuccaaguugcuuggcaaauugacaauugauaaggcgccaaagggacauuucuguuauuuaaaauaaagaaucacauauuaauuuaugauagaugaauuaacaauauuauugaaaucuuucaagcauaaaauuuacaaauauuagaaauaauuuacuuaaauaaucaaguuccuugaagauaauagcuguauacacaaauuuaauaaucuuuaugauugauacaacuuaaacacuguucaauaguuuccauaauuugucuauagcagauguuuuuuuuuuuuucccuuaaauuacuccuguccuuguuugcuucuuuccuaaagauaaagucuuuuaaggugucuugauuuuauuauuugggggagaggguuauaucuauccugccaauagauagccuauauauugaaucaaaguuuauuauuuuucuguuauaacucauccuucuaacuuaagaauguuucaaggcuaaaaauaaauuaauaucgaaaaagaaaacaucaacagaacuuacucauuguaguauuugacuaucagacaaauguccccagaacaagaauggccaaguauaaggaugucacuaagaacagugggagccugaaggcuggggugacggcucagguguguaauauugagcuuagauggauccccaacacucaugugaaaagccugguauggcaguguguuccuaaaauuucaaagcuggagguagaaacagggggauccauagggcuugcugggaagucaauaaucaagauuagugagagacccucuuuuuaaaaaaaggaaaggguugaguaccuuuagucccaguucuugggaggcagagacaguuggauuuauaaguguuugaggacagcuuagucuacagagugaguuccaggacagccaaggcuacacagaaaaaccccgucucaacaaacaaaauaaaacaagaaugaaugaacaagacaccugguuugugacuucuggccuucauacacauaucuacccaugcacacaugcacguuaaagaaaaaaaaaggcaacaguaauguggcuagaaaaguaucucuauaaagaauagacaaugauaggcaugaccagaaaggacaagaucagaugacagcucugcucaguagaugaauucagggaacugaagaaacucauucagagagaaugcagugaaucuucacuucaaacugagaucaaaacaaauuaaagaaaaaaaauuguuuucuaguaacuucugccccuagccauaccacuaaauuuuuacaacuauauuguguacucugcucauuucaucaaugcaggcuacaggugauuuuaaacucuuaugugacuuggaaaaggaacccacaccauuuauaaguaauguggauuagucagugugcaggaugcauauauuucccuucugcuccaccaccaagaguuuauuuaacugguguuuuaggcauucagauagacaucuaaaacuuuagaauauuaauuucuuauagcaucaaaaucaaaauagaacagaugauacuguaauguucacagcagauuccuaacacccugcauaaaggcaggcacacaugaagaaggauuagucaguauuugcccggaguaauauuuccugcuuaugcuuuucaaaauaggaaaaacuauuuccagauuccauauaaauuuucuggauacuugaauaagguuucaaaaacaaauauaauacacccauggcuuauauguuuaacgauuuauagggaaguuuccaaacuuuggugaaguaaguuccuuuuuauauuggacuauaaacaaacaaaaaaaaucuaauaacuuaucaguuguuaaaucuuucuuuuaaguuggaaauuuaugacuuauaagucaaacgucaauuauucaauguaacaauuuaagauguuuaaaauuauacuauugggauaaauagauacauauaugagauauaguaaaacauuuuuagauugaauuuaagauauuuuaguuguauuucuacuuaagaguaguaaauuuaaaauuugagacagguaugguacauucuaugucagcuggagcuacacagagaacugucucaaaaagaaaauaaauaaaccugaaaaacuauaaugccaguuauguuaucucuaaaaauuucuggaaaagaugugcuacauuuuuuuauaauaaaaagcucaacagagagaaauaaccuaguuagaaauaucuuuaccuagcuauauaugaugauuacuuguuuuuaaaaguuuauuauuauuauuauuaaaauuauuauuagugugucugcacggugcauuauuuggacagugugucuguguuugugugaucuuguguuugugugugcaugccauggugcaucaaguggaugucagaggacaaauuuguggaguuguucucucuacaguuaagugggucccucaguuugaccucagauaaccagacuuguucuuccaggacaucucacugacccauuaacuucuuaaaggugugcuuuugggcucucugcuccucccagguccagagacagaugcaccuucuuagacagugccagccuuuucccugaaacaugauggugaagguuggagugaacagaucuggccauauuggaugccuggacugcauguuugccuucaacucugguaacaugcaacauggguacuguugcuaucaaugaucucaucauugaagucaacuauaugcaauccaauguccagugugauuauaaccaugguacuuuacacaguagagucaaggcugggaaugggaaacuuuucucgacaggaaggccacguccaucuuucaggagugugaucuaccagcaccaacaggguuacgcuggugcugagguaccuugauuaucauggagaaggcugcagcccacucaaaggguggagcugaaaaggcugaugccccuguguuugugaagggcauuaaccauaaggaugaauaacucacucaagagcaucaguaaucaaucccuccuucaccaccaacugcuuaguccccauggucaaggucauccuugacaacuuugguaucacugaagaacucagaacuauagucacaccaucauuccacccagacuguagauggccccucuggggaacugugaugauggacaugauagaacaucaucuuugcauacauuggcuucaaggcugugggcaagguccucucagagcugaauaggaagcucacugacauggacuuccacaguccuacugcugauguguccauaguagaccugaccugcugcuaccuggagaaagcucacaauuaagacaacaucaagaaggucgugaagcaaacaguggagggaggucuaaaggacaucuauucuagguuauaaugagaacuggguugucuccugugacuucaauagcagaacuacucccucuuucaucuuugggcugggacugacacuggucucaacaggcacuuugccaagcucauuuucagguaugacuuugaaugugauggaccucagagucuacaugaucuccaaggaauaacagaucccaaacuacccaccucagcaggaacaagagaagagaguugcuguggaguuccugcccuaacaaaugcccaauacacuuacuucuccucauaguuuuuauguuagaugccuucaaaagaaagagaggggcuuagagaauccuaacaucuuacaaacuaccauuaaaguucuuuggaacucccaaauaaaauaaauaaauaaauaaauagaguuugguuuguggaccacuaagauuguacaguagguaaagguacuugccaccaaaucagauaaucugaguuugaucccuggaaccuacaguguauaagaacugacaccugcauauuguccuccaaucuccacauguacacgguggcacaggcguccccaaacaggaacacacacacauguacacacacucaagauuacaaaauaaacaaaaguaaaaacuuaggcggguggugguggugcauuugggaggcagagucaagcaaaucucugaguucuaggcuagccugguuuacagugugacuucuaagauggccagaguggucuauuaaauuaaagaaguaauaauacuguucuaagaagauugcuuucuuaaauuucuuuuuaauuuaucuacccuauacuucugucuuuuuaaaaaauuuuaaaguccuaaaaauuuucacauucuauuuuugacucaacaaacaaauaucacuuaccuuaauacaaauaccacaaccaauacagagaguuucagaaauccaugcuauuuugcucugggguguaacuucuaugcacaauuuuccuggcaaagacaaauaauuuccuuuaucuuuuagaauacuuuuaagaucgccauuuagaaaguaccccuuucaaagucucacacaaaaguuucaaugauaaugauuuaaaucagaguuugguaggacagauucugaauuaaauauccagguuuaucaacuauguauucuuaucaagcaauaaacaaauggccaauguauuuuguccaauaccaguaaaaauaugguaaaccccgaaacaacauuaugaguaagcugacuggcuucaguuugguuuuggugcuuuggaugcaacuggagcuaugcauucacuagcugccuuauaaaagaaaucaugucaccaggcagugguggcacaugccuuugaucccagcacuugggaggcagaggccagccugcucuacagaguuaguuccaggacagccagggcuacuugaaaaaaaccaacaccccccucccaaagaaagcaugucuuagcaaugaaaggcacaccauagaaaggaauaaauuauuucagugagguaaaugaaaccauaaaaagcuaugcuuuuuucuaguacacagacaaaauucaguacaguauuugagacauuaaugacugaauuucugaaaaccaugggagauacuaacagauaauaccuacagguucucuuccgacuugguaagucuagaaggucacuacuacggggcagcagucauguaacauaacacugaagacggucaacaacuugucaccucugaauuguuacauuuacuccauccugaaaaccuagcaauaccccacaaaaugucugucuuaaaacaacaucuaauggaaggacccuggcaauccuuccccuugacucaccuaucugcaggacugcaaggaguacagugaacuuuggcuugacuuuuuacaaucuuaacaauuacauucuauaauuccuuucaaaaggauaauuuaaaaucaauaaaaguuuagaauucuaaauuucucacuuuuguagcucaaagaaaccaccagugauuaacuaucacaguaucugcuaagccccuaggaagcuuccaaacccaucugcucuucuacagcugcuuucuacucuuggaugccgacagagccacuuacccauccgaaccacagggcaacucuuuuugcacuccugucgacauuucuuagguuugcauuugucgugguugacaauagcaauucuuguuaauuugucugccauaauuguaacaaagaauauccaguucuucuauuaaagaaaaacaaacaaaauuauagcaaauucuguaauauugagaaauaauuuauggguauaaaaggaggacacaucauauggaguuccuauguucauuuggaaaauuaaagaaaaauuagaaacagaaaaauaaucuauuuaguuuggaaaacaaaauuuuacacagcgaaguuagauuauaaaacaggugccacuuaaaauaccacaaaaaauuccuagaaagauacuuaauguauacacagaaaaaaaaaaaaccucaaaaacacuaagucacaaaagaccuaaucaaauaacguauguuaucucaguuuuuauaauaaaaaguuaauaucaaagaaauuuaauucucuguaauuuauauaaacaauuaaaucucuuggguaaaaauaaacuauauauaccaaagcucuuuuuggaaaaaauaaucaggaauauuaaaacagcaagaauggaaaauacaugacagauuaaaaaauuauaugaggccucaaugauuaauacugauaccauuguaugaauauaaaucuauaaaccaaauuauauaugaacacacccacaccaaaaucaugaauucauuuucuuuuaucuuuccgagacaggguuucucuguguagccuuggcuguccuggaacucacuuuguagaccaggcuggccuugaacucagaaaucugccugccucagccucccaagugcugggauuaaaggcgugcaccgccacugcccagccaugaacuuauuuucuuauccaaccgacuauaaugacuacuacugauggaaagugggaaaugcuuauuagaguuaugagcaucaugcuacagcccagguuuuuauguaguagcaauguuguauacauacuuacuaugucuuaaagacuuuucuauauaacgccuauagagaauuaagaucagaucaaauuuacaaucuuuauaauauuugguuuaguguauuuacauuaacucccucaugugacuaaagggauuaaguucuaacagugccuucauagucuaguuuaucucuaaaucugaagaaaaagccaaaagccaacacuauccaucggcaaagauacuaugcugacuuuaucugugacccacaacuuacuuagccauucguaugauuagacuuggagggacagaagcaaucuugcuccucacuguuguccuacacuauuuccucuuccucccuaagaacacucuuagaccucaagguuuccaucauuuacagacuaccagacuacuucauuucaaacugguaaaugcucuacuuuguuuugguagaggugagcaaagcuauaguaaugaaaaacaaaccaaaucaacaaaaacuaaaaccuuaacuguugugcugacaaagucauuucuuuaaaaacugauacaggucuccuaaguuuaacuuagaaauuaaaugauuuuacuuuaccucuaaagcuuacuuaaaaccccaaaccaaccauguacucgucaaagaaauugacuauuuuagcaaacaaacuaauaaaccaugcauuccaauacaaauaaaaaaugcuuuucuacaaaguacccaguaaaugaaaguauuuucagagaauaaaucuuucacuaugauaagagccuauaauaaguaauauuuauagggaacagaaauauacuagagguggcuaauuaaauugauuuaaauaauaaaauaaauuauuuuacauuuaagaaaaagaaauauagauucuuuggauaacgguuacauagguaaacauaauuugugcaaccucccgauuuccaagaauuauggaaauggaguuaguucccuucuuuccaauagaaagacaccugaagaggaauuauuacaggaaaaacuuuuaggaauacaaaaagaucugaaaacacuuagaauguuuuucugaaacauauuuuugucuuuguuguuucauuuauagaggugagcuaagcagugcuaugaaaagauaaaaccuuaaauacauuuugguucaaaaauauuuaagcuuuuugauuauagugaauacauuaucaacugacagacacagggugacuacuuucagcauacaggaccauaggcuacaauacaaauguuacucuaacuccguaguuuguagucccuuggaagaaagggcaaagcaauaaaagcuuuuugacagcuauuccuuaguuaccauuuuuaccaucaaaauagagaaaauacuuauguagcucuugagguucagaaauucaccuuugaccaucauuuauuugcaacacauacuaaauaccuacaauguauuaagccuagaaaggauauuuaaaggcauuuugaagacagcaucccugaugucaagaagccgaagagguaauaaacaagagauuaagucacuaaugggaagaggacagggugcuacaaagugcuucucggaaguccuaaagacaggcacucaacucggaaacucacuuggucuacuaaccgcagucccaacugagaacacgucgcucuaugagaaagauagaacguuugccuaucauuuccauaaagucugggacuggacuaggagcacuggacuucauggcggcaagaugcuaugagucaguccacaauuauuaaaaaaaaaaaaaaaggauuacuucuuacaaccaaaugccaacauagccgucugacugugaggggaagcuugggggaucugcugggugcggagcguccuccacagaaggguuagcuugagggugggagcggggguggggggaaggggcaguggaggguggcgagcagaggcuauggcaucugcgaccguucucguggcagcgggccgugucuggaauacagacgcccugaggccgggauggccgaacggacgcgcgcggaacgcuccggcgucccagaugugcagcuggagccgguugccacgcgcuacggucuccgcuacugaggccuaacuuacaggcguuccgacugugucccuaagagucuucccaagguggcagccggccgccuaacaccaaaccucucccgcgaauucucguaccuggagacagcgggccccuuacagcggggcgugcaguagccaaagcagcgcuagccgucaggucuuagcacacagcguguucuuaccgccaccggcaaagauggcggugcacagccgccgccucgcgcaaggcaugagggcauagugcgcgugcgcgacagagcgcagagucggcgcccuggagggagugaugacguug

SEQ ID NO: 4556 - RNA, 28301 nt, Mus musculus
caacgucaucacucccuccagggcgccgacucugcgcucugucgcgcacgcgcacuaugcccucaugccuugcgcgaggcggcggcugugcaccgccaucuuugccgguggcgguaagaacacgcugugugcuaagaccugacggcuagcgcugcuuuggcuacugcacgccccgcuguaaggggcccgcugucuccagguacgagaauucgcgggagagguuugguguuaggcggccggcugccaccuugggaagacucuuagggacacagucggaacgccuguaaguuaggccucaguagcggagaccguagcgcguggcaaccggcuccagcugcacaucugggacgccggagcguuccgcgcgcguccguucggccaucccggccucagggcgucuguauuccagacacggcccgcugccacgagaacggucgcagaugccauagccucugcucgccacccuccacugccccuuccccccacccccgcucccacccucaagcuaacccuucuguggaggacgcuccgcacccagcagaucccccaagcuuccccucacagucagacggcuauguuggcauuugguuguaagaaguaauccuuuuuuuuuuuuuuuaauaauuguggacugacucauagcaucuugccgccaugaaguccagugcuccuaguccagucccagacuuuauggaaaugauaggcaaacguucuaucuuucucauagagcgacguguucucaguugggacugcgguuaguagaccaagugaguuuccgaguugagugccugucuuuaggacuuccgagaagcacuuuguagcacccuguccucuucccauuagugacuuaaucucuuguuuauuaccucuucggcuucuugacaucagggaugcugucuucaaaaugccuuuaaauauccuuucuaggcuuaauacauuguagguauuuaguauguguugcaaauaaaugauggucaaaggugaauuucugaaccucaagagcuacauaaguauuuucucuauuuugaugguaaaaaugguaacuaaggaauagcugucaaaaagcuuuuauugcuuugcccuuucuuccaagggacuacaaacuacggaguuagaguaacauuuguauuguagccuaugguccuguaugcugaaaguagucacccugugucugucaguugauaauguauucacuauaaucaaaaagcuuaaauauuuuugaaccaaaauguauuuaagguuuuaucuuuucauagcacugcuuagcucaccucuauaaaugaaacaacaaagacaaaaauauguuucagaaaaacauucuaaguguuuucagaucuuuuuguauuccuaaaaguuuuuccuguaauaauuccucuucaggugucuuucuauuggaaagaagggaacuaacuccauuuccauaauucuuggaaaucgggagguugcacaaauuauguuuaccuauguaaccguuauccaaagaaucuauauuucuuuuucuuaaauguaaaauaauuuauuuuauuauuuaaaucaauuuaauuagccaccucuaguauauuucuguucccuauaaauauuacuuauuauaggcucuuaucauagugaaagauuuauucucugaaaauacuuucauuuacuggguacuuuguagaaaagcauuuuuuauuuguauuggaaugcaugguuuauuaguuuguuugcuaaaauagucaauuucuuugacgaguacaugguugguuugggguuuuaaguaagcuuuagagguaaaguaaaaucauuuaauuucuaaguuaaacuuaggagaccuguaucaguuuuuaaagaaaugacuuugucagcacaacaguuaagguuuuaguuuuuguugauuugguuuguuuuucauuacuauagcuuugcucaccucuaccaaaacaaaguagagcauuuaccaguuugaaaugaaguagucugguagucuguaaaugauggaaaccuugaggucuaagaguguucuuagggaggaagaggaaauaguguaggacaacagugaggagcaagauugcuucugucccuccaagucuaaucauacgaauggcuaaguaaguugugggucacagauaaagucagcauaguaucuuugccgauggauaguguuggcuuuuggcuuuuucuucagauuuagagauaaacuagacuaugaaggcacuguuagaacuuaaucccuuuagucacaugagggaguuaauguaaauacacuaaaccaaauauuauaaagauuguaaauuugaucugaucuuaauucucuauaggcguuauauagaaaagucuuuaagacauaguaaguauguauacaacauugcuacuacauaaaaaccugggcuguagcaugaugcucauaacucuaauaagcauuucccacuuuccaucaguaguagucauuauagucgguuggauaagaaaauaaguucauggcugggcaguggcggugcacgccuuuaaucccagcacuugggaggcugaggcaggcagauuucugaguucaaggccagccuggucuacaaagugaguuccaggacagccaaggcuacacagagaaacccugucucggaaagauaaaagaaaaugaauucaugauuuugguguggguguguucauauauaauuugguuuauagauuuauauucauacaaugguaucaguauuaaucauugaggccucauauaauuuuuuaaucugucauguauuuuccauucuugcuguuuuaauauuccugauuauuuuuuccaaaaagagcuuugguauauauaguuuauuuuuacccaagagauuuaauuguuuauauaaauuacagagaauuaaauuucuuugauauuaacuuuuuauuauaaaaacugagauaacauacguuauuugauuaggucuuuugugacuuaguguuuuugagguuuuuuuuuuuucuguguauacauuaaguaucuuucuaggaauuuuuugugguauuuuaaguggcaccuguuuuauaaucuaacuucgcuguguaaaauuuuguuuuccaaacuaaauagauuauuuuucuguuucuaauuuuucuuuaauuuuccaaaugaacauaggaacuccauaugauguguccuccuuuuauacccauaaauuauuucucaauauuacagaauuugcuauaauuuuguuuguuuuucuuuaauagaagaacuggauauucuuuguuacaauuauggcagacaaauuaacaagaauugcuauugucaaccacgacaaaugcaaaccuaagaaaugucgacaggagugcaaaaagaguugcccugugguucggauggguaaguggcucugucggcauccaagaguagaaagcagcuguagaagagcagauggguuuggaagcuuccuaggggcuuagcagauacugugauaguuaaucacuggugguuucuuugagcuacaaaagugagaaauuuagaauucuaaacuuuuauugauuuuaaauuauccuuuugaaaggaauuauagaauguaauuguuaagauuguaaaaagucaagccaaaguucacuguacuccuugcaguccugcagauaggugagucaaggggaaggauugccaggguccuuccauuagauguuguuuuaagacagacauuuugugggguauugcuagguuuucaggauggaguaaauguaacaauucagaggugacaaguuguugaccgucuucaguguuauguuacaugacugcugccccguaguagugaccuucuagacuuaccaagucggaagagaaccuguagguauuaucuguuaguaucucccaugguuuucagaaauucagucauuaaugucucaaauacuguacugaauuuugucuguguacuagaaaaaagcauagcuuuuuaugguuucauuuaccucacugaaauaauuuauuccuuucuauggugugccuuucauugcuaagacaugcuuucuuugggagggggguguugguuuuuuucaaguagcccuggcuguccuggaacuaacucuguagagcaggcuggccucugccucccaagugcugggaucaaaggcaugugccaccacugccuggugacaugauuucuuuuauaaggcagcuagugaaugcauagcuccaguugcauccaaagcaccaaaaccaaacugaagccagucagcuuacucauaauguuguuucgggguuuaccauauuuuuacugguauuggacaaaauacauuggccauuuguuuauugcuugauaagaauacauaguugauaaaccuggauauuuaauucagaaucuguccuaccaaacucugauuuaaaucauuaucauugaaacuuuugugugagacuuugaaagggguacuuucuaaauggcgaucuuaaaaguauucuaaaagauaaaggaaauuauuugucuuugccaggaaaauugugcauagaaguuacaccccagagcaaaauagcauggauuucugaaacucucuguauugguugugguauuuguauuaagguaagugauauuuguuuguugagucaaaaauagaaugugaaaauuuuuaggacuuuaaaauuuuuuaaaaagacagaaguauaggguagauaaauuaaaaagaaauuuaagaaagcaaucuucuuagaacaguauuauuacuucuuuaauuuaauagaccacucuggccaucuuagaagucacacuguaaaccaggcuagccuagaacucagagauuugcuugacucugccucccaaaugcaccaccaccacccgccuaaguuuuuacuuuuguuuauuuuguaaucuugaguguguguacauguguguguguuccuguuuggggacgccugugccaccguguacauguggagauuggaggacaauaugcaggugucaguucuuauacacuguagguuccagggaucaaacucagauuaucugauuugguggcaaguaccuuuaccuacuguacaaucuuagugguccacaaaccaaacucuauuuauuuauuuauuuauuuuauuugggaguuccaaagaacuuuaaugguaguuuguaagauguuaggauucucuaagccccucucuuucuuuugaaggcaucuaacauaaaaacuaugaggagaaguaaguguauugggcauuuguuagggcaggaacuccacagcaacucucuucucuuguuccugcugagguggguaguuugggaucuguuauuccuuggagaucauguagacucugagguccaucacauucaaagucauaccugaaaaugagcuuggcaaagugccuguugagaccagugucagucccagcccaaagaugaaagagggaguaguucugcuauugaagucacaggagacaacccaguucucauuauaaccuagaauagauguccuuuagaccucccuccacuguuugcuucacgaccuucuugauguugucuuaauugugagcuuucuccagguagcagcaggucaggucuacuauggacacaucagcaguaggacuguggaaguccaugucagugagcuuccuauucagcucugagaggaccuugcccacagccuugaagccaauguaugcaaagaugauguucuaucauguccaucaucacaguuccccagaggggccaucuacagucuggguggaaugauggugugacuauaguucugaguucuucagugauaccaaaguugucaaggaugaccuugaccauggggacuaagcaguugguggugaaggagggauugauuacugaugcucuugagugaguuauucauccuuaugguuaaugcccuucacaaacacaggggcaucagccuuuucagcuccacccuuugagugggcugcagccuucuccaugauaaucaagguaccucagcaccagcguaacccuguuggugcugguagaucacacuccugaaagauggacguggccuuccugucgagaaaaguuucccauucccagccuugacucuacuguguaaaguaccaugguuauaaucacacuggacauuggauugcauauaguugacuucaaugaugagaucauugauagcaacaguacccauguugcauguuaccagaguugaaggcaaacaugcaguccaggcauccaauauggccagaucuguucacuccaaccuucaccaucauguuucagggaaaaggcuggcacugucuaagaaggugcaucugucucuggaccugggaggagcagagagcccaaaagcacaccuuuaagaaguuaaugggucagugagauguccuggaagaacaagucugguuaucugaggucaaacugagggacccacuuaacuguagagagaacaacuccacaaauuuguccucugacauccacuugaugcaccauggcaugcacacacaaacacaagaucacacaaacacagacacacuguccaaauaaugcaccgugcagacacacuaauaauaauuuuaauaauaauaauaauaaacuuuuaaaaacaaguaaucaucauauauagcuagguaaagauauuucuaacuagguuauuucucucuguugagcuuuuuauuauaaaaaaauguagcacaucuuuuccagaaauuuuuagagauaacauaacuggcauuauaguuuuucagguuuauuuauuuucuuuuugagacaguucucuguguagcuccagcugacauagaauguaccauaccugucucaaauuuuaaauuuacuacucuuaaguagaaauacaacuaaaauaucuuaaauucaaucuaaaaauguuuuacuauaucucauauauguaucuauuuaucccaauaguauaauuuuaaacaucuuaaauuguuacauugaauaauugacguuugacuuauaagucauaaauuuccaacuuaaaagaaagauuuaacaacugauaaguuauuagauuuuuuuuguuuguuuauaguccaauauaaaaaggaacuuacuucaccaaaguuuggaaacuucccuauaaaucguuaaacauauaagccauggguguauuauauuuguuuuugaaaccuuauucaaguauccagaaaauuuauauggaaucuggaaauaguuuuuccuauuuugaaaagcauaagcaggaaauauuacuccgggcaaauacugacuaauccuucuucaugugugccugccuuuaugcaggguguuaggaaucugcugugaacauuacaguaucaucuguucuauuuugauuuugaugcuauaagaaauuaauauucuaaaguuuuagaugucuaucugaaugccuaaaacaccaguuaaauaaacucuuggugguggagcagaagggaaauauaugcauccugcacacugacuaauccacauuacuuauaaaugguguggguuccuuuuccaagucacauaagaguuuaaaaucaccuguagccugcauugaugaaaugagcagaguacacaauauaguuguaaaaauuuagugguauggcuaggggcagaaguuacuagaaaacaauuuuuuuucuuuaauuuguuuugaucucaguuugaagugaagauucacugcauucucucugaaugaguuucuucaguucccugaauucaucuacugagcagagcugucaucugaucuuguccuuucuggucaugccuaucauugucuauucuuuauagagauacuuuucuagccacauuacuguugccuuuuuuuuucuuuaacgugcaugugugcauggguagauauguguaugaaggccagaagucacaaaccaggugucuuguucauucauucuuguuuuauuuuguuuguugagacgggguuuuucuguguagccuuggcuguccuggaacucacucuguagacuaagcuguccucaaacacuuauaaauccaacugucucugccucccaagaacugggacuaaagguacucaacccuuuccuuuuuuuaaaaagagggucucucacuaaucuugauuauugacuucccagcaagcccuauggaucccccuguuucuaccuccagcuuugaaauuuuaggaacacacugccauaccaggcuuuucacaugaguguuggggauccaucuaagcucaauauuacacaccugagccgucaccccagccuucaggcucccacuguucuuagugacauccuuauacuuggccauucuuguucuggggacauuugucugauagucaaauacuacaaugaguaaguucuguugauguuuucuuuuucgauauuaauuuauuuuuagccuugaaacauucuuaaguuagaaggaugaguuauaacagaaaaauaauaaacuuugauucaauauauaggcuaucuauuggcaggauagauauaacccucucccccaaauaauaaaaucaagacaccuuaaaagacuuuaucuuuaggaaagaagcaaacaaggacaggaguaauuuaagggaaaaaaaaaaaaacaucugcuauagacaaauuauggaaacuauugaacaguguuuaaguuguaucaaucauaaagauuauuaaauuuguguauacagcuauuaucuucaaggaacuugauuauuuaaguaaauuauuucuaauauuuguaaauuuuaugcuugaaagauuucaauaauauuguuaauucaucuaucauaaauuaauaugugauucuuuauuuuaaauaacagaaaugucccuuuggcgccuuaucaauugucaauuugccaagcaacuuggaaaaagaaacaacacaucgcuacugugccaaugccuucaagcuucacagguauauuacucuuuacuucagucaaggguaaaauucccugaaggguuuucagaauauggaugaaaaugaucuugcgcaucuaccaaaaaguaguagacuauuauaaaauacaagguuaauuuauaugucagcaguugccaggcaugguagcagaugucuuuaauccuggcauucaugaggcugagacaucucugaguuuaaggccagucuaggcuacauagugaaaucaugucucgaaacaagcaaaaaaauggcagcaguucauucuaguuaauaguugaauuaauuuuugagggacuuuaaagcaacacaaaugcccaguugaguuguguugugaagauacagaaugucuggaagguaaaaccccuuaaauuauucuaaaauaugaucacaguugacagugguucguaguacccuuacuuccgaauaaucuuuaaagaaaguugcuuugguuuuagucaucaacuaauguuaugucccacaggaaaugcuguacugacuuggaccucauuaaauaacuagguccuuaaugcuuucuggcuuuucaggaugguauuucuguauugccuuggcuguccuggaacauacucuauauaguccaggcuagccuugaacucagagaccugccugugucugccuuuugagugcugggauuaauggugugcacagccuagccucacugcuuacuuuuaucugcugaauauuaauauauugaaucugaaagucuagguuuuauuaauuaaaagguauuuucacccugcccgcucuuaaggagccaacagcaauaggagauuagggggaaaaagacaaugugguauuguaccugcugugaaauuuuuaccaaaacauuuaguguguuaaagaugagccuuaacuaugaagaaaaaugucauuuuugauaaagaacuggauaaaguuauucauuauggauacauuucuaacaauuaguuucucuuggcuguuuucucuccacuaauagccacuaaugcuuagcauauauuucuuagcuuauuaauggcauacaagugcuuuaaaauacaucauuugguuguuguguaucuuuuccauguaauagcgaguuguuuuuguuuuguuuuccuauauuguaauagguugccuaucccucguccaggugaaguuuugggauuaguuggaacuaaugguauuggaaagucaacugcacuaaaaauuuuagcaggaaaacaaaagccaaaccuuggaaaguaugauguauguauuaaagauuauggaaauuaauaugucuggaucuuuuauggauuuuuuaugagagugauggguauacuuuuuuucaauguucuuuuuuuaaguuaauuuauggaguugaguucaaagguguuauacaucccaaguuugguuuggauuaguuuuuguuuuuuaagacaugcuguuacuguguagcuucaaaggaccuugaacucagccucccaauucugguuuacacugccauguacugaugucauuccuguuguugucauuugugugugugugugacaagucucauguucuaucccuucaaaauaaaaauguuaguguugcuuaccagaaaauucauaguucucucaaacuuuugaguuaguaugccuugauuugaaacuaagucugcuuccaaucuuaaacuagaaguccucuauuuagauauauguuuaauuuuauuuaauauauguaauuuuauuuaggaacuguccccuuuguauuuuuaucuuaaacucacauaacaauuguauuucuaggauccaccugauuggcaagagauuuugacuuauuuccguggaucugaauuacaaaauuacuuuaccaagauucucgaagaugaccuaaaagccauuaucaaaccucaauauguagaccaaauucccaaggcugcaaaggucaguuugcuuauagauagaaguuauagauuguagauuauugguaggacgauaacaauucuaucaaaauagacuuacuuuacuuugugaaauuuuugaaaggaauauagugauaauuuucuauugugacaggggacagugggcucuauucuggaccgaaaagaugaaacaaagacacaggcaauuguaugucagcagcuugguaaguauugaggacaugcuuuuaauaaacugcacuuagucauaaucuucuugaugggcuauggauugccaaauuaaugaggaaagcuuuaguaauuauuuuauuauuauacuacacuggaauaucuaucauucagaccuagagucaugacauccagugugcauuaugcccagaagaggugaaauggaauuuauaacauugaacacaaugcuucugauuauucuuuguagauuuaacucaccuuaaagaacgaaaugucgaagaucuuucaggaggagaguugcagagauuugcuugugcugucguuugcauacaaaaggcugauauguagguuacuuuacacuuuuugugguucucagucuuugugaguuuagauuuguaauacugcuaauucagcaguaaucuugaaaggaauaauuaauagagacuuuuaaguguuuaauuuugaggugauguguuaaagcaguuguauugccaugauccacuuucccuuuaguaaguccuuugcuuuuuuuuuuuuuaauuaauuuuuuuuuuauuauuauauguaaguacgcuguagcugucuucagacacaccagaagagggagucagaucucauuacggaugguugugagccaccaugugguugcugggauuugaacucaggaccuuuggaagagcagucgggugcucuuaccuguugagccaucucaccagcccaguccuuugcuuuuauuaguaguuauuuauaccuuacauaaaacuaaagcuuucuguagacuaguuagugucagaaugacaugauucugugaaggggacauggaauuaaaaaggcucgucuccuuccugcuuacuaauauuuccuccucucagauacuuauuauucccauauuuuuccauguuauugcucuaguguauaaucaagcccugucuucaccaaguauccucugacauccugugcaugagaacccaucugcuuuaaagccuuuggacuugagccuauuaagacaauggcuccuuuggggccagcaagauggcucagcugaauagggggggugacaccaagcccuaccaccugagucaaauucccuagacccacaaaguuuagaaagaaccaacacgggcaaguuuuucuucaaccuccacaugcagauaguggcaccccucaacacacacaguaaauacgauuuaagaacaaaaaaagcccuucaaagucauugagacucuaucagaauauuuuuuuaugauauaguaccuauuaauaaguuaguccaaucuucaaaagcucuccucaaauuuguagauagacauuucugcauuuuggaauuauuuucuuucuuccuucugaacagaacagaauuuuaccauuacaaguagccuuccuucuugguauaugaaauuuuuguucuguuaaaucagaaaccauuauuguauuacuuuaaaaggauauaagguauaguuauguuauucagacuugcuuuuuuuuuuccuuaguuuuauguuugaugaaccuucuaguuaccucgaugucaagcaacguuuaaaggcugccauuacgauucgaucucuaauaaauccagauaggugaguauaaauccaguauguuucuauuuucuaauguugaggacauuuugcagauguuuaaauauuaaacauucuugauuuccaucuuaaucauuuauaguaaccaccagaauuuuucuuccuuagaacaaagguuuuuagugcaagauucacaauuguuaccuccaguucuauggaaaauacuguuuaaacgugaaugcuuuggagucauguguaaauuuuguguauguucuuggggaaaacagccuuaguuuuuacuaaaucuucaaaaguaaaucacaauuuuauacaaacacaaaagacuucuuaacaacuuauaugaugcauucacaaaaccauuuguugaauacaguacuuuguaauuuccgaaguuucuuaguugaucguugcccugaugcuucugguagcuuuauugggucuuuagguagaguucguauuuuguuggggcuuuagaaaggauuuauauuuugcaguugaaggagcuuauaaaaggcuuguuacuuagugaucagucuuaaaacugucauguguagaaacaaauaacaaugcacuugggaagacugugcccgcaacucgugauuauguaaacuuuguacagguaagaguaccagaagcagcugucccuaaacuuacacagcauacauacacaacauaaacagcaagauagaguaguagaacuccaccuggcauucugaaagagccccucaaauaguaagugagaguuguaaaguauucaaaacguggagauuugaaauguucaaaagcagaaauaucuaaaaagcaaauguagagagggcuguggagaauguguucccugcaaacaugaggacuugagcucaguccccagaauguuagaauaggccaagcacguauguaaguauguauguacuguaaggucagugcuggggaggcagaggcagaaagaucccuggcuugcuggucuagccaaugacuuccagguccagugaaaaaauccugucuccaaaaauaagggggagaagccauuaaaaagauaugaauguuggccuuuguccuccaugaguacacacauguacauaguuacagagaugcaccuacacucagaaaacucaaacauacacagagggagagagaaagcacaacguuaccaacuugcugaacuaaugagaugaguuaggaacagcacucgaacacuaagacucgauuucacaguuaguggcuguaacugaggagauggcauugaaauauaagggagauuugaaaaauggugauuguaguaagaagacuauuugauugcuuuaagagugaaaagcagacaagugggcaagauacagguaaagauacaaguacagguaaagucacucgcugcuggcaaacaguccaguaaucccuagcuagcgcucagaucagauuggauggagagcaagagcuccauaaagccagcucugacgucagugagcucuggcacgugcugcacacaugguggggaugcggguuggugguggugcuuugcuuuuugguuuugguucgguuugguuuuugaagacuguguaucccugacauccuggaacuugcauugccuuugccuccugagugcuggauuaaaggcgugcaccacugugccuaccaaugcuuaagaagcaugaagggaucguggcugauaaguuuucagaauugauaaaacccccaacuucucaaacaugauuucaacaaaugaucaguaacaccuaggugcuucaaauugaaccuaagaauauuaauugguagaaucuuacauccugaccucaguuuccccuccccuuacucuuuacagucccuucuccaucuccuuucgcacccaguccacuucucccuuucccuccaaaaaaagggagcaggccucuucuuguaguagaaggauaucuucuacugaacagguuacaauaagauuaggcacaaacugucaugucaaagaugaacaaggcaaccggguaggaggaaaagagaccaaaaugcaggaaagugucagagacccacacucgcacugcagaccuacaaggacagcaagcuguacaaccacaagguauagaagaccuugaugagacccauauagacuuggggaugacugcuucagucucugugagcccugcuuaguugauucuguaggcuguguuucccugguguuuuagggcccucuggcuccaaaaaugcuuccucucuuccuccugugggauucuccuggcuccuccuagugguuggcugugggucuuuguauccacucccaucaguuguuagaugaagccacucugaugacaguuaugcuacauuucaguauaacagauuaucauuaggaaugugugugugugugugugugugugugugugugugugugugugugugugugugugugugcgcgcgcuaauucuguuugguucuacccugggucucuggguugggcugccucuuuccugaccaucuguucagugucagucaucggcugccucugguggccugggccucaaguugaaccaaucauuacucccacaaguucugugccaacaugacccuagcacaccuugcaggcaggacagaauuguaggucgaaaguuuuguggcuggguugauguccaagauccacuacuaagagccuugccugguuauagaaaauagccagauuaggcuccauaucccccauuaccaggagacuucccuaggggaguuuccacuguacucgguuucuauaucgcaugcacccccaaccccccccccccccauucagguugucucucccaguacucucucccuccauccuucacucacuuaucugauccuuccugcuccuauccccggcuacacccagucccaccugcaaaaucuauucuauugccccuuuccagggagauccauauauccuugagcaauccuuguuacuuagcuucucugggucuguggauuguagcaugguuauccuuuacuuuuccaguuacccacuuacagguggguacaaaccauguuugucuuucugacucuggguuaccucacucaggaugcucuuuucuacuuccauccauuugcuggcaaauuuuaugaugucauuguuuuuaacagcugaguaauauuccauugcguaaauguaccaaguuuucuucauccauucuucaguugagagacaucuaagcuguuuacaguuucugucuauuaugagaaaaacuacugugaacauaguugagcaagugucuuugugguaugguagaguauucuuugaguauaugucccagaaggguauagcuggucuugaggaagauuuauucccaauuuucugaaaagccuccaaauugauuuccaaaguggcuguacaagugugcacuccuaccagcaguggaggagugucucccuuauuccacaucauuguuaacaugagcuguccccuugacuuguccaggggauauauggaucucccuggaaaagggcaauagaauagauuuugcaggugggacuggguguagccggggauaggagcaggaaggaucagauaagugagugaaggauggagggagagaguacugggagagacaaccugaauuggggggggaggggugcaugcgauauugguugguuuugguuuugguuuuucuguagcuguccuggaacucacucuguagacuaggcugccucugccucccaaaugccucccaagugcugggaauaaaggggugcagugcagucaucugacucaguugagguuuuugaucuuagccauucugacaguuguaaaauggaaucucaggaucguuuugauuuucauuucccugauggcuaaggaugguguuccuuagacauuugagauucuucuguugagacuuuuguuuagaucuguacccuauuuuuuaauugauuuggcuuaucaaugucuaguuucauaaguccuuuauauauuuuggauauuagcccuuugucagauguaggguuagugaagaucugaagaucauuugccauucuguaggcugcccuuuuguuguaaugauuguccuuugucuuacagaaacuccucaguuuuauugagcucccauuuauugauuguuuuucuuaguaccugugcuaucaguguucucuucaggaaguugucuccuguaaaaauguauucaaggcuauuccccacuaucucuucuauuagauuuaguguaucugguuuuauguugagaucuuuugauccacuuggacuugaauuuuuugcaggaugagagauaaugaaucuauuugcuucuucuacaugcugacauucaguuagaccaguaaccacuuguuaaagaugcuuucuuuuuuccauuauguauuccuggcuccuuuaucaaaaaucaggugaccauugguauguggauuguaccucugggucuuagauucgauuccaugccaauccguugugguuuguauugcuauagcucuguaguacagauugagaucagggaugguauaccaaacuuaaaagauagagaaucaaaugacuaaguuucuuaaucuaagccccuuuuaguauagaucagaucuacuuugaucuaugacuuuuaaauagcaaauaauauuguaacuccaauaaaagaagagcuaaaagaaaaaagaauucauagcuaggugagucacaacacauuucaguaucuagauauucaagcaaaucacuggacaacaagacaccacacuuacacuaagugcaauuaaaagauaaaaggaaagaaagguauaacaggagugaacugaucuuaugaaaacuaaugaugauaaugauuuuauaagacuuaaauaugagaaaggauaacaucuuagucguaacaugugcaguuaaucaagcagaaacaguaaguaaaacgcuuuuguagauguaccaaucuguguguauugcugaguuguagaaaucuauguguaaugguaggcugaugggaagaagccacagagagcguaucaguucugaaacuaccaaagcaugcauucauucacucuuuagugguauaaaaauuuugaagaucauauccuccaaaaaacaguaagaaauccaaguaauaagcuggaaguuucguugcauauauugucuauauuuuuguagcacagauuucuugaguacacagaugcuguguuccuaaaacaucagaacuuuugauuauuaaguuaguuccauuugaauacaaaaaaggcaagaaggggcuuugaagaguaagaaaaauacguuugcauauuggaaaagguaucccuacagugaauaggaacuaaguggaauuuuaaaaugugaaacuguugguaagugacuaaguuuaggaaggaaggaguggcccuuaaacauacaaaauaaaaaaaugcauuaucaagaagauaaacagcaaguuguaauuuuuucugcauauaaauaaauaguaagauacaugaaaauuuaaaagcuugaaaaaucugaaaauuuuuugugagcaugauuagucuguuuauacaaagagaacuuuaugcagagaacuuuaugcuaaugguuuaagcugguuuuggagauacguguaaaguagguggggugagaaccaagucugcauaaacgcuucaucacugcgcugguugguaguuucugcucuagcaauagauuuuuaaaucaucuuagucaaauauauacugaggaaaacauuuuaaauaggaacaucaauaauaagccuuguauaagaaaauauuuuguggcuuuacuauguucucuauacuuuuuauuccauuuucuaagauuuacaacuauaguagaaaaaauuauauauauauaaauaagagucuuagcuaaugauguuagaguaaauuuaaaaauaaaaauuuguuuugcuuuucagauauaucauugugguggagcaugaucuaaguguauuagacuaucucucugacuucaucugcugucuauaugggguaccgagugcuuaugguguugucacgaugccuuuuaguguaagagaagguaacuugaaaaccuguucauaaugcuguauauuuuuuucuuuaaugccuaaaaauguauuacuguugacaucacuacuauauauugcucuaauauguauaugaaacuggcauuuuguauuuuaaucauugaagacaacguaguguauuguaaggcuauacacuguuacagaaaaggauucuuuucugagaacuuucuucugggagaacagagaucaucaugaaucuguaugcuuugacaucacaguauuugucaccuucaaacuucccuuuagcaugccagcagcuuugauaaaacauuccuucagcucccaucccauuuccguauuucagaccuaucuguaaucccugucuuguguuugugauacuuagacuccuuaaaaauguaacaagauaguuuguuuuuaaacaaaaugaauaauucugaaaaguaauucaaaauuauuggaauuguaucacagucuaguuauaucaauaguuuagaaugugaguggagaaggagugauuauaacuuauuugcauauguuuaagaugaauagcuauguauuuuaagggaagcuuagugagguggcccuaguuuucuugccgguacuuuccuuuuguuuuuguacacugggcuuuucuguagccuuggcuguguuggaacugcucuguagaccagccuggccuugaacucacugagauuccacugcuucugcuuccaaguucuggaguaaaaacaagugucuucuugccuggcuccuugccaauagucuuaagaaacuuuuuuuaaauacagguugaaaccuuuaggaugucucaguggacaaugacacuggcugcuaaauaacgaccaccuaaguucuagccccagaacuacauacacuuuguggcaggagaggaucuaguucugaaguuuuccucuuaccuccacaugugugcuuuggugugcacaacacacucacagacagugaacaaaaguaauacuaagagagcaaugugggccugccgguugacagugcuugcuaugcuagccuggagaccuguguuuauucaguugaacuuaugggaaaguagauaaaaaccugacuccacggaguugcccuccgacuucugucugcauaccauggcaugcuugcaaacacaagcacacugaaacgaugcaggauauuagaacuaaauuuaguuuuuaggcuuuuguuuuggagggguguucucguuugcuuugccuuugguuuuuguuuuguuuauaaagacuggaguugccagggcaaugccagcacauaccuuuaaucccagaacucaugaagcagagguguguggcucucugaguuugagagcagccuggucuacagagagaguuucaggacagccagaacuacacagagaaaccccagagagagagagagacacccagacagacacagaccggccuuaaacucagcgaucuuccuguguaccugagcuuucuguguguugcaguuacaguaguaugccacauucugcuuggaagcaguagcuaauuuuuuuuucaacucacaaguacuacugagugccugcuuugugcaccuuauauaguuauguagaauuagaaugauauauggauaaccucagcgggcauucuugaaaguuccucuuauaaaugcugggucugcacagugauccuggugagguuuaaauggugaagugagaguuuguacuucauccuucuugcuuccccuucaaccauuauuaagcagugugucugucugucuacacauauuucuuuauguaaauuuauauaugcgugcagguucucugaacuguacagguggcuaucauuaagacucauuucaaguugacaggucagcuagcacagaaaaaauguagagacuacaucgcuuuuguuuuuuaaccaaagucucuucuucuuuaguuaguuacugaagcacuuagacuaaguuuucuuugccagagguuuuaguuuugauuuuuaacuauacauuuccacuuuuuaaauauuugaagaauaaaaaugaaacucuuagaaaaguugguuuauuacucucaagguuuccaaucaauacucuugaguauaaaugucccugacauguccagaggggaugcugccuguccuuacuuucucaaaaccugccagcuacuuuuccccauuaauauauagaaauauuaauauauacugaaaccaagugcuuccuuauaguuucauacauaauaaucuuuuuguuuucgcuuuuuuaaauuuucauugguuuacuuaccugugugaguacguguguauguguguacacagaggacaguuuucaggagcugguuaucuuuuuccauacuguaaggucccaggguugagcucgggccaucaggcuuagagauaagcacuuuacccacugagccauuguuuuaccccauaaugacaauuuuaauagaaggauacaucaaaaggauguccuguuucacauacauauauauacuuaaaauuaaucuuacacuggauuaagggaauuauuuugguuuggugguagaaaaugaauuuuucugagacaggagcucacacuguaaaccaugcuugucucacagucuagcacuugccagcucggcuuucuaacuguuggacuauaggcauuaacuaaccucuguaccuggccuguguucauugucgaaacacaccaaaaaaagcacuaguuuuugcauaugugcagacuuaauauuaacaaagguacaagguauguauguauguauucccaaaaaucagucucuuuuuuugguugguugguugguugguugguuuuuuuguugguguguguuuguuuguuuguuuuguuucucaagacaggguaucucuguguagcccuggcuguccuggaaaucacuguagaccaggcuggccucgaacucagaaauccgccugccucugccucccaucauuauuuuagauuuguuuauauuuucuuuagaucuuuacuaaucucauggcaauuuuuucccaacaggcauaaauauauuuuuggauggcuauguuccaacagagaaccugagguucagggaugcgucgcuuguuuuuaagguagcugagacagcaaaugaagaagaaguuaaaaagaugugcauguauaaauaucccgggaugaagaaaaagaugggagaguucgagcuagcaauuguagcuggagaguucacggacucugagaucauggugaugcugggggagaaugguaagcugugguuugugaugcugaaagucggcucugugcuaacuugugcuccuggggaacugacucgaggcuacacccgaguuuaaauccuuacaguuacuguuuuaacuucacaguuuugugguauuuacuaauauugccccacuguuguugaaacaggcuaaucauuauuuucacuaaaaauaugcaguuucugaucagcugauuuuucugugaaguaaacuaguaagcagucacuccugcagagggacugaagcaauaggcagguggugacucagucaggccagcuuucaugauuuccuuggauaacuguguuuagaauuuuucuuauauaaaauucagagcacucuguuuaccuucauaaauguuuuauuaguggcugggcaguggugguguacaccuuuaaucccagcacuugguaggcauaggcaggaggauuucugaguuuaaggacagccuggucuacagagugaauuccaggacagccagggcuacacagagaaacugugucucuagggaaaaggaaaaaaaaauggagauugcaacagaucaggcuucaguaaauauuuuugauagggguacaaucuuuuguacaagcugugaauaggcauuucuaucauaaaauagccuaugguacccuuaaacugugugauaacugaaacaaaugcaguuuuuuaguccauaaguuguguggacuaaucauuuauuaaaaagcacugguauuccuucuaauaaguuuaggcuacuauuugacaggugugagagaauuguuucuuaacugucacauaauaucuucaagacaaauuugucugauuauaacaagaauauuuggaauguaaagguuaauuuuguuuuuguuguauuaucagguacagguaaaacuacauuuaucagaaugcuugcuggaaggcuuaaaccagaugaaggagguacugucauguaaacauucccuuuuacucuaucccacagcgaaaauguuaaaggguugggcaguuuuuguguuauuguaauugugagguuuuugaauuuuuuguuuguuuguuuguuuugcaggagaagugccaguucuaaaugucaguuauaagccacagaaaaucagucccaaaucaacagugagucacacuuucacuguuaaaaugcauauuugguguaugugcauguaccuuuagucuuuugcuccaguaaggggcuugggcauuagcucagugguagaguauauguuuaacaugaguuaaauuacugaguuugaucuccaccacaaaaagaacauucuaaaacucuuacccguauuagcuucuauacagcacaggcuggccuggaaucuacuauguaauaaaauaccugagauucucaaucuaccuaccauacugcccaagugcuggagcuaauggguguccaguaccacaucuggcucuugucagaucauuucuagcacagagcuguaaaugccagcaauucuacucauuagcaaagaccugagcgaugugcacacuugagcaccaggaucaguacaaacccucaugucaggcagcugaugaaugguagagaacuuaauauagucuucaaaugugggguuacucagcaugagggaaauuaaaugcuuguauuaugcugcgcuucuuacuuaaucuauguucagcaucacagcacugacccuguuacacauuucaguuuaccuucauuaguauuuuacaugaucuguuucaaguucucacaaucagcucuguuccauacagcaaguaaaagccauuuuaggauucaacuaagaagagagaauaagauggugugcauuguguuaaaaccuacagauaauccaacguuuuuaaacccacuuugacauuuagaauuauuccuguucuucauuauuucuccccuuucugcuuuucaauuuuaagauuauuauugcauuuuuacuuauguacaugauuggggcaauuauguauaaauguaaaacuuugagaaagccucaaaaugaaggagauggugaauaggcauuaaacuagaucuggccaggcaugaugaugcccauugauaccagcgcucagaggcagaggcacccuaguuggcuaaauagugagucacucugucuaagaaaaagaaaaaauauaaaauugauagaaauuggugguaaauagaauucauuuuggucuaaaguuaguacuaauauccauaaacagaaaaguucuuuccugguaauuuaucauuuaaaguuuuuguuucuuuaaaaccagggaaguguucgccaguuacugcaugaaaagaucagagaugcuuacacgcauccgcaguuugugacugauguaaugaagccccuacagauugaaaacaucauugaccaagagguaccauaacauuauccuucuacaucuguacacaucauugguucagaauuuggaugucuuuacauguuuucugaacuuuuccaauuagguacagacauugucugguggugaacuucagcgaguagcuuuagcucuuuguuugggcaaaccugcugacgucuauuugauugaugaaccuucugcauauuuggauucugagcaaagauuaauggcagcucgggucgucaaacgguaaaugucauuuuuguagaauagcauuuugauugugugugaugacauacaaaucuguuugugacuuaaaaacucugaaagguuugcaauuguguuccaguuucauucuccaugcaaagaagacagcuuuuguuguagaacaugacuucaucauggccaccuaucuagcagaucgcgucaucguuuuugaugguguuccaucaaagaacacaguugcaaacagguaaaaaaaaaugcuuuuaaaaauguucagaaguaaaauuuaaguucuaacaacaauggaaaauuaccacauucuaucuaaauuuccaguaaggucauaaacaccgaagucuuacugcuuucaucuuugaagcaguuagcuacuaagucaguuucuuguucugugacagcaccccacccccaacuuauuuauagauaauacuguguagggccuuacaguaguuuucagccuaguauauaauacuugacccagguggauaaucuuacaggccuuuuaacuuuucuuucauuuuaacuuuuuccaaagaauuacaugacuugcccaacaacacuguaguuggagcagaugccaaauauauaacacugacccacaacaguuuagguguagucuuuugcccucucuucuucuaccuagaucugucauauuaaaaacucgggucugucuaugagacauuauuuuaccaguaguacuagaccuacauuaaguugcaucuuauaaaauuaccaauacacaaacauauuuugggcccauaaaucuauuuuauuugguucucacacaaaauuuuuugauguuaagaaguaggguuaaguugcuauuugaauaauucuuucaaaaaaaugaaguaccagccaaguaugagaggcagagccaggcagauuucuguaagagagaggacggccuaccagaucuguauaguaagacccugucuaaaauacaucccagaauaugucuuuguuuucauguuaaagucuaucaucaguuauugagauauguacauuucaggaaauuucucagauauauaaauuuguuucuucaguaacaaucuuuuguguuuguagaaggcuuuaaaauguuucuuuuuuuuguuauuuagccaauuuaaauuuuaauuuuggagggcuggagagauggcucaagugaguaauaccacugguugcucuuccagagaacacagguuuauuucccaugauaacucacaacucucuguaccucuaagucuguggggggguggaggggaacgagcuuagcuauaaaagaugaaagcauagaaagguuugaauggggcuggugagauggcucaguggguaagagcacccgacugcucuuccgaagguccggaguucaaaucccagcaaccacaugguggcucacaaccauccguaacgaggucugacucccucuucuggagugucugaagauagcuacaguguaccuacauauaaauaaauaaaucuuaaaaaaaaaaaaaaaaaaaaaaaaaaaagaaagguuugaauggaagaugauguguuguaauguuagcauuggugcuuggcugaguggaaaaggcagugaugauucuugaucauuaaaauuuaaugaaaauuguccauuuucccccuaguccucagacucuuuuggcuggcaugaacaaauuuuugucucagcucgaaauuacauucagaagagaccccaacaacuacaggccacgaauaaauaagcucaauucaaucaagguauguggaaauaaacauacaucuuuuaucauacugauucucagaauuuggguuguuuuuccucucauuuuuuuuagucuugcuucaagguaucugguguucuaguuuauuuuguaccauuuaaaacugccuugaaaucuggcacgugguagcacaccagcucuagagaggaagaugcaggcagauaaucugugaguucgaggacaaccagggaaccuucugucuaaaagaguaaaacuucuuagagaaaccuuaguuugugcccuugaaaguaaauuuauggaauuuuauuaaugaaacuuuauaauacguuucaacaauuucucuguuuuuuguuuuaagauaggguuaaaauaaacauucuccuuugcuuauuaagucacuucuguaugcugggucauuuuagauaguaauagagcauaacacuaaugagaagcuagcugaucagguggguaagcgcacuauuacuauucuauaaacagugcuaagaaaaucuaauuaguuuucaagcugacaaucuguugccuuuuguaccaggagcuuaaaaaugggauuuauguuuguguacaauuuuuaugcauuaaagcgucccacagagcgcaugcucuaguagagcagcccugcauagaggacaaaugcucacugugucacuucucuuucuuuuuaggauguagaacaaaagaagaguggaaacuacuuuuucuuggaugauuagauugagucugaacuuauaagccauuuacuuacugggauuuuuaucauauaaaacuuuaaucagguuuuauggccccacauacucuggagcuugaaguaugauuuucuuaaugugacaucaaaaagccaguugucuuguaaauuguuguuuaagaacuauuuuguucuuaagauuaaaccucugugcauacuacaugaacauggagacauuucagauuaucaguuaccuccagauuuucacaaucuacggggagauuuucaguuguauauuauauucauguaccaaaugcuuccugguguugcccaucuuuaaaaucuuggauaaaaucuguacuuaccuguuugcuaaguguaccaguauaacagaacugcccccuucuaaaaagccagucacagacuugcugccaaagucugauacauaagcaucagggcuauauuugcuacuuguguucagugugugcuuccaaggaacagugucugcuacaaacaccauuguuggaagauguugaugaccaacuuaugcauuguuuuuaaugaguuuuuggugcuuuugaacaucugucaaaauuuauuucagugcccuaauuuaacuuuuuuuuuuuaguucuuacauucuauaacaacauucacaguaauguuacuuuuauaaauauauaaucacugaucaagauuagggaggaggcauuucugaagacuauuugcuuccugcagaacuauaggcuugggcuggggagaugguucagucaguaaguacaagcugcacgcucaugaggaccauauuugagacuuuaguagaagugaaguccagcagaucccuaaagcccacuggccugccagccuaacacagucuaugagcacauucaguagaagguccugucuuaaaagcuaaguggacaguaauugaggaagacacucuggcaccaacacacacacacaaaacccaaccgauacagucuuuauaguuggugccuaaguaucuggauuuuaggguuucgguuuuaauuuuguuuugagacagcuugucguccuauagcccaagcuggccucaaauuagguauccaaggacaaccuugaauuucucagcccacuaccuaggcuuggauuacacagugcugaggaucaaacccagggcuuugugugugcuaggcaagcacucuaacaacugagcuacauccccagcccuacauauuuagacuccagagucuucuguugagcaaccaaggacaaccuaaaacaacuucuccagugagugcagggaaauagcaauacaaaguguccauugcugcagugcauacucauuuguuggauacaaaggacauuauccacauuuuacuaauaugccaaacuggaauuaugaggaagguggauuacaaugaacagggcaggcagaacaggaaaauuagaaaguauuugacaagacuuuagaacuuuaaauaauaggucugauuaauuugcagacaaugauagaaaguuuguuuugacugauacccauuaggcuuucuaaaaaugaauuuauauaauccauaaauauguaucuguuguaaaggaacacaaaguauauggaauaaaaucucccuuuaucaguuucugagcuuaccgguguguggucauucuuuccuucacuauguacuuaaucuuguuaugggaauauacuaaaauauauuugugaauauuacagauacaaaguucauccaccuuaaugcuaaugacaauaugugaauaagaguauuuuugugcaaaugaaauuugaaaauacaaaaucagauauuaaacuuuuuuugacuucuuug

SEQ ID NO: 4557 - RNA, 1157 nt, Mus musculus
uuuuggaagaaauaauugaaaacauuuuaagauggaagaaaacucuauaaacaaggucacaaaauugagguuuggaagauggaaagagauugggaggugcugugcaguggaaggaaguagaauugagcaugauguaucuguugagaccuggagauuuaaaaauagaaguauaaagggaaaucuuaaguggaaaaagauuuagcauuaugauuuagccagugcuggagcuuuguucuaagccccauuuggauagcauuccaugaacuucuagaaggaaagaaagaguacucuaauccugaacuauuucugucuugaaugaggaauuguuggugaagaugaacuggaagccacaccagacuaguacaauggggcauugcaucaagcuguucagaggcgauguguguaguagaaucggagaagcaaugcuucaaaguaguuugcuaaagggaauggaaaccuuaguggcuguguagcagcagacaucauuaucaguauaauauaagccucccuccaccccuacuaugcugaaccaucgagcuguaauauuucccagguaaccagccaguacuuauaggcuggucuugagcaagugauccuucuguuucagcauccuagcugugaucccagguguaagccaguacauacaacaccuagauugaaaaaaagaaaauuacauuuuucagaaagaaugcuuccuuacuaauuuuuccuauguauauaguccaggcuggccuauaauucucauguacccuccaagggcugagauuacagacaugcuccaauacacccaguuaaauuacucaaauuaacuuaagagucccaacuacauuagagauguguuucuuuaggauguggcaccaguggugucagcaguggcaguauaugagaagaaucacuaauaugguugacaagcacaggcccuggagucagucucccacacuccuaaaaguaagucacagguugucacgcagaaguucaugggcuacauacaagcauguuaaauuugagauaccaucauuuagaaguucucaguauauccauugguuaauguuuuccuucuaguuaaauggaaugaauguaacaacuuuaagcaauuuauuuuuucugcucucaaauuuaucagucucaaauguaucagacaauaaaggaaggauguu

SEQ ID NO: 4558 - RNA, 39572 nt, Mus musculus
cggguggcguagguagcuguccugguuggcuggagaagagaauccacucccggagaggagaaggcgccgggaggccucugagaaccuuccguuuuccuuucccuuucccucggcccuccgccuccucagagucagcccgccuucccugaccuccgugaccccgcuggccccgcccacucccgucgacgugauucccgccgugagguaaacgccuguggagcagagucccgcggaagaggacggcgaggcgagcggcgcggcugggccggcucgggucgguggcggagcccucgcgcgugagagcuuccgggcaggucucacuccuccggcggcccggacgcccgugucgcgcaggcccaagccgcuucccucggcgccgcgccugcccguggccgcggcgggugacgcagccggaacaugucguccgcgguggagccuccgccgcccccgccucccgagagcgcgccuuccaagcccucggcggcgggcgccggcgggagcagcagcggcaacaaaggcggccccgagggcggcgcggcgcccgcggcuccgugugcugcgggcucgggccccgcggacaccgagauggaggugagcgcggccgugcgcggggagggagggagguggaugcucggccggcgcgucuccugcucuucaccuuuaccuuuuccccucgguguagcuagccuagcccgaccgcggaucgcucuuacgaaacacauguuccugauuacuggggccgaggggacccguuuccuccauugccaggcucccccagaacucgcucaauuucucccgauuuagguuuuaguuugcacuaaacuuugaggaaggcgagggagaugccccuccggagugggauucccggggcgaggggcgacguuucccagcgucgcagcuggggacuugcgccuccagugccucauccccgugcuggcgggggcggcaucugucuguucugggcagagacaauggcgagagcuggagggccgagugcgcaguggggauaagcggggcgcagcugcuugugugcaacgaggggaagccccucccgggcccugcuccaccgggaggggaacgagcgugacagccgcagcaccuguccuggauccccauccaauuacggguguaugcauggagaacugaaugaaugggagccucggggaaggaugaugggcuucuagcucugcgcauugcuuccuuuugaagccauucggaggauucgcuguugaaccaccuucuuggggcuccagugggccagaugauggugacaauacuggaggaagcggggagagaguggaaaaugggggagcugccaggcaggucucuuuggacaugcucccaggcauugaguugccugggaacaaaguuacugcuuccaauuuuuauucuuggccuuggccuuguuuugagguauucuguaguuccagucugaaggaagacuccugggaguuuuaauccucagauuggaagcaauacuauaaaagugaacuuuagugcaggauuuacacuauaaggaaaugauggugcagucugcauuacuuuuaugaggcagcuugggugaaauaacguuaaucuuugaaacaacuuuuaguggggaagguagguguuaguguaaugcaccaauuugaagugaaugcaguuucaauuuaaaaauguacuugaugccccccccccccuuuaagguuuuaaguggccuuuugaguuuuuagugcuguuuuacuuggauucuuagauuucuauuccaugaaauaaaagaaucuggacaccagugacacugguggcuuaggccuuuuaaucccagcacuugggaggcagaggcagacagauuucggaguuccgaguccagccuggucuacagaucgaguuccaggacagccaaggcuacacagagaagcccugucucgaaaaaacaaaacaaacaagcaguaacugacauaaacagaaaagaaaaugcgugaagaauaagauugagaaaaaaauagaaacuguugauauuccuauacugagaagacucaguuuacucaucugauuaaugaaaauaccacuuauuuuguguuuucacauuuguguuuauauuuaaguuuuaauugaaaaauagcaacucaaaaauuaaaguauuuuauuaggguuuaaaugcuccuggcuauuuuauuguccuuaaaauaauuaucaucagacugcuuuucaucgucuuaagugaauuuagagucagaauuaguuuugaguugaguacacuugccuaauguauuugaugaccuuagauacguuuuacaguuggaaaaaaagacauugaauuauuuuuuuggguaauguucuaggaaguguaaauuagggacuagcuaaugcuuccuuucuuguauacauuucuauaaaauagcacaguagguagauggaauuuuaugauacaaagagaacuuuguucacauucaaguuacuuaauuuguauuuauaauuuuauugaaaaaauauagauuuguccauauggcuuguauagaaaguaauuuugccuuaggguguaaaugauauuuuuaccccaaaaguuauauaguuuauaauugggaaaagugauuauccccauaguauuuuauuucauccauaucagguuucaugucagguuaucugauagccauuaaauaucuugggacgggccuuggagcaagaauauuauuuacaauuuuuuuuaaagaaaugaguauaaugauaguugacaauccuuaaacaauuugaugauuuuccuuuccuaccaggaaguauuugaucauggaucaccuggaaagcaaaaagaaauccaagaaccagauccuacauaugaagaaaaaaugguauguucuagacaugugaauacuuuauaaugaacuucuuuguuaagauaauuaaaucuacuaaacuuauguauuuacuuagaagcagucagaaugucaacagaacagcuguuuuuuguuuuuuugcaguuauagagugguauucagacagaacaauuaucuuuguauaagcuucaucagagacaacugaagauaaaacaaaaacaaaacugaaaaaaacccaaaauauugccccuccacauauauaacuaauuugugcuguacaucaacaagaaccuguuuuaaauuuccaugccacuuuacaaucccuagacuguaccaggcaaagcuaguggcuauugaaaauauuacaggacagggcuaucuaaagauacauucuguaguguguuaacugugcaaaggaaagacacugugcuguuagaaacaaaucugacacagccuuacauuucaauuuuuuuucuuuaaauggaguuaguuguauuugugugugugggggggguuaaauguuuuauagacaaggaaaaaaaccuuugagaaccaccuuccucuuccucauccuuucauccucugcuucagcuuccuccuuuuucuugcucauuucagccuuuacuaacccuccccgccccccuuuuuuggccacaucagguuuuccuuuaguucuguaagccgcacuauccuuuucguauuucuccuucagguugguaggcuccuugucacagggcugcuuaucaccugcagcaguguuguuccacaucucucccaguuucuuugcaacagaggaccaaccaggauguccuccuuugguuuuuggacaauacucagaacagaauggcaggaggccucgggugcuuugguguccuugaacuucaauuuggucuccccuuugugugugggugauguggguuuuuaugucaaacuuugccaugucuucaaauuuccccuuuucuuuagcagcagacauggucuucugccucucugagcacuuagggaaccugaggagcugauagaagcauccgggugcugcuucuugugcucuucuggaaaguuugcacaaagaaugcauauagaagacauuugccuuuuagcuucuuugggucuccuuugcuugcccaggguuaguugguuuuccauugugagacacagagucacccagugucuggcucucacuugcucuguggagcucaguuuacuguaauuuuguguuuaauuuuuauaaguagaacauagauaucuaauugaaauauguauaacaugggauauuguuugccuacauaaaccagacaaguauuuuaggaaggcuacauaguaugauauaauuacucacuugcauuaaaaaauaccuuuaaagagagcauugaaaaugauuguaaaaaauuucagcaaauuguugucuguaugucuaguuuuguucuucacuauguucaaugacuaauuaaugcaauuuggucuccgcuuucucucucucucucucucucucucucucucucucucucucucucucucucucucccucccucccucccucccucccucccucccuccuuccuuccuuccuuccuuccuuccuuccuucauauaugugaauacacugucacugucuucagacacaccagaagagggcaucagaucccauuauagauuguugugagccaccaugugguugcugggaauugaacucaggacuuccggaagagcagucagugcucuuaaccaacgagccaucucuccagcccuggacucagcauucuuacauugugaauggguuuguguuuuucuugugcugaggagcaaaccuugugcauguguuuacuguugagcuacaguaucagcuucuugaauagagccuuacuuuauaaaaaggaagcuugauauuuuacucuuuuuacagagccaguuuacaucauguacuuugcucaacuuaguaccuaaaaagaacuuuauguuuaaauucaguuuuugauaauaacagccaacagugaaugcuuauuaugacccuguucugagugccuuauauauauauguuuaaacucaagaacauuuagacuguuuuuuuguuuguuuauaagacagggucuuacuauguagacuaggcuggccuugaacucaguucuaccaguucucagugcugggaguaaaggaaugugccaacaucccuggcuaggguagaacuuuuaaaauauauauauauauauuuuuuuuaauuugguuuuacuucuccuucaaauauuagagaauacuuaaaaauauguuaaaaagcuucaaacucucaauauuauggcauauguacagaauuagcauaauauauaugcuagcaaaauguaaauuauaaagauuuuaauaggugcuggagaaauagcucagugguuaagagcacuuguuguucuuccagaagacccagguucaauucccagcacccacauggcagcucacaacucucugaaacucuaguuccaaggaauaugaaaacuucuuccgaccucuucaugcaugcagguggcucacagacugccaacuuauuaaacaauaaugcccauauaauuuuaguuuuggaaauaauuauaugaauucauuuaaguauuacuguaagcaugcuauagaauauuuucuguugugccccuuugcaguaaauccuucuugcccuuagcccauuaccccaucacuaacuagaacuaaauguuuucauuucuauucaaaucuaugcuugucuuggcuaugcuuuggagagucacccaaguagcauguuucaggaguuuacuugauucuugaguuugucaugcagacauguugaaauugauucuuaaaguuugauaaaaugugucuuaaauuuugcagcaaacugaccgagcaaauagauuugaguauuuauuaaagcagacagagcuguucgcacauuucauucagccugcugcucagaagacuccaaccucacccuugaagaugaaaccagggcgcccacggguaaaaaaggaugaaaaacagaauuugcuuucaguuggagagugaguaauaguuuaauauuugauaguuuaaaccaaaugugcuuuuuaaauucuauuuuuuuaagguuuuaaauuuauuuucuguggcuucacagaucaauguuuaaauaucuaaaaauagacacagugacuuacuuuuauacuauuguaugcuuuaugaauuguuaacagccaugcuguacaugacaugaagauguuaagcuaaucucuagguuaaaaugcagaaguuaaauguguuauucaucauugcauagaaguaaguaaguaggucauccaggcuugaauuuguaucuauguucuuagcuuucaaaacacauaggugcauuaguuuuuuuugguuuugguacuggggauagaacccagggcuucaugcuugcuggauaagcauuccacuggcuuacaaaauccacccauguuuuuucccuuuuuaaaauuuagaggcagggcuucucugaguuguuagaguuggccuugaacuuaucuauagcucagacaggccuuguagacuucucucuuaguccuuaucaccagccuugguuauaaggguauuugaaaucugagcugguguguagaguauucuaauuugcuuuauuaccauuuguuuaaaauguuugccacuuuguuguuuuuugauaauauccuguacauacugaauauacaaauaauucaagauuuuugugcuagcauauuaauauauuuaggauagucucuucuaugcugguauaaaaaaugaaacaugaaaaauauauguaagauuauuuaaaagggagauuauauauuuaucaaugugaaaauugcuaagugauuaguugaaauaagaaaguauguucauauagagggaauaaauaucguaauuucuuaguuuuauuuggaauauuuuaguuuaucuuaucaauuauucuuaccaaaauuauauacauauauauacacacacacacacacacacacaacacacaaguauuguuuuuauacuuaaaaacuuuauuuuaauauaaaugcauuuacuuucuuuguuuuguuuuuauauccuuacugcaguuuccccucuucucccagucucucccugcacccuacaccuccccuuccacuccuccucccuccuccauuucucuucagaaaaggccagguuuccuauggguaucaaccaagcaugacauaccaaguuucaguaugacuagacaccuccccucaugaggcuggaugagacaacuuaacaguaaaggguuccuaaagcaggcaaaaaaguuagagacaguccugcucccauuguuagggauccuacaggaggccaagcugcacaacuguaacuaacauaugcagaggggcuagggcaguccuaugcaggcucccugucaguucagucucuaugagccccugugaguccuuguugguugacuguguaguuuuucuuguggugcccuugacccuucuggugccugcaauccuccuuccauuuucugcaggauuccuucagcucugccuaaugucagccuguggguuuccguuuccaucaguugcuggaugaagccucucugaaaacaacugggcuaggcaccaaucuaugaguauagcagaauaucauuaggaaucauuuucuauccuagaaggcuguccagccuuggcuccuaacuuuccaggcagugucaggggugggcucccucuucgggcauuggucucaagcuggaccagucauugauccagcuccuggauugauugacugcuccuguaauuucuccccuuuauuccagcauaccuuguauauaggucacagguuuuauggcuggguugguguugauagucuuuccgcuggaggucuugccugguuacaggagauggcuaguuaggacucuguauucccuauuacuaggagucaggguaaacccucauagauaccugggaguuuccauugcacuagguuucuaacucauuccagagauugcucccucccccugcacaccucauucugguuguaucucccaguauucuuccuccauccuucccccaaccugauccuuccuguuccuguacccaacccaucacauaggacccccccacccuccauguugguucuguuuccccuucaccgggagauucauguucccuccccagccgccuuuguuauuuagaaauaacuguguacuucagauguauuaaguuguauuaacggcuaacaagcuguuagcuacuuaaauauaucaguguuauagaaauuacuguuauaagcauuauuguggggauaguaaacauaauauaaaaagaaaugcucuugcucuuuuaguuuguaauucuguaagauaaagauuguccacagaaaauacagaguaaguuacuaaguuguuucuuuauugaauaguaugauuggaaaauaagauugagauuucucucucucuugagauagauagucuugugaggaucaaaccccaugccuuggguauacuaggcaaguacuuugccacagguagauauauuuuaguuccccuuucucauuuuggagauggaguggaguuuuguacuaccagagauaaugucucaguguguagcccagacugacuuuaaacucagucuuucucucuguuccugggauguugaaauuauaggcauggccagcuaaaaccagagauuugguuuucucugccuccucagugcugggauugcaagcucaagcugcauuuggcuucuguuuuggugggugaauagguuugaacuccugucuucaugcuugauauuuuuuucuucuuugacuucaagacaggguuuuucuguguagcccuggguguccuggaacuuauccuguagaccaguuggaccaaacucagagauccgccugccuuuuaauguauuuuaauuuuauucauaauuuaguuaacuauauaaacauuucagguuauauacuaguaauuucuacugcucacuuucuaggcuuacucugcuuuuuaguuuuuuuuuuuuguuuguuuuuuguuguuguuguuuuuuucgagacaggguuucucuguauagcccuggcuguccuggaacucacucuguagaccaggcuggccuugaacucagaaaucugccugccucugccuccaaagugcugggauuaaaggugugcaccaccacugccccgcuuauaucacaauaaucuuaacagguaucuaaguuaagccaaggcuacacagcacuugucuagaaugaguagaaguaccaaguuagaucccacauaccaauaauauaaaacauaauaaaaaacuaaaaaagccgggcguggagguacacgccuuuaaucccagcacucgggaggcagaggcaggcggauuucugaguucaaggccagccuggucuacagagugaguuccaggacagccagggcuauacagaggaaccgugucucgaaaaacaacaaagcaaaacaaaacaaagcaaaaaaaagauuauugugauaucaucauuuggcuucuaucaugucgaaauaagucucauuauaaaugauuuuguuuucauuuugacaguuaccgacaccguagaacggagcaagaggaggaugaagagcuauuaacagaaaguuccaaagcaacuaauguuuguacucgauuugaagauucuccaucauguaaguuaaauucauugaaucauuugauuuucaaaggagccuccuuugagaaucucauaguuguuugaauuuuacuuuucauauaauuuauaaaggaaaauuuuuaguaaucuuggauaguuacuggcuguguauaaguuuuagguguguguauguguuuuuuaauuugagauguuaauauguugguuggaguuauagcuauagggugcuuauagauagcaugugcaaagcccagagacgaugguaugugcuguauuucagaaguauaugaagaugcuacucaguuuauuaugguucuaaaauccguguaaaauggaaugauuuuugccacauacuuuuuccuaaauuaggaaacuucauaauaggggaacaucauaaaaaauugcuuuuuuuuaugaugaauuuauuauuuuugugaaauauauuagugcuuuucuguaagauaacagcuuaauuuuacuuauacacaaucuugauuucugauaggguuagaagcuuuuugucugaagccuagcuuuccugcaacuccuguuacuggaugaguaguuaguguggacaacuaauagaauuuuaguuguauucuugcuuaguuagaguauuaagcaguucacucacucacugguucacuuuuacauacacuuucaguucucccuugccuuacaaagcacccaguuucuuuuucuuuuucuuugguuuguuuuuuauuucgagacaagguuucucuguguagcccugacuguccuggaacucgcucuguagaccaggcuggccuugaacucagaaauucgucugccucugccucccgagugcugggauuaaaggcgugcaccaccacgccuggcuuuuucuuuguuuucaaaucaagcuagaggcuagagcuaugacaaacuggaaaggauauucagauuauuucuuccucaaauuaacuaauguacccaguccugauuagcuuuucauucuuaggcagugauuuguccaggcaaguacaacuaaugucugcauacugaagggcauggguccuuauguacgaucuuaaggaauagaaaggguggacuuggagaaggaauuuccugucuuuauuucuacucucaaugggaagaaaggaaaaaaaccuucagagaaccacuaucugaucuuuaugaaagaugaaaacucuugguuaaaaaugugcuaacauuuaaaagagagguaaagaggccagagguacucuuaagaccaaugugcuuucucauuggauugagugauuuacugaggacucugaugcaaacagucaagaguuccuuaucugauaacuucauuaucagcuaguuguauccaacugccucugcuucaguccagauuucauuagcuauuuuuaaugauuuuaaccuuacagaaacauguaagguuacacauguauccucuagaaaagaguagauacccauagguuccuguuaaaccucugaauaucagauaaaaggggccagcccugucuuauauuucuuguccuuaaaaugagcauuguuuuguuguuauuuuuagauguaaaaugggguaaacugagagauuaucaggugcgaggauugaauuggcucaucucucuguaugagaauggcaucaaugggauccuugcagaugaaaugguauguauuugguuaccuugaagcuuggaagauuuuuauuguuguaacaagauuguuugacauaaaauuuguagcaauuaagagagauaguuuuguuugauuacaacuauuuuucuuaaagcacuauaacccacugccuuaguuguguaagugacaugugaagaauuuccaucucuccauuagaguacauuuuaauauaguacaucuugagaacucuguuguuuuugcaauaauuugacuguuucuuuuuccauuuuaaaaaacagcccacaggguuuaguuucacaagacaucuucucuucuguucauuacuuacuaguuagugaagauuuuaauccuucucaaaguaguguucaaacaagugguuggggaaaguaugcagccauuaguacagucaaauguauuucacuucugccucugauaguuuacuuuggaauaucacauuuccugagucaggagguggugaugauaccuuccuuauagauuuaugugaccuaaguguaaacuuacacacacaguaaaucuugucaugcugucucacacucagcauuuccuuuaaauguuccuguguaugauggggcuauaaguaugggagaauguuuuuaauuguuuaaggauuaauuugauuaauguaauuaauuaaauuuuuuaacgguuaauuaugaugaauuuuuuaggguuugggaaagacacuucaaacaauuucucuucuuggauacaugaaacacuauagaaauauuccugguccucauaugguuuugguucccaagucuacauugcacaacuggaugagugaauucaagaaauggguaccaacacuuaggucuguuugcuugauaggagauaaagagcaaagaguaaguuuuuauauacuauguagugguauuuuuauauuaaaggaauuuaauuuuagacuaauaacgaaauaacuggagaagagauuaaaaagaaaggaucuuuacaaauuguuaauaguuuauaauuaccauacugucugguuacucaagaaucuuacugagaaggcauuaaagacuagaaagcuauaugaauuucuuaauuuuauuuuuaguuugcuucacuccuucuuggaacucauuguauaaaguccaagauaauuuauuuggaaauguuagcuuguuuuuugaauauguuaaaucauuggaaauuugaggggccagauuucuaaauuaggguauagugguaauagucauagaauaguaauuguuaaauaugaguugagucaauuuaguaauuugaugagcuguuaugauacaaaugugaguuaaauuauugacuucuuagccacaucuuuuugggacaaagucauggaaaucaugacacuauuaagaauaaagaacuuagauuuggaaguuggggauaaucaauugccuucauugauuaaaugauugaauuaaaugauuuuauacuuaauuagguuaguuuuuuaaaauauuguuuuauauuuauggguacuuugccugcauccgugguuuccacugaggcuagaaaagggagucaaaucccuggaacuagaguuacggaugguugggagccacugugugggugcugggaccugaaucuuagucuuuauaagaacaaguguucuuaaacacugagccaucuuuucagcagcagucuagauuucuuugcuccucaguagguaaauuauguggguuauuuuaaguuaccaaguugcuuuuuggggaagucaauuaauucugcuuuuuuacuucauauccuuaucuauaaaauaagaauaauaacaguaaugugccaauacaucuacaaaucagaggaaugagaccaucuacuaccaacugucaggucuuucuuaacccugcuuccuaagaacggcaagaucuguggaacuuuggaaagacauuuuaaaguuaagcuauggaauuuugugacucacuucaacuuuuugaaacuaaguuaaaacugacauuaaagugauaaugaaguaauuucagugauaggaugguagcuuuaaaugcuuauuuauuagcucuguuuaauacucuaauuuuuucuuguuuuugauuacuuguuaagugaauuuaauguguaauugaguugaguuguguaauuuuuuuuguuuuacaggcugcauuugucagggauguuuuauuaccaggagagugggaugugugugucacaucuuaugaaaugcuuauuaaagagaagucuguguucaaaaaauucaacuggagauacuuaguuauagaugaagcucacaggauaaaaaaugaaaaaucuaagguaauuugauacuuaauaugaacauuuuuugugucugagaguuugauauuuauucagaauguucuaauacugggcuuugguucuuucaguugucagaaauagugagagaauucaagacuacaaaucggcuguugcuaacagggacgccucuucagaacaaccugcaugagcucuggucacuucuaaacuuuuuguuaccagauguguuuaauucagcugauguaagcuucucuuuugugguuaauaauauuuugguuaauaccuauauuuuaauaauagcacuguuugauauggccauuaauuuuuuauacuuauguagcuagccaguuacuaaccuacuaaauugauuauguauucugagaauuuauucacuuuugagccuuggcuuuaaugucauucccaucaguuucuucaucuggguuggaguauuuuuucuguuuggcaaucaaggcucuuuaauuuuacuucaggguuucuagguuaaaggcucgucuuuaagcauuuucaaguaucuuuauaucuuacacauuguguuuuaacauuaagagauggccuucaaauguggagggauuuguuugacccuuuugucuuauuuucuuuucauguugcugugacaaaagcagcuuaaggaagaaaggguuuauucugggccaguucaagcgaacaggacagcggguguaacaguagcugaucaugcuucacucacagucagaaagcagacagugcgauaagugugucuguacuacugcucaguucucuuuuuuuauucugagcaagacaauauccccaacccaggaaauggucacacaauuuaagaugggucuucuuaacagcaauuaauguaaucaagacaguccccuacagauguguugggagggccaguucugggcuaauucuagauugugaaguugacaaugaccaaugagcaucacacccgucuuuuauuaccguguaauaaccuaguuuuuaucaauucuuuacauaauagaaaugaugguauaaguaguuaucuuuaugcugugugacagaaaauaguuuauguaauugauagucugugcaguuaguaaagacaguggccaaacuggaguucuguuuugaauguuugcuccuacaucuggaguggaugggagagcuuuguagagacccauguuagugcuuuuauauaaacaaauucuauaaagguguuaacuuggcuuguuacauuaaggguucuuuucauuucauuucauuucuuuuuucuuuucuuuucuuuucuuuuuugaaacaguuucuauguuuauccuuggcugucuugaucauucuauagacaagguuggccccaaacucagagaucuacuugccucugccuucugagugcugggauaaaaggcauguacuaccaccagccagcuaacgguuauuuuacaaagaacagaaauguguauggaaaaaguacauucagauuugaaaguuuuaauucuuuuaaauauuuugauguuuuacaaauaguuugaagauuauuuguuuuucuuccuaguuauuuaaugauuucuguuaaagccuucaguuauaacagugacuauaagauauuuauuuaaguagcauauuuauaauagauauuuucaggauacuugauaaggaaauugucuuuauacagcucuucucuaaguaguaacaaaaugcuuuuuguuucaaguuucacuuagauuaaugagaugaacuuuucucuggaaaccuuguugugucuucuaauuacuucuguaaacuagcuuucagacucuuuacugucagucuguguacuuaccaaaaaaaaaaaaaaugcuuagggagcagccauuaguccuggagcuaguaguaaaccugauacuugggaaguaagggcuuaaacuaaauuuuuuuuuuuuuuuuaagaaacaguuguuacacuuggagauauagggcauuuaagguuaauuuuaucuuugagcuuacgauguuuuuguuuguugaucuaggacuuugauuccugguuugauacaaauaauugccuuggggaucaaaagcuaguugagaggcuucauaugguaaguaugguuagaacauacuuuuaauaggaaaguauuuucauuauuuuacuguuaacagaaguaugguauuguguguguguguguauguguauguauguguauauaacauguauauauguauauauacacauguuauguauauauauauauauacauguauauauguauauauauguguguguguguguguauguuugaauuuaaaauccaguguuugaaaugauauuagaaagauaaucuuugauaguuuuaguaucuaguuuuagaaccuagaauggauuuuuaauguaaugaagaaaguaaucuuuuaguuuuaaaagguauaguauaaaggauaaaacaacagaguagauaacuucuuaaagcuuaguuucacuuaaguuccauagcaggaucuaaaaaauugauaucugaaaggaccaguugauacaucugacucuaaauauagugaguguacauaaagcuacuacugcauaguucaguuucuucauaguauagaaguucauagguaaaaguugguagguagauaaggauacucuuuuuuuuuuuugguuuugguuuuuugagacaggguuucucuguauaguccuugcuguccuggaacucacuuuguagaccaggcuggccucgaacucagaaauccgccugccccugucucccaagugcugggauuaaaggcgugcgccaccacugccccgccgauaaggauacucuugauugucagguucaggauacuguaaccaugcgcuagagguucuuucaugaccuauacuggagcuuuuaaacacuuggucacauuuuggcuaggguaauauguaggggauaggaggagaagagaagguugcauuguguacuauauauguagucccuaacacuucuuccuacaugccaugcaugacaauaaaaaugucuguaaguucccuggaagguaaaucaugcucugcucaccucuccuuccuuacauccuauucuuuucagauacaccagcguuaauuuuacuuuuacauaaauaugcuagaaacauuugacuaguuuuucuuauucuuucuuuguucauuguuuuuacucuaauugaaucucuuccuaauugucuucuacauagccuaagucucaguuauaucuaccaccuuucuuguugaccaucuaggcugagccuagccuagguacuuuguguauucauuccaucuuuagucauuugagcagucucauuuauaggacuuccuacagaagacugaaggguuuuccuuaauggaucuuaagcacaaacucugaaaacauaaauacuuugcaugguuccuggcuucaguggauauuuuucuucuuucuccucuucuguucuguuuuguugagacgugguuuugcuuugcaccccuggcuggcuuguacuagguaauccugccacagccucucaagugcugggauuauaggugugagcccuuauugccagguuggucuuuuuuucauauauaaauuaauuauacuuuuaaauucuuguguauugagauuuuuuuuuuuuguuaaguauaucugagaguagugauagucuccuaggaacuuuuaauucagauaacaguaaaacauuuaaaugugguuuaggauuuucuuauuuaaaggacugaaaucuugaaauguuagaguguugauaagaucuuagugaugaaaaaugaggcacaggaauugauuccuuucuaacuuuccccuuuacuucaugacuuuccuuuaaguaaaugucuagguacauguagauaaagcaggcuaaagugccuaugcagcagagucaaguguuugguaucuuuguuguuuuuucucagaguaauauaaaguacuuaucaacucaagggagaagagaaaugauguuuucuacuuuguccuccugcccuugcauucugaaauccccacucugacccuguggugaaagagacauaagcagucagccugggaggcugguggcaugugucaguauuacagaaaggugcuugcuuuggaggccucguaaccucaguuaaaucccugacacccucaccaagguggaaggagagaacugauucgacaugguuggcuucugacuucaaugugugucauagcagauacagcaugcacggauacacucaauaauaauaaaaaauuuaaaacucauccuggcauucuuaggaauaauacaaugauacaaaaucacuucccuacucucuacaaauuucuaucuuaauaacuugaauuuuaauaguuucagaguuuguggguagucugaugaguucuuggcuggguuuaucaagcuacuggacaauuuuauaagaaagccaagugggacugaaggucuucuugucucugcaguagcugguguuuggccuagcuuugguauaugcgguaaucagaaaagaguugaugaugguuuuucucacccacuuuaaauuuguuuugugauauagucauuauuuuauaagccaguaaaacuaguacaaagaaagaauaaaaguaauuuuuuguuuuauuguuauacuaaaacuuauauuuuauaaaaaggacuaguacuuuugaaauuuaagauacuaaucauaaacauugaauaaaguuauaagugauaauauguagaaauaauguguuguauacaauuaaaaacaagaggugaaacagaucuaucuuuaaaaagaaagaauauugcuuacuguuaggaaagaacugagagcaagccgggcagugguggcgcaugccuuuagucccagcacuugggaggcagaggcagguggauuucugaguuugaggccagccuggucuacagagugaguuccaggacagccagggcuacacagagaaacccugucucgaaaggaaaaaaaaaaagaacugggaggaacucaaggauuuguaguccgacuacauuugcuaaucugaacuugcuaaaacugaauugaacuggguuuuuuauaguugucacauugaaugcuuuuguaauggguaguuauuuaaacgcagucacgcaggucuuacugugggcuagccaugucuuaagcagugcugaacagcauguguucaaguaacucauuuuuacacuugaucuuagccaaaaggccgagaagcgauguaacucauuuuuaaacaaacaugaauuagcaauggugaaaauaguuuuaagacacgucauuguuuucuaguauuuaaugaaaauauagcaaguauuauauaaauacaaauagaauaaguggugagagucaguaaugcaauaguaauaaaugguauuuucuggacaggaaaauacuaaaaauaguuguuauucaagcaaauuguuucuauguauuugguacauaauuuuaagacuuugaaauaauaucaguauugcagauaaggucaucuuuuuuuucccucuuucuaagguuuugcguccauuccuccuucgucgaauuaaagcugauguugaaaagaguuugccuccaaaaaaagaaguaaaaaucuaugugggucuuagcaaaaugcaaagagaaugguauguauucugagauacuugcuuguacuguuuucccagauuuucauuuuacagucuuauuuaccuaauuugugucuuuagaauuucuguguacuugauuaggcuuaaccuguuaauucagugcccauuaaaagguaggugggaggaggcaagucagcacaccagacuggcuugcagugugguuucugcugcccagguguauucugguggggugucuuccuucuguuuauuugggacaagugauaaaauacuaaagguuuaguuuaguuauccuaacauugagugauaugcuucuauuuaauguuuguuuguuuguuuuuugagacagggcuuuucuguauagcucuggcuguccuggaacucacucuguauguagaccaggcuggccacgaacucagaaauccgccugucucuaucucccaagugcugggauuaaaggugugcuccaccacugcucggcgcuucuuuuuaauuuugcccaaaguucauaauuucuguauuuaaaaaguacagcauuuugcuggccagucauggaagacaaaauagacagaauuaagauccaugaaacaaacaaacaaaaaaaugauggcucaagcugcaguacauuuguuaaaguguuuaacaugcaccaaguccuagauucauguauuucaugcaucaucaccacauaagcugagaaauacuuuuuuuuuuuuuugcuuuuugcuuuuguauaaacaugggaaacuuuuuaagucucuguuauaccaguuuauuccuagaccauuggaagcaaauuucaggcagugguuuuucaaauuauuaaauauuuugugguugggaugggugaggggauuaaguaugcaaugugguaggcauauuaaacaauuuuucuuuuuaauagguauacucggauauuaaugaaagauauagacauauuaaacucagcagggaagauggacaaaaugaggcuauugaacauuuugaugcaguugaggaaaugcugcaaucauccuuaucucuucgauggagcugaaccugguccaccguacacaacagauaugcaucuaguuaccaacaguggcaagauggugguguuagacaagcuacucccuaaacugaaagaacaagguaucuauauuacuggcguuuaauuguaaaguaaugaagacuuuaaaaauucuagaauuaagaggaugaaauacaacauuuugaaaugucuauucuaacaguuuuuaaaguugaaauguuaaauguuuaaaaagaucuaaaaauuucagccaaauccucuucccuuaauuuuaggcuuaaauucuuauagaaaaugauaaacaugcagaguagcgaccauuuuaacuucauguagguuuccuagaaauuucaucuuuuucauaagauaccaggaaugccuuuccuacauacaccuuucccagauacuuuguuagacagugauguuguguuccuguuauuuucuuuuaugaauuuaaaaauauuuacuuaaauauuauuuacauguacucaaaaguauuucuacuuacaguauucugaauucuuuuguaugagaaugucuggauuguauguauauagguauaguucuccuagaugaauugaaaugaaucuucucauuauagugguuuugcauauuaaagauaaauagcaguccuaaaagaaacagagauuucuguaauaucaagaguccaguaagcuuucaaauuucucuaguuguguuuuaagacagagcuucucuguguagucguggcugcccuugaacuccuucuagauuagucuaaccucaaacucagggaucuacuugccuuucucccucuuauagaauuaaggcauaugccgccauugccuggcuuagguaugauuuuucuuagguaugauuuuugaaggaaagaaggcacagacaucaugaccaaguuacacggacaacauaaaauuggggcuggcuuacagguucaguucauuaucaucauggugggaacauggcagcauccaggcaggcaugcuguaagaggagcugagaguucuacauuuucuuucuuucucucucuuucuuucuuucuuucuuucuuucuuucuuucuuucuuucuuucuuucuuucuuucuuucuuucuuucuuucuuucuuucuuccuuccuuccuuccuuccuuccuuccuuccuuccuuccucccucccucccucccucccucccucccucccucccucucucucucucucucucuaauggaacguuuuucacccuuuuuuuuuaaagacuuauuuauuuuauuugaguacauuguaguugucuucagacacaccagaagagcgcaucagaucccauuacagaugauugugagccaccaugugguugcugggaguugaacucagaaccuuuggaagaggagucagugcucuuaacgacugagccaucucucgaaccugagaguucuacauuuucaucugaaggcuaggagaagacuggcuuccaggcagcuaggaagagggucauaaagcccagguccacagugacacacuuccuccaacaaggccacacuuucuaacagugcaacucccugggccaagcauauucaaaccaucacagaugguuauaccaauagauauaccuugauaaugacagccaaaaaccccuuuguaguugcuagugaauugacacauguuaauggucuauuaaguuaaaaugugguucccacaauuagauggauuuuaguguugaggaguucagggaaucauguuuaaagaaaaaaaugugcaguggugaaauacaacuuuuaaauauaaaugagguaacaggcuaaugauucacucuccuaaagcagacagguuuuaccuuaguauacuguacacgugacacucucuuuuuuuguucuauaauggaagauagguggggaauggcuggccuagguauuuauugaugucauuguuauccuuuuauagucaaauaacuaauuuggaacuugauggauaauuuuagucuuauuuuuguuuaguguuaaauuuuuaaauaaaaaauucuguguuagaaauuucugauaauagguauuuauguucauuagguucaagaguacuaaucuuuagucagaugacaagaguauuagacauuuuggaagauuauugcauguggagaaauuaugaguacugcagguuggauggacagacaccccaugaugagagacaaguaaguaugaaagggugggaaguuaaaaagugaaguaagaacuuuauuuuuuauauuccauuaguguguaccaauuuaauauauguuuguauuguauugcaucagaguauuugauuuuuuuuaaaaauauguauuuuucuuuuaaaauuuauuuugugugauaguguuuugccuaagugucugucuaucuguaccuuguaugugccugguggccaaggaggccaguggugggcauuggaacccugggaacuagaguaacaacagaugguugugagcugcuacaugggugcuggggauugaacuaggguccucuagaagagcagccagugcuuuuaacuacugagccaucauaucagauaaagacuuauauaucuaggcuagucugaaauucaguguaguugaguaugaucuugaacugccucuuccugcgugcugggauugauuauagguaugugcuaccauguccuagauaaaguaauuuccuaagccaggcaugaugguaucaaccuguagucccagcugcuuguaacuucaggaggagcggguacuugagcuagugugggcaauauaaaaauaucccacccaccaguuuugguuaugguggagaguaccuuuaaauccaauacucaggagucaggaggaggucuacauauccagaccagcuagggcuacguagaucgucuuuugagagagagagagagagagagagagagaggagagagagagaagaaagagaggcagaggcagguggauuucuguguucgaggccagccuggucuacaaagugaguuccagaauagccagggcuacacagagaaacccugucucaaaaauacaaaaaacaaacccuaagaaccccugaaagaacaaaaaaccaaauacaacaaaaauuucuaacacuuguuauuuuauuuccauaggacuccaucaaugcauacaaugaaccaaauagcacaaaguuuguauuuaugcuaagcacacgugcugguggucugggcaucaaucuugcaacugcugauguagucauuuuauaugacucagauuggaauccgcaaguugaucuucaggcuaugguaagagaugaacaaguaaauacugugugugcuuaauagauguguucauuuuauaaauauccugauuuuaccuacuagaacuuucuuuuaauuuuaaaaaauuuaguuauuuagaaaguaugucaacacauuucugccuaauguauaaguggaggccagaggacaacucgggaauucucuuuccauuaucuguuuuccaggaauuuacucaggucauugggcuugggcagcaaguucuuuacuuaaucaucaucucagcucacagucgucuuuauuuuuaaaagcuauauaguauuuuaaucuuuuauuuuggucauauacaucucccauugccccugccugcucuucuuagauucauccuaauacaucucuccuuucucaaacccuccuugaucccccccaaaaggaaucaaaugauuuuaauuauugcgcgcgcgcgcgcgcgcgcacacacacacacacacacacacacacacacacacacacacacacgaaaaaaaaaaguucaucccauaacaaauauaacagcacuugggaggcaaaggcagguggauuucugaguucgaggccaaccuggucuacaaagugaguuccaggacagccagagcuacacagagaaacccugucucaaaacaaacaaacaaacaaacaaacaccgauccccccccaaaguccccccuaaaagaacaaaaaaccaaauauaacaaaaauuauaggccauauauauauggccuucuacuggagcaagggcaauuuaucagugguuauaccuaaagaaaaaagauucucccuucacccaguagcaguuacccgccaggaacuccuugacagggaaaugggucucaacagcuggaauuuuggugggcuugauuuugugcaaguaaccacaacugcugugggucagugccuacaauaggcauguuauauauuccucuccagucucuggcucuuagauucuuucucccaccauuuucucucaccucuuuugauguguuaaagaaccuuuugaauguggugggagguugaugaagaugucucauuucaaguugaguucucacugucacuuaauagaauuuuauuucuuuugaucuaauaggucuguaaaaguauuuugaauacucuggugaaugagcuugucaguaaauguguguaguuguguuuuaagagaaaggggaaaucaguuuguaaguugguaguucaucugccacuugggaugccuaaaauuuaugcccauuuugagaguguccggccaaaugaggaaauugauuuuaaagcugaaaaaauucaggaucuacaaacuaauguggauuguacaaauucugacuguugacuuaaaguauuggguguuuuuaagugcaauuucaaauuaucugcacuagucacuuucuuuuuuuccuuuuuuuuuuaaaauuaaggcauuuuuuaauuagauauucucuuauuuacauuucgaaugcuauccccaaagcccccucuacccuuucccccccugcuccccaacccacccacccccgcuuccuggcccuguacuggggcauaugaucuucucaauaccaagggccucuccucccauucaagacuaggccauugucugcuacauaugcaacuagaggcacagcucuggggagcacugcuuaguucauauuguuguuccuccuauagacuuuuucuuacacucuuuguaaggaugguuaagggaaacugauaaacuauuagaauuaagguguuuuaaaaaacuuauuuaauguacgacuguucugcugcaugugcacccaccugccagaagugggcaucuaaucccuaugugguugcugggaauugaaaugggaaccuuuuaaaagcagccaguacucuuaaccacugagccaucugaccaacuccauaaauaagguguuuuguugguggaacauaguuugaauuuaccagaaguuaaacagaauuaacauucaaaauaauuugauugaguaaucuuugaaugugauuuuuauaucauuugugaaggacauuuuuuaugguuuuuauuucccuaaugagugacaagauuuuauuaauuugaugaagaacaagauuuugaaacuaaaaucaagagaaagaaaugauuauccaacugauauguuacaguuuugccuguuagauaguaucauauuuuuguuacucaugcaguuggcuuugucuauuaaaaaacuaugauuuucuuuaguuuuaggaagcuuuccuuguguuuaauuugauuaaaucugagaauuuaagaacuauuuauguaacaugaauccauaguauagguguuauauuuaaagaguauuuuaauuuugcuucucaguguacauguuucuuuauucacuuuuuaauuauauucaaaguaacaugguaauuuaauucuaggaccgugcccauagaauuggacaaacgaagacuguccgaguguuucgcuuuauaacugauaacacuguggaagaaagaauaguggaacgugcugagaugaaacuuagacuggauucgauaguaauucaacaaggugagaccuagaacuuuaaauaauucccuaaguugcauauuucagucugaugcccuaggggagauuuuuaagcaccuggaguccagcuaacagccaagaaagaaaguuuauauuccggauauuuuaagcuuuaacuuugucacuaaguuaaugaguuuugaacuucauaauucacuuaaguggaaauaaaaguaauacuuagcuuuuaaaaauuagugggauaauauauaaaauauaugacauucagcauagcauauauuaaauugaauuguggugauuuauaagcacugaggauacugaacaaaaaguauauuacuuuuuucuuuuuuuuuugguuuuuugagacaggguuucucuguauagcccuggcuguccuggaacucacucuguagaccaggcuggccucaaacucagaaauccgccugccucugccucccaagugcugggauuaaaggcgugcgccaccaccacccggcuacuuuuuucuuaucccgaacuauuuacuaagugaugacugucagaugcuagguaggcauuggguggaccaaaguuacuauuuugaaggaacuuuagaauuuaguaggaaggaaacucuugacuauagcuguagaacuuuauuuggcacuuuauuuggcucaguugaaggaaacuucaaguucuuguaccagaucaacuuuuagaugacauuuuuugcuuauauuugugaaaacacaaauuaagauuggcuaaauuccuaccaguugaucaaacuaaauuuucaaaagcuuuugaguuuauuauaucuagauauuuucuuuuguuauuuuaaaaaucaaucaaucaaucaaugaauuuagcuuugcaguggugguguacgccuuuaaccccagcacuugggaggcagaggcagacagauuucugaguuugaggccagucugaucuacagagucguuccagcuaggguuacacagagaaacccugucucgggaaggaaaaaaaaaaaucaauaaauuaauugaaauggucuuauuguguagcccugacugguuuagaauuugauaaguggacugggcugaccuucaacucauauacugccucugcuuuuccaauauugggguuaaaggcaucuguucuuauauaaaaucuaaacauaaugggaaagauaaucaauaacaucacuaugauaggaaggauuucuuauaagguuuagauauguuaaaauuugugagguuuucucucaacuuuucuuuuccccuuccccuuccccuuccccuuccccuuccccuuccccuuccccuuccccuuccccuuccccuuccccuguuuguuugccauugagucagggucucacuauauauagcuguggcuguccuguaacucacuauauaguucaugaagguuggccuugagcucacagauaaaugccugcuucugugucuugaguucugggauuaaaugugucugcuauugcgcucagcuacuugauuuucaaauaucucaaauacuguauucuucauaaaacauuuuaaugagccaauauacaauagguaauauauaauguguuagcuuuagaaauauuuaaaaacuuacacagcugaaaauauggcauuaaauuuaacacucagugaguuugaucauuuguaaauuaacaguaaacagaaauggguaaauuuucuaauuuuuuaaguuuacaguaaaauaaauucagauuaauauaauguuguguguaaaguuaaaaacacgcuaccuccuuuucucucaacuagguuugccaagcugccaacaacugccugucuuuucuuuccccucuugcccacuuuagcuccauggauagaaaacauauaauacaauugcuaggcucuuaucagcaaaucuauuucggccaaccaccugucagggcgcugguucuggcugcccuaagaccuuacauggcucuugcauccuccuccuuccaaagccuggccaaagacauccuccugcccuguguccuuucucugccucuuaggacacagaaaucccaccuuuuuccuuuuguccagcauuccgccuucuuuauugacacaaucaagaaccaauuagggaauccgauuuucguuuacucucuucccccuacaauauaauacaagacaauccuuuuuuucccccccagggaggcuuguagaucagaaccugaacaaaauugggaaagaugaaaugcuucaaaugauucgacauggugcuacacauguguuugcuucaaaagaaagugaaaucacugaugaggauauugaugguauuuuagaaagaggugcaaagaaggugagaugcauaguaaaugauaguguuuuguaacaaauaguuuaugaagaaacugacgaccugacaugguuaaggagguuuuuuaauuguagauaugagagagagaacagccagcggcaucuggaggaguccagagcagagaaagaaguagacggaacaugaucagcacagcauauguggccaggcuggagaagcagcagaggguagagaaauaguaaaaauagcaggaacaauggggagaauagugaaacuagccaggcuguagcaggaugaacaguuggcaggggaagcccaagagcuagaugagguuuagguaagggacuaggaugguaguguagcagcauggacuuugaaauggauaacagguacucaugguacugggggagcuuggaggccagcaugggcuuugauagauagguggauaggugccaaugguagagaggcugccagcggcaaggacaaugacucccuuugggaggcaacuggcuugacaaguuucugaggaauacuggcuuugaucuagcugccaaggcuccuccuauaguccaggcugauguaguuucuagauauuuggacugccuuuggauuugaggaauuaagaguuuccuuugaaucugacaguucaguccaaaacuauuugagaaaaauauuuccucugugaaucaccaguuucuuuucuauauaaaaaaaaacguguuuguauaaaggagucuuuuuuuuuuuuuaaacuuauuuuuuuguguaugggugcuugccugugcaucacgagugugccuguugcccaaugaggccagaagagggcacuaaaucccuuggaacuggaguuaaauagaguugugaguugccuugugaauugaaccagguuaucuggaagaacaaguguucuuaacucgugagccaucuuucuaguuuuauuuugacuacaggucuuaagauuauuuugcucucaauuuaagaagacuuuuuuuuuuucuauguagacugcagaaaugaacgaaaagcucuccaagaugggugaaaguucacuuagaaacuuuacgauggacacagaguccaguguuuauaacuuugaaggagaagacuauagagaaaaacaaaagguacuuauuuuagaaugaaguuuuacugaaaacuuggaauccuguguuaguuuauccacaucuuagguuuuucauagucuauuguuguaguuugcaaucucugauuuauuuuuucccuugcuuauuuacuuauggugugugugugugugugugugugugugugugugugugauaucuuaauauggcccuggguggcuuuccuugauucauaucugaggcugccuugaacucuuguaaucccuuguuucuagguccguccuuaguguugccauuauggauguguaccucuaagcuaguuuuggaguauuuuuaauuuauacaguaaaguucacuguauacuauuacugaaaguauucuuguagagugugucauuuggaauauuugaaaguaaacuaaauggcaauaaaaaggccacaggcuauuuuucuuggaacuugaauuaauugguaauuaaaaugguuuaguuuuaguagauguauuugcuacuauagaaauugucaaaugcuguauagaagaaauacuugucauuuuucuuaucauuuagauaaguauugaacauaguuuuuuaaacaaaauuaugucuaauuuuucuacuuauuuggguuguagcauaaauucuguaguauuuauuguguauuaauuacauaguacuaaaaauaccauagucugcaccuuuguagaauuuuuaguuugguacuucaucauuauauuuuuauuuauaagucacuauagauaauuuauugcuguguauaaugaaauuaaugauuggaauguuuuucccaucuccuagauugcauucacagaguggauugaaccaccaaaaagagaaagaaaagccaacuaugcuguugaugcauauuucagggaagcucuccguguuagugagccuaaagcacccaagguaaggggacagcauggaaacauuuaaauaggugguagguaagauugugcuuucucacauuuuuacaacaaaauaaaauugagaauuauguuuugaguuauuuuugaauugguuuacauuuuuuuugguuuuuuuuuuuguuuuuuugagacaggguuucucuguguagcccuggcuguccuggaacucacucuguagaccaggcuggccucgagcucagaaauccgccugccucugccuccuaagugcugggauuaaaggguacgcuaccacugcccagcugaauuuugauugucaguucauuucuauuuaaaggugaauucucuuucuuggagauuugguuguuaugguuuaggaaaugacuuaggaagugugaguuuuguguauuuuuguuuuuuaauggacaauacuguuuuuauuuuucuuuaggcaccucgaccuccaaaacaaccaaauguucaggauuuccaguucuuuccuccgcguuuauuugaauuacuggaaaaagaaauucuguauuacaggaaaacuauuggguauaaggugauucaaauucuucucuuugcauuuucuucucagaccacaagggcaaagcuacuacuuaauugacuuuuaacuaauuugaaccuagaaggaaauacuguugcuugcuauacgcuaguauacgaacuuucugaguuuucauuaaggaaaaaauuucaugaguaauacuuuuaaaagauguaauauauuggaaauuaaauaauauggcuaaucccauggguauauuaaaacuauaauguuaauuuguuaagaauuuauuaagccccuuaaaauuuaccaauugauggcauugaaaaacaucugcuagguaccucggaguccugaucuaccuaaugcagcacaggcacagaaagaggaacagcuaaaaauugaugaagcagagccccucaaugacgaggaguuagaggaaaaagagaagcuucugacacagguauaaccuuugauuaacacaaaguuauuuuguaaaguacuguuuuggguuuuugaaucauacauacgugcacauuucugcuuucaaagagaaugguugggcugacuguaaccugguacugggugcuucccuagcauaugugguauucuagggccagucuccagcuaggagaaguaagaggcaggauaaguaaacaugggcaagccuggacacgugcugcuggauuggacugucauuacuaguugagguuguaguuaaguacugguugagguuguaaguugagguuguaguuaaguauucuuuagaacuuauuuucaguauugccagcuuucuggucuuuuccaaguucuucuuuuuuuuuuuuuuuaaaagauuuauuauguauaaguacacuguagcugucuucagacaccccauaagagggcaucagaucucauuacagaagguugugaaccaccaugugguuguuggcauuugaacucaggaccucugaaagagcagucagucagugcucuuaaccgcugagccaucucuccagccuuuccaaguuacucuaaauuacaaauuucuacuugguacuuaguuuaaaauguaaaaaaauuuauguauucauuguccuugguacuguguuacaugaaaaguacauugacaccaaaauuauacauuguauguugagcacauucguccccauacacuucauucucccacuccuccggggagaggugauuuuuaagugucagcauaaaaucuagaugcaacaagugagagaaaacaggcagugucugaggcuggcuucauucacuuuguaagauuaucuccaguugcuuccacuuuccuguaaacaauguaacuauuuuuuacggcucaaaaaguuucuacacauugcugauacuauauuuucuuuauuccucuguuguuggacaacuggauuggucccguaauuuagcucuugagaaugauugcugaauacacauugaugugcaaagugucccagauauauugacuuggagucuuuuggguaauagaacugucauacgguggacuggagagauggcuaagagguuguuaaaccacuuguucuugcagaagauuaggguuugauucacugccccuacauggcaccuugcaaaugucaacuaguuccaggacacacaagauauagaauguauucauguauaacaauuacauacauaaaauuaaacaagucuuaagcaaaaaacugccauagugacuuuuauaauaguuuuacuagcuuaaguauccacuagaggcauauaauugauccauuuuuguucacaacauuggcaauauuugauauuuucuuaaugagugccauuaaauaaaauacaauuacaaugccauuuuaauuuguauuucucugauggauaguaaaguuggauaguuuauauauguuuguuagccauuuguauugauuuuuaguuacguucauuacucauuuguauuucauuuucuguaagcuacuuuuguauuuccuuagccuauucuuuauaggguucuuuaaguucaguuuaauuuuguggaguccuuuguugauauuaacccucugucagauguauucugcuuaguauuuuugaaacauugcuugggauucaagccuuugagaaucuggucuuuaaccuacccuuuaaaaaaauuaauuugacaguuucauacacacacacacacacacacacacacacacacacacacacacaaugcacucuuggcaacucuugcuccucaacaucucucucuauucccaccacuguaaacccuuccccagucccguuguugcgacccacugaguuuuuaguuagauuugucugugugaguaugcguguggaacuguccacgagauagagcaugguagucucaucagugacuccacaacugaacauaucugcuccccuugucuuagcauccaucaguggccaguaguucccccauuuguagauaggucccuaugagccucugcuccauccauaauugaauaccaacagaaacugcuauuaguuugugauuauaguggcuauuuauacccagaagggaagcauuucacaacuuccuuucuugucuggcuuguauauccugucuucuuuucuuugauacucccugcaacaguguauagcacuucugucugauacaugcgugcaugagaugccagccagcaggagggaagcagcuaguuaaauuccagcuugaguccucuaucugcagccaaauuguaugcugucuccagcaggagggccuuacaucuaaucuaguucuggugggcaaccaggaauacuggcaguagcuuguauuccauuuuaggguuucuggagccuuccuaaucaacaacuuaaaggaggugucccacaucuggcaaugggaauuuuguuuaauccucauagggcuuggcugcagguacaugguguaccuucucacuggcucuuuuaaaauucauauagaguaguagguuucgauaugacuuuuuacaucuuuaguuuuggucagcccugucaccuuccauuuucccguuucuucuguccccuuuccauuuaauuuuuaccaccccaguguauccuucccacuuacacaucacuuguguucuguccuuuaaacuuggcuuuuugugcauuuuucuacuugcucauuuuuaugauacuuuuacuucccaaauacuaauaguauuucagaguuuaaagugucauugagcuugucaugcagcauuccuacugccuucuauguagaguucguugcucagguuucuuuuuuuuuuuccuuuuuccuuuuuuuugguuuuucgagacaguuucucuguauagcccuggcuguccuggaacucacuuuguagaccaggcuggccucgaacucagaaauccgucugcuucugccucccaagugcugggauuaaaggcaugcaccaccaugcccagccguugcucagguuucuaagaaauauaugauguacugguaaaaguguguacaugaaaacuuaaccaaacuccuaguuaagauaaaguaggaguuuuuuucuguaacaaauguauuugaaaguaugguagcauuauuuucuaaguccuaugugcugugauuaaauauuuugcuuauugcuguuuagggguuuacaaauuggaauaagagagauuuuaaccaguuuaucaaggcuaaugagaaguggggucgugaugauauugaaaauauagccagagaaguagaaggaaaaacuccagaagaagucauugaauacucagguaauacuuuuacuauguucuauaagaauguggucaauauuuggaagcuuccuguuuuccuucuuguauuuuuuucauuucccccauuuauucuuuuauacucuuacagcuguguucugggaaagaugcaaugagcuucaggacauagagaagauuauggcucagauugaaaggggagaggcaagaauucaaagaagaauaaguaucaagaaagcacuagauacaaagguacuuugcauauuaaauacagugacuaguguaacuauacugugauauuagauaacuacauuaaaggaaaagaaauugccauuugaaaucuaaaauuucuuuugaaaagaaaaacacauuaacucuuguuaacauaguuuuccugaauauuaaauuguuagccugguuuaaagaagaccccacuucuuaaguguuagaacacuuagaccccauuucuuguagucacaacaauaguaaaagucuauaaaaguacuacaggacaaagagcagguacgaaucuugauagaaaauucugauuugaaaugguacauuuaugguuaguuauggaaaggcuaaaguaaguuugaaguauggauuacauaggacuuguauuuuauauguguacauuauaacuuuuauagauuggacgguacaaagcacccuuucaucagcuaagaauaucauaugguacuaacaaaggaaaaaacuauacugaagaagaggaucguuuucucauuuguaugcugcacaagcuuggcuucgacaaggaaaauguguaugaugaauuacgacaaugcauccgaaacuccccucaguuuagauuugauugguuucucaaguccagaacugcgauggugaguguacaagguuuguguaaugcagcagaguucagaaugaguauauucaguuauguguuaccuuguaaaaacauccuugaggaacacuuuccuucaguuucagagauuaaguuauuucaucuucuauccacagccacaguuugcaaacuuuauaggaaauuugaaaaguuuaucuucuucuuuaauguauguuuuaacauggcuuuauacagugagacuguauuagguucuaagugaggagaaauguucaccuggacaugauggcuuuugaguuugcaaguagacagcucuguagagaagaauguucuucaggcaucugucugcucaucagguugcugaaucuggguucuuuuaaaauggcugauugacauagaacaauauuuuuuacacugauuuaagacuggguuuuauuuguagucuuaaugucuagcugucuaacaagagauguccauuucuaacaucuucaaauuagaauucaagaaagcuuacuuuggauuaugucuugccuucuauauuuuagaaccuuuaacaaaaguuguauagucuuaaguuugaaacauagcagcagaacuggagagauagcucagugguuaagagcacugacugcucuuccagagagguucugaguucaauucccagcaaccacaugguggcucacaaccaucuguaaugggauccgaugcccucuucuggagugucugaagacaaugacagugcacucacauauauaaaauaaaucuuaaaaaauaaauaaauaaaaagaaacauaauagcaguaagaaaguguaugcauuugaaguauagccauggauaauguguggcauuugaucauugaaaaauacuuuuauuuuucaguagcuauuagggcuguuguuauaugccauuguuagaaaauguaauuagcauauggaacuuaccugaagauacuauauuauauaaucauauaguuaguugaaagauugaguugcuauaagcucugcuguguauauuuuauguaagguacuauuuuuauauaacauaagaaauuauuucauaauaaugcuaaugaagauagugucacauacuacauaagccaguucugaaaacugcuguacuucuuaauaugguaauauuaaggcauauaaaauaaacauacauaggccuuugugauaaaaaauagaggcaugcuuuuuggccaguucuucaaaggauucaguguaccagaagugugugugcuauaguaaacuugauaagacacugagcaccauauucuugguaugugugcugugcuauacuuucuugucuuguuuuguuuuguuuuguuuuguuuuguuuuguuuuguuuuguugggauaagguuucucuguguagccuuggcuguucuggaacuugcucuguagaccaggcuggcauugaacucauagagauccacuuggcuucugucuccucagugcugggauuaaaggugugugccgccguccccaccaccuggcuuugcacuguacuuuuuaaauggaaacacaacuuugcuuuuuauugccuucugucucuacuauugaaaauauuacuaagccaugcauggaguuucugcuaaguaguucagaauuauuuuacuguguuugccuguauagaaguuuuacuuacauauaagagauuuaaaaaucaacaaagcgcuuuuguucuguaaggaaacaaagcagugaggcaaauggaucuuuacuucagugcgcguccugugguuucuucauuaugcuucacaucucuucugguggccacauagauugguagagaaagguuuaaaaauguguuguggguguuggccuuccugcuuggaugggaggugugaauaggcagcagugggcuuuauggccaugugcauaacugcuguaaacuaagaugaugaugcuuucaaagaaaagauuaucuuuauuccuuaaguucuuguugguuuugaauuauguauguuaauuuuuaaauauaagucguccagcauuccuaggcauaguuauuacaugugugggaugcucauuuccauugcuuuaguaccuauaugagaaaugaagggacaguuggugaaaacuguacacuaguguggagcuuuacuguauguuugauugcuuauuggcauguugccauugagcuacauguacccagccaugucagugcagcuuuaaagggugaaauaaaaacauuaaauccuugggguuuuguauucucauagcguggucugugagaaaaaauaacuuccucuugauuuuuuuaaaaucuacuacgaauauuuuaagugauuuuuuuuuauuuguuaaaauguaucuuuauuuaguuacagaaauccugccaacauguaguuggaaaaaccaaguuuaucauguuuauuuauaaugcaggagcuccagaggagguguaauaccuuaauuacuuugauugaaagagaaaauauggaacuagaagaaaaggagaaggcagagaaaaagaaaagaggaccaaaaccuuccgugaguauagauuauauaaaucauacaauuucgguguuuuaugcacacuagugugugugugugugugugugugugugugugcgcgcuccauauauguaugugugauaguacugugugggacagagguugauauucaggugcuauauuuuuuugagaaaagagucgcauuaaguuugcggcuugccauuuuggcuagauuggcuguucugagcaccucuucucuucuugacccauuuccuucauugaugggguuguggagcuuuacuggauuuuggggaucagaacucagguucugcuuucaagagaagcaaaacccuaccacagccaaguauuggaacacuguuuugucuuuuuuuuuguaaauaauacauuugagucaccuuaaaauauaaacugaauuugaugcacuaaauauagaaaagcaaguuacucugaaaaggugaaagucuuuugauugccaagacugcacacuuguucugagaauucuugaaauuuuaggagccuuuuaagaauauuagauuagggcuggagagaugacucagcaguuaagagcacuugacuugcucuuccguaggucccaaguucaauucccagcaaccaccaugguggcucacaaccaucuauaaugagaucugaugccuucuucuggggugucugaagacagcuacaauguacuuacauauauuaaauaaauaaaucuuaaaaauauacuagaauauuaaacauaguagcuuuacaaguucugugguauucuaagcuuggauucacuuucuuaguaauguguuagcaguuugaauauuucaggaggaaauaggcaucuugcuauuuaacagcaauaaauuauuuggagauuugauagugguuuugaaagauuuguugucuagcccuggagaaaagucucacgcuguuacuacuuacaugcugcaucauguuuggcaauauuuuaauuuuuguaucauuuuugacuugucaugagaacuaauuguuguuuguuuauagacacagaaacguaagauggacggugccccugauggccguggaagaaaaaagaagcugaaacuaugaaugcauuuuugucuuauaaucacuaacugguaguucuuuaauuuacgggucuucauaagaugugcuguacagugcucaacuguuaugucauucagacaucagguccaucugcuuacugagcuagaaacauaguauguaguuucacuuuuuuuaaaugcaacagcugugcugaaauuuuuuuuaucauuaacaauugaaguaauaaaacaggcuucauuuauuaauaaauguuucauuugauuuauuuuucuaauaguuucauuugugaggauuguggcuuuuuaucagcuacuuuaacacuuguauggcuuaaaaacaagcaaacaaguaaaaaaauacugcagauaacauuugauuggucccuucagcuugguuguguaauuaauuacuucacauucuuugccuuugcugauuuuuuuuuuuuuuugugguacuauugagucucaucuggaaagauuguaaauugcauucuugcuuauuauagaauggggaagacaaguauuaauaauuuucuaugcauauuucuguuauacuuucuguuccuaugguucugaugugaauguguccuauuuuguuggaugaauggccuuuuuuaguuguauagccaaagacauuuaguauuuucugguucuuuaaggugauguauuauuuuguaaaaggaauuuuuuuaaguauuuggaaaauauuuugacaaauggccuugcagcagccacaagauaaugucagaaguaaggugauuuuuuuuuuuuuaaauuugaaugacccagccaaaaugagguuugaauuugucauacuguuauaauacuaauagaauguacccucucaguuuauaguauuuuugaguuuuuagaguaaaugaaaauuuuauuuuauuauauuuuaaaaauaacuucuaagucuuaguagcaagauggaguauaauuccaguuuuuauuuucuauggaauagacugguaaacuggagacccugaagcaggaauacccagaggccuuuaugugcuacacaucauuuguauaaaguuuuauaugugcaaauuggguacauaagcaguucuccauuuuucuaagggaaugcaauaaauguagcaucgugaauaaauauaacuuuuauaauccuuaaag

SEQ ID NO: 4559 - RNA, 5136 nt, Mus musculus
ucacacgcauagaccgagaagcuagcauaaguaagugccagcacucugcucuccuuuaacaagugaugacaagcucucugcaccucccuguuccagaaacagccgcaucuucuugugcagugccagccucaucccguagacaaaauggugaaggucggugugaagagauuuggccauauugggugccugguuaccagggcugccaucugcucuccacauggcaaaguggagauuguugccaucaacaaccucuucauugaccucaacuacauggucuacauguugcaguaugacuccacccauggcaaauucaauggcacagucaaggcggagaauggaaagcuuaucaaugggaagcccaucaccaucuuccaggagcaagaucccgcuaacaucaaaugaggugaugcugguguugaguaugugguggagucuacuggugucuucaccaccauggagaaggucgggcccacuugaaggguggagccaaaaggguccucaucucugccccuucugccaaugcucccauguuugugaugggugugaaccaugagaaauaugacaacucacucaagauugucagcaaugcauccuguaccaccaacugcuuagucccccuggccaaggucauccaugacagcuuuggcauuguggaagggcucauggccauaguucaugccaucauugccacucagaagacuguggauggccccucugaaaaacuguggcgugauggcuguggggcugcccagaacaucaucccugcauccacuggugcugccaaggcugugggcaaggucaucccagagcugaacagaaagcucacuggcauggcccuccauguuccuacccacaaugugucuguggaucugacaugcugccuggagaaacgugccaaguaugaugacaucaagaagguggugaagcaggcaucuaagggcccacugaagugcauccugggcuacacugaggaccagguugucucuugugacuucgaauaugucuacagcaacagggugguagaccucauggccuacauggccuccaaggaguuagaaacccuggaccacccaccccagcaaggacacugagagcaaggagucccuaucccaccucggcccccaacacugagcaucucccucacaguuuccaucccagucccccauaauaacaggaggggccuagggagcccucccuauucucuugaauaccaucaauaaaacuucacugcacccacaaaaacaaaaacaaaaaacaagugaugacaaaauguauauguauaaguauggcuauauauacaaauacacacacauaugcauauauacacauauacagauaauguacauauauguauaaauaaauauaccacacauauauguguauauauaaaauacuagccgugugaccuguuuccgagucacucacauuugcaguagugacacaccucuguccaauacuuugaagguggcauaggccagauuuucuucagcucggucaguagcuuuuuccuaccugaccauuuucaucugaaugugucuugauaauccccuacagggcucaggucugcaucuccuucccacauagacagaucaguuaacacucacaacguguuuuuccugaacccuuuuacguugcuccagggagaaugaagcuugugagguucaaguugcaguuuacacccgaguguugugugacccuccugguuggggcugguaggacgaggaggauucuuugguuuuguucuggggcagagcaagagauggucaugagcgugcugccugguggcuuugauuagaucguguacaugagcacucagagaaacagacacuccagaguaugccccaccucagagcuucuaggcacaagagagauucagccucagaaugcucacucagaacucaguuaggcuuuccacugcgaugacacgcccagaggaacccaagucaguccguacuagagaugcuugcaaaugcgugcucacugaggcacggcucacggcagccacagaagggaauccaccuaugugcccuuccacagucggcagaugaaggaagcaugguguguaaguacagcgaaguaucacccagucguuacaaagaacaaagucaggcuuuuacagaaaaauugauggggccagggaucuucucguuaaguaaaauaagcuaaauccaaaaugauaaggaucacauguuuucucucauauacagacuaugguggggggagaaacauaaaaauaggagggggaauauuagagaaaaaagaaaucaggggacaauuggagaugugaggaggagacugugagaaaguccacugcgugugcacagaaauguugaaaugaaacccauuauuuuacacaguagcccgugucaacaccacuuauucuggagccuccgaucucaguaaaaacccugccuccaauaaaaccaagugggcaucacuggaggaaagaugcucaagguugacaucugagcccuacacucaggcauacgggacauaaauucucacacuaaagguaaauaucgcuguaguggaaugguuuuuagaaaaucaaaaguaacacuaggcaugggggagaauaaugggggagaauauuauuaauacauuauguuguagccaggcacuugggagguagaggcaggcagauuucugaguuugaggccacccuggucuacagagugaguuccaggacauccagggcuauacagagaaacccugucucgaaaaaccaaaaacaaagcaaagcaaaacaaaacaaaacaaacaaacaaaaacccccaacaaaacaaaacaaaaaaacacauuauguugugguaaggcuaggccccacacuaagugguuuuccaggcugagccuuagcauagaagacuguuucacagccagauuuugacuuuauuuugagggagaaaaaugaccucagcccagagguagggguggggcagaaauggcaccaucggucgacaccaucauacccuccugguacugauaaaugauuaauccugggaacagaaagggagccguuggugaguugaaacuguaggagcaaauuaaaucaaaccaggcccaaaaauuuaucagacaugccagaccaaggaaagcaaguaacuccgucuccuggauaucccccuagcaacagacaccuaacacaaggauggcacagcacaucucuugucagacacuuggcugacaagcacggacucccugacugucccuuggguuggucugauccucugcuguugauguggccuacuugaccgcucaucgauccacuuguuugccagucagguaugacgcucuguuuccugcaaggcccguuuccuguggcucuuggucuugguugggccuuuugcucacagcuucucuauccaaccuggacuccagcagcuuccaaagcuccucccuccuggagcugccagcuucauuaucuuaccaauuuagacuccgcccaccccugagaccuuuucaacucuauacaacccuuuucaccugcauucauucuguaagcaacgcauaauaauaagcaaggagauaaauagacagauuugcugugugcuaugagcugugagaguuaaaaauuaguaaucaguuaaggccagucuggucuacauaguaaguuccagaauaccuagggcugcauggacagacccugucuuauauacaagacaaaacaaaauguuaauaauuuagauucuuauaaaagauucaacauuugcuucagccaggcuaccaagauaugcagauuacauggcaaauugcugucauugaaacugcugaaccuuguaaauuuaucucuauucaguauaucuugacauuuuuguauuugucucuguuucuggcauugcaugcucaugaccguuauguguaugaaauugugaaggaaugaauuuugaaacagguauauuuaauaagguaguauuacauacuacaaaacuccaaaagcauuguugggaaauccauaaagaagaaaauguggaagguguagguagacagaggaccagugcuggcccagcucuacaccauccuaaggccagcagugucgaccuaguagauccuaagucagccucugacucuuccuugguauuucucccuuggggacuugcccggaguuacagagcaauuggaacgaggcugggaagcugagcgggccucuagcaaugcucgccugucuuuaguucuuacccuuuuuucuuccuccucuucuuccuucuccccuccuccccuccucuuccuccuuccuuuccccuccuccuccauuccugcuccucuguucuucccuuuccucuguuaguacucaccuccaugucugcccugagacaggaucucacguagcccaggcugacuucaaacuuacuguguaacuaaggauaaccuuuugcuucuccuaccucuucagccccaggguugggaugauaagcagguaccagcacacccuauaugagcuguuaaggauuuagcgaggacuugguguaucuuaccaacugcauuccaucccuugccucucacucacuucaugggaagccgagcugccagcucuauuucagacucuguaauaaaaaaugaucaaagaguuauuugacuuacaguaacagugguuuucugaaaaucaauaccaacucugaaaugucuuccguuguuguugguuuauccucugcuggccugaagcccacacgaugaccuuuaguaauucccauggcuaucuuggcaguggaagucuucaaugugggaaacuguucucugugaaaguugauaaagcgccccacggcugagggauucccucuaaucugucaguggaaaucuuuucguaagugcuggcaagugcagcgggccacuccucgggcuccugauggaugccagagcauccuuuacagaggauguuuuaaaagcaaacguuugaagugagcaccagggauccauagggcugugcaugcggcggcaucuggcauuuauaaucagaacaaaagcucucuuccucuuucuuaaucuuuaucccagaugcaagcauggcucaguaccaagaaaguuugcaguuuuucuucccagagaaagcuaaccuagaagcagagaaggccacugggaaguggccaugggaacguggguuacagcuuucauccgucccauuccaugucuaaagaaccacug

SEQ ID NO: 4560 - RNA, 34230 nt, Mus musculus
aguagggaagugagguguggcauuuuaauauuucaugaagcagauuauauuuuauguguaaggcaugugucucaaaggaaaaaaauccaaauauacaacucuaaaaauguuaucaauguuuaaugugaagauuaaguaacaaaucaauuaaagauuuuuuacuuaaacuagcuucauuuccuccgaauuuuucuaagaguuagaaauuuaccauuacacuuacuaguuuagaaccaccagaucuuacuucugaaauaucuaauaccuuaaaaaauuauaauuuuaauguuagcacaaaauuccuuccuaacgcuuuguuuuagaaaacuuuccgccgcagccaaagagaaccuauuuuugaauuacaguacugcaaggcacauucagagacucaccuccuuuaaaacacauaggagauacacucccugaaacaggauuuuaaaguccuuggacaacuggaaauccuacaaaguucaguuaaaaccccugcccucuggcgucaugcaccuugugugaauucacuugccacguguguaaaugacacuuguuccugaaucuggagugcaacgccgaggacagcggagacagcagcccagagacuggcagcugggguggaaggugcuaucgccuccagagacucaccaucucuacuauuuucaaagacuugaauuuaauauugggguaauuauaccagaaauaagaauuucauuuuucuuaagauauaucuagcaucaauuuuuguacaaagaaugauaagugaauuauuuuguucaguacaacugaaaauacaccauuuaaauccuucuaccaaauuuaaugcagcuuaauuagggagcagguaugccuuuuccucuaaauacuuguggccaaacaugucuaacuguaacugcaaaugaguuuaagagguagauuuuuuuuuuccaugaugaauuuuugucaagaaaauaaaaacaaccacugaguauauuuucuuaaaguauucgggucuaaugaaaagaaaaauaaaagauagauaugcuauagguuacagccugacauuuuaacagccacaguauuggauguuuugugaccagauacauuuucaguucucucagggucaaaauacgagucugccaacuguauugaagccuccuccaccgcccccaccaguuggcccacagcuuccuggugggucauugucaucaaauccauugggucggaacgaacaggaagcagaugcagcuugcagggcccgggcucgagcauucaauucuuguuccuaaaauucaaaguaauguuuauaaaauuaauuugcuaaguagaauggaugaguauggcgcgcacacacaccuucucaaacuguguuagucucuaccaagcaagcauacuucauuucaaaacucugacaccaagacaugcacaugucuuuaaucccaguacucaggaggaagagacaggugaucuuugaggacagccucaucaacagagauuucuaggacaucuggggcuacacagagaaacccuguuugaaaaaaacuaaacaaaauaaaauaaaauaaaauaaaauaaaaacugacaucuaucuuugcuaucucccacuaaaguacauaguuaccuuuggaggcagagaggacaaauuccucacguaacuguaguaacaaauaaauacuuuacaacagaggagggucaacuccugugaaacaucuaguacaaaaggaauggaauucuucaacccauuuuauuagugugugaguaugacagguuggaaaugaugccugaaguuccccucuacugcuuccugagguuagagagucaggcagauuuggaggaacagcaguaaguaagugaggccuaucucuguacagaacucuccccacuaguuuauuugaaaguuucccaggaaaucaaugauguuugccuaugugucaaguacaugucagaugcuuaauaaagacuaaugcucuuauuuuagaacaucauuaguuacugggaagcugagauggccuaaugaugaguuccacauuuggagcccacaugguagaagaacugacucccacaaacuucucuuucuucuacaugugaacaacauguaugcacacacauacucauucaaaaaaauguauaauuaaaaucauuauucaguuuuacaaagcgcaucugugaauaaauaacggcagaaucacaagguagggugcaaaacuggcccuaaaucaacaaugagaagaauggcugcucauggucaaaugccacauggcucgaagagauggguaagccagagcaaucuguggacuuggacuguauccaaggaggaguagcugugguuauauaaugugccugccagcucaauuguggaaaccagccagcuucucaucugauaaacauuguaacauugauaaucuguuuucuucagaaggaagggcauaccgggccuuguaguauacuacauuuuuuuuauacaucuuccuauuuugucuuagugcucuguucuucucacaaccuccaaccuucaaauacugugaucuguaaggcugagugacacaggcaaggaagagaugacccgauacauucuauuucuuuuaccuggauauuaagccaucugcauaaguguuaaugguaagucagucuaguucuaauauucuaauuauuuugcuaaguuaauuuuuguaacacuagaacacugccauaccccuuuuaaaauguaucauguaucauccuuuagauaguuuguaauucaguacauuugaaagccuuugaauagcccuguaauuucauuuauaaguuacugugguuccuuuucuguuuuguggacaaggucuccuuaggugucacaugccagccuccaacuggcaaucaaucuuccugccuccagucccuuccuguuugacuugcuggcaugccccaucacaccuagcuucugguggcucuuuuuguugauagaaaguugagaaauuucucucucucucucucauacauauacacaaaaccaaacaaauuugaggaccaauuaacaucaaaggaaguaguuucuugaaaaggacauacucuugacaaagcccucucaugaaacuuuugcuccauagcuuuuccucaguaaauguucuuuauuccuuggcucugugguaaaucuuugaagaacacaaacauccuucacauuuucauuaaauucuuuaucugauucaucugaauguuaauacauuuuccuuaaaauauggacaaaaagagccugcaggaguuaaaguucagccuguuugcugugcaggccuaagggucuguguucaauagaacccauggagguggauggaaagaacugacuguacaguugccucugaccuccauggcuguaccacaccccacaauaaaaacggaaaaaaacuccaaacaaacaaaaaacaaaaaaccccucuuuugcggguaggaggaacugaggggcaggaggaaacagaacauugcaucaaguuucuguuucuauauggcaugauuugauaauacuuuguaacuaacaugacaucauuugcaguuauaaacaacugaggcacagcuuugcaauuaaaaauaaagucuuauauauugcagauaaccggcaauauuucauacuauauguaugacgaguggaaauacauacauccaaucuuaggcuucaguauccuuggaaaaugugucaacuuuaaaguuagaccauuggauuaagucuguuacucaguacuguucagaaaugcuaucuaugcuugcaacucaccugcaaauacagcuuguuguccuuuguuauggcauccaucagcucuuucuguagggguggaucuccauuggcccagacaccacuggcuggauugucacugucuaugccauuagcucugcuuuguuuuuuguacaaaagcacauaagcugugucuuuuggaaaccuacuugugauuuucugaacugacugaaaugaaguaaaugucacccugcugucauuaaauaaaaaccacucuugugacauuuccuuauuuuccaaguccuguucaaugacuguauuggggcuuucuaccccuaguaaacaacucugggagggugcuaaugccagacuuucagacugggggcacaucugguaugaagacucuguaccugugauguuucuggcauaagaguaguaauggccacucucagaggacacaccagagugcacaacaacagaacuuaauagguagggcacuaauuuggggcagaaagcuucuucagucccagaagguuuuaauuuuuuagguagguucucauuaauaucagugaagucaacaucuacagaccaacucugggacaaggaagagaaggaagcaguucuuuuaacuggcaacuccaaaaccagaggcagugacacauugucuaaaauuuuucuucucacaugguacuucugaucguaggagaaucucaggagcguaaggauaagauacucaggcuccuccgugauuugcauaguuuucucugcguucuguagagaggcacagcuuucacaguaguauugguucuccccaguaagaaccucuggagccagaaaguaguuuaguaagucagucacugaaguugugcuuucaccuccuggguucugagguacaucuuuacugaugagaaucuuugcagauucuucagggacagaagagcuuucagcacagugaaacucaacaggaggacugccuaauacucuuugauucacaacugagucgcagacaaaggcagcuguugcuggauuauaaacuacuggcucuucuucugggucagcgacacugguuugcauuagcccaucaucuugagcacuggguaacgaagcuguaucuuggaaagacaggucuuccacagaagggcuaggacaaaaggcuagcgaaagaucugugaaggcuucaacuuugugugagguacucccacaguuuaggcagcagaugugaguccguagcuucccuccaaacauuuucucuauuagagucuucucacugucaccuguaccaggagacucugugggcacugcuaccuuacuggucaccucuuguaaacaaguuucagcacaguccagaccuuccgaaggcuuaugugaggacugaacucgcaagaucuuuucuucuucauggagucugcaagaggguauauuuuuacacagccaagauuaaugguauuuauguuugagaucuugguagcuuauaaacauguuaauucaaucaaguaaaaggcuuaaagucguuuucuccuccuuuaugcaagagugugaauaguuauaggaaaggccauaaagagcaugcucgcuuuccacacacacucagcucacauccccugcgcuguuauacagcgcgcacaccaagcugcagucagccacacgcacagucugccucacacagcucccucugcuugacaucucacagccuagcaccaagaaagcaauacuacacugaggaaggcaggaaggcaggaaggaaggcagggaggcaggaaggcaggcagggaggaaggaaggcaggcaggaaggcaggcaggcaggaaggcaggcaggcaggcaagaaggcaggcaggcaagaaggcaggcaggcaagaaggcaggaaggcaggaaggaaggcaggaaggcaggcaggcaagaaggcaggaaagaaggcaggaaggcaggcaggcaggcaggaaagaaggcagguaggcaggaaagcaggcagaaaggcaggcaggaaggcaggaaagaaggcaggaaggcaggcaggcagguaggaaggcaggcaggcagguaggaaggcaggcaggaaggcaggaaggcaggcaggaaggaaggcaggaaggaaagaaggcugugcaggcugacuaccuuuacuaauuauucaucccagagaaaggaguggacacagaaauaugcagguaaaauaggucuuauuguuaaugaauugguuaaaggacaccacaaaauaccaagcucuuagaguuuaccaacuggcucuuaaaagauuuuggucucagggcccuuuaauauuuauuaaaaacaaaacaaaacaaaacaaaacaacccaaaaaacaaaaaaaccccaaccccaaccaacuaaacccuauagaaccagcaucccuaguggguggugcuguucucaaggaucauggagcuagccuugcugauacacacugcugagggcaggcucugaaaauuuuauagccuggucccacuuuccuuucucucucugcuucccaacugccaggcaggucucaaauuccugcugccaggcauucucugccaugacauacuauaugcucugugaaacugugaaccaaaauaaacuuuuguccucuguguuguuucuagccaugguauuuuaucaagcaacaaaaaagcaacauauguauguacaugcauacauaaagauauuuacuauauuaaaaacaauaaaauauauaaaacaauauaucuagaaugaauccaucacaaauuaauuuccagcuuuuuaaguaagcaucauugcuucauacuuuuuaaguauucuaagcauguggcaccacagaagacagcuggguuccguaucugcacugcauccuuccuuacugauaucuauuuuuacaagaugaaauaggcaaagaagagccugaacucccacagauauguaguuaagaggggauuugacaagaguucugaaguuuuagcugccccuuaggaaucccaaaccaaacuaagaacaaagacaacuuuauaaacacacagucacacauggugcuuuaaagaucaagucugaaaucaguauuaagagaaauaagguacuaagagaagacagcuuaaugaacuuuaaaccauuuguaccuguccagcagaaaccugagguacucagagcaguccuguugugaccugggaguaaaccacggaggucuggaagccucaaaaaauauccgaggugcguaagcuucccucuugauuguggaaaggaaauucgagaaagugacucuuacagcacaaaccagugacugaaccucauaaagauuacucccauacuccauuuuuaccaaaguaugccaggcauggguacaaagcaaaggcagaggcaacuuuuuuuuucccccccccgagacaggguuucucuguguagcucuggcugucuuggagcuuacuuuguauaccaggcuggccuugaacucagaaauccgccugccucugccuccugagugcugggauuaaaggcgugcgccaccacgccuggcgcagaggcaacuuuuacauuaagcaaccauuagucauagccaugggaccugcucagauggaaccaccaaguggacacgggugacuaccacaggacucaggugucucuaacuccugcuauagggucccugcuuuuaucccucucugacacacauggcuuugagucccuaaaucuuuuuaaaaaaacggagugugagaaugauguuaaugaaugcaaaugauguguguauugugugugcaauaggaaccacacauauuuacuuugcugaaaauuucugucauaagucauacauguggacuuauacauacaccugccucaaguguggaugggaacaugcugguaaggacuuugauaaucucucauucucuuuauuucucucugcuugcuugcuuucuuuacuuucuguuuuuuuuuucuccaugccccuuucuuucagaaauucaaaggcaguugauaaugaaccugggucaugcgugcucaaaucuuagguauucucacaaaacgaaaaugaacagacauaaaaaaagaccugguuaaacugaaaauguggauucucucuguauuugaaauauuuguggcauaaagugacagugccuuucuugguucucgaaagcauggaaaccuccugaaggguuucuuuccuaauaucucugauuuaguaaauaaauaaaguauacauaucuacacagaugcacacacauguuuauguacgaaguauagaauaaaaauuaauucaguaaauuaguagaaaacaacaggagaggggagagagguuuugguguuguuugguuuuggcuauggucuaacgcugcuuuuguaguauuaugacuggcuugagacuugugucugagccucuugcccccaccucuggaauacuggcaaugcagaagugugccaccacaccuggcucagaggcaguuuuuauuccccuggguccugauguuaauuuguuaacauauuucuccaggugaaucauauccucugaguguaucaucaacucuaagccacuacagucaucucaaacuugcucucaauucuuuccauuuaagaaauuuauuucaguucuaaagacugucauuucccgaccauggucagacugugagacaguggcaauuagagugaaccagaaaaauaaugauguaugcuuuaugugagcaacauaccuacauuuauguauguuugagccuuagcuagaaguucuuugagagcaagauccccgcuugauucuuaccagacuauacacagaaccucugaacaugucuguucaaugaacuuaacuaaaggaccuauagacccugccucaaguugacuuuacugaauuaauuuguggauauaaaagaacaccacaaaguuuuaaguucaagagcuuaagagaugaacaaugaucuauaaagauauguaaguacaauaaaagaauaccuaaaagaaaauaaagaaaagcugagugugguagcgcacaccuuuaaucccaacaccugggaggcaggggcuggcaaaucucugugagcuuggucuacaaauggaguuauaagacagccagggcuacacagagaaacauugucuuguaaaacaaaaccauuaacaaaaggacuacagagaaaaaagccuagaccauaauuauuuuguguucacuauuauaucaauauauucagucucuguaaaccaacaaaacaaaacaaaacaaaaucccagccacaguccauucuuuucaguccuuucuuucaucccuccccucuugucucuuugagauaggagcaugcuacauagcccagacaggcccugaacucagaguccugccucagucuuuugaaugcuggagugacagguguaggacauuaagccuagcuuuaaaguuuuuuucaugaaggaaauucuuuauuaucaggaaaguagacuugauguguagcugguuagcaugauaauccucugcagggaagggaagcagggagaagagacaagaguucuagguguccaggcagagucccugagcacuugcaaguggaucuuuauuuuggacaagacacaugacacacaauuccaccaguuaaaaagacucaugaugauauauaguuuaaagaacaugaucaugcaguuaauauguacauauuacacacauaaauacucacuuguguaugagccaaaaaagcaaaaagauguuguaauuuuuucauuaacgaauuacacccauuuagauuuaaagauaauacuugucuucugaaccugaaaaagaauauaaaauaauauaauguuaucuauacacuuacgcacuuuuuauaaagaagcucaaaggaagcuaguuuaagaaugguuauccucaguguuaccugauguguagggcagccccuuacuaacaguuacuagcacacuuuguugaguacucauauucucccuccacuuccugagugcuggaucacagguguaugccaccacaccuggcuucuagcauacuccuuuuacuucaagugcuucuagaugcuuguaggguccccuggagcuggagugggcugccugucaugggugcugggaaccaaacucccagccuucucucuggcaccaugacuucgcuuuuacaucugucuaugcugauguuuaccuaugugucugucuguagacuuauaucauaaagauggcggggugacaauaaaugaaugggcucuuguuacauggccugguauggaugcugucauaguucuauuuucugggucagcaaauauaaauuggcuaaauauuaauuuaacuuauaaaaaucaacuuaaaguugauuauuucaaaaguaaaaaauauucuuccaucaaaacacaucaugaacuuaggaugauuuuaaaaagagaaggaguauggcuagagagguggucagcaguuaagaguacuggcugcucuugcacccacaagacacaaguaucugcuguaacucuaguuuuaguggcuuggacacccucuuguggcuucuacagcaccaggcccuaaagugggguacagacacucaggaaaaaccucagcauagacaaaguaaaaacaaagucauccugccauagagaaggcucggaguuugguuccuagcacccaugucacccaugucacagccaccuguaacuccaguucuaggggauccuacagccucaguaugcucuugaauuucuuucucuuucucagagauaaaaggggugugcuacaagccagguaugguggcauaugccuguaaucuggggugaaucuguagucugcaauacucagagcgcuguggcaggaggaucaugaauuugaggcuacuaugguuaagaccuaauuuuccuaaaauaagaaaacaggaauaacauuugcuaaauugugaaaaaucuaagacugauugauugaaucaagugcugucagagguauagggucacagguacaagcauauauugguauaaaaggucaaauuuggguuagggagauggucccuggguaaccucaugucuccagcccucaugugaaagcugggcaaggugcuucuccucugucacuccaggcuccacgaggagccauaaggucaagaagugauugaggaagcuauccugacaucagccugugcacucuaagcgcaucuacaagggugaacauuccgcaccucucccccgccccccguaguguuuuaagggaaaauaauuuggcauagccuagucaaggaaagucucaucugugcaugguuagagaaaugcuaacuaugagcaaaacacugauauuuaccaaaaauauagguaagcaaaugucaggcuggcaagguggcuugcugggaaaggugccugccaugagagccugaugacccgagcucuagucaggaacccguggcaagguggaaggagagaacggacuacaguuuucuuccagcuucuacacacacgucauaggaugcaugcgugucuccacccagcacuaacaaacacauuuaaagaaaaaagauaaacaccaugucaagugacugacaagaaaaauuucaacagggcuccuuccagauguguguacacauacauuaauuauaugcaacuguuuuguauuagauaacuauacaaaaaaguucucaaacaaugcacauagcggauauguuugagaauguaugcaucuugguuuuuacaaguuugauuuuuuuaaaccaaggaaaauaauucauguauuucuuaagagaucucccuguuuugagauagcauuacuggcugccacaacacucuguaguuacaagugcuuaggucacuacuuuccguaagaugacauagcuagcaaggugaccucugguggugagcuauggacucuucagucuuacauuuaauaccacgugugucuaagaguaucccuuugucuuaaaacaaguugucaaauacaaacuaagcaacaagaaaacugaauggaagcccaggcacuuggguuucauagccugggacaaacaacaaaacccuaaagcugagcccacaccuaacaguguuuaaguucuaacagcuuccaucuuugggucagcucaauuggcacgauuuaaggaaaaguugacaauuauuuuguaucuucaaggacaauuuuuuuuggggggggaggggagacacgacagagccucauguagucuucgcuagccuuacacacaucauguagacacgaaucaccauaaaggucuuucugcuuuaucccaagugcugagauuacagaugcgcaacagcaagccuggcuuuaugaggugcuggggucaugcacaggcaggcgcugcacuagcagcaggcacccuagcagaugugucuccagcacaaggaugucacucagcuaaggacugauuucagguuuguugcauucaaaagaaaaggggcuugaaagaaaauucacaggaaugccuaucuguucaggaaccaacaucuuggcauggaaucaaagcuuagguuuccuaaaagcaaaaaaaaaauuaugauauaugaauuaaaaaaaaauacaguaggacaguagaggcaaggaaacaggguaaaacacaccagucaucaguaguguagggcacauaaacuuuuuggaguaggcucagccaaucccuuugguuacauuacaaaaacaucaagucauacugauuacaaaucaaacaguggcauuguaaguacaauguacaagcuaauucgucagaaucagaaacgcuggcauuucacuguuccuaggcauuaagagcaguuucauuuuuaacugaggcaagugauggcacugugaacacuuacgcugcuuacacgggagcagggacgauucucuccuccucccaucuccucagcaccuacucacucacuucuacuucaaaucagaaaguucacauuuaaacuuacucuguagccauaaacaaugcuuguaaaacacuguucauguaacacguguuucccagguuaauaagaccaguuuuuccaguuucagauuuuccagaaagucuagacaagcaagaugccaaagcauuggauugagaaguccaggcgcuuugauugagaaucagcuuaaucuuuucuucacugggcuuaggaaaguccuagaucauaaagaaaagaaaguuuaaaaaguaaagagaaaacuauuuuuuuauuuaaacaacucaacaccacaaugugggacuucccuacugacauuugagcugucuuugcucucacucauucuguacaugacagagaacauacagucagccuuuaaaacaucacacuacaggggagagcuaauuuuaaugguugacuuuauugaaaaacaaggaggucauuuuggguauguacgugagguugucucuagagaggguuaaguagaaguagacucacccugaaugugggcugucuguccuucucugcucagggauggacaacucucauuacagcugagagcugcuccuguuaccaugacucgauacagugauggaaaaggcccuuggauuguaagccacaggaacccuuccucugagucacuuaucacagcauccacaaaauagccauggggacaaaugccuuccagaaucuuguuaagagauuuaaaauuuuugaggcaaaaaucucaauagccuaagcuggccaggaacucacaguaauucuccugccccaguaucccaagugcugagaucacaggcacaaaauaucaugcuugucuuaaaauacuuuaaaagccaauggaacaaugaguucaaguugcaugucaauuacuuguauucaaauucuaugaugaaaacagagcaugacucugguguacccaguaccagcccuuagaaauggcagccuacagucaggacgaaaagggaauacauaaugauccgacugugaaaagucaaacucaaucucaugguugccaucuagaaaauuacuacuacacacaguccucuuacguaguaaagcaggaaauaaggaaauaaaaaucuaagugcaaaugauuucacgccccagcagaacaaugggcaauaagagaugcuggaaaaaucauuuaugcuuaaaugauuagcuuuucuagaccaaguguggugguuugaaagaaaaugccaccccuacucccuuggaccauagggagggggacuauuagguguggccuuguuggaauagacguggcuuuggagguaugucacuagagguaggcucugaagucucaugcucaagacagggcucuuccugcugccugcugauccagauguagaacucccagcuccuuuuccagcacuaugucuaccuguaugcagcccuguuuuccaccaggaugauaaugaacuagaccucugaacuguaugccauucccaauuaaauauuuuccuuuaggauaguugcuguagccaugguaucucuucacagcaacagaacccuaggucaccaaggucgccaucuacuguuuaccccacagaggacugacacuuugagauggcauuuucagcugcuuuuaucuuguuuguuuuugcugcugacagcuacuugaaaauacuuuccuugggcuaagaaguaagcccuuuguuucugaguacuggaagacagaagaaugucagucaauagacauggcagcaaugagggaaggcaguaacaaucucucaaguccauagcaaaugcuucuguguaccguuuacuucugaaagggcagugucauaccagcuacacacaggccuaacugccuugugacccaggccuaguucuuaguuucaguuagcugaacagaugcaaaaacagcuuguccuuaauuuaucuuauauacauuaguaaggcaaugaggccuauauauuguauuugcuauauuaauaucaugauuagaauugauaucuaguaacuucugacuaagccugaguuuagcucuccaaguucuuggcuaggcucugaauuugcagucauccacuccucaacacagauucaccaccuuuuuagaaccuaucuuuuauaaacuugaaaaucagguaacauaauuuaaauagaauuucuaaaaaauauagacauccauaaaguguacacacagaacaaucaaaacaggagggaauugagcauugccuugcuucuaagaagauggacuaauuguugcccaugucugacacugaagcagaacugaugucugcaugcaucuagugcagaauucccucaccaaccaauuucuuuaacagcucauaaauuuaaagugacaccuuuuacuugaugacacaacauaauuaagaaaugugguuauugaucuagcauggcgauagcaaauaagagauuaugcccugacauuaaugaaacuaccaccuuaaaaacagcucauuacaguaaaggaauacauuuuaccaaauuuguuccuuauaucauaugucgcucaccaagucugguacaaaaagccaucauaccuuuacugccuccagaauaggcucauagagaucugggaauccggaguaaugguacaucauacagugaaccaacucuguuaacuguacuaggaaggcugugcuggaagguaggccaucacuucugaaggagugaaccaaguuaacuauaugagggacaaucugaaaagagaaccgggacaagcacucuuaauucacacaaguugacagcagaaugcaaucacuacaugauaaacacauacuuuucuauacguuucaucacuuuuuucccuuaaagucauacacuguucaauuggcaagcuaaaucuaauuuuuuaaguuauauaacuguaauugcauuaaaauguuauuuuuuuuauuuaugugugugugugcgagugugcacacacgcaugcccacagaggacagauggggguuuugaacuccccuggagcuggaguuacaggugcuugugaaccacacaggccugggugcugagaacugaacucagguccucuagcaagcacucuuaaugcugagcucucucuccagcuccuguaauugcauuuaauaugcuucuccuucagcucagcaguaaaaagcaucuauuucucaccaagcccaacaagcucaguuaaaucucuagaaccuagaugguggaagaacucacugucaaauuguccucugacuuccacacacacuguaauuauauuaaauaaaauguuuuuauuaauacaauuaaagauugugggaugccuuagcagguaagguccuugcuaccaaaugcuagggaccugaauuugauccagagaacugacacccguaaauugucuuuugaucucuguauguauuauacacacaauccaccuaaaauacaaacuacauguacaaaggaguuucagucauuguugcauuaaaaaaaaaaacacuuucagguaaaagugcuauggucauucuauugaauagauaaauuguuuuuuaaaaaccucuuuugaguaccauggcucaagccuuacccuuguguaugccaggcaagugcucuauuagugaguuacaccacaacccaaccagauuauuuaacagaacaauguuaaaacucccggaaaaaaaaaaacaaaaaacaaaaaaacaaaaccaauacaaugaaaucccccaacugaaauuagugaaagagcuccaucuaguguuaaguuuaaauuuuucaacugaaaaaaaaaugaaaaaaguacauagcaauguguacugcaaaagucucuauauguaacuaaaauugugcucagcuaauaagaauauauuguuugauaauaacaggaauaauaccuuagauaggucauauccuuauuaacaaaacagcugcuccaaaaauaaugcucauuauuaaaauauuuaauacugguaaaugguaaaauaaugcucuuucacuuaaaauuagucuaaauaccaacuuuuuuuuaaaagcagugaaugaaguauuuuuauuaaucuccccacacccaaggcucagggaacaucagaagaguugucaaagaaagucagaguuuauaguugaggggaggggcugugaaaugcagacuuuugacaugacaugacugcuuuacaccucaacuaauagcgccuguaguuuccugaacaauaccugaacaaaaucaagccaguugcacuuccaguaugaauuggagaggggucccagagaggcccaacuuuuggcagaaaagcuguuguucagguuuugugcaggucauacuuccaguaugaacuguagaggggucccagagaggcccaaucuuuggaagaagagcaauucccaguugaugguuucugauagagugaaagucacuguacuuuggggacaugguugcuaaauaccaacucuuauacaaucaaagauuuaagagauagccaagggcuggugagauggcucaguggguaagagcacccgacugcucuuccgaaggucuagaguucaaauccccgcaaccacaugguggcucacaagaggagaucugacucccucuucuggagugucugaagacagcuacaguguacuuacauauaaucaauaaauaaaucuuuaaaaaaaaagagagagauagcaaaaugaaaauucuauuuuacagaaacggcugacaucaugauagaauauuuuuucaacuaauuauuaaucauaaucugauaccauauauaaguauacuucugaacuaaaggugucccagguucuuuaugcauaauaucuuugcagcuccaaauccugauaaacuguauucacuacucuaucaggguugucucaccaaacaguaccucaaucaguggucagauucugcaauuaaccacuguuaauugcuguccugcacugucuggauuucuucugugucaaugcauuaagucacauuguaccuuuuaugccaucuuuuaagaccugaauucuaugacaguuaccugauguggccauacuacagcaggugcguauaguaccacauugucagcuucuaggcugguguuccagaauugggugguuggaaaggaguuggcacaaaaagugcacaauuuaaauuuaugauuuaaaauuuuaaucuuuuauuaauuaaagcuuucuuggauaacucauacacacacauacacacucuacuuacuuucaugcccuaccuucucucuauauuuuaacuuuaugcauuuggauauuuccccugcacauauauccauguaccacaugugugccuggccuggugcucacagagaucagaagugggcaucagguuccccagaaguagaguuccagucacguggaguacuauuuguguacugggaauuaagcgcagauccacaggcauaguagccaagcucuuaacugcugagguauaacacaccucccuuggauccacugauccuaguaccccuuucucagucaguuuaugauuuugugcuguguucucaucagcuuuccucaguuaccuguggcugccugggguguggacacgccagcuaccagauucuaaugaguuuguucuuuugucugguuuuccucccucccuucucgucaccucgaagauacaacccagguacuccugcaucuuagaagagugcucuaucacugagaauaucccuggcucucauuucuacguuucuaacacaucucagugacaauuucauaaaacuaaaaucugucacuuucuugcuaaacuagacugaaauccaaaauuauuuuguuuucucagagguaaagggagaaagaugaaagaaaaggacucuaaaagugaauuucauaguuucaagucuuccaaaguucuuccagucgagaaauggccuucacaaccaggcugcagucuugucuccuaucacauugucaauggccacucucaucaccaacaaggaaaugagaugcaguccuuucccagcaguguagacugccacucaagcaggcugaugccuucuaaacgauuccaaguuagauuucauguguaugaguguuaccugaaacaaaggugaauacccagggaggucagaagacagugucagagccccggaaacuguagcuacagaugguugugaaucacgguguggguguugcaaacugagccuggguuguucaacaagugcucuuaaacacugagcuaucugucuagcccccaaauuuaaauauuuuaauguaugaaauuaaaugcauuuagaaguuacugcaauacucauucaacuacuugaggaaauacauauagcuuaauuacuaauuuugcuuuuuuuuuccauuuuaacuaugcaccacagauccaucuaaaauaaaauuuucuuuuuauuaaaaguauaugaagcugggcagugguggcacacgccuuaaaucccagcacuugggaggcagaggcagguggauuucugaguucgaggccagccuggucuauagagugaguuccagggcagcugggccuguaaccuaucacaacuuccuggauuauucucagauuucuaaacaggaaauguaaugaacgaguaugcuguucaucccaggcugcugcucagauguaccuacaucacauaaaccccuccccacacggagugucauacugggucuccaagcuagcuuuaguugaguuuugcagaguauucacaaaguacuaggucuugauuuucaggcuuuacuuagaucaaaaacuucaaauuucaaaccuagauauuucuuaaauaggugauuuaaaacugcuuuaauccaacagcuaaaauuucagccaaacauuucaacuuuguuauuucaacuuccuuuuucagaaagagauagaggaaaaaaaacaauacaaaagguaaggaaguaccuucuuuuaacaaacuguaagaaaagggaguaagaguucagcagagccuaugugauucuccacagagguuaaggaaaggcaccagugugcaaggccauaugcuguaauuccuuucccacaacuuuugaaaagaaaagaagccuuuauucaaauauccuguacguaaugaugucacaagacaggacauuuuguagacauuuuacaagacauuuuauuuauauauuuaaguaaacuagcucaaaauugaguaauuugauaaagagagaaucuuaugguuucaccaucaauuucacuacuaugagagcaauuacuacagaaaucacucauccaaaauaugaaaugaagugacuuauugccaagguuucccugaaacaaagucuguggauuuccccgaggacaagguacuggcuagcccaugugagccuagggugcugaggcuaccuugcuagcugcgcacaaccaagaggaauuagcucugcucuucgucaugucuccugacuugucaugguguauuagugucccucagguugggaggggcugcugcugaguuucuacuccuguaaaacauggucagaccuuggagaaugcagauaaccacaugacaguuuccugaaacaaacagauuuccaauaacauucugucauucuucacauguaguaaccgacaacugcaaucaaaucaaagccagcaagcaauuggcuuugggugguugguagaacugugacuaucauuaagauggaguuaggggcugagaaagaagaaaaagcccuacaccuaaggcuaacuuguuucuguaguuucugccacuguguaaagguuucuacacugcuacuguguaaaggcacccugcgaugacagcucccuauagcaguaacuucaguugcuggcaaugguuguugaguggggcuguuuaggugaaguacaaacuuucucaaaauacugucuuugucaggauauucuacaaacucaauuuguuaagaauuuauaguuacaugacaugcuauaaagcuaaccuacagucuuuucauuaaguauccacuaugagcuauacuuugagaacaagcguuucugguucagagagcuuccaccguacuuaccacauggaaugccucaggagaaugcugaaaacuaagcagcauaugagagaggacugcaagagcaccaggucucacgagaggaaaccaaagucgguuaaaaaccugcggaaggagacaccauucucagaguucacagcuaaagauuuauuaacccuucucuacagcugacagcucguuagugucagugucccucuuccuugauagcccuauccuaacacauuauuagaagaaaaugaaagaacaaaggauugaaauuaaagaauuuagugaucuaaacaauucucaaaauucccacauuaagugaaaauaugcaaaugagguuacgguucccuaggucgcuaucauucaguuuacucgaucaguauuuacugaacaccuacuauuauuuggcacugcuccaguuacuauaggccauccauggcuuauggcuaagaggacacguacaagauaauaaaaagaaauaaauagcaauacaugcuaaaaauacaaaguagaacacagugaccagcaaacacugggcggccaaggagucugccauuuuaaagaggguguuaaaaaugacccagaaaaaugugacagcugaguguaaacugagggauaucagcuccacagacagaacaagagcauuuaugaacagacagacaguauugcaaaggucccagaccauccagacuggugcgccagacaauuaagggcaaugucacugaaguaagagaugaaggcgaaaacaucuggacauaggaugacagaagacagcaacgggagcucuuguguaacauguaaggaacuaaaggcaggaccaaggaagcugcugaaaucaauguaacaagagaugaugacuuuacaccagcaacagggauguaguggguuaaaggaguaguaggauucugggcauuuaaaguuaguaaauuuuauaggacagacaguauuuuauagacaguaaaaagagaaggguugcuccaaagacuagggcccaagugaguggaagcuauugaagauagcuauuuaucaagagggagagcaccagguuugggaguaaaaaucaguagugagaguguggauuuauaugaauuuagcauuuucgaguauaggcuacucacuuccugaguuagucagaacaugugucuuuguaauguauucuaucuuucuuuugcuguaauaacucuuuuuauggaaaaaagcacaaacaaaaucuaaauuaucuccacuugucccccuuccccuuaagaaaagcaaaagagaaagaucugaguuuagauaacugaaucaaugugugaugguuugaguuaagaguggcccccaaagccauauuugaauguguagucagcagggaguagagcuauuugaggauuagaaggacuaggaggugugucacugggggugggcuuugagguuuccaugccaaguccagguucugucugccugcugucugaggaucaggaugcaaagcucucaacuacugcuccagaguuaaugccugucugcuuccagccaggaggaucaugggccaauccucugaaauuguaagccagccccaauuaaaugcuuucuauuauaagagcuuuucuuggucacugccuuaguuaggacuucauuguugugaacagacaccaugauugaagcaacucucucucuuuuuuaaagaauuauuuauuuuauguauauaauuacauuauagcugaauucagacacaccagaagaaggcaucugguccauuacagaugguugugagcuaccacgugcugggaauugaacucaggaccucuggaagaacagucaguguuccuaaccgcugaggcaccucuccagcaccaugaagcaacucuuauuaaaacaaaaccaaacauuuaauuggggcugguuuguaauggcgggaacagagaccaggaagauaugauacuggagcugagaguucuacaucuucaucugcagacagcagaagggaacugugucugggcagagcaucagcauaggagaccucaaagcccccuccccuccagcacacacuuccucuaacaaggccacaccuucuaauagugccacucccugggccaagcauacacaugugagucuaugggagccauucuauucaaaucaccauagucauggugucucuuugcagcaauacaauaguaacuaagacaaaaugaauaccuaauucaagggcaaauagugaacucaaauauaaaucuguuaugccuuaaguuggacaccuuauuuaaguccauguagcaucuaugguuacuguaugguauagaacacuugcaguaaguuuggauuaagaagaaagugggaauggcuaagaucaaaaauucaggugacagcagaugcuggcguggauguggagaaagaggaacacuccuccauuguuggugggcuugcaggcuuguacaaccacucuggaaaucagucuggcgguuccucagaaaauuggacauaguacuaccagaggauccagcaauaccucuccugggcauauauccagaagaugccccaacugguaagaaggacacaugcuccacuauguucauagcagccuuauuuauaauagccagaagcuggaaagaacccagaugccccucaacagaggaauggauacagaaaaugugguacaucuacacaauggaguacuacucagcuauuaaaaagaaugaauuuaugaaauuccuagccaaauggauggaccuggagggcaucauccugagugagguaacacauucacaaaggaacucacacaauauguacucacugauaaguggauuuuagcccaaaaccuaggauacccaagauauaagauacaauuugcuaaacacaugaaacucaagaagaaugaagauugaaguguggacacugugccccuccuuagaagugggaacaaaacacccauggaaggaguuacagagacaaaguuuggagcugagauaaaaggauggaccauguagagacugccauauccagggauccaccccauaaucagcauccaaacgcugacaccauugcauacacuagcaagauuuuaucgaaaggacccagauguagcugucucuugugagacuaugccggggccuagcaaacacagaaguggaugcucacagucaguuaauggauggaucacagggcucccaaugaaggagcuagagaaaguacccaaggagcuaaagggaucugcaacccuauagguggaacaacauuaugaacuaaccaguaccccggagcucuugacucuagcugcauauguaucaaaagauggccuagucggccaucacuggaaagagaggcccauuggacacgcaaacuuuauaugccccaguacaggggaacgccagggccaaaaagggggaguggguggguaggggagugggaguggguggguaugggggacuuuugguauagcauuggaaauguaaaugagcuaaauaccuaauaaaaaauggaaaaaaaaaugggaccccuugugcuuuucuauguggugguauguauaugugagagcagggccaauguaucuguuauuucaggagguugugaaccacccugguaguauguugggaacauugcucugguagucuucaggaccaguacauucucuuagcugcugagcuaucuucuaaguccaguacauguuuugauuuaucauuauucauaguaacaaucaaaaaaaaaaaaaaaaaaaaagaagaaaguggaccaaagaucaguuagagcagagccugauaaugucagcaaaagacaagagucaagagggcauaauguccugggaauuaaacaaagacaguguuuuaaugagggagugacuuggcugaggauguagaucaggggugccuaacucugggcuggauuccuagcacugggaaaaaccaaaacucaaaacaaaaauugugaucaauuguguccuggguuagcaacacagaaugcagagucucaaggcaguuagguggggcguagugcuagaagucugacauuuugcauuuggagccaagcauggugccuuucuauuugugugguuaagacaggaggauugugaguuugaggucagucugggcuccauagugagacugucucuaaaaaccagaagauggaaaacaaacaucaucaaaccaacacuaacaagaacagagaaacaacuaaagugaaugaaaacuguuugaaaacugcaaacuaguuucaaaugacuaucucugucucacuggcuuugcccccaaaaccuauuuaaaacaaaaccaaaacuaggaacauacucagaauuguaugcacuccaaugggcucaucuacuucuacucaccaguucuauuuucagcaaaguaacaucuaucaaaauaguaaacuucugaacagcugccaguccuuucaggagagcaauuacccacguaucuacaugcugagccaauggccaggacagccagucaaucauucugaaaaaaaccaaaacaaaacacaauuaucaguauuuaaaauacuuucaacauuaguuaggaguagcaagaguuacaauaaguaaccauucaguuugugacucaguauuuacuacugagcuucuaguaaaaagaaauauacagcaaugaauguaacuguggccugucuugaagcacuuucuggucuuguaagcaauauauucccauaagacuuuaugauaaaugaucacuucucauaaaugccaaauuucuaauggacgcuugauauagggauaucaaaaacuuguucaacaguaaauguuauaagaggaguuuaaaaaucagacaucugaugucugaguaucaacgaagauuucgcuuuuuggaaagcaauguaauaugaaagacgccauuuaaagaggcuacaaucugaacccugaagcaggcuccuauacuucuuucaaaaucguauacacaauggcaacacaaggaaaccuccgaucauaacagacacugaguaugcaaauauucuaaugaucugguuuacauuaccgucuauuuccuuuaguaaauaucaagucacuucaauggaaaaaagacaaaggaaucuggguucugauggagccgcuuucuaaagcuagauauauagcacacugaagaccaguacaacucuuuggaaagcagccaggcuacauguuuaugaaaccuggugaagcaaucuauuuagauggauuacauacuaauaaaagaguaaggaaaauucuuagguuucugaaggcuuaaaaaaaucucaauucaugauucauuaguugggggaaucuaacauuggaaauacucaucauggcuguacccuccaucaauuauuaacacaaggagcaauuugcauccuucuaaaaaguuuauuauuaaugugugagcauguauauaugugugugggaucugaggagugagcuuagguugccagaguuguggagaauauaccucugagccaucucaucucaaugacuguacaaacgcaaacauaaauaccgacgacauaagccggugaccgagagaacaccaccacgacaucagcacugcccagccauuuaccuuagggcuggaguaccgucuuugucagucuuucaggacagggucucacaguguugcccaagcuagccuuaaacuuguggcaauauucuguuguaggcccccaaguguuggguuucuaguaaugcacaacuuuuuuuuguuguuuuaagauuuaaauguuuuaaaaaguaugaggaucccaaguacaauguacacuaacugcuguuaucuaggugcccuccauccucuacacaaauuuuguuuucuuuuuuccugacuucucaccauaacaguaaugguuccaagucacuggcacaguugcuaucuuccaacuauugcagggcugcuuuucagaaaaaucuguaggcauuauacagagacuaaggaagacacauguauuucugaagaguacauccacgucggggcagguacugagcugagcugguagugcuuuuugguuggccauguacagagcuuugcgagggaucaucaacacuuugaaaguugacacugcuacagauuccagcucuugagaugaggaucagaaacuaaaggucauccuuggcuacuaucaaguucgggggugggcagucugugaugcaggagaugcugucucagaagguaaacgcaagcuuaguauggugguacaugcuacuuuaauuacagcacuugggaggcagagaggcagaggcagaucucuguuaauguagaguccagaaaaggauacauaguaagacugucugaaggaagaaaaaaagcaaaauaaagccuauagcaguauguuguauucucaugcugggaugauaccuuagagguagaacucuugccugguguaugccuuggguuugauccuagcacugcaaccuccuccccuaaauguauacccaagcauuguuuaugauaugggaaaauuuaaaaaaaguguaaccugccaccgguaaaggaaagaaagguacacuguaguccugacaacacagaauaccauggagguacgaggacacuguaagauggaaagguaagaguagggcaugguggcucacuuguaaucuuacuuaugagcccaaggaaggagggcugcuauaaauuagagaauagccugaaucagaaagugagaucuaagccagccugggguagacuagagucuccuccuacccuccccccaaauaaaagaucugagauauuauuaaauuaaaaauacuagugaguuaagaaaccccaacaauuuauuuuuguuuaaauggaaaugagguagugugggcauuuccacuuggcucuuuggacucaugucagaguagaccaagugcaugcaaggccaggaccuucaccucacuuuaaagagagaauuuaauggaaggaggaguaauguacacucacaaugugucuuuacuauuaacaaucaucuuauuugccuuuccuggugugucuucuucaagcuucucauuuuauaagucuccauucuaccuuacacucaugugcugaaaucuaauccugaaucgagaaaugaggcccccgggagguacagugccaugaccaaggcccauaugacugggauuaguacuccgauaaaggugcuaaggaugacugacccugcaccuuccacuauucaagaacaugagagaaguucuauggugucuugagcucagauuuucaaccaucagaacuauaagaauuguacgucugcuuauaaauuagccagucuaagguuuuuuuuuuuucuuuuuuuuuucuguuguugugauuuguuuuuaacagcagcccagacagaagucauucaugagacaaauaccugagugcuuacucuauagcuagaaaguaagguguuagguacugagaguguuauggaccgauaugccuucugccugugauuuggaagaaguuaggaaagcugucaacuguccaagacucaucaggcaguguuacugcuauuugcacuauguaugcucuagauguuauaaugcacuuugggauguacuucaguuucaacaguggccguccuuuguguauuucagucuuacagggauuguguucuuucaucuaauacuuuggauuccaguguuuguaaguaaggccauuuauuccuacagcucaaagaaauucacacagcuuuaaaaccauaacauuacauuaaaacaggcagguagcugggugguggugcaggccuuuaauuccagcacuuggaaggcagaggcaggcggaucucugugaguuugaggucagccaggaccaccaggguuauacagagaaacccugcccugaaaaaccaaaacugggcuggagagaugguuaagagcacugacugcucuucugaagguccugaguucaauucccagcaaccacacaguggcucucaaccauuuguaaugagaccugaugcccccuucuggagugucagaagcuacaguguacuuacauauaauagugaaugaaucuuugggccugggcgagcagggccggaacaagcagaggcccuaaguucaauucccagcaaccacaugauggcucacaaccaucuguacucaguguacucauauacauaaaaauaaauaaauaaaucuuuuuuuuuuuuaaaagaaaaaccaaaaccaacccccauucccucaaaaacccucacuaaaacaacaacaacaacaacaacaacaacgacaacaacaacaaccaggcaauauucugaaaagcaacaaaaugaguuaaccauaaauuauggaauauaauauaaaaccaacuuucacuuuccaaggcagcuugaggacuccagcuuucagucuuauuuggccuacuguuuuauagauaggacauuuuauacagauaauuugacuugagcauucuuuugaaaauucugaggcagaaaaaccagauucaaguaucaagagaccccuggggcugagggccaucuuccucucagaagcugcuuauauaguguagcccaugucauuucacuguuccuggccuguuuccuacuugaauguuguuauaccuguucuuggaauauauuuacauaugacuaaccagacuauuguaacaguacagauuugaucucacaaaugguagagacagaaaaaugacaucuaagaauuauucuuuaaaaaaaaauuauuuauuuuuauguaugagagcucuaucuaucuuuauaccuuacaccugugugccagaagaggucaucagauuccaauauagaugguugugagccaccaugugguugcuggggauugaacucaggaccucugaaagagcagcuuuuaaccacugagccaucucugcaguauuuuuaaagauagaauucaagggacuagugauauuaaucaacauaagagaaaggauggaguuccuugcuucuagguuugugaucugagaaauuagaagcacaaguuacagaugaauuggcuccauuaacagagcaccacaaagaagcagcuaguaugaguugguguugggcggugucagugcacauggcacuuucugagagcccaacauagaauaguucaguucauguaaauguaauaagagacacagaagccacuguaauccuuaccugcuuaaauagacuaaauacacagacagaaagaauuaagaaacaaaaauuaagcagcuaaauaaagcucaagcucaauaugaaaacaauucugucacugaaaugcagaaacagcaucugggacaagcacuauggaugggcaucaucauaaagaaaacugagcagguuuuaagacaaggcagguacuccccaacuuaugacagcacuggauaucuacuguagauggaaaauaccauaaggaguaaaacuuccaauauaacaaccuaccaaacacccugauuuagccauauauuccacuugagaauacugggcaccuacucuguuugugugacugacuuagagcuguuggcucacuguaucuacucggcauuuuaagaaagucucaaauuuauaugguagcccagaaaaagcagaacucagaaaucaaagccuagcuucuacggaaugcuuguuuuggaagcuucagaaaguugagaaaucauacugagccacccuaaugucagacaccaccugugcugacuguccguguaauacagagccacagcacugcuuccucuuuuacuuuaguguugugggcaccucaauaaacccguccuuagccaucuuaaugacaacugcaaacuaccuagucacagccuaccccucuucuugucuaucguuucuaacaaacucaucauuuaacauacuaagucauccacuguauguucuaaaacaaaaucuaaauccaaaacaaaagcaauguuauuauguagcaguauggcaagaaagccaggccuuuuuaacuagggcacccauuuuauacauuuuaacaucuuaaaaaucaggauaaaggcuggagucagugaagugcuacuacauuaccguuggucucucugacuagaaagcagcuauuuuuaucaguuugcucaaggaauuuugagggccugacacucuuguuaagcacucaguaagucacucugaaugaauaacuuaguucaagcauaaaagugcugcaaagggcaaauuaguuucuaguuagacauggcgaguaagacugcagaucacuuaggauauguuaucagaaacagcugacaaucaggcuggcagcaccuguagaugcccagugacagugugcuauuacuuucaaaauguuaaaacaaaaaacagcuagggcuggagagauggcucagugguuaagagcauugacugcucuucaagagauccugaguuuaauucccagcaaccacacgguggcucacaaccaucuguaaugggaucugguguaucugaagacagcuacaguguugcucaugugcauaaaaaauaaaucuuuaaaaagcaaaacaaccccccccccaaucacaaacaaacgaacaaacaaaaagaaaacagcuagaauaagggagagaaaauaguuuucacgaggcaaagguaggggcuggagagauggcucagcagauaagagccacuuguucuugcagaggauccaaguuugauuuucagcacacaacuagugggucauaaacauccauaauucuaguugcaggagcugaccucugacaccacgcaugcacacaguacacauacacauucaaaggcaaaacacauaaaauaaaauaaauaaauccgccgggcgugguggugcucgccuuuaaucccagcacuugggaggcagaggcagguggaucucugaguuugaggccagccuggucuacagagugaguuccaggacagccaaggcuacacagagaaacccugucucgggaaaaaaaaaaaaaaaaaaccacaaaaauaaauaaauccaaagagacaggggcaggugucaccuauugagucuggcugaaagagaaaaauaaaaucucuaccuagcuaagagaaacaaaaccaaacccagaauaauacgaggauaacaaccacccccccccaccccccccacggaagaaggcuacaggaaacaguaaggaauagauugucuagaaaaacaacccgcccacacaacuucaaaugagacuauaggaagguugagucauucuaauuaaucuggagaaaccacaaauuuacuuuuagauuuuaguuuuagaaauuucucaaaguuuuucacuauccaaaaacccagacuauguccugguauguaaacaucaaaguaccugcagagagcuugggucauacucgcaucuuuuacauuugggucggugguuaggcuccugaugaggacugugaucaucugcagaggaauaugcugcaccaggcuugccaaggcaaccgagggcucaaaggaugcaucuaguuguuaaguuaaaaagacagacaaauauggcauggagauuaaaagugaaguacuagugcaagggagaaaggaaacacacacacacacacacacacacacacuaaaggugcucuaggaaguuauguuauacaucauggguagacucuaaaucgaaaguuaaaccauaaaagagagguuaagaggaaauagcaauaaucacucauucuauagccacaucacuaaauuagaaaaacuauuguuaaguuuuuucaauaagcuacuuuguuguuaauaguacauuuauggguuuagauaauacuuuagaaagcaguaaucggggguggguaagaaccagucacauauucuaauuuccaugucagaggcucauauuauaguagucauuacacugcugugauacuugaaaaaaauuuuaagaguagaaauuaaggcgaagggggcuggcuuugcuuauauaaaauguaaggcaucaagauggucugcuucaguaggccagugaaagacuuggaaaaaacuuguaacagcuaugacaaacuacaaguacgauggcaggaaggggaagcaaaugccccugguaucuauuaaacacaucagacuaugggagccuuuaaagcucaacccucauuucuggccaggguaaaaaggggcagcuccacuaaguucagucucacucuggcugugaaccuauuguuucacaacugccagacucuaaagcaccuucaaguacaggcacagacaagguucuaggugagguuuucuaagaccuuucccuaguuuuugaggaugcaguucaugauaaagacaagacagauuacuuacuaccuaagcugucacacuugucuucaugcucccuggaucuccugucacauacacugucgugaagugaaaugcugacauuuaaaaaacacuacaugguauaccgggacaauaauagauugugcgcgacucaugaauuaaaaaaaaaugagaccaccagaaaacaggaaaaaaaaaaacccaacaagauacccuucaauaagaugauagguuacacacaguaauaauaacucccugcggcaagcaucauauaugaccauuagucaguaaugacuagaagcuuuucauccuggcugucagccuguaagaauuccaaaacuggagcagaggugguguaauuaaaugacuuguucagugacaaaggucuuuggacuuaggcauccucaauguuuuggcuccagcguaccauucugaacaaggcagugaagaggaguaacauuuugcauaaggguauuuaguuuugcucuccaucaagaacgucucuuacuggaggaguuacucuaauaaaauaggcuaccuggccucuuucaguacccccaaagagaaugcuuccgggggggaaaaaagcgcacuguguugaugagacacacguguugaauuuccaagacacacuuuucugaaauaaugacccuuaccuguggaagagaugcuugcaaaaacuucuugcagagaagguagcagcguggagggcucagccuuccaaauauucuguaguaagguacucacuuucguuaccugggagacauacucccguaguuccuucuccugaguggacacgcacuggaaaugaccuaucguucgaaccagcuguugacagaagguaacugacaguuucccuuuggggacgcacugcacgaaaucggucaggaggucgcucagccgggcacagagcacuggcuccggccucucgcaaaccauucgcaggaccuccaccuggagcaggcugaagagauccagcaccgacgggcagcucauaaucagcuucaggccguugugaauguaguccaggauggcgacguccuuccuguccacugagugguagcccugcugaaggaggcccaacacgaaagucuuguugaagaaggacucgaacuccggccggugguaccgcgcguaggccuccagcaccugguggcccacuugucgcuggaaaggguccuggcccuccaggaugaggcgggucgucaggucaaacauggccucgcacugcgccucgucgagccaaugcuccgcgaacuccaccaccuuccgcacaaucauccgcuugaggggcagcgggugcgaggagcucaccaggccuuccagaaucuuguccaucgucgccacucugcaaggccaggcccuggggauaaagagcuggcagcggcagccccggggggcagcaaagcgccccggcggggaggaacuuggagccaaccagcagcaggaccggccaccgccaccgccgccucagcagccacauuuaucgagugggaaggcccauccgagccgggacgggagcgagcgauucugggacgccgaaaggcugcggguccccgcgguccgccucaggggccggagguccgcauaaggcugccucgcugggcccgcgaccucucccagccuccgggcgcagggacccuccaggcugagcuggaaggugaggagcgccuucgugucccgggucagugcggagccccggcucccgcgggugggcaguuaaaagucgcccuggguugagucaggaggcacugucaaugcgaguaccucgaucugccaaggagaggagccggaggcgcggaacacccugaacccggaagcagaaauacuggcgaauaggaagugaagcuccga

SEQ ID NO: 4561 - RNA, 34230 nt, Mus musculus
ucggagcuucacuuccuauucgccaguauuucugcuuccggguucaggguguuccgcgccuccggcuccucuccuuggcagaucgagguacucgcauugacagugccuccugacucaacccagggcgacuuuuaacugcccacccgcgggagccggggcuccgcacugacccgggacacgaaggcgcuccucaccuuccagcucagccuggagggucccugcgcccggaggcugggagaggucgcgggcccagcgaggcagccuuaugcggaccuccggccccugaggcggaccgcggggacccgcagccuuucggcgucccagaaucgcucgcucccgucccggcucggaugggccuucccacucgauaaauguggcugcugaggcggcgguggcgguggccgguccugcugcugguuggcuccaaguuccuccccgccggggcgcuuugcugccccccggggcugccgcugccagcucuuuauccccagggccuggccuugcagaguggcgacgauggacaagauucuggaaggccuggugagcuccucgcacccgcugccccucaagcggaugauugugcggaaggugguggaguucgcggagcauuggcucgacgaggcgcagugcgaggccauguuugaccugacgacccgccucauccuggagggccaggacccuuuccagcgacaagugggccaccaggugcuggaggccuacgcgcgguaccaccggccggaguucgaguccuucuucaacaagacuuucguguugggccuccuucagcagggcuaccacucaguggacaggaaggacgucgccauccuggacuacauucacaacggccugaagcugauuaugagcugcccgucggugcuggaucucuucagccugcuccagguggagguccugcgaaugguuugcgagaggccggagccagugcucugugcccggcugagcgaccuccugaccgauuucgugcagugcguccccaaagggaaacugucaguuaccuucugucaacagcugguucgaacgauaggucauuuccagugcguguccacucaggagaaggaacuacgggaguaugucucccagguaacgaaagugaguaccuuacuacagaauauuuggaaggcugagcccuccacgcugcuaccuucucugcaagaaguuuuugcaagcaucucuuccacagguaagggucauuauuucagaaaagugugucuuggaaauucaacacgugugucucaucaacacagugcgcuuuuuucccccccggaagcauucucuuuggggguacugaaagaggccagguagccuauuuuauuagaguaacuccuccaguaagagacguucuugauggagagcaaaacuaaauacccuuaugcaaaauguuacuccucuucacugccuuguucagaaugguacgcuggagccaaaacauugaggaugccuaaguccaaagaccuuugucacugaacaagucauuuaauuacaccaccucugcuccaguuuuggaauucuuacaggcugacagccaggaugaaaagcuucuagucauuacugacuaauggucauauaugaugcuugccgcagggaguuauuauuacuguguguaaccuaucaucuuauugaaggguaucuuguuggguuuuuuuuuuuccuguuuucugguggucucauuuuuuuuuaauucaugagucgcgcacaaucuauuauugucccgguauaccauguaguguuuuuuaaaugucagcauuucacuucacgacaguguaugugacaggagauccagggagcaugaagacaagugugacagcuuagguaguaaguaaucugucuugucuuuaucaugaacugcauccucaaaaacuagggaaaggucuuagaaaaccucaccuagaaccuugucugugccuguacuugaaggugcuuuagagucuggcaguugugaaacaauagguucacagccagagugagacugaacuuaguggagcugccccuuuuuacccuggccagaaaugaggguugagcuuuaaaggcucccauagucugauguguuuaauagauaccaggggcauuugcuuccccuuccugccaucguacuuguaguuugucauagcuguuacaaguuuuuuccaagucuuucacuggccuacugaagcagaccaucuugaugccuuacauuuuauauaagcaaagccagcccccuucgccuuaauuucuacucuuaaaauuuuuuucaaguaucacagcaguguaaugacuacuauaauaugagccucugacauggaaauuagaauaugugacugguucuuacccacccccgauuacugcuuucuaaaguauuaucuaaacccauaaauguacuauuaacaacaaaguagcuuauugaaaaaacuuaacaauaguuuuucuaauuuagugauguggcuauagaaugagugauuauugcuauuuccucuuaaccucucuuuuaugguuuaacuuucgauuuagagucuacccaugauguauaacauaacuuccuagagcaccuuuaguguguguguguguguguguguguguguuuccuuucucccuugcacuaguacuucacuuuuaaucuccaugccauauuugucugucuuuuuaacuuaacaacuagaugcauccuuugagcccucgguugccuuggcaagccuggugcagcauauuccucugcagaugaucacaguccucaucaggagccuaaccaccgacccaaauguaaaagaugcgaguaugacccaagcucucugcagguacuuugauguuuacauaccaggacauagucuggguuuuuggauagugaaaaacuuugagaaauuucuaaaacuaaaaucuaaaaguaaauuugugguuucuccagauuaauuagaaugacucaaccuuccuauagucucauuugaaguugugugggcggguuguuuuucuagacaaucuauuccuuacuguuuccuguagccuucuuccguggggggggugggggggggugguuguuauccucguauuauucuggguuugguuuuguuucucuuagcuagguagagauuuuauuuuucucuuucagccagacucaauaggugacaccugccccugucucuuuggauuuauuuauuuuugugguuuuuuuuuuuuuuuuuucccgagacaggguuucucuguguagccuuggcuguccuggaacucacucuguagaccaggcuggccucaaacucagagauccaccugccucugccucccaagugcugggauuaaaggcgagcaccaccacgcccggcggauuuauuuauuuuauuuuauguguuuugccuuugaauguguauguguacugugugcaugcguggugucagaggucagcuccugcaacuagaauuauggauguuuaugacccacuaguugugugcugaaaaucaaacuuggauccucugcaagaacaaguggcucuuaucugcugagccaucucuccagccccuaccuuugccucgugaaaacuauuuucucucccuuauucuagcuguuuucuuuuuguuuguucguuuguuugugauugggggggggguuguuuugcuuuuuaaagauuuauuuuuuaugcacaugagcaacacuguagcugucuucagauacaccagaucccauuacagaugguugugagccaccgugugguugcugggaauuaaacucaggaucucuugaagagcagucaaugcucuuaaccacugagccaucucuccagcccuagcuguuuuuuguuuuaacauuuugaaaguaauagcacacugucacugggcaucuacaggugcugccagccugauugucagcuguuucugauaacauauccuaagugaucugcagucuuacucgccaugucuaacuagaaacuaauuugcccuuugcagcacuuuuaugcuugaacuaaguuauucauucagagugacuuacugagugcuuaacaagagugucaggcccucaaaauuccuugagcaaacugauaaaaauagcugcuuucuagucagagagaccaacgguaauguaguagcacuucacugacuccagccuuuauccugauuuuuaagauguuaaaauguauaaaaugggugcccuaguuaaaaaggccuggcuuucuugccauacugcuacauaauaacauugcuuuuguuuuggauuuagauuuuguuuuagaacauacaguggaugacuuaguauguuaaaugaugaguuuguuagaaacgauagacaagaagagggguaggcugugacuagguaguuugcaguugucauuaagauggcuaaggacggguuuauugaggugcccacaacacuaaaguaaaagaggaagcagugcuguggcucuguauuacacggacagucagcacagguggugucugacauuaggguggcucaguaugauuucucaacuuucugaagcuuccaaaacaagcauuccguagaagcuaggcuuugauuucugaguucugcuuuuucugggcuaccauauaaauuugagacuuucuuaaaaugccgaguagauacagugagccaacagcucuaagucagucacacaaacagaguaggugcccaguauucucaaguggaauauauggcuaaaucaggguguuugguagguuguuauauuggaaguuuuacuccuuaugguauuuuccaucuacaguagauauccagugcugucauaaguuggggaguaccugccuugucuuaaaaccugcucaguuuucuuuaugaugaugcccauccauagugcuugucccagaugcuguuucugcauuucagugacagaauuguuuucauauugagcuugagcuuuauuuagcugcuuaauuuuuguuucuuaauucuuucugucuguguauuuagucuauuuaagcagguaaggauuacaguggcuucugugucucuuauuacauuuacaugaacugaacuauucuauguugggcucucagaaagugccaugugcacugacaccgcccaacaccaacucauacuagcugcuucuuuguggugcucuguuaauggagccaauucaucuguaacuugugcuucuaauuucucagaucacaaaccuagaagcaaggaacuccauccuuucucuuauguugauuaauaucacuagucccuugaauucuaucuuuaaaaauacugcagagauggcucagugguuaaaagcugcucuuucagagguccugaguucaauccccagcaaccacaugguggcucacaaccaucuauauuggaaucugaugaccucuucuggcacacagguguaagguauaaagauagauagagcucucauacauaaaaauaaauaauuuuuuuuuaaagaauaauucuuagaugucauuuuucugucucuaccauuugugagaucaaaucuguacuguuacaauagucugguuagucauauguaaauauauuccaagaacagguauaacaacauucaaguaggaaacaggccaggaacagugaaaugacaugggcuacacuauauaagcagcuucugagaggaagauggcccucagccccaggggucucuugauacuugaaucugguuuuucugccucagaauuuucaaaagaaugcucaagucaaauuaucuguauaaaauguccuaucuauaaaacaguaggccaaauaagacugaaagcuggaguccucaagcugccuuggaaagugaaaguugguuuuauauuauauuccauaauuuaugguuaacucauuuuguugcuuuucagaauauugccugguuguuguuguugucguuguuguuguuguuguuguuguuguuuuagugaggguuuuugagggaauggggguugguuuugguuuuucuuuuaaaaaaaaaaaagauuuauuuauuuauuuuuauguauaugaguacacugaguacagaugguugugagccaucaugugguugcugggaauugaacuuagggccucugcuuguuccggcccugcucgcccaggcccaaagauucauucacuauuauauguaaguacacuguagcuucugacacuccagaagggggcaucaggucucauuacaaaugguugagagccacugugugguugcugggaauugaacucaggaccuucagaagagcagucagugcucuuaaccaucucuccagcccaguuuugguuuuucagggcaggguuucucuguauaacccuggugguccuggcugaccucaaacucacagagauccgccugccucugccuuccaagugcuggaauuaaaggccugcaccaccacccagcuaccugccuguuuuaauguaauguuaugguuuuaaagcugugugaauuucuuugagcuguaggaauaaauggccuuacuuacaaacacuggaauccaaaguauuagaugaaagaacacaaucccuguaagacugaaauacacaaaggacggccacuguugaaacugaaguacaucccaaagugcauuauaacaucuagagcauacauagugcaaauagcaguaacacugccugaugagucuuggacaguugacagcuuuccuaacuucuuccaaaucacaggcagaaggcauaucgguccauaacacucucaguaccuaacaccuuacuuucuagcuauagaguaagcacucagguauuugucucaugaaugacuucugucugggcugcuguuaaaaacaaaucacaacaacagaaaaaaaaaagaaaaaaaaaaaaccuuagacuggcuaauuuauaagcagacguacaauucuuauaguucugaugguugaaaaucugagcucaagacaccauagaacuucucucauguucuugaauaguggaaggugcagggucagucauccuuagcaccuuuaucggaguacuaaucccagucauaugggccuuggucauggcacuguaccucccgggggccucauuucucgauucaggauuagauuucagcacaugaguguaagguagaauggagacuuauaaaaugagaagcuugaagaagacacaccaggaaaggcaaauaagaugauuguuaauaguaaagacacauugugaguguacauuacuccuccuuccauuaaauucucucuuuaaagugaggugaagguccuggccuugcaugcacuuggucuacucugacaugaguccaaagagccaaguggaaaugcccacacuaccucauuuccauuuaaacaaaaauaaauuguugggguuucuuaacucacuaguauuuuuaauuuaauaauaucucagaucuuuuauuuggggggaggguaggaggagacucuagucuaccccaggcuggcuuagaucucacuuucugauucaggcuauucucuaauuuauagcagcccuccuuccuugggcucauaaguaagauuacaagugagccaccaugcccuacucuuaccuuuccaucuuacaguguccucguaccuccaugguauucuguguugucaggacuacaguguaccuuucuuuccuuuaccgguggcagguuacacuuuuuuuaaauuuucccauaucauaaacaaugcuuggguauacauuuaggggaggagguugcagugcuaggaucaaacccaaggcauacaccaggcaagaguucuaccucuaagguaucaucccagcaugagaauacaacauacugcuauaggcuuuauuuugcuuuuuuucuuccuucagacagucuuacuauguauccuuuucuggacucuacauuaacagagaucugccucugccucucugccucccaagugcuguaauuaaaguagcauguaccaccauacuaagcuugcguuuaccuucugagacagcaucuccugcaucacagacugcccacccccgaacuugauaguagccaaggaugaccuuuaguuucugauccucaucucaagagcuggaaucuguagcagugucaacuuucaaaguguugaugaucccucgcaaagcucuguacauggccaaccaaaaagcacuaccagcucagcucaguaccugccccgacguggauguacucuucagaaauacaugugucuuccuuagucucuguauaaugccuacagauuuuucugaaaagcagcccugcaauaguuggaagauagcaacugugccagugacuuggaaccauuacuguuauggugagaagucaggaaaaaagaaaacaaaauuuguguagaggauggagggcaccuagauaacagcaguuaguguacauuguacuugggauccucauacuuuuuaaaacauuuaaaucuuaaaacaacaaaaaaaaguugugcauuacuagaaacccaacacuugggggccuacaacagaauauugccacaaguuuaaggcuagcuugggcaacacugugagacccuguccugaaagacugacaaagacgguacuccagcccuaagguaaauggcugggcagugcugaugucguggugguguucucucggucaccggcuuaugucgucgguauuuauguuugcguuuguacagucauugagaugagauggcucagagguauauucuccacaacucuggcaaccuaagcucacuccucagaucccacacacauauauacaugcucacacauuaauaauaaacuuuuuagaaggaugcaaauugcuccuuguguuaauaauugauggaggguacagccaugaugaguauuuccaauguuagauucccccaacuaaugaaucaugaauugagauuuuuuuaagccuucagaaaccuaagaauuuuccuuacucuuuuauuaguauguaauccaucuaaauagauugcuucaccagguuucauaaacauguagccuggcugcuuuccaaagaguuguacuggucuucagugugcuauauaucuagcuuuagaaagcggcuccaucagaacccagauuccuuugucuuuuuuccauugaagugacuugauauuuacuaaaggaaauagacgguaauguaaaccagaucauuagaauauuugcauacucagugucuguuaugaucggagguuuccuuguguugccauuguguauacgauuuugaaagaaguauaggagccugcuucaggguucagauuguagccucuuuaaauggcgucuuucauauuacauugcuuuccaaaaagcgaaaucuucguugauacucagacaucagaugucugauuuuuaaacuccucuuauaacauuuacuguugaacaaguuuuugauaucccuauaucaagcguccauuagaaauuuggcauuuaugagaagugaucauuuaucauaaagucuuaugggaauauauugcuuacaagaccagaaagugcuucaagacaggccacaguuacauucauugcuguauauuucuuuuuacuagaagcucaguaguaaauacugagucacaaacugaaugguuacuuauuguaacucuugcuacuccuaacuaauguugaaaguauuuuaaauacugauaauuguguuuuguuuugguuuuuuucagaaugauugacuggcuguccuggccauuggcucagcauguagauacguggguaauugcucuccugaaaggacuggcagcuguucagaaguuuacuauuuugauagauguuacuuugcugaaaauagaacuggugaguagaaguagaugagcccauuggagugcauacaauucugaguauguuccuaguuuugguuuuguuuuaaauagguuuugggggcaaagccagugagacagagauagucauuugaaacuaguuugcaguuuucaaacaguuuucauucacuuuaguuguuucucuguucuuguuaguguugguuugaugauguuuguuuuccaucuucugguuuuuagagacagucucacuauggagcccagacugaccucaaacucacaauccuccugucuuaaccacacaaauagaaaggcaccaugcuuggcuccaaaugcaaaaugucagacuucuagcacuacgccccaccuaacugccuugagacucugcauucuguguugcuaacccaggacacaauugaucacaauuuuuguuuugaguuuugguuuuucccagugcuaggaauccagcccagaguuaggcaccccugaucuacauccucagccaagucacucccucauuaaaacacugucuuuguuuaauucccaggacauuaugcccucuugacucuugucuuuugcugacauuaucaggcucugcucuaacugaucuuugguccacuuucuucuuuuuuuuuuuuuuuuuuuuugauuguuacuaugaauaaugauaaaucaaaacauguacuggacuuagaagauagcucagcagcuaagagaauguacugguccugaagacuaccagagcaauguucccaacauacuaccagggugguucacaaccuccugaaauaacagauacauuggcccugcucucacauauacauaccaccacauagaaaagcacaaggggucccauuuuuuuuuccauuuuuuauuagguauuuagcucauuuacauuuccaaugcuauaccaaaagucccccauacccacccacucccacuccccuacccacccacucccccuuuuuggcccuggcguuccccuguacuggggcauauaaaguuugcguguccaaugggccucucuuuccagugauggccgacuaggccaucuuuugauacauaugcagcuagagucaagagcuccgggguacugguuaguucauaauguuguuccaccuauaggguugcagaucccuuuagcuccuuggguacuuucucuagcuccuucauugggagcccugugauccauccauuaacugacugugagcauccacuucuguguuugcuaggccccggcauagucucacaagagacagcuacaucuggguccuuucgauaaaaucuugcuaguguaugcaauggugucagcguuuggaugcugauuaugggguggaucccuggauauggcagucucuacaugguccauccuuuuaucucagcuccaaacuuugucucuguaacuccuuccauggguguuuuguucccacuucuaaggaggggcacaguguccacacuucaaucuucauucuucuugaguuucauguguuuagcaaauuguaucuuauaucuuggguauccuagguuuugggcuaaaauccacuuaucagugaguacauauugugugaguuccuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguucuuuccagcuucuggcuauuauaaauaaggcugcuaugaacauaguggagcauguguccuucuuaccaguuggggcaucuucuggauauaugcccaggagagguauugcuggauccucugguaguacuauguccaauuuucugaggaaccgccagacugauuuccagagugguuguacaagccugcaagcccaccaacaauggaggaguguuccucuuucuccacauccacgccagcaucugcugucaccugaauuuuugaucuuagccauucccacuuucuucuuaauccaaacuuacugcaaguguucuauaccauacaguaaccauagaugcuacauggacuuaaauaagguguccaacuuaaggcauaacagauuuauauuugaguucacuauuugcccuugaauuagguauucauuuugucuuaguuacuauuguauugcugcaaagagacaccaugacuauggugauuugaauagaauggcucccauagacucacauguguaugcuuggcccagggaguggcacuauuagaagguguggccuuguuagaggaagugugugcuggaggggagggggcuuugaggucuccuaugcugaugcucugcccagacacaguucccuucugcugucugcagaugaagauguagaacucucagcuccaguaucauaucuuccuggucucuguucccgccauuacaaaccagccccaauuaaauguuugguuuuguuuuaauaagaguugcuucauggugcuggagaggugccucagcgguuaggaacacugacuguucuuccagagguccugaguucaauucccagcacgugguagcucacaaccaucuguaauggaccagaugccuucuucuggugugucugaauucagcuauaauguaauuauauacauaaaauaaauaauucuuuaaaaaagagagagaguugcuucaaucauggugucuguucacaacaaugaaguccuaacuaaggcagugaccaagaaaagcucuuauaauagaaagcauuuaauuggggcuggcuuacaauuucagaggauuggcccaugauccuccuggcuggaagcagacaggcauuaacucuggagcaguaguugagagcuuugcauccugauccucagacagcaggcagacagaaccuggacuuggcauggaaaccucaaagcccacccccagugacacaccuccuaguccuucuaauccucaaauagcucuacucccugcugacuacacauucaaauauggcuuugggggccacucuuaacucaaaccaucacacauugauucaguuaucuaaacucagaucuuucucuuuugcuuuucuuaaggggaagggggacaaguggagauaauuuagauuuuguuugugcuuuuuuccauaaaaagaguuauuacagcaaaagaaagauagaauacauuacaaagacacauguucugacuaacucaggaagugaguagccuauacucgaaaaugcuaaauucauauaaauccacacucucacuacugauuuuuacucccaaaccuggugcucucccucuugauaaauagcuaucuucaauagcuuccacucacuugggcccuagucuuuggagcaacccuucucuuuuuacugucuauaaaauacugucuguccuauaaaauuuacuaacuuuaaaugcccagaauccuacuacuccuuuaacccacuacaucccuguugcugguguaaagucaucaucucuuguuacauugauuucagcagcuuccuugguccugccuuuaguuccuuacauguuacacaagagcucccguugcugucuucugucauccuauguccagauguuuucgccuucaucucuuacuucagugacauugcccuuaauugucuggcgcaccagucuggauggucugggaccuuugcaauacugucugucuguucauaaaugcucuuguucugucuguggagcugauaucccucaguuuacacucagcugucacauuuuucugggucauuuuuaacacccucuuuaaaauggcagacuccuuggccgcccaguguuugcuggucacuguguucuacuuuguauuuuuagcauguauugcuauuuauuucuuuuuauuaucuuguacguguccucuuagccauaagccauggauggccuauaguaacuggagcagugccaaauaauaguagguguucaguaaauacugaucgaguaaacugaaugauagcgaccuagggaaccguaaccucauuugcauauuuucacuuaaugugggaauuuugagaauuguuuagaucacuaaauucuuuaauuucaauccuuuguucuuucauuuucuucuaauaauguguuaggauagggcuaucaaggaagagggacacugacacuaacgagcugucagcuguagagaaggguuaauaaaucuuuagcugugaacucugagaauggugucuccuuccgcagguuuuuaaccgacuuugguuuccucucgugagaccuggugcucuugcaguccucucucauaugcugcuuaguuuucagcauucuccugaggcauuccaugugguaaguacgguggaagcucucugaaccagaaacgcuuguucucaaaguauagcucauaguggauacuuaaugaaaagacuguagguuagcuuuauagcaugucauguaacuauaaauucuuaacaaauugaguuuguagaauauccugacaaagacaguauuuugagaaaguuuguacuucaccuaaacagccccacucaacaaccauugccagcaacugaaguuacugcuauagggagcugucaucgcagggugccuuuacacaguagcaguguagaaaccuuuacacaguggcagaaacuacagaaacaaguuagccuuagguguagggcuuuuucuucuuucucagccccuaacuccaucuuaaugauagucacaguucuaccaaccacccaaagccaauugcuugcuggcuuugauuugauugcaguugucgguuacuacaugugaagaaugacagaauguuauuggaaaucuguuuguuucaggaaacugucaugugguuaucugcauucuccaaggucugaccauguuuuacaggaguagaaacucagcagcagccccucccaaccugagggacacuaauacaccaugacaagucaggagacaugacgaagagcagagcuaauuccucuugguugugcgcagcuagcaagguagccucagcacccuaggcucacaugggcuagccaguaccuuguccucggggaaauccacagacuuuguuucagggaaaccuuggcaauaagucacuucauuucauauuuuggaugagugauuucuguaguaauugcucucauaguagugaaauugauggugaaaccauaagauucucucuuuaucaaauuacucaauuuugagcuaguuuacuuaaauauauaaauaaaaugucuuguaaaaugucuacaaaauguccugucuugugacaucauuacguacaggauauuugaauaaaggcuucuuuucuuuucaaaaguugugggaaaggaauuacagcauauggccuugcacacuggugccuuuccuuaaccucuguggagaaucacauaggcucugcugaacucuuacucccuuuucuuacaguuuguuaaaagaagguacuuccuuaccuuuuguauuguuuuuuuuccucuaucucuuucugaaaaaggaaguugaaauaacaaaguugaaauguuuggcugaaauuuuagcuguuggauuaaagcaguuuuaaaucaccuauuuaagaaauaucuagguuugaaauuugaaguuuuugaucuaaguaaagccugaaaaucaagaccuaguacuuugugaauacucugcaaaacucaacuaaagcuagcuuggagacccaguaugacacuccguguggggagggguuuaugugauguagguacaucugagcagcagccugggaugaacagcauacucguucauuacauuuccuguuuagaaaucugagaauaauccaggaaguugugauagguuacaggcccagcugcccuggaacucacucuauagaccaggcuggccucgaacucagaaauccaccugccucugccucccaagugcugggauuuaaggcgugugccaccacugcccagcuucauauacuuuuaauaaaaagaaaauuuuauuuuagauggaucuguggugcauaguuaaaauggaaaaaaaaagcaaaauuaguaauuaagcuauauguauuuccucaaguaguugaaugaguauugcaguaacuucuaaaugcauuuaauuucauacauuaaaauauuuaaauuugggggcuagacagauagcucaguguuuaagagcacuuguugaacaacccaggcucaguuugcaacacccacaccgugauucacaaccaucuguagcuacaguuuccggggcucugacacugucuucugaccucccuggguauucaccuuuguuucagguaacacucauacacaugaaaucuaacuuggaaucguuuagaaggcaucagccugcuugaguggcagucuacacugcugggaaaggacugcaucucauuuccuuguuggugaugagaguggccauugacaaugugauaggagacaagacugcagccugguugugaaggccauuucucgacuggaagaacuuuggaagacuugaaacuaugaaauucacuuuuagaguccuuuucuuucaucuuucucccuuuaccucugagaaaacaaaauaauuuuggauuucagucuaguuuagcaagaaagugacagauuuuaguuuuaugaaauugucacugagauguguuagaaacguagaaaugagagccagggauauucucagugauagagcacucuucuaagaugcaggaguaccuggguuguaucuucgaggugacgagaagggagggaggaaaaccagacaaaagaacaaacucauuagaaucugguagcuggcguguccacaccccaggcagccacagguaacugaggaaagcugaugagaacacagcacaaaaucauaaacugacugagaaagggguacuaggaucaguggauccaagggagguguguuauaccucagcaguuaagagcuuggcuacuaugccuguggaucugcgcuuaauucccaguacacaaauaguacuccacgugacuggaacucuacuucuggggaaccugaugcccacuucugaucucugugagcaccaggccaggcacacaugugguacauggauauaugugcaggggaaauauccaaaugcauaaaguuaaaauauagagagaagguagggcaugaaaguaaguagaguguguauguguguguaugaguuauccaagaaagcuuuaauuaauaaaagauuaaaauuuuaaaucauaaauuuaaauugugcacuuuuugugccaacuccuuuccaaccacccaauucuggaacaccagccuagaagcugacaaugugguacuauacgcaccugcuguaguauggccacaucagguaacugucauagaauucaggucuuaaaagauggcauaaaagguacaaugugacuuaaugcauugacacagaagaaauccagacagugcaggacagcaauuaacagugguuaauugcagaaucugaccacugauugagguacuguuuggugagacaacccugauagaguagugaauacaguuuaucaggauuuggagcugcaaagauauuaugcauaaagaaccugggacaccuuuaguucagaaguauacuuauauaugguaucagauuaugauuaauaauuaguugaaaaaauauucuaucaugaugucagccguuucuguaaaauagaauuuucauuuugcuaucucucucuuuuuuuuuaaagauuuauuuauugauuauauguaaguacacuguagcugucuucagacacuccagaagagggagucagaucuccucuugugagccaccaugugguugcggggauuugaacucuagaccuucggaagagcagucgggugcucuuacccacugagccaucucaccagcccuuggcuaucucuuaaaucuuugauuguauaagaguugguauuuagcaaccauguccccaaaguacagugacuuucacucuaucagaaaccaucaacugggaauugcucuucuuccaaagauugggccucucugggaccccucuacaguucauacuggaaguaugaccugcacaaaaccugaacaacagcuuuucugccaaaaguugggccucucugggaccccucuccaauucauacuggaagugcaacuggcuugauuuuguucagguauuguucaggaaacuacaggcgcuauuaguugagguguaaagcagucaugucaugucaaaagucugcauuucacagccccuccccucaacuauaaacucugacuuucuuugacaacucuucugauguucccugagccuuggguguggggagauuaauaaaaauacuucauucacugcuuuuaaaaaaaaguugguauuuagacuaauuuuaagugaaagagcauuauuuuaccauuuaccaguauuaaauauuuuaauaaugagcauuauuuuuggagcagcuguuuuguuaauaaggauaugaccuaucuaagguauuauuccuguuauuaucaaacaauauauucuuauuagcugagcacaauuuuaguuacauauagagacuuuugcaguacacauugcuauguacuuuuuucauuuuuuuuucaguugaaaaauuuaaacuuaacacuagauggagcucuuucacuaauuucaguugggggauuucauuguauugguuuuguuuuuuuguuuuuuguuuuuuuuuuuccgggaguuuuaacauuguucuguuaaauaaucugguuggguugugguguaacucacuaauagagcacuugccuggcauacacaaggguaaggcuugagccaugguacucaaaagagguuuuuaaaaaacaauuuaucuauucaauagaaugaccauagcacuuuuaccugaaaguguuuuuuuuuuuaaugcaacaaugacugaaacuccuuuguacauguaguuuguauuuuagguggauuguguguauaauacauacagagaucaaaagacaauuuacgggugucaguucucuggaucaaauucaggucccuagcauuugguagcaaggaccuuaccugcuaaggcaucccacaaucuuuaauuguauuaauaaaaacauuuuauuuaauauaauuacaguguguguggaagucagaggacaauuugacagugaguucuuccaccaucuagguucuagagauuuaacugagcuuguugggcuuggugagaaauagaugcuuuuuacugcugagcugaaggagaagcauauuaaaugcaauuacaggagcuggagagagagcucagcauuaagagugcuugcuagaggaccugaguucaguucucagcacccaggccugugugguucacaagcaccuguaacuccagcuccaggggaguucaaaacccccaucuguccucugugggcaugcgugugugcacacucgcacacacacacauaaauaaaaaaaauaacauuuuaaugcaauuacaguuauauaacuuaaaaaauuagauuuagcuugccaauugaacaguguaugacuuuaagggaaaaaagugaugaaacguauagaaaaguauguguuuaucauguagugauugcauucugcugucaacuugugugaauuaagagugcuugucccgguucucuuuucagauugucccucauauaguuaacuugguucacuccuucagaagugauggccuaccuuccagcacagccuuccuaguacaguuaacagaguugguucacuguaugauguaccauuacuccggauucccagaucucuaugagccuauucuggaggcaguaaagguaugauggcuuuuuguaccagacuuggugagcgacauaugauauaaggaacaaauuugguaaaauguauuccuuuacuguaaugagcuguuuuuaaggugguaguuucauuaaugucagggcauaaucucuuauuugcuaucgccaugcuagaucaauaaccacauuucuuaauuauguugugucaucaaguaaaaggugucacuuuaaauuuaugagcuguuaaagaaauugguuggugagggaauucugcacuagaugcaugcagacaucaguucugcuucagugucagacaugggcaacaauuaguccaucuucuuagaagcaaggcaaugcucaauucccuccuguuuugauuguucuguguguacacuuuauggaugucuauauuuuuuagaaauucuauuuaaauuauguuaccugauuuucaaguuuauaaaagauagguucuaaaaagguggugaaucuguguugaggaguggaugacugcaaauucagagccuagccaagaacuuggagagcuaaacucaggcuuagucagaaguuacuagauaucaauucuaaucaugauauuaauauagcaaauacaauauauaggccucauugccuuacuaauguauauaagauaaauuaaggacaagcuguuuuugcaucuguucagcuaacugaaacuaagaacuaggccugggucacaaggcaguuaggccuguguguagcugguaugacacugcccuuucagaaguaaacgguacacagaagcauuugcuauggacuugagagauuguuacugccuucccucauugcugccaugucuauugacugacauucuucugucuuccaguacucagaaacaaagggcuuacuucuuagcccaaggaaaguauuuucaaguagcugucagcagcaaaaacaaacaagauaaaagcagcugaaaaugccaucucaaagugucaguccucugugggguaaacaguagauggcgaccuuggugaccuaggguucuguugcugugaagagauaccauggcuacagcaacuauccuaaaggaaaauauuuaauugggaauggcauacaguucagaggucuaguucauuaucauccugguggaaaacagggcugcauacagguagacauagugcuggaaaaggagcugggaguucuacaucuggaucagcaggcagcaggaagagcccugucuugagcaugagacuucagagccuaccucuagugacauaccuccaaagccacgucuauuccaacaaggccacaccuaauagucccccucccuaugguccaagggaguagggguggcauuuucuuucaaaccaccacacuuggucuagaaaagcuaaucauuuaagcauaaaugauuuuuccagcaucucuuauugcccauuguucugcuggggcgugaaaucauuugcacuuagauuuuuauuuccuuauuuccugcuuuacuacguaagaggacuguguguaguaguaauuuucuagauggcaaccaugagauugaguuugacuuuucacagucggaucauuauguauucccuuuucguccugacuguaggcugccauuucuaagggcugguacuggguacaccagagucaugcucuguuuucaucauagaauuugaauacaaguaauugacaugcaacuugaacucauuguuccauuggcuuuuaaaguauuuuaagacaagcaugauauuuugugccugugaucucagcacuugggauacuggggcaggagaauuacugugaguuccuggccagcuuaggcuauugagauuuuugccucaaaaauuuuaaaucucuuaacaagauucuggaaggcauuuguccccauggcuauuuuguggaugcugugauaagugacucagaggaaggguuccuguggcuuacaauccaagggccuuuuccaucacuguaucgagucaugguaacaggagcagcucucagcuguaaugagaguuguccaucccugagcagagaaggacagacagcccacauucagggugagucuacuucuacuuaacccucucuagagacaaccucacguacauacccaaaaugaccuccuuguuuuucaauaaagucaaccauuaaaauuagcucuccccuguagugugauguuuuaaaggcugacuguauguucucugucauguacagaaugagugagagcaaagacagcucaaaugucaguagggaagucccacauugugguguugaguuguuuaaauaaaaaaauaguuuucucuuuacuuuuuaaacuuucuuuucuuuaugaucuaggacuuuccuaagcccagugaagaaaagauuaagcugauucucaaucaaagcgccuggacuucucaauccaaugcuuuggcaucuugcuugucuagacuuucuggaaaaucugaaacuggaaaaacuggucuuauuaaccugggaaacacguguuacaugaacaguguuuuacaagcauuguuuauggcuacagaguaaguuuaaaugugaacuuucugauuugaaguagaagugagugaguaggugcugaggagaugggaggaggagagaaucgucccugcucccguguaagcagcguaaguguucacagugccaucacuugccucaguuaaaaaugaaacugcucuuaaugccuaggaacagugaaaugccagcguuucugauucugacgaauuagcuuguacauuguacuuacaaugccacuguuugauuuguaaucaguaugacuugauguuuuuguaauguaaccaaagggauuggcugagccuacuccaaaaaguuuaugugcccuacacuacugaugacugguguguuuuacccuguuuccuugccucuacuguccuacuguauuuuuuuuuaauucauauaucauaauuuuuuuuuugcuuuuaggaaaccuaagcuuugauuccaugccaagauguugguuccugaacagauaggcauuccugugaauuuucuuucaagccccuuuucuuuugaaugcaacaaaccugaaaucaguccuuagcugagugacauccuugugcuggagacacaucugcuagggugccugcugcuagugcagcgccugccugugcaugaccccagcaccucauaaagccaggcuugcuguugcgcaucuguaaucucagcacuugggauaaagcagaaagaccuuuauggugauucgugucuacaugauguguguaaggcuagcgaagacuacaugaggcucugucgugucuccccuccccccccaaaaaaaauuguccuugaagauacaaaauaauugucaacuuuuccuuaaaucgugccaauugagcugacccaaagauggaagcuguuagaacuuaaacacuguuaggugugggcucagcuuuaggguuuuguuguuugucccaggcuaugaaacccaagugccugggcuuccauucaguuuucuuguugcuuaguuuguauuugacaacuuguuuuaagacaaagggauacucuuagacacacgugguauuaaauguaagacugaagaguccauagcucaccaccagaggucaccuugcuagcuaugucaucuuacggaaaguagugaccuaagcacuuguaacuacagaguguuguggcagccaguaaugcuaucucaaaacagggagaucucuuaagaaauacaugaauuauuuuccuugguuuaaaaaaaucaaacuuguaaaaaccaagaugcauacauucucaaacauauccgcuaugugcauuguuugagaacuuuuuuguauaguuaucuaauacaaaacaguugcauauaauuaauguauguguacacacaucuggaaggagcccuguugaaauuuuucuugucagucacuugacaugguguuuaucuuuuuucuuuaaauguguuuguuagugcuggguggagacacgcaugcauccuaugacguguguguagaagcuggaagaaaacuguaguccguucucuccuuccaccuugccacggguuccugacuagagcucgggucaucaggcucucauggcaggcaccuuucccagcaagccaccuugccagccugacauuugcuuaccuauauuuuugguaaauaucaguguuuugcucauaguuagcauuucucuaaccaugcacagaugagacuuuccuugacuaggcuaugccaaauuauuuucccuuaaaacacuacggggggcgggggagaggugcggaauguucacccuuguagaugcgcuuagagugcacaggcugaugucaggauagcuuccucaaucacuucuugaccuuauggcuccucguggagccuggagugacagaggagaagcaccuugcccagcuuucacaugagggcuggagacaugagguuacccagggaccaucucccuaacccaaauuugaccuuuuauaccaauauaugcuuguaccugugacccuauaccucugacagcacuugauucaaucaaucagucuuagauuuuucacaauuuagcaaauguuauuccuguuuucuuauuuuaggaaaauuaggucuuaaccauaguagccucaaauucaugauccuccugccacagcgcucugaguauugcagacuacagauucaccccagauuacaggcauaugccaccauaccuggcuuguagcacaccccuuuuaucucugagaaagagaaagaaauucaagagcauacugaggcuguaggauccccuagaacuggaguuacagguggcugugacaugggugacaugggugcuaggaaccaaacuccgagccuucucuauggcaggaugacuuuguuuuuacuuugucuaugcugagguuuuuccugagugucuguaccccacuuuagggccuggugcuguagaagccacaagaggguguccaagccacuaaaacuagaguuacagcagauacuugugucuugugggugcaagagcagccaguacucuuaacugcugaccaccucucuagccauacuccuucucuuuuuaaaaucauccuaaguucaugauguguuuugauggaagaauauuuuuuacuuuugaaauaaucaacuuuaaguugauuuuuauaaguuaaauuaauauuuagccaauuuauauuugcugacccagaaaauagaacuaugacagcauccauaccaggccauguaacaagagcccauucauuuauugucaccccgccaucuuuaugauauaagucuacagacagacacauagguaaacaucagcauagacagauguaaaagcgaagucauggugccagagagaaggcugggaguuugguucccagcacccaugacaggcagcccacuccagcuccaggggacccuacaagcaucuagaagcacuugaaguaaaaggaguaugcuagaagccaggugugguggcauacaccugugauccagcacucaggaaguggagggagaauaugaguacucaacaaagugugcuaguaacuguuaguaaggggcugcccuacacaucagguaacacugaggauaaccauucuuaaacuagcuuccuuugagcuucuuuauaaaaagugcguaaguguauagauaacauuauauuauuuuauauucuuuuucagguucagaagacaaguauuaucuuuaaaucuaaauggguguaauucguuaaugaaaaaauuacaacaucuuuuugcuuuuuuggcucauacacaagugaguauuuauguguguaauauguacauauuaacugcaugaucauguucuuuaaacuauauaucaucaugagucuuuuuaacugguggaauugugugucaugugucuuguccaaaauaaagauccacuugcaagugcucagggacucugccuggacaccuagaacucuugucucuucucccugcuucccuucccugcagaggauuaucaugcuaaccagcuacacaucaagucuacuuuccugauaauaaagaauuuccuucaugaaaaaaacuuuaaagcuaggcuuaauguccuacaccugucacuccagcauucaaaagacugaggcaggacucugaguucagggccugucugggcuauguagcaugcuccuaucucaaagagacaagaggggagggaugaaagaaaggacugaaaagaauggacuguggcugggauuuuguuuuguuuuguuuuguugguuuacagagacugaauauauugauauaauagugaacacaaaauaauuauggucuaggcuuuuuucucuguaguccuuuuguuaaugguuuuguuuuacaagacaauguuucucuguguagcccuggcugucuuauaacuccauuuguagaccaagcucacagagauuugccagccccugccucccagguguugggauuaaaggugugcgcuaccacacucagcuuuucuuuauuuucuuuuagguauucuuuuauuguacuuacauaucuuuauagaucauuguucaucucuuaagcucuugaacuuaaaacuuugugguguucuuuuauauccacaaauuaauucaguaaagucaacuugaggcagggucuauagguccuuuaguuaaguucauugaacagacauguucagagguucuguguauagucugguaagaaucaagcggggaucuugcucucaaagaacuucuagcuaaggcucaaacauacauaaauguagguauguugcucacauaaagcauacaucauuauuuuucugguucacucuaauugccacugucucacagucugaccauggucgggaaaugacagucuuuagaacugaaauaaauuucuuaaauggaaagaauugagagcaaguuugagaugacuguaguggcuuagaguugaugauacacucagaggauaugauucaccuggagaaauauguuaacaaauuaacaucaggacccaggggaauaaaaacugccucugagccaggugugguggcacacuucugcauugccaguauuccagaggugggggcaagaggcucagacacaagucucaagccagucauaauacuacaaaagcagcguuagaccauagccaaaaccaaacaacaccaaaaccucucuccccucuccuguuguuuucuacuaauuuacugaauuaauuuuuauucuauacuucguacauaaacaugugugugcaucuguguagauauguauacuuuauuuauuuacuaaaucagagauauuaggaaagaaacccuucaggagguuuccaugcuuucgagaaccaagaaaggcacugucacuuuaugccacaaauauuucaaauacagagagaauccacauuuucaguuuaaccaggucuuuuuuuaugucuguucauuuucguuuugugagaauaccuaagauuugagcacgcaugacccagguucauuaucaacugccuuugaauuucugaaagaaaggggcauggagaaaaaaaaaacagaaaguaaagaaagcaagcaagcagagagaaauaaagagaaugagagauuaucaaaguccuuaccagcauguucccauccacacuugaggcagguguauguauaaguccacauguaugacuuaugacagaaauuuucagcaaaguaaauaugugugguuccuauugcacacacaauacacacaucauuugcauucauuaacaucauucucacacuccguuuuuuuaaaaagauuuagggacucaaagccaugugugucagagagggauaaaagcagggacccuauagcaggaguuagagacaccugaguccugugguagucacccguguccacuuggugguuccaucugagcaggucccauggcuaugacuaaugguugcuuaauguaaaaguugccucugcgccaggcgugguggcgcacgccuuuaaucccagcacucaggaggcagaggcaggcggauuucugaguucaaggccagccugguauacaaaguaagcuccaagacagccagagcuacacagagaaacccugucucgggggggggaaaaaaaaaguugccucugccuuugcuuuguacccaugccuggcauacuuugguaaaaauggaguaugggaguaaucuuuaugagguucagucacugguuugugcuguaagagucacuuucucgaauuuccuuuccacaaucaagagggaagcuuacgcaccucggauauuuuuugaggcuuccagaccuccgugguuuacucccaggucacaacaggacugcucugaguaccucagguuucugcuggacagguacaaaugguuuaaaguucauuaagcugucuucucuuaguaccuuauuucucuuaauacugauuucagacuugaucuuuaaagcaccaugugugacuguguguuuauaaaguugucuuuguucuuaguuugguuugggauuccuaaggggcagcuaaaacuucagaacucuugucaaauccccucuuaacuacauaucugugggaguucaggcucuucuuugccuauuucaucuuguaaaaauagauaucaguaaggaaggaugcagugcagauacggaacccagcugucuucuguggugccacaugcuuagaauacuuaaaaaguaugaagcaaugaugcuuacuuaaaaagcuggaaauuaauuugugauggauucauucuagauauauuguuuuauauauuuuauuguuuuuaauauaguaaauaucuuuauguaugcauguacauacauauguugcuuuuuuguugcuugauaaaauaccauggcuagaaacaacacagaggacaaaaguuuauuuugguucacaguuucacagagcauauaguaugucauggcagagaaugccuggcagcaggaauuugagaccugccuggcaguugggaagcagagagagaaaggaaagugggaccaggcuauaaaauuuucagagccugcccucagcaguguguaucagcaaggcuagcuccaugauccuugagaacagcaccacccacuagggaugcugguucuauaggguuuaguugguugggguugggguuuuuuuguuuuuuggguuguuuuguuuuguuuuguuuuguuuuuaauaaauauuaaagggcccugagaccaaaaucuuuuaagagccaguugguaaacucuaagagcuugguauuuugugguguccuuuaaccaauucauuaacaauaagaccuauuuuaccugcauauuucuguguccacuccuuucucugggaugaauaauuaguaaagguagucagccugcacagccuucuuuccuuccugccuuccuuccugccugccuuccugccuuccugccugccuuccuaccugccugccugccuuccuaccugccugccugccuuccugccuucuuuccugccuuccugccugccuuucugccugcuuuccugccuaccugccuucuuuccugccugccugccugccuuccugccuucuuuccugccuucuugccugccugccuuccugccuuccuuccugccuuccugccuucuugccugccugccuucuugccugccugccuucuugccugccugccugccuuccugccugccugccuuccugccugccuuccuuccucccugccugccuuccugccucccugccuuccuuccugccuuccugccuuccucaguguaguauugcuuucuuggugcuaggcugugagaugucaagcagagggagcugugugaggcagacugugcguguggcugacugcagcuuggugugcgcgcuguauaacagcgcaggggaugugagcugaguguguguggaaagcgagcaugcucuuuauggccuuuccuauaacuauucacacucuugcauaaaggaggagaaaacgacuuuaagccuuuuacuugauugaauuaacauguuuauaagcuaccaagaucucaaacauaaauaccauuaaucuuggcuguguaaaaauauacccucuugcagacuccaugaagaagaaaagaucuugcgaguucaguccucacauaagccuucggaaggucuggacugugcugaaacuuguuuacaagaggugaccaguaagguagcagugcccacagagucuccugguacaggugacagugagaagacucuaauagagaaaauguuuggagggaagcuacggacucacaucugcugccuaaacugugggaguaccucacacaaaguugaagccuucacagaucuuucgcuagccuuuuguccuagcccuucuguggaagaccugucuuuccaagauacagcuucguuacccagugcucaagaugaugggcuaaugcaaaccagugucgcugacccagaagaagagccaguaguuuauaauccagcaacagcugccuuugucugcgacucaguugugaaucaaagaguauuaggcaguccuccuguugaguuucacugugcugaaagcucuucugucccugaagaaucugcaaagauucucaucaguaaagauguaccucagaacccaggaggugaaagcacaacuucagugacugacuuacuaaacuacuuucuggcuccagagguucuuacuggggagaaccaauacuacugugaaagcugugccucucuacagaacgcagagaaaacuaugcaaaucacggaggagccugaguaucuuauccuuacgcuccugagauucuccuacgaucagaaguaccaugugagaagaaaaauuuuagacaaugugucacugccucugguuuuggaguugccaguuaaaagaacugcuuccuucucuuccuugucccagaguuggucuguagauguugacuucacugauauuaaugagaaccuaccuaaaaaauuaaaaccuucugggacugaagaagcuuucugccccaaauuagugcccuaccuauuaaguucuguuguugugcacucugguguguccucugagaguggccauuacuacucuuaugccagaaacaucacagguacagagucuucauaccagaugugcccccagucugaaagucuggcauuagcacccucccagaguuguuuacuagggguagaaagccccaauacagucauugaacaggacuuggaaaauaaggaaaugucacaagagugguuuuuauuuaaugacagcagggugacauuuacuucauuucagucaguucagaaaaucacaaguagguuuccaaaagacacagcuuaugugcuuuuguacaaaaaacaaagcagagcuaauggcauagacagugacaauccagccaguggugucugggccaauggagauccaccccuacagaaagagcugauggaugccauaacaaaggacaacaagcuguauuugcaggugaguugcaagcauagauagcauuucugaacaguacugaguaacagacuuaauccaauggucuaacuuuaaaguugacacauuuuccaaggauacugaagccuaagauuggauguauguauuuccacucgucauacauauaguaugaaauauugccgguuaucugcaauauauaagacuuuauuuuuaauugcaaagcugugccucaguuguuuauaacugcaaaugaugucauguuaguuacaaaguauuaucaaaucaugccauauagaaacagaaacuugaugcaauguucuguuuccuccugccccucaguuccuccuacccgcaaaagagggguuuuuuguuuuuuguuuguuuggaguuuuuuuccguuuuuauuguggggugugguacagccauggaggucagaggcaacuguacagucaguucuuuccauccaccuccauggguucuauugaacacagacccuuaggccugcacagcaaacaggcugaacuuuaacuccugcaggcucuuuuuguccauauuuuaaggaaaauguauuaacauucagaugaaucagauaaagaauuuaaugaaaaugugaaggauguuuguguucuucaaagauuuaccacagagccaaggaauaaagaacauuuacugaggaaaagcuauggagcaaaaguuucaugagagggcuuugucaagaguauguccuuuucaagaaacuacuuccuuugauguuaauugguccucaaauuuguuugguuuuguguauauguaugagagagagagagagaaauuucucaacuuucuaucaacaaaaagagccaccagaagcuaggugugauggggcaugccagcaagucaaacaggaagggacuggaggcaggaagauugauugccaguuggaggcuggcaugugacaccuaaggagaccuuguccacaaaacagaaaaggaaccacaguaacuuauaaaugaaauuacagggcuauucaaaggcuuucaaauguacugaauuacaaacuaucuaaaggaugauacaugauacauuuuaaaagggguauggcaguguucuaguguuacaaaaauuaacuuagcaaaauaauuagaauauuagaacuagacugacuuaccauuaacacuuaugcagauggcuuaauauccagguaaaagaaauagaauguaucgggucaucucuuccuugccugugucacucagccuuacagaucacaguauuugaagguuggagguugugagaagaacagagcacuaagacaaaauaggaagauguauaaaaaaaauguaguauacuacaaggcccgguaugcccuuccuucugaagaaaacagauuaucaauguuacaauguuuaucagaugagaagcuggcugguuuccacaauugagcuggcaggcacauuauauaaccacagcuacuccuccuuggauacaguccaaguccacagauugcucuggcuuacccaucucuucgagccauguggcauuugaccaugagcagccauucuucucauuguugauuuagggccaguuuugcacccuaccuugugauucugccguuauuuauucacagaugcgcuuuguaaaacugaauaaugauuuuaauuauacauuuuuuugaaugaguaugugugugcauacauguuguucacauguagaagaaagagaaguuugugggagucaguucuucuaccaugugggcuccaaauguggaacucaucauuaggccaucucagcuucccaguaacuaaugauguucuaaaauaagagcauuagucuuuauuaagcaucugacauguacuugacacauaggcaaacaucauugauuuccugggaaacuuucaaauaaacuaguggggagaguucuguacagagauaggccucacuuacuuacugcuguuccuccaaaucugccugacucucuaaccucaggaagcaguagaggggaacuucaggcaucauuuccaaccugucauacucacacacuaauaaaauggguugaagaauuccauuccuuuuguacuagauguuucacaggaguugacccuccucuguuguaaaguauuuauuuguuacuacaguuacgugaggaauuuguccucucugccuccaaagguaacuauguacuuuagugggagauagcaaagauagaugucaguuuuuauuuuauuuuauuuuauuuuauuuuguuuaguuuuuuucaaacaggguuucucuguguagccccagauguccuagaaaucucuguugaugaggcuguccucaaagaucaccugucucuuccuccugaguacugggauuaaagacaugugcaugucuuggugucagaguuuugaaaugaaguaugcuugcuugguagagacuaacacaguuugagaaggugugugugcgcgccauacucauccauucuacuuagcaaauuaauuuuauaaacauuacuuugaauuuuaggaacaagaauugaaugcucgagcccgggcccugcaagcugcaucugcuuccuguucguuccgacccaauggauuugaugacaaugacccaccaggaagcugugggccaacuggugggggcgguggaggaggcuucaauacaguuggcagacucguauuuugacccugagagaacugaaaauguaucuggucacaaaacauccaauacuguggcuguuaaaaugucaggcuguaaccuauagcauaucuaucuuuuauuuuucuuuucauuagacccgaauacuuuaagaaaauauacucagugguuguuuuuauuuucuugacaaaaauucaucauggaaaaaaaaaaucuaccucuuaaacucauuugcaguuacaguuagacauguuuggccacaaguauuuagaggaaaaggcauaccugcucccuaauuaagcugcauuaaauuugguagaaggauuuaaaugguguauuuucaguuguacugaacaaaauaauucacuuaucauucuuuguacaaaaauugaugcuagauauaucuuaagaaaaaugaaauucuuauuucugguauaauuaccccaauauuaaauucaagucuuugaaaauaguagagauggugagucucuggaggcgauagcaccuuccaccccagcugccagucucugggcugcugucuccgcuguccucggcguugcacuccagauucaggaacaagugucauuuacacacguggcaagugaauucacacaaggugcaugacgccagagggcagggguuuuaacugaacuuuguaggauuuccaguuguccaaggacuuuaaaauccuguuucagggaguguaucuccuauguguuuuaaaggaggugagucucugaaugugccuugcaguacuguaauucaaaaauagguucucuuuggcugcggcggaaaguuuucuaaaacaaagcguuaggaaggaauuuugugcuaacauuaaaauuauaauuuuuuaagguauuagauauuucagaaguaagaucuggugguucuaaacuaguaaguguaaugguaaauuucuaacucuuagaaaaauucggaggaaaugaagcuaguuuaaguaaaaaaucuuuaauugauuuguuacuuaaucuucacauuaaacauugauaacauuuuuagaguuguauauuuggauuuuuuuccuuugagacacaugccuuacacauaaaauauaaucugcuucaugaaauauuaaaaugccacaccucacuucccuacu

SEQ ID NO: 4562 - RNA, 1926 nt, Mus musculus
gccuuuaaucccaacacuugggaagcaaaggcaggcgaauuucugaguuugaggccaaucuggucuaaaaagugaguuccaggacagccagggcuauacagagaaacccugucucaaacaaacaaacaaacaacaaaaaacguucuuaaaagguaugcuugacaccuuaauaagaaaaugacaaaaucaaaugucagcgacccugcuccucuaccucagacuuuauuagacacacucuaagugaugguggccaguuccugccaccagugaugccuucacaugcuacagaaaaaacuccucuagauguucucaagaaagucagaagugugcccaccaucugucuacauuaauugguuaucuuuagaguugugugauuucuuugagauguacuucauugugucccucaauuuccuuaacauuggcuuuggguguguuggaagguccugaauauauggacagugcacgaaaacauuuguaccaugguccaugcaaaaaaacaacaauggugccccuucuguguacaugugcagucucuguauagaacuccucucucucucucucucucucucucucucuuucucucucuuucucucucuuucucucucuuucucucucucucucucucucucucucucucucucucucucucucucucucucucucucucguguguggugaaggucaggguaugccauaccauagaagaauucguaaaggucagaugauucgacuggcacuuguugagcugacuagucugcuucccaucauuugccaucacuuccucccuucauggcaaaggguagaggucauucagcaaaguccagaccuucuguagcaaggacacucucaauacauaaaagauaugacucaccugugagaaugugagauccauuuucuacuucuaauccuacagucccagagugcuucaaaccccuucauccuuaggacaucagagauuuucuaguucaaacaucauugaucucuaaaaugugaaaacagacucuagagaaaggcugaaauuaagaaacaaaacugcuaaauucucauuauucaugacauggacccuagagugaaaacacaucaugugcagaaaaaaaaccuaugaaauucucaccagcuauagaguagcacuuuggccaugugaguaaggaggaauuguuaucacuggugucugagugagaggagaaacugguuuccuagccuguuuccauuguagugugucaaguacacauauaaauaauucucucaaaaaaaugcuacugaugcucucauaaguuuccagugaccuucuagaacauuauagaguaacccucuggcacuguauucagaacuuaguguguuggauuuugcaucauuaugacagaauaccucuguuccaccuggggcacagccagcaaggugagcuguacaguauccccuugaaguggaagcuuaaggguucuuuggaaagucaguucaaugguguuuugcugaaagacugugaaggaauauucuauuaaagaggacacaggugaaaggcuaaggcagacacaugaaggaacguuuugcugaagcagacacaggagagaggauguucugcuaaagcaagcacauggaaggacacaugauaaaaggauucuuugcuaacaacacacaugugccuuacauugcauaguugagcugcauuuaucaggacuccauagagagaaauggaccaaaacacuucuagugguguccugaaguuucuuaccauuuccauggacuuuggcugauuggaugcaugugcugaggcaagacauguguugagucaaggcacauggacaacacgugauauuugaaggguguaaauagcacuccacagagugauggagagagugguuggccugcugguacagcuaguuguucauugcuucuuggucuugagucuucgcugaucuucacuucccu

SEQ ID NO: 4563 - RNA, 19857 nt, Mus musculus
cgcagccuccgugcggacuuccgggucgcgguguucgcagggagcgcuccacguagagcgucguuuccguugccgguguuugcagcuggggaaaccgaggcagugccagcuucccccuaguucuuccgcuccugugagguggcugcuguuuuauuuuucucucacucugaguugcuggcgugcggcugcgcaagccucgcuggcgucccgcggauaacccgcagggugcgggggccgucggggcuuugugcagcguucccgcgcgcgagaggggcgggacggcgcggugcccacggggcucgcacucgguuucccgaggcccuggggcucggcgggacggccugccugcgccuggcacuucugcccgcuucgucccgacaagcgccgacgggaugacucauuuuaaagauccugauccgcgugucuggcaccgacaccuggugccuugccuugcggggauuucgaauuugacagcuccucgggcccgggcgcagagagggugugucugcgaaucccagggcuggaguucccgguaucccuccuccccuucguuuagcacccgaaaagaguuuuauugcaagaucaguuauaucaaguguauagauuuugugggguuuuuuguuuuuuaaccucuuggugucucugcccuucaccuacugacuagaacaaugaugaauucgucaggaugccaucugcucgguuucccaaccuguaugcuucaguuuguaagccacuuguaguguuuucauuugucggagucagcugacagggacagcugggcgcgcucucaaccaaggcugagaagagcucauuuuuugggaagccacaucugaugugugguagauuugaaauuguugcucgguugguccuuuuauucuugaacuucuuuguuccaaguuucaagggaugaaaaacggaaguaugaauccaaaauauuaaauauaauauuuggcaaaaaugaaaugugguuauucuuuuuagcgauuaaauaauuuggccaguuauuuggcuacuuuuuacauuuuuuuuucaagugaccauuuggcaaaucauuauuuaagcuguuguauguuauuuccuugccugaugaauuaaacacucacaaaauagacacaauggaauaauauauuucauuaucauuuggggaguuggaucaacuuaauuucuuuuucaguuuuauaauuccaguuugagaccguuaagcuuguguguuuauauccucuuuccagggaaacauguucgugucucugugggaguuuuucuauggacacuuuuuccgauuuuggaugaaauggcucuuacggcagaugacugggaaaugugaauugcagcgaauuuuugacaccuauggaggggcacagaggaccuacagaauagguaauaccuucaaaauaaagaaaauucaacauuaauuauaaccuaacugaauucuucugcucaccccaugggaguuugauuugagcgagucacugcagcugaguuucuuaagcuuuguggucuuuaaguucuuuucauucuacuacugacuauugaauugagcacugaauauauaaaaagaaacuuccuaaaacaucccauauguauccaaaaaacgagccuuuugggugucuuaaaaauguaucaguuauuauucagauuauauuuucaauuguuuacuagaaaauuauucucucuuccauuugaaauuuuuacacaaauguaugagguaaagauugaagaguacccccuggagcucgugucucuagcugcauaugaaucagaagauggccuagucgaccaucaguggaaagagaggcccauuggucgugcaaacuuuauaugccucaguacaggggaacgucagggccaagaaguguggggggggggugaggggggagggcaugggggacuuuugggauaguacuggaaauguaaaugaagaaaauaccuaauuaaaaaaaagauugaagagucaguuaucuguuuuccuacuuugaggccucaauaaucagucuucucacuuuugacucuuauuucugaauggacagauuacucauugguccuaggaaagacuuuuagaaccuacuugguccaggcucacagugauggccacaugguucugagcacuugaagucugcaugauguuaauugaguugugcuuuaccuguaagauacccacuggauuucaaagacuuauaugaaaaaauguguaaagauguaugauaauuguauuuguaauacagucaagugauaauauaaguuguuagagcaauaaaaauugcauguauuuuguuuuaauauagcuguggaaaugucuaugguauacauggggcucaauuuggcuuguguuauauuucugucaaaugacaguuuuucaguguuuaauugaaaauguuguucugacuucaaacucagauggcugagaaaugugguuugaaguuacuguagaaaugguaagagagaccugggcggagccacagcucaugaugcuguguuaaguagaaagucaagaauuaaccagcuccuauuuuguguugaucaaaaaugccuugaauaaggaauugaugcucuuuacguccaagggagugagguguggacagcagacccuguacccaggaugacaaggaagaauggcagagugucuuguggcugaaugaggcauaaagcacaauucugcacacacacacacacacacacacacacaccccugcacacacacuugcucagaagaaccaagugccucuuaacacagaccucugcagucuguacugguuggcacuuuacaguguggggaaagagcauauucaaagguuuacuuugaggcaaaaagcaucuuucuuacaauucucaaaaggagaguguucuuaauaaauucuuaaacuuuuuuuuaacagaccaauacaaauguugccauucuuagaagagaaaccaggaaugcagaggcuauucgcucuuugccuagugagaggagagcuggcagacagucugcuccuuuguucuuguacugcugaguugcgggccgcuugcucagacugacagagaagaggguguagugggggauauagucuucagaugaauuucugagaucuuagcagugggcaaacacccccacucuggcggucugcacagaaacacacaguucugggaaaauuagauugucaccagcuugguacugcauuugggggaugaugguuccaccuuuuucucuauccuguaagauuuugagaugauuguuguguuguucaugugggaauuguaccuuaaacugcagaagugauuuaucguugcuguuauaguuuuacuauuugauuuuggguaauucagaaaauguguucaagugguaacuuuuuuuuuuuuuuuaauuucagaaaauuccuugacauauuccaagaauaagguaagagcacauuaaaaugcuaauucuagaaaacuuaaccuaaguguaguuuuuucuuugaaaagaacauuuugauuucaggauuauguuuacugccuuugcuaugagaaacugugaguuaaguguucucauuuuagaaauuguaauccuguuuacaaaauacuuucuccauguguuuugauggacagaagaggauuucaacucuguguccuguucugagguccuaccuguugauuuuguagcagcuuugguagcuuuggggaccagcauguuaggaaagccuuucccaagacuguguccucaggguagguugugugagagaagagccaggcaaauuuugauccaaagugagucccagcauacgaucccuagcagucagcuuuugcuguauaagaaacaagcacaagucugcggagccuaaagcagugucauugagugcucaugcccauguggcucagcugcaaaggccuuuaucuugucggucucauguucccaugucuguuucacuugucuuacuguaggucacaggugcggguucagugggcagugagggaauggucucacaguaagucacuggaggcccgcagacugcaucaucuccauuugcaucuguggguuuaaaugagugguuaagugcaagacaaaagaugcauucugaacagcccaaagcuguggcaggcgagugguugcaugggaacuggcuugcaugggaaggaaaaccugucugccacaugucagcugcagcucuugauguguuacgugggaaaccaagaauuaaccaguuagaauuuacuguaagaucacaguguugucuguaaaagaauuacugguauauauuauuuugugacauuuuuaguuuagccaucugugugcacaucucuauuuuagauauccauauacauguuugcacuggucauaauguaaaauaugaaucauaauaaaaaaacguggacaugauucggucugcuaguguugguaagaguugcugacucacacuggaaucggaagaguuggguucugcaagcugacacacuucguucuggagaguaacuucuaaagugggugcuuguuaucuuagguacagucuuucauuuaugaguuaucugugugagaguaacucgcauccacaucaguggacacugggcaggguauagaguugccuuuguucagaauccuaaacugugauuuguuuuuuuuucaugagaauauggcaucuggaacuuugaaaguuucugcccuaauucuuguuuaauugcacacacacaugugguaccuguuacuguaauauagcaggcagauccccacagcagccuuugauuguagguaccugcuuggacacauuuuauuucagagcuguuacggcaggucucaaacuuaguagccccagcauccugugguagccuguugggagugaagacacuggguuccaccccagauguccugauucuguuucugacuuguugguuccccagugaugcuuguuuccugccggucagggcccugcuuggagggauagcccuguguucugacuguuccugcucucucuguaagaagccauguuuucuccacacagacugacugaugcagaucaaguuguguuucuuuguguccuaaaucuuggaauauuugagaaugaauuguccucugacaggugcuuuccagugcccugaaaacuacuguaaaaguguuacaguuccuugugccgcacccacacacccagcacuuauauccucuuuaaugcuuugagaccuuccugcacaccaucagugcugccccagugcaccccacuugcucccccuagcgcauccccuuaguuucccuuguugcucacuguugcaucuagcacugcucuugcccugugcuucugcuccaaaccagcguaccaucugucaucagccuguguaggccuugugccacuagggccaaaguguugguucucccuguuaaaaguuuaccucacaucagcuccaguuucauucaguucucaccucaugagcacacugagccuucucuacuuggaaucauaagucccacccccuguccuuuuuccuccuccuucuucuucuucuuuuuuuuuuuucaguaucuuacuucuuuauuucuucauucucuccugcugcaaagaaacagcaugaagcauagugucuguugcuuacggccguauccccagcgccugcacugacucccagcaagcagcagugcuuugaggguuaagaaaacauagacagagugggcagugcuggcccuuuuccacaugagcgugugguucuugcuuccuuugcuuguucugguggagaaggaucagaaacugaacucagcacccacauaucagcagaccgaggauaggcuggagcagcaucugggcucucagaauuuaucagugggauuauauaaauauauauauauaugugugugugugugugugugugugugguaaauuaagcuaaauguaaguaggacaggggaucagauauuggcaaaauuucagcaaggauugggugacuaccauauguucagauucugccaggguuucaauauuuguaggaguaguaaaauugaugauggacaauuaucaauaggcaacaaagagcaauacagagcaggaaggacuggacauggcuuagagcaguggcugcaaccuucccaagucugcguacagcuccucauguggugacuccaaccauaaaauuauuucauugcuacuucacaacuguaauuucacuacuauuaugaauuuuaauguaaauaucugauaugcaggauaucugauaaugccaucccuguaaaaaugucauuugacuucuaaugagucaugauucacaagugagauccacuggcuuagaguauuuugggacucaacaugaguggauuaaauuaacaggaaauaauaugcuaaguuuucaauuauuuaguagcuauuuaaaaaucucaccugaaauguaaauguuaaaguuguauucuuaugaugucaccaucaaaaaauagaauauugcuguguuuuuauucuguaaagagaauaacuagcaaugcuacugcuguguuuuuuauucuguaaagagaauaacuagcaaugccuaagauuaacucaaaucauagcugcuuucucuucuugaagccucgaacugaaguuguuuugucaauacauagaaaugggcuugucaguuuaaacaugcaauuuguauauuucuucaagagaauaauauuauucugauguuguggauuuccauugacuaucucaguauuuuacuacaugaaaagaagucuggaaauuguuuugauuuuauuacuuucuauuuuauuuauugcuuguccccucaucaauaccuguaucaccauuuuagaaaggcaacauaagagagugcauguugauaauauugaugauaauguaauuaagccagugaacacuauaagaauaugagagaaagcauccgugauacccuuguacauauuuaaauacuuugcauuucuaauggugaguaugcaugcuuaucucugacagcaaucucaauauaugguucuguuggguuguagacuguuggacaguugaaccgccuucuuuguugguuaaacaucuuacucccucaguuacagacuuggaccuauuuauagcucuguccaauggcugcuaaacugugaaaauuugugguaucuggacuauaaauacuguaguagucccaugggucaaagaaaaauuuggugggaaauagacaaaauugaacuggaaacacaacauaucuacauuugcuuagcucaccaaagcaaacuuuaaaagccuaaaccaguacaaucuguuuguaccuuuagaaaccugaaaaguaagcugaagaaguuacaaggcagaaaaaucaaugaauuaguaaaauagacaaacgugggcauugccaacaagcucagaagccaauccguuaaaaagauuaguagcgucagucaccucuagccacugaugaauucugcgagaaagccaagauucccagucuuaggaaagguagaacauaaggccccagagccugggucacagguucugugagcagcuucauccugggaaacccuguaguuucugugaagugggaaaaguuuguggaaagcaguuugucaacuaauaugaaaauaaaagaaucuagguugccauauauucaagaaaagaaauaaaaucuccaauuuaaaauauuguaaaacucuguagcauuggccuauuuaguucucuuuuaauagauguuugggcccuugugcuuuugaguguuugccuguaugcacugugucugugcuguguacauaccugcugcccacagagguaagaagagggcaucagauucucuggagcuggauugucaggugguugugagccaucagguagguccuggaaaccaaacccaguccucugcagaaguaguguucuuugccauugagccucucucuagccuugcuuaauucuuaccaaacauuuauggaagaagaaacagugccacuguuaacagaaaguccugggaaauggagggaagacccccccccuuuugagugcacacuaaaaccaaagaccuauaaauaaaaaauacaacucgguguccuuuaugaacgugaugcaagaguucuuacagaacaugagcugagugaucauagaaacacauaaaaggacacuguuaggauuaaaguuuaaguucagggacuucaucuauuaccacgguaacagagucgacagguacugaaaaaucggcucaugauuaaaaucuaucccacaauccauuaaaggucgccagcggacaaucuagcugacaucacagaagacauuaaacuuugaagguuuagucacuuguaguuggaagcaugacagauaugauuaguuucucugcuucuauucagcauuuuacugaaaucuuggggaccacagucagcaaggaaaaacaaaacaaaaacaaaaccugagacauaguuggccagaaagagcuacauguauuaacagagauguagucugaggauguagacagugcugggucccuggaggccacugcuauguauuaauaaguggacugaaauauuuggcagcagguugcucacuucugucuguauuagcagugcacuuuuggaucaucaaaguggagugccagcuaccgcagcagacagaugcaaaccauccagagaguucuagugagacaguuuucaguucuaaaccuguggagaaaguuuugaaaagaaaaaaaagccugauauuuaucaauuaaaagacucaguguuucuaaauaugaauucgaaaauugaucuaugaauuugugaaguuuuagugaaaaucucauugaauauauuggaaaacuguacuggcuaguuuugugucaacuugacacagcuggaguuaucacagagaaaggagcuucaguugaggaaaugccuccaugagauccaacuguaaggcauuuucucaauuagugaucaagggggaaaggccccuuguggguggugccaucucugggcugguagucuugguucuauaagagagccggcugagcaagccagggaaagcaagccaguaaagaacaucccuccauggccucugcaucagcuccugcuuucugaccugcuugaguuccaguccuggcuuccuuuggugaugaacagcaguauggaaguguaagcugaauaaacccuuuccuccccaacuugcuucuuggucaugauguuugugcaggaauagaaacccugacuaagacaaaggcauugacaagcucagucugcaaacuuauacagaaauagaagaguggccugagauagcucaaaaugaucaucuaagacggguguacucaacaagguuuccuacagauagaggguguuaucagacagaccagagcagaccucaaaaaaagagcaccuuaaugugcuggcacgcacacugcaggaagaaaagcagccagcagugggugcuagggagcuggaaguggcagggguagaagggugggcuugggaggugagcagguggugcacagagagacagcuccuagagacuguugcuacucuuuuuaaaauuaauuuuaagauuguaacaucuuuuuuugacaauuucacagaucuguaguguuucccagaauacucucccucuuacccacucuaucuccuggguaugugggccuccuugccaccccucccccucuuuucugacaucaucauuuguuguuuaauuaugaucacuuuuacgaguguggguaggaggcuuuuagaaauccacaaagacuuagaugacuccagcuuuggggaggucugaagucaguaggauuucuuuuugcauuuuaaaguuguaaaguugcaaauacagacuucucuaucagcucuuggagacuucucucauguaucuccaucacuagguccuacagaaugcaacacgaguugcccagagugaacuggacagguguauagcgaacaucaugaaggaaaagaacaucugcuccgagaaggacacaagguaugcugacucccucugugacugaugucgccugcucugcagagcccugcacaguuggacuguggugcggaaggcuagugggugagacagcccagcucuguuauccccugagcauugaggcccagaaugcugauaucugcacaggcugcagccgcaaagcugggcccucccacuccaucccugaggucaaauaauuagcuggcagcuguccuuccugcccuucagguuuuggugucucuuugcuguucaggucaggcccucccauagcccucuugugugugucacauguucugcugaguccuuacacuguccucuguccuucaugcacaggcugcacugcccaucuguaggcuggggacucuuguucuguaagagucaccaaguagcuggccaaacagaugcuaggcacccugaugagcaacgguacacugaaggcuagaugucuucuguguuauaauaaaugacauuaguugauacauaaguaagggaggugaaggguggcuuuggggaugugacagcaguuaggaaaugaacccuugggguaagaggccacaaccccagcagggaguuggugcugugcagacuggucugaaggucauuucauagacagggugaggcuugaaggucuuccaaacuguugauggauuagaauuugaagugcucuagcugagaacuaaagguuagugugcuguuacuauaguacagucacuguaaaaagcauguagcuccagggaaagcaagcuacuguacucggggaaacugagagaacuugucauggguuguuuugaauacacuuuaaauuauuagagauguugcaaagugacaauaaagauuugggcuguguggacauuucagagaaaauauguugaguggugucuugugauggagucagucacacggugcaugcugucuaggccuuguuuuaucacagccccgagugaugcucugcacagccuugggugcuuaaggaggcucuucggugcaccuugaguuaagucagaagcggaaacccacuuccuaaauagaugugugacgccccccccccccaggcuuugcuuuauugugauagacauucugauuuaaacaaugguuuuacccuuucaguuuucagaucugcaugcggacgugcuuacugcagauaacuggcuauaaacagcucuaccacgauguagaaaaugugaggaaaaagcccuaugacucugccaaugcacagcacgagaagaugcuccucaaggugagccuggcgcagggcgcagggugcagggcgggagcugggugcacucuccagccucgcuugccuuccugcuuguuugccuauugaagcauuuguuagaguucauaaauagggaaagauuguuggucaccagcuuaguugauaagcaucuuuaaaaacauauucacaggaagaaaaggagagagcaccuuccugucuccugcuucugcugugcaagugugugaggcuguagucgcacccauaucuaauguagcaaaccggccugcggcuuauaugaaccgggguucuccagggaggcaggcuggggcugaaaagagagaaacuagauggucgagagaaauaauagagccaagacaaagguucugaucaaggcccaagaguuuauuaagagaccaugcuuauaagggggaagacccccccccccaugccaggcuucuugacuaaccaggcuggccgcuuauucaggaaucucaggaaaacagguucagccucuaggcagguggcagaagagcagggcaguugucacuuuacaaaggagccagccaaguaggaaggcugcacugcugguggccccaccucagugguggccuggucuauaccagcccgcuucaggcaucuaaaggcugaggcuagagaaagagcugugcagugugacccuucacuggaggaaaagacugcaaggccugggggcugggcugacuugcugugcgugcugacucucuggagccaggacagcucugccuccugccugccuguuuccgcacaguucacacugugcaggaggauuaaagcugugguuuuaacuguuuucuuucauucuuuuacacuuuuacucucucuuuccauucugucccucucucccuccugccucaguccucuccagucuccucccuccucaccauguucaugaagcagggguuuccugaugacauuucauacagcuuuaacguagacucccuaugugucccucuguacuggcugguuuugugugucaacuugacacagcuggaguuaucacagagaaaggagcuucaguugaggaaaugccuccaugagauccagcugugggguauuuucucaauuagugaucaagggggaaaggccccuuguggguggggccaucucugggcugguugucuugguucuauaagaaagcaggcugagcaagccaguaaagaacaucccuccaugaccucugcaucggcuccugcuuccugaccugcuugaguuccagugcugacuuccuuggugaugaacagcaguguggaaguguaagccgaauaaacccuuuccuccccaacuugcuucuuggucaugauguuugugcaggaauagaaacccugacuaagacaagugguaaagauuuuauuuauuuaaaacuaaauuauuuuuucuuucaaaaauuaaaauuuuaugaaauaguuacacacaccuaucucuugaguuauauuaauauuauuccaugauccccucucucagaauuaauuuuccuuuauuccuuuccuuuccucccuccccgcucucucuuuuuauuaaaaaguaaccacccagcauuacagcauagccuauucaagccuaauaugggucuguuuauucaagacugcucuucccaaacaauuuaauguuaguauacauuuauugguuauuagacacaggucauugcucuagauuacugugguauuugcuuuuaaaaaaugauucuucacaacagucauucuagauacacuguguuuuaaauacaguccuugucggucuuagaaucugcauauaaagguuguugaacuucagguauucaauuaugaauuagauaaacuaagguaaggaaaaugucccaguaaaccaagaauauuacuauuauuuguaacaaaaaagcauguuugugcagcuuuggagucuucugaugccaacgaaaaaguugacggcccggaucuccaagcagugggcagacauugguuuccaaggugacgaucccaaaacagacuucagaggcaugggcauacucggacugaucaaucucguguaagucaaaauaaaguuucuuauuucuuggcugaacaaaauucugcaguugcuucauauuaacucuuaaguuuucauagguauaaugcgcauguuugcuaguguguugacaacauucaaagacauuguguguguuugugugugugcacgugugcauaugcacguacgugugccgaguuugucucuugugugcaugucugugugugugugcacaacugucugugugugugcgcaugucugugugugugugugcauguuuguguguguaugugugcauguuuguguguguauguauacuuccagugccuuccccuuccugugucuuucugccucacuuuugacaucugcuuaacagucaugaccaccccuuucugguuuugucgucuuguuuccacuguguggacucugauuccauuuggggcaacacccagguuaggugacaugcuccucacuaccucuggcccugaccugaacccugaguccaggcuauaacaaccugccuguucccucagcauuuaggcuacaugcaugcaaucccagauaugcaauauaaaucacaacugauagucagcacucuuccaguaagcaagaggaagaucaaguucuuauaccagugguucucuacuuguggacugugaccccuuugggggcagcauaucagauauuuacauuaugauuuauaacaauaguaaaauuacaguucugaaguagcaaugaaacacuuuuaugguuggagccacucugcuagauagcuauacagguguauacaccaucguguuugaguuuaucugugaucgugacuuacaaauuguaacugauguugagaaugggaagccaguagguuuuuuuuuuuuuggauaauuuuuaaugugaaaaaaaucugaauugaacuaaacuaaugcugagaaaauuguuuaggucaauguggguaaagcuguuggggaaaggauaugccauaaugagauuucaagaucuaugcuauuuuaaauuauaaaagcaugcauguuuuggcaaugccuaaagcuuaauaguucuauguaguucugcuuccuaaagauaaaucacacaguaagugacuucccugccuccacuggaagagacuccuacugagccugggguaacgugacagagucugacucuagacugugcggaggggucuugguguaccucugaugaccugcaguuucuucacuguauuuagagcauaggcugaugugaagauggccagcauccacguccauuagugaugaucugcuugucagcaguguguuacaagcgcgcacucuagcguggcagagaggacagacagugaggagaguggcccggcagcugcacuuucguauuggacaggaugagaguuggcagauuucagaacuguucuuuuguaagcaaauaggacaucccuuuguaggugauuucucugcugaaauggucuugccaagagccagucugucugugguccuuauuuaaucaggugccaucaggugccuugagguggagaugguggagcuguggcagcgagggcacggucugacagugcacgugccugcucugaaguauuuacccugcuuuuggugggacaucucgcuucaucauuucccuugacuuguuuagguauuucagugaaaacuacaccagcgaagcgcaucagauucucucccgcucaaaucaccccaaauuaggguaagcugggcaaacaaaaaaacuagacucuugaagugaaaaugacuguauauuucaaaauguauccuaaaaugauguuauuuuaaugauugaaacugcagaaaggauaauauaaacuauuuuaaggaaaaaugaucauaaguguucuauguauuccaaaauaaauuuuaucacaugauguaguuuauaaaacaaagauaagggcucauuuuuuuuuuucaaggacuauuucaaaguagaaggagaaacuuaggaaaaucugaguuagcuuugaaaauaguaaagaaaaugcaaauugagcccuuguuauuagcuuuauauugcuuuguauauaauaacuagaacaauaaagcaugguguauaugggugucccucauuguauuuaaauguugcagucagaacuuuuauuuuuacuucuuagcuucuauucagaaaacaacagucuucaaaaaaacaagcacuuugcggggcggugguggcgcacgccuuuaaucccagcacuugggaggcagaggcaggcagauuugugaguucaaggccagccuggucuacagaguaaguuccaggacagccagggcuacugagaaacccugucuugaaaacaaacaaacaaacaaaacaaaacaacaagcacuuugaucuuucucacugucugaguucagagagguuacugcaaaguaggcccugugucaggagugcaguagagacaguuuggaguggacuaaugagcucuuuacaugcuguaagcuguuacgagcgucagcuagcuguguaacuggcaauguuucugacguagguauucuuaugcaauaguuggaaucaaccuuacagagauggcuuauagcuuacugaagagcgaggcccugaagcuucaccucuacaacuuugucccugggguaccaacgauggagcacuuccaccaguuuuacugugaguaucggggucagaaccagaccugaccaagagcaauucuaacacucagcgaggcagaauauagagcuuuuaaccuaaugccucugaauacagaguuuaugcuuaucauuuuauuguuuaagaucuuugcuauccaagagaauaauggaagaugaucucuaagugcacuuuaaacauuacugucuauauuugaacucagauugucuggcuggugugacaagcagccuuauucaccaagcugucucccugacccaagaugcguauauacuuucugaagauggucuaaauagaugauuuuacuccuguggacauguauuuguguguuuuuacuugcagguuaccuugucuaugaauuugacaaguuuuggcuugaggaagagccagaaagcauuauguacuucaacuuguacagagagaaguuucacgagcggaucaaaggacucuugauggauugcaaugcugugcucacuuugaaaacaugaaccauccguguaucuucacuuucuaccacauuuugcacacacaacagaauuuauauguuauuauagaaauuaucugauuaacuacacucauauaauuuccuacaaaaauacuucagaaacucuauuuaagaaagcuagcggacaaucaguguauguuuacaguuguuuauacacuguucuccaaaggucccuuacccuuccaaagagcccuuccggagguacaugaacuacaguuuggaacuugggucuuagccuguuaguuuaaaaguauaaaucagguauauuuauaguuagccaauugaucacaaugugcacaagucuguugucauuuuauguguggugcucccaagcuggugucuuuuugaaaauucugcagggucauuguuugcucuggaaguggcuuuugaaugcccuuugucuuuuuauuucuaggcaaaucagcacagggugcccucugaggcuuucuuugugucuuuagcucuugucaagauguccuguccuuggagcagagggcacaugacucugucagggaagguggacaaucauggcuuccuuuugauuuuucuggucacugacuaaagaaccgagacguggcaguacugauggcugcuucuuacuuauaaguagcccgugugggagguuuuauccuaaggagucuaggcauuuacuccaggucaguauuuguuuuuaucagcuguagaaggaaccuuccucagagcccccugggagaaccccgccuguguguuuagaaaggaggugccucugcugagaaaaucuggacugcauuugaaacauaguuucuuuuucgauaaaacugucuuugaaacuuacacaagaagaaaaccgagagcuuuuuagacaucuguucccuaucauugguguguuugaccugcuguucacuuuugcuugcccuugauuugacucugguguuucuggguaauauuguagggaccuggguuagugggcugggacaugcuaccauagccuggaucaugacugugcauuuuuguauagcuuuauucuccaaagucucaggagggcagcaaguauugucgaggauucuaugugaggggauucuaauggggugguuuccucuuggcaugcuuuagcaauuuguucucagagcaaaacaaaaagagccuaaagauaagaaagaugauuggacuuagaagcacugaguacgucccguggaaaccagucuacaacaugauagguuaaccuaaaacauggugcuguuuugcacaucuuuuaauaucagguauuuaaagacuagcuugugugauagcggaaaguuugcuguuuucucacaauuuguucauguuuucugucaagccugucuucccacuugugggguuggggggagagagcaagcaugagaaagucaugugcaguacggaugucccaucagagagccacagcuggaguguuguauagcacuguguugcagagcauggguucaaauugcuuuuccuuaaggaagauaaaacuuuuuuuaaaaguagcuuuguuuuauaauacuagaaaggauucagcuuuucaguauuauaggaauuuaauaauugauuucuuauaggggacuuguugacccugguaauacaguaauuucauuuuugagaaaucuuuugucacccagguuuuaggaugcauuguguaccaaaacccuaacaaggagcccaugguuaccauuguuguccacuguauuauagugugaaguccuccauggaaagcagcuguguuagucuuuaacuuuugugcuaaaaguacuuaugcauguauuuuaaucuuugagcagccuagaucuugaacugauuuaacucuuuaucagcauauguaacaaaaagcauacuugaaguaugaaagaggaaguaauaauaauaauaauaaguaauuauuuucuggcagaaaaaaaucucuaaugauguuaagaacauauugucaugguuugguuaaugucacaguccuuaaauccuccuuuguacauuacagauauuguuuguuuuuuuuuguuuguuuguuuauuuguuaaaauuaucauuagccauuucagauaauuauauagugaacugauguguuagccaauuccagcuucaaaguucugaucuucugggagcuugacugucacuaguuguauacuagaaugguucccuuacuugcagcagacaucagaacuucaugcaguuuuaaaacgcauguuuagaugcuccccugugucuaggacuuguaaaauuacaauguagcaauugguaguaauggcauugaaguacaagaaaguuacguuauuuuagauuaaauccaguagaaucgauguggagauggauucuuguacaugugacgaugaaaauauuucaccagugacaagagcagcauaagaauagaaccacaacauuuaacaguugagaugcucugaaagacaaucuuuuaaacaugggagacacuuggguaucauggauccuagaccaggcucuuuguaaauaaauguaacaguacagguagguauaaaaaugaacuagcaccauuuauaguucaaaacucagacuguuuuucuaaaaaauuucuucccuguuuauucuuccuuucuauuuuauagcuacuuagauuuguguuacuuuuuauggaaauguaugcagcguuuauucuucccucaguguuagccaucauucauaucauucugucccuugagaauauucagcaaaagggauuuugauuacagguuuugcucaaagaaaaacaauuucuugggugugaaaagcagcucuucauuucugcagcagaggggagcaacagcauagaagauggagcuuugccuaggaaggugaugguuuauuauugugcucauaacugggggccacagcugcauccccagcacaggugcucuacucuaauccacaaaggauggugcaucuggggaggcuuugucgucacguucauguguacugccucuccacacaaauggcuuuuaaaugaagauggcucuuucacacucugagaaagaucaugauguguauuuuuguuuucugucuccaauuuuugaugagauaaaaguuuaaauguaguggagguaggacccaacaaccacauugacguugguagaguaguucuauguuuuguuaaaaguacugacaaauauuuaaguuguaguguucccuggagggaaagcaccaguugguaacuuaaauuuuugucucuuuugcaucaagcauuugaauuucauguaaaagcaauagugugagaugugacguccuuuuguuugugauguuaagugagagaauaaaaucacagcugaaacuguugaaagccuuucuguggaugcuugagcugccccucaucccuauuuaagucguuugaguucaggaaacaaugcuugcuuaaguuacaggugaguuguaacacacagacuugugacucuuaaaucacuuuguaauuauauaagaugauauuggcucagaguaaguggcucugagacucaaaguauauuuuacaagaagccaccauuucacccaaacucaucccauuccaccccguuuucaccaaagguagaagugauucauacacacauuuuccuuuacaauguuuccugguucuauuuauauacuaauacucaauuuguacaguugcauggcauuccaguaugugcuuuuguagauguauuuuauuuugaaauaauaaacucuucauagagcagucu

SEQ ID NO: 4564 - RNA, 1113 nt, Mus musculus
gacgucauagguggcuccaauacacagagacuugucccaggauacauccccaccaaaacuccugaugaugaaggccaaugcuucacggggcaccucucgguucagaaagaacuucgggccuucaaagaguuucuugugcuuuuccugugccuccagcucuuuccuccgaucuuccuccugugcugucaccucccuaucaguagggaauucaucagccucagccuccucuagagcaggcaccaccacucgggccaggcuggcacugagggcagccaguuucuccauagagcucucagaguccaaugcauauguguccucgcugaucuuugucucugcuugggcuugaccuucaagcuuugguggguagugaagguugagugacugguagagauggaaguugacgaagcccaggagcaugguauagaacucagugaagguggccaugacccuguaguccacaucugucggaugaucaugggagaaagcauagggugcaauccauacgaugagcugacccagcacuucagccugauaauaaaugccuuuauuggacagggcagggcuugggcagugaugacguagggcaagaacugcacagugagccgguggcacaacugaauggucugcaugugacacuugccaguccaagggaagguggagaagaggaagcacauugacagggcauccucgagguccagcagagcaucgauaaaugugggguaccgcuccuugacaauguggucaaguuuguagcaggguuuauuguccuucaggcucuccacagcauuccauucccuccuuccauaggcuuugcggagcuucugaacaaacaccuuguacugucggaacuuguugacgaugggcucauggaggaggaauuuaaugucuuugauaagguaaaauguccgggcugcuguggaacccuuguuagcuuucuucuuaugcuuggguucgugaggauaaauacuuuucaggaugcacagcugccugaagucaggcaggcucagcugcagcuucuuccuggccuuguuucuggugauauaauugguggcagagccucguucauacuucuucuuuuccagaccucccauagcuccucauugagaaacucaa

SEQ ID NO: 4565 - RNA, 4959 nt, Mus musculus
ggugucagcgagccaggaagcguuccaucguucaucucuaugacccccgccgcagccuagaugacccggaagacacugaaggggcagugcuuccaggugggagcgaggugaccccggcuacuaaagaaggguaaggcagaguagccaugggggcgcaccugacccggcgcuaucugugggaugccucgguggagccugaccccgagaagauacccagcuucccgccggaccucggcuuuccggagcgcaaggagcgaggugagcucagugcgcaggcgcgaccgcagaucccgcggaacucagcugccugcuugcggagggccgggucgagucgggagggcgaccuccuugaguguggaggcugugcggggauggcuaaagcaaaaggcugggacgagacagcagagaacgggaagaugagacugccccggugcacuucguccugggcacagcgcggagccuaggacauguucuuugcaucuccauacauugucacuagcauuugguuacguacaauaauacaagguuggggggcuggagcgaucaugcuccuuguccugucuagugugauggugcugggggaggaacccaaggccuguguguacucgcaagguucucauucuuccuguauaggaaaaucagagugacagcucuggacaaaguccuaguuuggcacuugggaugccccaggguagcagagagccacuggcgcugucuucagggagcccccuggacaaagcagcguguccaaaaagaucugggaagcaaauuuaagaguguagaagcacaggcuaaaagggguguauaugagauugaugaagcugguaccagggagggacagagccccacuuguaagcaggggaaagacacaaaugacuugccuuaccaaaagguuguagugucgacuagaagauggcuccgucaguacugaaucugcagaacauuuacccaccugacacccugcuuugcccauagucauuuugaaaauacagcacucccuggccgccucucuugcuuggcuaauccaaaacccugguaaaacucagcuggcccugcugaccuggucuccaaguugcuuccucacuccagacccccuucuuauuuuugagucagacuagucucuaacucacaguccuuucccuuuggccucgggagcacagagcucauaggcccaguggugcucagggaugcuauagccuacauuguugcuucuauaguucuucacugccucuucaucuuaggcaagcucuugugagaaagcaagaguagcuccugcucccacacccaugcaucuccaaacuccuuccaaaugacuugucccuagccuggcggaguccccauuccaggugaacccccccccacacacacacacacaccccuuuauauccuccauccacccucuacaaugaaaggauccugcucccgaaccucucaucaggcuccuguccaugguuuugaaacacccccacaggaacaucaugaguuccugggauggauagcaauccugucucaaaaccuaaguauaaaaauccccguuacugaagggcuccucucaaggcucccagccagccccagcuccaccugucauuccccaccucuaccuugcucaccuccacuucccugcgcacucucacugauuguuccucggcucccuugacugccuugaagcugcugccuccuuuguucugcccuggaggcagcucacaacugugugguguacaccagugcuguccacuugaucuccaaggggagccuuaaccuugaacuuauaaaugacauugcugacuuuuguuuucugaauuuuagggcuuuauuagugguacauguguaugugagcacucgugugcauugacggccagaagucugcagaguguccuccugaaaucacauccccuuuccucccccaggagccaccacccccuuccacugacaccuuaauuuuuaagauaggguuucacucuguagcacaggcuggccaaccucugaguguugagaucacaggaguaagccaacaagcccagccuggguuuuauuuuccuuuugagacaggaucuugcuguguagcacaggcuagucucaaaacucuuaccucaggcuccugagugccgagauugcuggcuguaccccucugucuucaaugucugucuuguacucuuugagucucagcucuguccuccccuuaagccuaccgugcucaccuucccagucacugucaaggacagcucuaccuuucccugagcuuaggucaaaacccggaagcaggaaaggugccugcugccucaaggcuuuggcccccuucuaccugagauguucuugccccaggcaucugcccgacucggcccuugccucauggcccacuuuccagcacuuccuaacucugguuuugguuggguuugguuugcccucugcagucaguaaggcugccagccauucaaagacagugugcucagccuacuuugugucccucugaagagggagaccaucuauuugccugguucccuccuacauuccugcagcuuagcaggcaacagugugcuaaaggcuugcugcuggccucuugugaacuggaaaugagaggccagagcuugaguugcuaacccgagcuccagggugaguaacucuggcaagagccugccugugauuugagcccugggccuggaguacagaggugcagaguggagggaccagguuggccucaucagccuacuguagcaucaacagucagaagugcggucaaagcuguaaagaagcagguggcugcugcugggcucgggagcuccagagagagagcaacacagaaggcagagaaagccuaucugggugacaugcaacccugcugaggcacgucugggcaccaggugagaagcccaaaaaaggggacaaggaccugagaccauguaagaaaggacgguagcuggaagcauaaugggagacaacagcccugacaggaauuggauacccccaccccaccccaccccagaggaaggccagcaggugauuggagcaugcaguggcugugcagggcuaagguuuucccaaggccucacacaagcuaccacugacuuaacuccaaccgguuucuguguauuuuuuuaagguucuuuuuguuuuuaauggucugaauagacauuuggacauaaggguucaggugccagauaagggcagagagggcaguggaucccuggagcuggaguuaucggcaguggugagagcugcccaccccaccccacccccacccccaguuuucugcaggagcaauacaugcuaagccagcucucuagccagcuuguuugguuugguuuucaagacaggguuucuguguaguccuugcuguccuuuagaccaggcuggccuugaacuuggagaucugccugccucugccucccaagugcuaagaucaaagguguauaccaccaccaccaccaccucuaauagaauauguuuuagugcaaugaaauaggacugaggcccacccagguggagaggagauaggccuacagacccagcaaagcagguaugugguugagggccauaguggagacaggcuggcgaguuucuauuacuaaacacuccugaagggucaggcuugccagugauagcugaucuacccgaggcuuacuuaacacacacacacaugcuaugugguggccuuuugucaacaucagacuccaaacagugaaugcuauaaguccuauaagcuagugacggaccuugguuugugugagcacaugcuacgcugaucacaccggcaccccaaugaugcuccaaagacgcuuccuguuaccacagcucuguugacuuaguggacagcccggcaccuucugugcugggacuggcaucuuccagugggggagcaaaggcugagaggccccaguacccacugaaaagcugaaauucagguuccauauggcuuaggggcuggggaaggugagcugagcucucugggagacagcaucucuagaugaagggacaucagaguucuuuauugcuguuuaggacauaggggacgaggagucacccuuccugucagggugcagccauaauccagauggguucugcuaagccauacugugucuggcuuccguuugugccaugugcacaccggggucuguggagguggggcuggcugcagggcugagccucaccacuccccacagugaugguggccacacaacaagagaugauggaugcccagcugacacugcagcaacgugacuacugugcccacuaccucauccggcugcugaagugcaagcgagacagcuuccccaacuuccuggccugcaagcacgagcagcacgacugggacuacugcgagcaccuggagugagcccgccccgcccccacccgccccacccacaccacagccauccacacugcagccauccaccccacggccaccuucuccacagcuauccacaccacagcuauccacacugcagccauccaccccacggccaccuucuccacagcuauccacaccacagcuauccacacugcagccauccaccccacggccaccuucuccacagcuauccacaccacaacucagcuauccacaccucggccacccacaccacagccacccacacugcaccacagccacccacaugggcaugggaagaggcuggagccaccuaggacaggggccaagucagaauuccugggggaggccucaccccuagcaagggcuuccagguggcuggaauggacucaagacaaaaccuauggcacugagacccucuauguucugcccacaguuacgugaaacgcaugaaggaguuugaacgugagcggcgacugcuccaaaggaagaagcgaagggcacugaaggaagcacggguagcccaaggccagggagaaggagaggugggcccugagguggcccuguagggauuacccgccagccuguggaccuaucagugaaauaaaagcuuugggucaccugccuaaacuuca

SEQ ID NO: 4566 - RNA, 36277 nt, Mus musculus
cuacagagacgggccucuccgaaaggccgcacccuuucccccagguuaucgccggcugggagguucugcugcgugacuugugguagcuaccugacaaguaccucuaagcuuuccugcucuaacccagggauaaaaauaggcaccccgcccucuucugcccguagcccuugguuuuucccguaaggccguuacuguaaagcgaggugagacuggucugccuugggcuugcugcagucgggcugccucuccgguuuaucuuacuuccuacuaauuccuacuggguuuagcucgccucuuggcguucugauacuugucacuuccuuugccgucugaguuuaccaccagggcugcgugauuuuuuuaaagauccacugggugcuucguaaauauuuccaaauacuuugauauaguauagcuuuuugcuuuugguuuuguaagucugggaugauggcggucaaggacggagcugagugaggaagaggagagagcuucagauauuggaaggcauagagaagcuggaauagucauuggugguucuugcagggaaugggacugccugaaagugcaugaaagacugacucucauccuagcacuuucuggcugugugaccuuggguugguagaguagcuuuucuggucucaguguggucaucuguacaaagggaauggucguggaauauggugaaguugacauuauucugcauuuguuaaagacaagggacaaaggguguucuugaaagagaugauuaaucaucuuguuuaguggacaacuguugacauucccuuucuggaagcucuguaggaggagagucagauaacccuugcccuaggcaccccugagaaaaaugacuuuagccuuccguuaaugguauagcugugugugguguauguguuuugauuuuccuaacuguacugaccccaugaaaaccgaaccaguugagcccugccccccgccuccccauggauuuggagcuagggaacacuuguagagaaagugucuuuaaagguacagagacagagauagugagcuggcagugguggugcaugccuuuaaucccagcacuugggaggcagagacaggcggauuucugaguucgaggccagccuggucuacaaagugaguuccaggauagccagggcuauacagagaaacccugucucgaaaaaaaacaaaaacaaacaaacaaacaaaaagauacagagauagcgacagccugggcacaguggcauauuccuguagucuagugcagggaugcugcugcacgaggacucccugugaggccagccugccuucaaaauaggugacuagaaaucaaaguacauacugaacagaagagcugucccagaggcaaggaaagcacaggacaugggagugcuucacauuuacggggugauuuuaacggagaagugcaggugugccucuggcugggccuaucugggcuuuacuaagguuucuugccaugggggggggggcggggggcgggugcuggcuuguccacuacguuaugcaagggaaaucuuucuguuuggggauaaucucacaacuggaaaugccagcuuucuacguaaggcugaggcugauucaugaugggguauuuuaauuaucacuguuauuauuauuauuauuaucauuauuuuaggcacauucucauucuuuaacccacaguggucuuggguucauuauguagcccaagcuggcuuugaacuccagauucuccugccucagucuccuuaguguugagcugacgaguaccugccaccaugcuuaucagaaaguaucaguuguucaaaagcaaacagguagugucgugugccuuuaaucccagcacucuguagucagagacagguggaucuaugaguucaaggccagccuggucuacagaauuucagggcaucuagggcuauacagagaaacccugucuuuaaacaaacaacaacaaaaaccaagcaagugcuucucagugacgcagggugugggucacauaggcaaggauccuggguuccaugucugacagcaaacaacagacaccaaaauaaagccaaagacucuaugauaccccccccccaccaccaccauggggaagcucauuggaugcugggcucugagccuggagaagcuguuacauuuagcaguuaugcaugggcuuguucaauuacacaggaaguuauuuuguauauggggcuagguuaacaucuucuaucauuaggcauuaaguacaggagguccccucaaagaugugagugggcuggcccaaagcaaaugccaaauagucuugaaugccagaauuagccaugccaguuguucauaacugaaaucccagaacuugggaguccgaggcaagagaguugcugggagcuugaggccugccugggcugcacauucaaggccagcccacguaaaauuugagacccugucucuaaauauaaaaguagggccaaggagaggucucuguauggaaagcacccaaguuugauuaccagaaucuacagaaacaaaauggaaaaacaaagccaggcauggcgacaggcaccuggaauuccagcccuggguaggcugaccagacagccagcuguugggggaugguuugugcacuguguauucagauguugauuuuaugcccagacaguguguugcaguuccuaugaugauaggucaccaugagaacacacuuggagcagagguagccagggcaagacucagggugggaaauaggcggccuagagggguagaacagcucagaaccugcccagcuuagugcuugcaacuuguuaauaaaaauaccaggucucuguguccuuuacucaggagcuaaaaccguagagugggcguagaaacaguuacuuggcagcagaaggggugaagaacccuuccccaaauacuauaacauccagcuuagucuaauuagugugcccagugggagacugucucaaaaaucaagcuggaggcaggcguguuggcacaagccuuuaauccagauggaucucugaguucaaguccugccuggucgacaaguucagcugcccagguaaggcagagucaaauagcccaugauggauuggcacccauggccuggcccccguugugcuggcucuacugcugagccacaccccaggcucccauuaacuuaccuaauuguaacaauugccuucagacacucccauuuuacagcuaaagcucugagaaguuggaugcucccauuuuacccaggccacacaguaaagcaucgaagaguuuggguacugagcccuuacugagugcguucagcugcugugugauguggcccaaauggugguaaagccuugaagaguuuugcucuugcccucuugucuccuaucuguccaucaaagaccaucaaaaaacauggcagcccuuuggccaccacugccauucccaggaaaagccgaugugcaauaaaaacucauguucaaguugggaaugguggcauguagcuuugauuucagagcaaaagaggccgaagcaggaggaucucuaauuccaggguaggcugggauucauaacaaaacauugugucaaaaaaaaaauuaaaaggaaaacaaaaaucaaaacauacccuauguucaguggcugucaggaaagcaugugaggacucuucccaccaaaccugaggaccuggggcccacacagcagaaacggggcacugacucccucaaguuggucucuuagccacauggcaugugcaccccucccacacgcacacaaagugaguauaauuuuaaaaaguuaaauaaacauguuuauguaacauaggauuuuauuuuuacugaggcuuuaugaauaauuaccaacagcuugaaacuugaguguccuucagugguugaauacaagcugugauccauccacacaauggaauauuuuuaggccauaaaaagaaaaaaaaagccaugaauacaggcuacaaugccaguguacuucaaaacgcauuaugucagugaaagaaggcaggcucaaaaggcugugugguucuauuuucugugaccuucuagaaaacgugaaaguaugugagcacaucagcagcugcuagggacuggggagcugccugccacagacggggcacagggcacucugugaggaugaaagaaaugcucucauuuguaaugauuuuuauuuuuaauuuuuuguuucuuuugguuuuguuuuucuagacaggguuucucuguguagcccuagcuguccuguaacuuacucuguagaccaggcuggccucaaacucaaagauccacuugucucaaccucuugagugcagggaucaaaggucuauaccaccacugccuggcuugugugugcuuuccuuccuucuuucuuucuuuccuuccuuccuuccuuccuuccuuccuuccuuccuuccuuccuuccuuccuuccuuccuuccuuccuuccuuccucccuuccucccucccuuccuucccuuccuucccuuccuucccuuccuuuccuuccuuccuuccuuccuuccuuccuuccuuccuuccuuccuuccuuccuuccuuccuucccuuccuuccuuuccuucccuuccuucccuuccuuccuuccuuccuuccuuccuuccuuccuuccuuccuuccuuccuuccuuccuucccuuccuuccuuuccuucccuuccuucccuuccuuccuuccuuccuuccuuccuuccuuccuuccuucccuuccuucccuuccuuccuuccuucccuuccuuccuucccucccucccucccucccucccuuccucccuuccuucccuuccuucccuuccuucccuuccuuccuucccucccuccuuuccuucccucccuucccuucccuucccucucucccuucccuucccuucccuucccuucccuucccuucccuucccuucccuucccuucccuucccuucccuucccuucccuucccuucccuucccuucccuucccuuccuuccuuccuuucuuuuuuuuucuugcuaugucuacaaagcccagacuggccuugaauuuaugauuuuauguuucaguuucaugaccacuuggaauugcaggucuaugggauggguggggcuggagacucuauuagagaucuuggcacagcagaaagugacuaaacagcccuagcauaucuaagccuggcuucauaacuucccucagacagcucugagucaggauugguucaugcucugaaacaaugcaaggcauccaagacgaucgcuaccuacuuuacccugugugggaaauacccauggcucugugaugugugucuuauggaagucagaucguagccauccaaauaacugggaguucucccaaagcucaggguagaggagucagugagccuucaucucugcaggcugcuuagaaucaaaccuucaagucauaauggguacaccccaccaucaucagcaaugaaucagccacuguguuaggugugcgaggacacaguuggaagcugucucuacauacaggcccugacagggcugcagcacagugggagguuugaaaagcaaccagucuccauuuggaacuggcucuauugucugcagauggccugguuacuggaggcaaggugaggcagacaaggaauuuccaaccccagcaacauucaucuaaagcaggaagccagagacagagccucaccccugccaaccuagcaacuuaagaggcugaggcuggaggacuguaaguucaaggaugaccugggccucaccuggggauucucccucaaaaagccuagacuaggggcuggagagguggcucagcgguuaaaagcaugcacuguucucagagaggauucaguucagcucucaguguuuuccuguugauggcuuauaaacaaugacacauuuuggccccgcccugcucccugucaucaggaacuaccuuuaaggacuucuuaaccugcgagaucugucaacaggaaaaguugagagaauggucuaguuucuguuugcgcccucuacugagcuuguccccucagcucaagcuugugaucaaucccagagccuucccuggaggcacucuaccacggaugugcucucucccucucucucucucucucucucucucucucucucucucucucucucucucucucucucuguggguguggguacguguuuucccuuucuuucugguuacauagcccagguuggccaugaacuuacgauuucccuguuucagccuuaugaguacuuggaauuauaggccugugccacuacacccagcuuguguauguguguguguguguauguauguguguguguguguguguauguguguguguguguguguguguguguauguguguguguguauguguguguguauguguguguguguguauguguguguguguguaugugugugugugcaugugugugugugcauguguguguguguauguguguguguguguguguguauguguguguguauguguguguguguguauguguguguguguauguguguguguguguaugugugugugugcaugugugcauguguguguguguguaugugugugugcaugugugugugugugugcauguguguguguguauguguguguguguguguaugugugugugugugcauguguguguguguguguauauguguguguguauguguguguguguguguguguguguguguguggucagccucaguguuguucuucaggaguuguccaccucuuuuuuucuuuuuuagaugauugaaguauagggguuggagagagggcucaaguguuaagagcacuuguccuugcaaagggccgagucuugauccccagcauccauauggcagcucauagucacuaauaaccacagauucagagaauccaguaggcucauaugugguacacauacaugcaugcagcuaaaucauguaucgacauaaagucuaaaaacaauguaaaguauuaccucauuuuccaucuuaccucucccccuucuaggccugcauggcuucuaucacuucucacauucguugucucuuuuccuuuaauuguuauaaacagcugagucauguauuugggggcgggguuguaaggcagggcuucucuguguagcccuggcuguccuggaucuugcucuacagaccaggcuggucucaaacucagagaucugccugucuuugcuucuggaguacuggaauucaaggcuguuccaccauaacccaaccauuauuuuuuuuuuuaaaacagacuuugauucacuuuauuuuucauguauuaaaaacccuuauuugguagccacagccagagcuuuguuucucugagcaggcugguguggauuuucacaagauggucagugaauuccugguaaggagacuuggcaaacacagucucuuuccagaggucgggggggucagguagcugcaggucuuggagguggcaucaaaggugaccuugacaaaguugccgaugguggcaguauagccccuggcugaugugcagccgucaucaaugccagccauuaucaguagcuucuugggcacaggagcagagauaaugccagugccucuggggggcagggauaaggcacaccagcacugaaccgcagcggccuaucaccuugcagggaacaguguggggcuugccaaucuuguucccccaguagccugucuguacaggaacgauggaaagcuuggcccagacgauggccccucgaauagcagugacgaccugcuuggagcacuuaacaccaaggcccacaugaccauuauaguccccaauagugacaaaagucuugagccuggucugcuguccagcuucaagucugcuuuugcacuggcuggaucacuagggccucuuucuuuagggaugcccccaggaaaaagccaauaaucuuggauuccuuaauggacagggagaacagguugaucuccuccaggggauuaaucauguccagguggcccagcuuggugacagggaucuacuucuugguuuuggcuuuaucuccacagccacaucuucaaccucuacagcagcuccuaagacagcugcugagccucaguggaagcugcagccuccucaucuugggcccuccuguugcagugguauuuuucugaagaaacagcugagggcuggagagauggcucagagguuaagagcacugacuguucuucuaggguccugaguucaaaucccagcaaccacauuguggcuccccacccucuguaauggaauccaaugcccucuucuggugugucugaagaaagcaauuguguacucauauauguaaauaaauaaaucuuuaaaaaaacaaaagagguuuuguguuuaaaaaaaaaaacacccagcugagaccguuuacuguuuauacauaugauuucagggcugaccauuuaguaguggaugaucaauuaggggucucauucuuggggaagacugauucuuccccucucugcaguuuuuaguucccugugguucuuuguuuaaaggcaggcacauuagcaugucuuuuggugaucucauuauucaggucuuauuuagucagccauauuauugagguauuacagguauagcuuccuugucauuacccaggauauacaaccacacaacagacuuccugucccucugacuccuacaaccuuuucauucccucugucuauguggggugcggugguuuuaguaggaauggcccccauagacucauguguuagaaugauuggcccauaaggaguuguacuacuaugagguguguccuuguuggaguagguguagccuuguuggagaaagugugucacugugggggcaggcuuugagguucucauaugcuccaacuacacccaguauggcucacaguuuccuguggcugccuguggauccugauguagaacucucagcuccuccagugccaugucugccugcauuuggccauacuucccaccaugaugaugauggucuacaucucugacacucuaagccagccccaauuaaauguuuuucuuuauaagaguggcuauagugauggugucugcucacagcauuaaaaacccuaacuaagacauggggguuguguuuuagauauauccacugagucugggcaccccagggucaguugcucucugcauuuucuuuuucuuuuuuuaggggggggguuucaagacaggguuucucuguguagcccugacuguccuggaacuuacuuuguagaccaggcugaccucaaacuccgaaaucugccugccucugcuucccgagugcugggauuaauggcgugugccaccacgccccggcuguucucugcauuuucaacagucauggcuuucuauaauggccucugucuaccacaagagagaaucugcuucuuuguugaggagcagagcuacacuugccuguggguauaaagcuaagaaucuagaacgaagugaggaauuaugcagguuuaguaaagagacaaaaauagguucuccuaagauccgugaccucaccggccaccuguaguuggcuagguuuauaguacuaggugugauuucccacuugcugagcaggccuacaaucuaauuagacagcuguuuguuacugcuaagacagaauaaccacuuugcaccucuagggauaucuggucacagugcuccaugggugucccagcuggguaaggcuauugauuccuucccucugucggcagcuugcagcacagcaccuucugggacuaugaaagccaguccucaggaaggagaguuuuuaggucagauccagcugaaaucucuaaauccugucugaaccacauggugucuuugucuucagcaucuuuaaccucugguaaccaagggcaacagcaauagucuguauuguuuugggggagucuugaaaaaggguuucucaugccugcacugcaacuucugccugguaguacagcuguugggucuuggagggcacauuaauuccccgacuggcacaacaucauugagacaaugugcauguuuaucuguauuauauauaauuaaaacuaaacauaaaacaacaugauucacuguggcuuuucaaacacccuuaguguuacucauuacucuuuccuccuucucauucuguaucgacauuuucuuccauucugaaguuaaagucaccuccauccccugauuucuuccuucauaacacuuggcccccgucacucacuucucugguacuccccuguugugguuuuuuaacuuuccugguuucugcaggucagguuauggaccuaaaucuaaagauuuggagcuaggagccucaaauuugagaacaccuguggcauuucucuuucugggucuguguuauuucauuuaauaggaucaauuugaguuccauguuccauucauuucccugcaaagcuuauuggcacaagccauguaggaaaaguuaugguaagcgagugaguuuucuggagauggccuaccauuuugcauggcaacaaugggugugcuuugagagacauggaccccagagauuucgccccaggauugcuucuugcugcugcugugucuuuccugccacuaucacacaggcuaaggaauccugggcaucagcccacccuauugagcaaacuuccugcagaucauuaugaagguguacuuucauguaauaaugcuguuuagaugaauugaugauuucauaauuccugauaaugauuuuauagaacucuugaauugauucaaguaauuuuaagcuccugguaaaauaaaaagcugcaaauagaguuuuuaaaaaaauauuuauuuauuuauuuuuauguauaugaguacacuguagcuguacauaugguugugagccaccaugugguugcugggaauugaacucaggaccucugcuugcuccgacccugcuugcucugccccaaguuuauuuauuauuauuauauauaaguacgcuguagcugucuucagacucaucagaaaagggcaucagaucucauuacguaugguugugagucaccaugugguugcugggauuugaacucaggaccuucggaagagcagucagugcucuuaacccgccuuauaagccaucucuccagccuguaaacagaguucuuuguuauggcauguaaauugcacuaggaagaaaaauacacuuagaacaaaucaauuauucuagaucagguccaaggaugaggccacaagugugcacuauggaaaagcaagggcaugugaaacuguugcuuugaacuugugagcuuauagaaugaaacacugcuuugaacuuacuauugacaucuucugggacucccuuuuguuuagcauuuuaucugugagguaauuuuauaaagaacuuuugucuaagaagcuauaaaaaggcugggagaaaaauaaauguguagaugucaggcugacuuccuuuuuuauguuuuuucuuucucuguggagccaguuauuuauuucguaguguucugccugcauauauacugcaggccagaagagggcacccgaucucauuauagauaguaaugagccacuuuguaguugcugggaacugaacucuggaccuuugggagagcagccaaugcucuuaaacucugagccaucuugccagcccucacaaagaguuaaugagcuucucgacaggccagugagaggccccugaguuaaagaauaaagaguccaaguaauuccauuucuuuuccuaaucuccuacugcuaucagcaggagucacuugccagaagccaccaguccugguccccagaacaguaaaagaggguuagugaccagagggcauucuccucugcucugcgccccacaucgguaccugagugucaggguggaacccugacaguucacaauuucaguuuucuuuacagcaaaauaguauugcacagaguauauguaccacacugccauuagccagccgucgaucagagaauguuuacguacguuguauuuccuagcuacuguguauggcagccaacauggcugagcaaguaucuguggagugagaaguccuuuggucauaugccaaggagcaguauagcuggauuauaugguuuauuuuuuuggcuuuuugagaauucucaaacuuauuuccauaguggcuacaccaguuugcaauccucccagcagugaacaagggguuaccuuucccuacacgcccucuagaauuuguuaaugguuguuuuauugguuuuauccauucugacagagaugagaugaagccucaaaguuuaauuucuguuucucuaacucuaaagaaugaugaauacuuugagauauauguuagccauuuguauuucuucuacugaaaacgucuguucugauccacagccccuccccccuuuuucuggcaagaaagucuacaauuuuauugggccuguuauauaauauuauuaaacuaacccuaaaugccaugucugaacauuuauuccugcaguauauacauauauauauucaggcugcagacuacagcaagcagaaucuggcugcacuaggcuuuuaacauuuuauauuuacuuaugagaguguguguauaugugugcuugcacaugugccauggugucucuguuccggccuuacauuaugugggucccugggauugaauugagcccauuagguaggauaccaaaugccuucauuuguaaugucuuuuuuuuuuuaagauuuauuuauucuauauauaugaguacacacuguaguuguacagaugguugugaaccuuaaugugauuguugggaauugaauuuaggaccucuacaccucugcuugcucuggccaaccccacuugcuccgguccaaagauuuauuuauuaaaauaaguucacuguagcugucuucaaacgcaccagaagagggcaucagaucucauuaugggugguugugagccaccaugugguuguugggauuugaacucaguaccuuuggaagaguaguuggugcucuuacccacugagccaucucaccagccccuguaaugucgucuuucucugcacuguucucugauguccuguauuuuuagacuggcagcaccugucauuuuuuuccuguauauuucaagggcucaguagcuacauguggccaguaguaaccaaacuguacacgauaacgcaggcagagacaaaggugguuuugcuucuagggccagcucaacugacaggagcuguuuuaggaggggcaccuguagaaugcggugcagguuuucuuuuccuuucuccauucgugauaucuggaguccuuucaaggguccuggugauggaugauaaucugaggucucaucucuuagaugagcuucucuacaucuacgaauucaccccaagccuggcucuccgggccacgcagcucuuuguucucguuuugccgcauugaccccucagccugacgucgcuggauuuccaccgcaacacugcaaugggcggagccagagggcgcgcggcgcccaggcuuccuuuugauugguggguggccggguuuuaaucuugcuugccaaagugggggggaggggguccgcugcgcuccuuggaucgagaaaucugauuggucaguuguguggcgcgagcagugggugcaccccacgcugauuggcaggagggacgcacgcauagaggggggcggagccggaguccgggagugcugcuccccgaguguguguggagcugggugguguuuggugcgguacggcggccacucaguugcagcagagcaggugccauccuguggaagaaccaugaagcacuacgagguaagcagcgcggggcccugggccaugauuaccgcagaccgcaaguguccugcagggccucggaaccuuuuuuuauggucugacucuccgccauggcgcaggcgcaguguagucucauugcgcaugugcagggggguauuuauaaaccugccacccagguuguuuggggaugccuuuucuuagggucuugcagggccuaggagaagcuugcagcuuccuugcagcauccuugauggccugaguggcagguguucaggaggagugcggugcggagcacuugguuuugguacgaacgauucucuugcacaauccuugcacguugucagcgccucgggcucaggaggggcucugcagccagccugccucuuccgaccuucgcacccaccucgccaagaugccugggcggcgagggaguugguuccagggucacgccagcccgugaccgccagggaagaaaucugaaugcgcaagaccauucuggaagcucaugucuucugacuguaucuugggucaccuuuccucuuaaaaccaaaucuucuaaugcucuucucgaccugaugauacuaauuucguuguugcugacuuuuaaguaaucaucauaaaacaguaacucacugcucacauucauaguaagaauacauuagucagggcuaacuaccguauuacugagguuuuguuauguccucagacucauaguccucugcggagggauuuguaguuuguuacuauguaggugaaagucagagauguccagugaguuguuggaaggucccugcuaguaauugcagaacagaaaggaaaugcagauuucuuuucaaaggcauaguuucuaaccacuagcagugcgguuccggguaaaugaaagcugccaagcugagaguuguguguauuucuccccucagaucuuaaauuugugaugaauuuagucaaccucagccuagccuuagguuaggguuuuuuuuguuuuuuuuuuuuuuccccuucccugccugcucccucaguuuguagugcuaggcuuagaacucagggcuuuucuccugcuaggcaaguacucuaaacucucuuugaucuuguaaaacugaagcuguacagcaguguacaguaucuccccauucccuccucccccagccccuggcaaccaccacuugucucuggaaauuggcauacuucaggaaccuccaauacauaggaaauaauccuauuuuuuuuuaucacaaguugaauacuaauauugcuauucaucuucuguaucaugauuauuguugguaguuuucccagggccugugaaaugaaucuugaaauccccagucuuuuuucuuuuuuuuuuuuuaacaugaugccagaggaccagagaugggagucugcaauccuuacgccccaucaacucugugcuuucaaaaggagguuuguucccugggguguuuuuccuuucccacccccucucuugcucugggggaaaagccauguucaguuugagaaguacaggcggaugauggaguuugcagccaaucauuuuaauuugcuaguagaaaaucaggccagguaggcuucugagacuuggggcgggugcuuuguuucaaggagugugaacacagccugaggcucacaguuuggccuggaaaacuugaucugguuuauuucagagccugauuucucccagugccucgaugggcugaugguaguuccuccggcagagcaguuguaugcacaagugugcacacacgcggcucggaggcucuggguuccacagcagcacaaaggcagggaagaaccaaacuggggaauagggguggagcucauuugguagagcacuuuccuaaccugggucggaucccuggcccugaggaaaacccggcaagcaagcugguacacgccuguaguuccaggucuugggacauggaggcagaaggaugcaagguuaucuucaacuacauagugaguuugaugccaacuggggcuagagauccugucucaaaaaugcaaaccaaaugaaauagacaaaaauaaauaaauaaauaaauaaauaaaaacaaaguuugaggggccuggagagaacaccacaggaagaccaacagaaccaaguaaccuggacccuuggggucucccagagaccgaaccacccacgaaagagcaaacaaaggcuggaccugggcccuccacacauacguagcagaugugcagcuuggucuucauagacaacuggagcagggacagaguuccugacugaugccugccuguggauccugugucccuaacugggcugccuugucuggccucaguggagagaaugcgcuugguccugcagugacuugauguuccagaguggguugguaaccaggggggcuucucuuuuaucagaggagaaggggagggggugggggaagcuaugugaggggggccgggaggagaaagggggcuguaaugaguaugugacaugaauaaauaaauagauaaauaaauaaaauaaaugggaaaaaaccccaaaaagccaaugugaccuuggugaaaaaaaaguuauuucauauauauauauauauauauuuuuauucucuguugacauuuguuuaauacacacugaggccauaguuuugggacaggagcaucugcuaucuucuagcccaguuugcagagccauuugcaguaccauuuuauugguacagaccaauaaaaaugggagagaugcuuucauaguuaagauggggaaaagugucagcuuaauccccauuaagagcagagcucugggcucuuaggccugcaugcaggagacccugaguuccagccccagcccuggauaaaaccaggcgugguaguugaugcuugugauugaucccaguacuugggaggugaaggcauuagaauuacaaguucagagucauccuugucuagcuacauugugaauuccaggccacccugguaggauggcucagcagguaaaggugucugcuauugaaccugaagacuugggguuaguuccuuuuaguuccuggaacgcagguggugaaaggaaagaacucccacaggcugcccucugacuuccacuugcaugcaucagugugcaucacaggcugcccucucugacuuccacaugcaugcaucagugugcaucacaggcugcccucucugacuuccacaugcaugcaucagugugcaucacaggcugcccucucugacuuccacaugcaugcaucagugugcaucacaggcugcccucucugacuuccacaugcaugcaucagugugcaucacaggcugcccucucugacuuccacaugcacgcaucagugugcguucaauuacaauaaauaaaaauguaauuuuucuugagguagaaucuguguagucuguguagcucugccugacccugaguggccuggaacuugccuuguagacuagucuguaucuggccuugaaccaagggaucucccuuugucuuccuaagugcuggguuuaaaggcgugugcuaccacaacaggcuaaaauuuuaauuuaaauaacaaaguaauagauaccuuugaaggacugagucgauccuuugcccucuugcaccucuguccacugggaaaccucccgucucagaagccucggagguagugagacaguucaucagguagagaugcgucuuugaggccuaccugaauuugauccuuucaccccacaagguggcaggagagaaccaauuucuggaauacaaugaauuuuaagaaggagaaagacuuuuugcccauaggaagacaccacagauauaaugaaguacaguuaauuauuuuuggauguuguggugcugagcuggaacccagggucuuucuugcacaggcuaaucaagcacccugcccccaaagccgcgccccccagacuuggugcucaggggcuggagagaugggucgagaagacccagguucaguucccaacaucaccaacauucugucuacccaucugcaacagcaguucuagggccccagcacccucuucuguccugugggcauugcauaagcuaagugcaugugaugugcaugcagguaaacagcccuaaacaugcagguaaacagcccuaaaaagagccaagcucagaaagguucaggacuucacggucaguuacggucacagggaagacccaaggcacaguggauuccaccuggagugcagauugcggcuucuugguaaguuuccuaucagcacaguucauugcuuauuuaucaguaaagagacucccuucccugccuaggccuaguggaggggaagcuuccugaacagggaauauaacuuaggauaguuauaaaucagcaggguuguuggaaaacagcuuauccugggcucaggguuucuuuuuuaaaauuuuuuuauuaguguuuuugccacuggagacggugcucggagagcaugccugugguagcucgagacagauacugugccuuguaaaucuccugagagucauccauguagggagucucuguagcccaggcugaccuugagcucauggaauggugagaguucaccaugcaggcuguaaagguagcuguuuaguaccucgccucaggccaguucuugccugccuggcucucucugaggacuuaguaugaaaauuuugaaaguaguuuuuggucaagagacauugaaaaaaauuacuguauuuuuuguuuguuuguuuuuaaugucaggcauuggagcccagggccuuucuugcaugugccacuaaacugcaucccuaggccugauuaaaaacauuaugguuauuauuaucauuaucuguguguguuugguguaugugaauuugggcaggggccagaggagggugucaugugccuaaacauucuuggcccaaguuuugacgcaggaaccugagucugggcuaggcuggaggccagcgaucccgggcaccacucuucuguccaucacaauucgggguucugggauccaaacucagugccuauaaaccacugagcuugccacuccaaugccccucauuuuuuguuguuguuuuuacagggucucacuauguagcccuagcuaaccuggaauuuggccacuuagaccaggcuagcuucaaacuuagacuaggcuagcuucaaacauagaccaggcuagcuucaaacuuaggugcacuuggcucugccuccugagugcuggcaucaaaggugugugcuucuaagcuccuggaguuuuagacaggcucucacuauguaacauaggcagacuuggaucuguguucuuccugcuguggauuauuggcgguacagacuugugucaucacgccuggugcuaugaagcaauugcagauaacagacagguaggugauaggugaggagaaaguagaccugugugcaggcaccgagucaggccucagaccgaauucugguauggcugccugacaaaaugguuugacucaauggaugggcuaccuucucagccugucugugcucggaaugaaacuguccuuggaaugaaaccugugugguugugaaaggaccaugaagguuagggaacaucacgaugaagcuagauaaugcuauuaaggcugugugugcaggagagcuuugggugugauacuuuuuaguuuuaauuuaguuuugguuuuuuugagaaaauuuuuucggaagcccuauccuggaacucaagagagauccguucugcuccugccuuucaaguucuaggauuaaagucaugaaucuccacgccuggccaacuucuuuuuagauugcucuuaugugccggugccaggugugcuacugugucuggcugcucugagcacgucacagcucuccugauugagcaugccucagaccaugaauauggauacauauggcuugugccuugggcacgcaguggcucagcuugcacaccucuacagaacccauaagcugcacggcacauugggccagcaaucucagccucgacaccuguacugugcagaugggagcugacccugcccggggccagcccccuccuuccauagcuguauuuguacugauucuccguccuaggaagacagcaggguauguaggcuuugcagcagaccuggagugggauccuucucugccacgggaagggguggggccgugcacauucuuuuauuuauacuguauuuuauguauauagguaugggucuuuugucugcauguguauaucuguguacugucugcguggcaucagaugcccugugguuggaguuauaguugugaacugacuggcgaguucugggucuugaacagcgauggccauguuuguguuacaggguggucucuuccaagcuuuggugcucuggugagcauuaggugcacacacugagcgcagaggaggcaagcugagacugaaggacccugggagaagcugauggucccgauguguacguuaggucaguuauugcuagggacgacuuagaggcccauagagcaccacagagccuugcuucacugacucccaaguggagagaggaacgaguggccuggacagacuggccagugcacagggcugauccagaaagagacuucuaguucugauaacauuguuggcuuugguugagugccuugcccuuugacaggcaggucuggcugggugggaaaacuguuuggucaaguucaggucuuaacaccuuggugcuauugauagugacagcccagaauguuuuaacagcuggggauacuuaccucagcucugagagugucgcuagccaucacagucauaauaaagcugugugcucguugccguuaguguugugcuccccacacccccccuuuuuuuugguaauagacaaggucucacuacucagcccuggcuagcuggaacucacuguauaaaccaggcuggccuugaacucacagucuucugaguucugcgaugaaaggcuggcaccacuguaccuggcuugcuuuuuucuuugucacuggggaugagcccaggggcuggcacaugcugagccauucguuacuguucuccaucccaguugucugcacauaccugccuguggucuuacaugugcaguagguaugguuccuagccacuugacauuuggggaaacagaggcacagaacaguagaacuucauguccguaagcuggcagguagcagaauccagacaggcccuggugauuacguacggagggaggggugguuaugugacugugcaggacauggccuuuggggccacuuuuccguuuagauuuuucucagguaggaggccaggauauggauagcauucuucggggcugccugggaggcugagguacugggcacugugccugacgguagcuaaguucuccgcucugaaucaucagguagaggcaagucugcaucccugucugcugcggggaguguagccuaccuguggcccccccuccuuugugauguuggggagcaaacucagggccuggagcagccgugaagguucucccauccuagcuguaccuuguccuuuuaagacauaaacuggucagcugguaacuauguauaugagugucuugccugcaugucugaauguacaccacauguguguuuggugucuguggaggccagaagagggcuuggaucaucugggacuggaguuacaggcgguugugagcucucaugugugcgcugugaauuggaccuggguccugugcagggccagcagguguucugaacugcugagccaucucuucagccgccuccucaggacuuagaauuacuaguuuacuguuauugugagucuguguguguaugugugugugugugugugugugugugauggcucacauguggagcucagaggacuaaggcugcugggcgugucuagagugccuuuacuugcugagaccugaacuaaacccuuuuucuuuuuuuuucuuuuucuucuuucuuuuuuuucuuuuuuuggaggggcccuguuuugagauaggguuucucuguguagcccuggcuguucuggaacucgaucuguaguagacuaggcuggccuccaucucaccuacucucucuccccagugcugggacuaaaggcacaugccaccauuagacacuuuucuuuaaaauaaaaacauuaaaaaaaaaaaaggcugccuuuacuuaugcguguuuguguuuauauacuugugugaguguuacauacacauguguguccggaugccagaagaggccgucgagaucccuuggagcuggaguuacaggucuuugugaacuaccugacaugggugcugggauccaaucaacuauugauuaagugguccgauugaacagcagcuguuaucaaucauggagucacaucuccaguucccacccaccuccccuuuuuuaaaagacagauugucauuauagccuuggcuggcuaggaauucacuguguggaccagguuguccucaaacucaacagagaugcccuucucugccugcagagugcugggaucaaagguguggccacccaucugguucuugcuuuuuuuuuuuuuuucuuuuugagacagggucucacugugaagcccuuacaggccuggaauucucuauguaaccccagcaggcuggucucgaacucacagagauccuccugccucugccugcugagcgcugggauuaaaagugugcgccaccacaccugccuauuuuccuuuuguuuuucuuggccauucauacuuuugagaaacccuguuugccuauguguugacuggaugacugcuaguuuuaagaguuugagcuuguuauguacuguggaguauuaauguccugccagauggauggcugcuggccaagcucucugcagugccuuggccagguuugggauugcccucaucccugaccggguccucacagcccugcucagacagcagacacuaccuggagcccagccuuccuuguucugggaguuccauguuagacaggcuggcugggcagggcaugauucucuagcuucccugaggaccuguggacuuuaugccggggaugaugaaacucucuuaccuguugaucuggccuaauguguaacugucagagggcagccuauuuuacguccucuggggcucucacagaaccauugcauuuggaaaggcacagggccacugcuuauuuucagccucgcccugccuugcuuccaagauaaauagcuuagaagcugggcauaguuuuuguugcaagcggagccuuuuccacuuagcccuggggaguacaagggccuguaucccuccugugucccuccugccaccuucugaaucuucuaucccuggaaggucuguaugugacagauccugucucacacucacaggaagucuccauuuggucagcaggaucggcuggccuucaggugugcuguucagcagguaggcagacagcugucaccuguugugccugcuguuacugcagcugucaccugcagcaccugcugucauggcagcugucacuuguugcaccugcugucauggcagcugucaccuguugcaccugcugucauggcagcugucaccuguagcaccugcugucauggcagcugucaccuguuacaccugcugucacagcagccagcagcuucucuaggagccaguacugcugcugccuuggcccccugaaguauccacaucccacccauuccugccuuucuuauuguaauuaaaaaaaaugauauuuuguuauuaacuuauuguucagauguuauagacuaauagaaucccaucauuguaaauaaaauuuuuaguacaguagaggugauuccuauuacuccuuaagcaggagauagugauaauaaacaguauaauauauguguguauuuuaaaauguaauugugugugugugcgcgcauugagucuucuaggcaaaaccuacaggaccgcauucugagccccauccagauccagguguaucuuuauuuuugagauaaaguuuuugccauguagcccaggcuggccugaacuugagauccucuuguuucaaccucucagugcuggggugucuagcuuccagguagguguuuaaugggauggauggauggagggucucagucugaccuuuccgguguacugccaguacccuccugugugcucccgugucuagcgcugcugcuguuuggagggaauuauuuucacagccucuggcaggccucugcuuccagacuacuaauucucucaaaaggaucccuuaagaauucaagccacagcugggguugguggugcucgccuuuaauccgagcacccaggaggcugcagaccacuacaggcauggaaugaguuccaggucagagaggacugacuacacagugaaacgccaugucagcagucacagcaaagcaagcagauuuaaacucaagucaggccucuccucacccagcccuuaggaccgucugccaugucaccucugcauuuccaccucaucuucuuccucucaugcauaugacuccagaccacacaucugugagcaucuguuccgcuuaacuugaggcccuuggcacagcugcucuucugugaggauggccaccuucagccuugauucuuucagggcuugaccgagagccccaucagggagcugcauccucacccucccucuccugacaggauuucacuaaguacucuagccuggccagcccgacacucacguaggccaggcuagccucacacucagauccaccugccugugccuucugaaguaugacuagggagguuuuucuugaccacuuuguauagaaaacuucauguacguccugccuccaccacaccugugucugucccgugugauguuuugugaugugaugucaccucauguagaccuauuugcuuuacauauucauucccuugcugucuuuccuuuacgcuggggguuaaaacuagaccuuauauaugcucagcgaguuccuggcaaagauguuuguccuaauguggccggcucuccagauuuccagugucuggaaugugcguugguuuuucacagucaaaggggauuauucuggcaagcugagcgcaugcggcgcaugcguggacucaccugccugccggcuuggguggagccaggggcgggcauaacggacaguggccgucgaacaccucuagucaguucauccucagggucucuggcuuccuuaagcuuccuggcuugcccgagucuuccuguccagaaauggagagaggcccgaauuagaccuuaauugcaaaagggcagcaggugggaggaccugugaacaggacaggcacagcccuggaggagggcagaggugcugagacugcagcucccagauugagagcucaggcacaguaagggacagaggcaggcgaggcucagcccugugaguucuuagcccuguccuggggcucgagaccugugcccccagcugcaguuucuugucagccuggagagcagcagggcagaugugcaugcugccugcccacagcccugggacacagaaggaggguaggggaaucacuaggugaggcucuuggggugggccauggcaguaugguagggguguuuggagauggcugucccuuccggucccaggaaguguuuuauauuuuuuugcugaggaugaaaucuuggccuugugcauacuaagcaccuacugcccacuuugauauagacccgccaccaagaagauaaaauuuuuuaauuauauuuuuuaugcaugcuaagccaggucucaguccugucugugggaacuuugaagucauauaugccaggcaguaguuagaaucucuaauguuggcaccuaggacaggguucuuccugccaguccacuggguacuacuguagcaaucuguuauuuuuuauuuguauuugagacaguauuuugcuguguagcccagguuagcuuugccugggacaaccucugccucaucacuggcaccggcaugcuuagcccauggcaguccucgugaaugcacaugcagccugaggguuagacgcccacaaaccuucccguuugccuuucugaccuuagcuaguguuggcagcuaguguuggcgacacuccugcucucccaggcggaugguggcgguggccuucaccugcugugggaaaccauggaauuguugcuccauccugccuuggcgucucuggacuuaggaggugucuuggguguggcccacuguaccaugcuggucuagcagagguggguacauaggguucuggggucaagaaaugugagucagcccuuggcuccucuguagcauccauaugcccugcguaggugauacugucugcaugcauuugaaaauggagacuggcccuuuaaaaucagauuugcuguagccggucugucuuugucucuguuucccugucucugucucucugucucugucucucucucuccuuuuggauaauuggauuuaggcaucccuuucuuuguaacagagccucacauauacuagucagaugcucugccauuaauccguacccaguuuuacuauauuucuuuaauccuuuauggugcuagaggucagugcagcuuuuugaugcuuuuugagacaggaucucacuguguagccuugcuggccuggaacguaacucuacagaugaggcuagccucagacucauagagaucuauuuuccccugccuucagaaugcuagguuaaaaggugcacaaacuaacuuuaaacaaaaaauuaugucuccgggcagaaacagaggcaggcagaucucugaguucaaggccagcccaguauaccuggucaguuccaggcuagccagggcugccuagugagauccugccucaaaaacaaaacaaaacaaaaauccaaacagaaaaauacagugugugugggcgugcuguggagccugcauguggaagucagagguuaugccacgggaaucugcucucuccuucaccacgugaguucuggggauagaguuucugcaucaggcuuggugguaagcaucuaagugcugagcuaucucucccccaccccuccccccuccuccucucucuucccuuaccucuucccucccuacuacuucccuccccucaacuuucccucccuacucuuccucuuuccucccuuuaccuuccuucugcucccuaguccuccccuccccuccccaccccucccuucccucccuccugcccccuuuaauugcuguggccucuguacucggugccaguccuggguugagagcuugugaacauaguguucagaguggcuucugucgaggugcaacgggcuggagcucgaaguaaccugaucauaggccaaguauaggcggucagcgucugcgcugccccugucugggguagccuguucccacuacugcuccuagagaggcuggcuagcaaaagaccugucccuugccccuggugcaccguggagaaauggguucagaugccaaggccacuggggaaggacacguuugggcuagagcaggugcagucugugcuggcagcagagagcaggccaucagcuaucacaacauuauuaggguuacuggguauuucuggaaaguaaaagagaacgggagccaaagccauugagcuggagucucggaugaacgcagggaggcugugugucuaacuggucagcugccugcccugugcuugggccaaugguugggccaggucucugcccucugggcucagcaaugucccuaagaagaguguucaugcccuuuugccucaggagugcuugcaacagcugacugaaggaccagagagguucuuugaaucuucacuugggguuuuugguagcagugagugcagagagcauguugccccgccacguggagauacugacuguguggcuguguccacuguggggacccgugccagggcugagagccugagggagcgcuggcuugcucucuccaccacuguggacucauggcugaccuccugccucaggcacuccuaggugacccagucuguagaccgugcuuccucaucuggaacaugaacacgaagccugcuguggugguuugaguaacaguggucccauaagcuuacguguuuaaauaccugguccuuagcugguagaacuguugggaaggauuaggagguguggccuuguuggaggugugucacuggggguagcuuuugaggucuacaucuuucccagcuaacuuucucugcuuugugugguugggucucaagauguaagagacaguuucagcaccaugccugcccccuugccaugcuccauacccugauggcuguggacucuaacccuguggaaccaugagccucagauucaaugcuuuuuuuauaagaaagccuuggccauggugucaucacagcagcagagaaguaacuaacacccacaguuccggcccuguaggcacuuauggagccgggcaggguugaaacugcuuaccaguguccccaccuagagucaucgggcaggucccauaguugaauacccagaguuccagguguguaaguuaguggcugaccuggaaagcuggucggaggcacugagcuagccugggacaugaagggcuuauaggcagaggaccuuggagcagcagggcucccgcauuugugaagagguauaugcagcuugaguccuguggcacgcagacauggcaggugugacccguccagccuggccuugauggggcugcuccuuccuacccggcuuggcagaccagacucuugcuccuucgucuucagguucaggccauuugggggucugcugcuuccauccugucugucuagaauccaaccauuguuccuccucucuugucccuccccgucucggucucccugccucugccucccccugucagacuguccugccagcacuggcacucgugaacucccgaaugaacccgugucccuucucugcucagaaacccuaugugacucccaucugagcccaggcuaaagccaaggugcucccuggccuacaggccugcucagcugugucucucccuuccugcuccucagccaugcugggcaccugacuaggaccuugguauuagccucugccuggaccguccuccccuggauggugaauggcuguguccuuccccuagccuagggccuuuugcuggacagcucgcucucagggagaucuuuauuccuuuaccuuauuuucagcuuuauauuuuugagacagggucguucugaucggcuuggaucuuuguaggcccgacugggugcucccugugcugcuuccgaaggacgggaugggugcugccacgcccagcugccgcucuguucuuaccugcuccguccccaucuggguuucccucaacucuaggugacagguugcauccuuuuguccuucccuuugcuccugcucccuugacagaggcuuggguugagagaaaggcuugguaguguuuguucccaugccugaggcagggagaguggggaggcaggcaggugguggcuccccaaggacucugcugcuaaguggaagagugagguuaggguuucuuugcuccccagagcugugugcuugcccauuaucgcuaggacuguuucugccggccauccuuccgccucuuggcacaaggggacaauggaaaguauugcggccucuauuggcugucaucgccccuuucccuguccucccacauggccccuuguugcuuguguucaggcucacugccugugugagcuggguggggcacgauccuucaguccucugaccuugggucgcugcauggaugcaugucaagguugcaggacagaggggccuggcuggcuccuggcaccucugugagugcuccucugccauagucagccguaugauauccaugugcuuuuucucuuucccggagcacguagccaagggcaggacaaggugggccucccauuuucugauccucccagagcugggaucccaggcacacacaugucagcacaccuggccacugcugagcgucuauucuagauugcugugugaaugcucgggugguugucuucuugccuuuugcuaucuuaauuccuauagugagcaugggccgcugaaguuggaaagagucugucaccuuguggcugaggagguggagagcuugcguagagccauacagagaggucuuuuaaaaacguaguguccagggauguguguaaaccccacugugccuugcagaaccugucaggucugggucaccacugagguggucaugcuggagccugugagcugauccauucucucaguauggggugccuuagaaccagggcuguaaggccuggcagccuggagugcaguguaggcccugaagcugacaagggaacagcagccucuuauaccauggccagguccucgucccaagggguaauacugaaccgggcucugccugggaucacuuggguguuagaaaacagccaggcccagggcagcaacaagcucucccuggucucgccucauucuuuuuuuuuuuuuuuuuuuuuuuuuuuuuuuuuuuuuuuuuuuuuuuuuagcaaaagcucggugggcuagggccaguggacaggcaguaacuagacuacuaucuguagucuuuuuuuuuuuuuuuuucuugagacagggucucauguagcucaggcuggccucaaacuuagauguugcuaggguuggcucugaacugaucccgaguccaucugcugauugcuggggucacaagccuaugccacccugucuggugggguuacuguuuuaauuggugcagugcugcggugcccaggagccugaggcaggaggcgugagccuccuguguaacagugacacagggcaugcuucucugccuuuuuguugcccugccaggcugggacaacuucaagagugcuaccuuugugucuuagaacaaggaacagacgcucucucuagugugccaaccuuggucuugccacacaguggugugccaaggccagcauccaccccuccuccccccgcccucugcucccagcccuggggugggcuuccguucuuagacugcuuugcuguccuugaccuugggcugguccuaguugcuguuggcugcagccgggccucgucauagcaaccucugggugagaauucuucacagacuagugggacugucaucgcagaagcagcgcaugugccgugccagggcuccugcccuuguguuugucuuugaccccugacuauugugcuuucaacagcaggucccccaccucugccccuggccagcuuggggacucagguuacaccucaugggccacccuuacccagauaaacaucuaucucacuauagggguccuuccuucgcuaagcucugauuucuccccagcaugggcagagccugcuggcugccugccuucaggggucacccuggcuggggcaccuuuccaucugugcccucugaccccugacuuaggugccccuccugguuguacucuaggcuggcuucaguguggaugggggugugagauaauuacauggcagggguggggguggcagagguugacgagugcggaggggaccaaggucuaaggugcacguugauuccccuccaucuccuuagccuguucccuggagcuguuuggucuuuucucuuuugguggacacuuugccugucuguuacugauugggcugggguguaacuuggugcaguaucugccuugcagugugagagcccuacauagaauccccugaagccagagcuuuuguagugcaguuccugugacugaauagagugcauaguccaacuguguguucccgacagcuguacuuccuuagcacuugggaaacugagacaggagcauucugaguuuaagaacucagacccugucucaccccugagugauaccccuccucccaaaaaaguacacaaccuaguggauuucaucaccuuuuggaaugcaggcccccaccucugugacuggcaccuuugucuuacccacaaagagcaugugucuuucagcauuccccccuccucuucguccccccccccccccgccccagguuaccagccggguucugucuauccuggucugguccugggccugaaagucugguuucuuucaucucgccaaccuucuugcuacacuuaacauaccuuuuaucuugguuuugaaauaaaucuagaggcucagagaguugcaagaacggccccuggcccacugggccuuccuagaccuaugccuggggggauggcggcuguguggaguuugggcuugugcaggccgugggaggcccccugacucaccucugcugcaggcagucccucagcuuguggcuugggauugcucuucaccguggccccucuccacgcgcucuccugcugcccaccaguuggugcaccacggcuccuggccuggcugcagugccccagcugggggagaggcuaggauuucagcccuccccggcagcuggcccaguagggagaggggcugguuguauuuuaagcuguugagugguucagcaggaacuccauggccuucccucccagugcacacugugccgcccuccugugauucacauggacucuaggggcucagcaacuauuaauauagccccagcccagagcccugccaccucgccccuucuagcacauuccucaugugcuccuccccucucgguccucuuuagaggggucccagcguaugacagcucagucuggcacugauuguccuuguguggauucagccaucugccccagaguaugcuguguccaugauguaggcucuggcacauaugggcaagcaggccuggguaccacugccuggcauaggaaccuugcucugaacucaagcccaggcccuacagggcagcaucacuguguaggguuaccuccgugggggcuucccgaccuguacaugcacacauacacacaugcauacacuuucugugugccagcaccaugucggcccacccaugccuucucaaggaccccuagcagaucugggaucgugccauggccucuguuguugggagcauguagguggcaacaguuggcuucucuggccugugaugcccccuucuucuggaaaaaaguggcagaucuccgcauagcccuugggucucccccagccagcaugggcaguguugagcaucuucucugaccugcuggguccgaugggucagauccccuggggcuccugccuccuuacccugccccuaugcauauuuucuggccucagccugcagguuucuccuuuggggacuguggaccccaggggugcaggcaggguauguguugggaggguauguguugggcuuugguaggcucguccaugggugagcacauuguguuggccugaugugguaggagcugugaggagugaggcgguggagagggagguggagggacuugggaacucugcaccaguaccucuggaauuugucaccucccugggaacacaaaugcacaagggaaauaauccagugucccuuacagcuuagaaguggaaauggaugaucugucucggagauucuccagauagcuggcauuuccccaggcuggguaaccuguuggccagggcugcacaccggggcugggcuugcggcgccugccauggcugugggccuuuuccuucuucaugccccuggcacuucugagggccugugcccacccaauuaacugccuguaugaggguagcccucaggggaggacuguggcuccuuugguggggacucgggcugagaugguuuuauauuuagccaggccaggcccuggugccacucggguuacaucuggcguuggcgcuggcugagccuggucagacacaggcucccuuccagcaccgaggcagaauuugaucaugcugcccggcccagcucacagcagcuuugugaggagaggucggaggugggggcuggcgacuggcagugggcaccacagacuggaaggcagagcaggagggccagcggcuguggcauggauaucagcuugagcauggcagccaaagaggcccaccaaggccucgauggucuucccaugcccaugccccacaaagcagccaagaagcauaaaaaggcuguccucuucuuugagguggagauucgggaugcaaagacgagggagaagcugugcuuccuggacaagguaggacugcaccccugggggugaagugccaggagggcugggucccuguuccuuacagcuccuguagggcuaugcaggcaucgguggcccucccuguccuucagaaggcauguaaaggguauugucuucaucuagagcagcgguucucaaccugugggcugagaccccauugggguugccuaucagauauccugcauagcagauauuuauauuacaauucauaucagcagaauuacagguaugaaguagcaaugaaauaauguucugguuggggucagcacaccaugaggaacuguacuaaggguggcagcuuuaggaagguugagaaccacugcgcuagagugagcagcuggggccccucuguggggcuggaagcugacagccuggugugggaagggacaaggcagccuugggagggcucuguguccguaaaggagguggaggacggauguaccccgugaagucagcuagcuuguuccugaccugccuguaccuggacccccucccccauccuaggccuggcucccuccggacuuacaccuuguuuuccuuuagguagagccucaggccaccauuucugaaaucaagacccuuuucaccaagacacgugagucucccgacacaccuauuccugcuccugacauacguguccccccgcucccgacacaucuaccccccacuccugccuccccucuggaugugaccugggcccgcaugccuccgcaugccuuucccucaucggcuuguugccucucagcacacuggaacagugagugaggcccggcugacugggcaggcugccccuguguggucaccagcaggaaugcucuugugcuaucuauccaaagggguaaaaaauaaaaucugucgcugccuauccugugugcccuugcacaggugggaggagcugggggggggggguccuagaguucuggaagccuuuagaggcaggccaaguuggggcguggguaggcugagccuugccagauuaggugaugcaaccccugaccuucuccuggcagacccgcagugguauccugcccgccagucccuccgccuggaccccagugaguacagcuguccaucagccuaucccuugggcucuuggggucaggaaaccagggcaguaaccaaauacugacuucucucuguagaggggaagucccugaaagaugaagaugucuuacagaagcuuccugugggcaccacagccacacucuacuuccgggaccucggggcccagaucagcugggugacggugagcucugacuccuucccuggucucugccuucagcuacccuggggcgacucaccuugucucuggguacucccaggucuuccugacggaguaugccgggccccuuuucaucuaccugcucuucuacuuccggguacccuucauuuauggccgcaaauacgacuuuacguccagucggcauacgguggugcagugagugggcccggaggaaggugggggugggagggaggguggaggcuggauuggcccuggcugagucugcuaccccacuagccucgccugcaugugccacucguuccacuacaucaagcgccugcuggagacucucuucgugcaccgauucucucacggaaccaugccuuugcgaaacaucuucaaagugagcacccccauucuucuugucuugccugccccccagcagcagugccugcccccuccccaccugcuaacucauuugcucuuccagaacugcaccuacuauuggggcuuugcugcauggauggcuuauuacaucaaccacccucucuacacacccccuaguaaguggguccagacagugcccuuacccugugugaccccaccacgaggcuuccucuuacagggcucuccuuccugcuuuuucuacagccuauggaguucagcagguuaagcuggcacuggccguuuuugugguaaagaggcuggggcagcaaccaaguguggugagguguggcagcuggguggggugagggcuggcuguggacugaccccuuucuccuucauagaucugccagcuugggaacuucuccauccacauggcucuucgggaccuucggccugcuggugaguggcuugcuggggcuggggcugggugagcagggugaggagggggucugaccuacucuuauccuccaugccagggucgaaaaccaggaagaucccauaccccaccaagaaccccuucaccuggcuguuccuguugguguccugucccaacuacacuuaugaggugagggacuguacugccuuuguccucucaggucugagguccugcacauggugaagugcaggagugggcuguggggagugagaaagcuugaccucagugaggcuguggccgucccccggggcugugaugcugggcuucccucucuguccucauucugccuguacuguccacaggugggcuccuggauuggcuuugccaucuugacucagugugucccaggugaguuccuugucccugugcggugcgcugcccuuccagcaaggcagccucauucugauaccccauucugcccacaguggcccucuucucccuggugggcuucacccagaugacuaucugggccaagggcaaacaccgcagcuaccugaaggaguuccgcgacuacccgccccugcgcaugcccauuauucccuuccugcucugagcagcuccucacggcucugcccaguaauacucuccaccccucacugccccuguccugauguguggcuggccauggcucuccagcagcaacaauaaaaccugcuuacccaacu

SEQ ID NO: 4567 - RNA, 9884 nt, Mus musculus
ucuuuuugagacagggucucacugugaagcccuuacaggccuggaauucucuauguaaccccagcaggcuggucucgaacucacagagauccuccugccucugccugcugagcgcugggauuaaaagugugcgccaccacaccugccuauuuuccuuuuguuuuucuuggccauucauacuuuugagaaacccuguuugccuauguguugacuggaugacugcuaguuuuaagaguuugagcuuguuauguacuguggaguauuaauguccugccagauggauggcugcuggccaagcucucugcagugccuuggccagguuugggauugcccucaucccugaccggguccucacagcccugcucagacagcagacacuaccuggagcccagccuuccuuguucugggaguuccauguuagacaggcuggcugggcagggcaugauucucuagcuucccugaggaccuguggacuuuaugccggggaugaugaaacucucuuaccuguugaucuggccuaauguguaacugucagagggcagccuauuuuacguccucuggggcucucacagaaccauugcauuuggaaaggcacagggccacugcuuauuuucagccucgcccugccuugcuuccaagauaaauagcuuagaagcugggcauaguuuuuguugcaagcggagccuuuuccacuuagcccuggggaguacaagggccuguaucccuccugugucccuccugccaccuucugaaucuucuaucccuggaaggucuguaugugacagauccugucucacacucacaggaagucuccauuuggucagcaggaucggcuggccuucaggugugcuguucagcagguaggcagacagcugucaccuguugugccugcuguuacugcagcugucaccugcagcaccugcugucauggcagcugucacuuguugcaccugcugucauggcagcugucaccuguugcaccugcugucauggcagcugucaccuguagcaccugcugucauggcagcugucaccuguuacaccugcugucacagcagccagcagcuucucuaggagccaguacugcugcugccuuggcccccugaaguauccacaucccacccauuccugccuuucuuauuguaauuaaaaaaaaugauauuuuguuauuaacuuauuguucagauguuauagacuaauagaaucccaucauuguaaauaaaauuuuuaguacaguagaggugauuccuauuacuccuuaagcaggagauagugauaauaaacaguauaauauauguguguauuuuaaaauguaauugugugugugugcgcgcauugagucuucuaggcaaaaccuacaggaccgcauucugagccccauccagauccagguguaucuuuauuuuugagauaaaguuuuugccauguagcccaggcuggccugaacuugagauccucuuguuucaaccucucagugcuggggugucuagcuuccagguagguguuuaaugggauggauggauggagggucucagucugaccuuuccgguguacugccaguacccuccugugugcucccgugucuagcgcugcugcuguuuggagggaauuauuuucacagccucuggcaggccucugcuuccagacuacuaauucucucaaaaggaucccuuaagaauucaagccacagcugggguugguggugcucgccuuuaauccgagcacccaggaggcugcagaccacuacaggcauggaaugaguuccaggucagagaggacugacuacacagugaaacgccaugucagcagucacagcaaagcaagcagauuuaaacucaagucaggccucuccucacccagcccuuaggaccgucugccaugucaccucugcauuuccaccucaucuucuuccucucaugcauaugacuccagaccacacaucugugagcaucuguuccgcuuaacuugaggcccuuggcacagcugcucuucugugaggauggccaccuucagccuugauucuuucagggcuugaccgagagccccaucagggagcugcauccucacccucccucuccugacaggauuucacuaaguacucuagccuggccagcccgacacucacguaggccaggcuagccucacacucagauccaccugccugugccuucugaaguaugacuagggagguuuuucuugaccacuuuguauagaaaacuucauguacguccugccuccaccacaccugugucugucccgugugauguuuugugaugugaugucaccucauguagaccuauuugcuuuacauauucauucccuugcugucuuuccuuuacgcuggggguuaaaacuagaccuuauauaugcucagcgaguuccuggcaaagauguuuguccuaauguggccggcucuccagauuuccagugucuggaaugugcguugguuuuucacagucaaaggggauuauucuggcaagcugagcgcaugcggcgcaugcguggacucaccugccugccggcuuggguggagccaggggcgggcauaacggacaguggccgucgaacaccucuagucaguucauccucagggucucuggcuuccuuaagcuuccuggcuugcccgagucuuccuguccagaaauggagagaggcccgaauuagaccuuaauugcaaaagggcagcaggugggaggaccugugaacaggacaggcacagcccuggaggagggcagaggugcugagacugcagcucccagauugagagcucaggcacaguaagggacagaggcaggcgaggcucagcccugugaguucuuagcccuguccuggggcucgagaccugugcccccagcugcaguuucuugucagccuggagagcagcagggcagaugugcaugcugccugcccacagcccugggacacagaaggaggguaggggaaucacuaggugaggcucuuggggugggccauggcaguaugguagggguguuuggagauggcugucccuuccggucccaggaaguguuuuauauuuuuuugcugaggaugaaaucuuggccuugugcauacuaagcaccuacugcccacuuugauauagacccgccaccaagaagauaaaauuuuuuaauuauauuuuuuaugcaugcuaagccaggucucaguccugucugugggaacuuugaagucauauaugccaggcaguaguuagaaucucuaauguuggcaccuaggacaggguucuuccugccaguccacuggguacuacuguagcaaucuguuauuuuuuauuuguauuugagacaguauuuugcuguguagcccagguuagcuuugccugggacaaccucugccucaucacuggcaccggcaugcuuagcccauggcaguccucgugaaugcacaugcagccugaggguuagacgcccacaaaccuucccguuugccuuucugaccuuagcuaguguuggcagcuaguguuggcgacacuccugcucucccaggcggaugguggcgguggccuucaccugcugugggaaaccauggaauuguugcuccauccugccuuggcgucucuggacuuaggaggugucuuggguguggcccacuguaccaugcuggucuagcagagguggguacauaggguucuggggucaagaaaugugagucagcccuuggcuccucuguagcauccauaugcccugcguaggugauacugucugcaugcauuugaaaauggagacuggcccuuuaaaaucagauuugcuguagccggucugucuuugucucuguuucccugucucugucucucugucucugucucucucucuccuuuuggauaauuggauuuaggcaucccuuucuuuguaacagagccucacauauacuagucagaugcucugccauuaauccguacccaguuuuacuauauuucuuuaauccuuuauggugcuagaggucagugcagcuuuuugaugcuuuuugagacaggaucucacuguguagccuugcuggccuggaacguaacucuacagaugaggcuagccucagacucauagagaucuauuuuccccugccuucagaaugcuagguuaaaaggugcacaaacuaacuuuaaacaaaaaauuaugucuccgggcagaaacagaggcaggcagaucucugaguucaaggccagcccaguauaccuggucaguuccaggcuagccagggcugccuagugagauccugccucaaaaacaaaacaaaacaaaaauccaaacagaaaaauacagugugugugggcgugcuguggagccugcauguggaagucagagguuaugccacgggaaucugcucucuccuucaccacgugaguucuggggauagaguuucugcaucaggcuuggugguaagcaucuaagugcugagcuaucucucccccaccccuccccccuccuccucucucuucccuuaccucuucccucccuacuacuucccuccccucaacuuucccucccuacucuuccucuuuccucccuuuaccuuccuucugcucccuaguccuccccuccccuccccaccccucccuucccucccuccugcccccuuuaauugcuguggccucuguacucggugccaguccuggguugagagcuugugaacauaguguucagaguggcuucugucgaggugcaacgggcuggagcucgaaguaaccugaucauaggccaaguauaggcggucagcgucugcgcugccccugucugggguagccuguucccacuacugcuccuagagaggcuggcuagcaaaagaccugucccuugccccuggugcaccguggagaaauggguucagaugccaaggccacuggggaaggacacguuugggcuagagcaggugcagucugugcuggcagcagagagcaggccaucagcuaucacaacauuauuaggguuacuggguauuucuggaaaguaaaagagaacgggagccaaagccauugagcuggagucucggaugaacgcagggaggcugugugucuaacuggucagcugccugcccugugcuugggccaaugguugggccaggucucugcccucugggcucagcaaugucccuaagaagaguguucaugcccuuuugccucaggagugcuugcaacagcugacugaaggaccagagagguucuuugaaucuucacuugggguuuuugguagcagugagugcagagagcauguugccccgccacguggagauacugacuguguggcuguguccacuguggggacccgugccagggcugagagccugagggagcgcuggcuugcucucuccaccacuguggacucauggcugaccuccugccucaggcacuccuaggugacccagucuguagaccgugcuuccucaucuggaacaugaacacgaagccugcuguggugguuugaguaacaguggucccauaagcuuacguguuuaaauaccugguccuuagcugguagaacuguugggaaggauuaggagguguggccuuguuggaggugugucacuggggguagcuuuugaggucuacaucuuucccagcuaacuuucucugcuuugugugguugggucucaagauguaagagacaguuucagcaccaugccugcccccuugccaugcuccauacccugauggcuguggacucuaacccuguggaaccaugagccucagauucaaugcuuuuuuuauaagaaagccuuggccauggugucaucacagcagcagagaaguaacuaacacccacaguuccggcccuguaggcacuuauggagccgggcaggguugaaacugcuuaccaguguccccaccuagagucaucgggcaggucccauaguugaauacccagaguuccagguguguaaguuaguggcugaccuggaaagcuggucggaggcacugagcuagccugggacaugaagggcuuauaggcagaggaccuuggagcagcagggcucccgcauuugugaagagguauaugcagcuugaguccuguggcacgcagacauggcaggugugacccguccagccuggccuugauggggcugcuccuuccuacccggcuuggcagaccagacucuugcuccuucgucuucagguucaggccauuugggggucugcugcuuccauccugucugucuagaauccaaccauuguuccuccucucuugucccuccccgucucggucucccugccucugccucccccugucagacuguccugccagcacuggcacucgugaacucccgaaugaacccgugucccuucucugcucagaaacccuaugugacucccaucugagcccaggcuaaagccaaggugcucccuggccuacaggccugcucagcugugucucucccuuccugcuccucagccaugcugggcaccugacuaggaccuugguauuagccucugccuggaccguccuccccuggauggugaauggcuguguccuuccccuagccuagggccuuuugcuggacagcucgcucucagggagaucuuuauuccuuuaccuuauuuucagcuuuauauuuuugagacagggucguucugaucggcuuggaucuuuguaggcccgacugggugcucccugugcugcuuccgaaggacgggaugggugcugccacgcccagcugccgcucuguucuuaccugcuccguccccaucuggguuucccucaacucuaggugacagguugcauccuuuuguccuucccuuugcuccugcucccuugacagaggcuuggguugagagaaaggcuugguaguguuuguucccaugccugaggcagggagaguggggaggcaggcaggugguggcuccccaaggacucugcugcuaaguggaagagugagguuaggguuucuuugcuccccagagcugugugcuugcccauuaucgcuaggacuguuucugccggccauccuuccgccucuuggcacaaggggacaauggaaaguauugcggccucuauuggcugucaucgccccuuucccuguccucccacauggccccuuguugcuuguguucaggcucacugccugugugagcuggguggggcacgauccuucaguccucugaccuugggucgcugcauggaugcaugucaagguugcaggacagaggggccuggcuggcuccuggcaccucugugagugcuccucugccauagucagccguaugauauccaugugcuuuuucucuuucccggagcacguagccaagggcaggacaaggugggccucccauuuucugauccucccagagcugggaucccaggcacacacaugucagcacaccuggccacugcugagcgucuauucuagauugcugugugaaugcucgggugguugucuucuugccuuuugcuaucuuaauuccuauagugagcaugggccgcugaaguuggaaagagucugucaccuuguggcugaggagguggagagcuugcguagagccauacagagaggucuuuuaaaaacguaguguccagggauguguguaaaccccacugugccuugcagaaccugucaggucugggucaccacugagguggucaugcuggagccugugagcugauccauucucucaguauggggugccuuagaaccagggcuguaaggccuggcagccuggagugcaguguaggcccugaagcugacaagggaacagcagccucuuauaccauggccagguccucgucccaagggguaauacugaaccgggcucugccugggaucacuuggguguuagaaaacagccaggcccagggcagcaacaagcucucccuggucucgccucauucuuuuuuuuuuuuuuuuuuuuuuuuuuuuuuuuuuuuuuuuuuuuuuuuuagcaaaagcucggugggcuagggccaguggacaggcaguaacuagacuacuaucuguagucuuuuuuuuuuuuuuuuucuugagacagggucucauguagcucaggcuggccucaaacuuagauguugcuaggguuggcucugaacugaucccgaguccaucugcugauugcuggggucacaagccuaugccacccugucuggugggguuacuguuuuaauuggugcagugcugcggugcccaggagccugaggcaggaggcgugagccuccuguguaacagugacacagggcaugcuucucugccuuuuuguugcccugccaggcugggacaacuucaagagugcuaccuuugugucuuagaacaaggaacagacgcucucucuagugugccaaccuuggucuugccacacaguggugugccaaggccagcauccaccccuccuccccccgcccucugcucccagcccuggggugggcuuccguucuuagacugcuuugcuguccuugaccuugggcugguccuaguugcuguuggcugcagccgggccucgucauagcaaccucugggugagaauucuucacagacuagugggacugucaucgcagaagcagcgcaugugccgugccagggcuccugcccuuguguuugucuuugaccccugacuauugugcuuucaacagcaggucccccaccucugccccuggccagcuuggggacucagguuacaccucaugggccacccuuacccagauaaacaucuaucucacuauagggguccuuccuucgcuaagcucugauuucuccccagcaugggcagagccugcuggcugccugccuucaggggucacccuggcuggggcaccuuuccaucugugcccucugaccccugacuuaggugccccuccugguuguacucuaggcuggcuucaguguggaugggggugugagauaauuacauggcagggguggggguggcagagguugacgagugcggaggggaccaaggucuaaggugcacguugauuccccuccaucuccuuagccuguucccuggagcuguuuggucuuuucucuuuugguggacacuuugccugucuguuacugauugggcugggguguaacuuggugcaguaucugccuugcagugugagagcccuacauagaauccccugaagccagagcuuuuguagugcaguuccugugacugaauagagugcauaguccaacuguguguucccgacagcuguacuuccuuagcacuugggaaacugagacaggagcauucugaguuuaagaacucagacccugucucaccccugagugauaccccuccucccaaaaaaguacacaaccuaguggauuucaucaccuuuuggaaugcaggcccccaccucugugacuggcaccuuugucuuacccacaaagagcaugugucuuucagcauuccccccuccucuucguccccccccccccccgccccagguuaccagccggguucugucuauccuggucugguccugggccugaaagucugguuucuuucaucucgccaaccuucuugcuacacuuaacauaccuuuuaucuugguuuugaaauaaaucuagaggcucagagaguugcaagaacggccccuggcccacugggccuuccuagaccuaugccuggggggauggcggcuguguggaguuugggcuugugcaggccgugggaggcccccugacucaccucugcugcaggcagucccucagcuuguggcuugggauugcucuucaccguggccccucuccacgcgcucuccugcugcccaccaguuggugcaccacggcuccuggccuggcugcagugccccagcugggggagaggcuaggauuucagcccuccccggcagcuggcccaguagggagaggggcugguuguauuuuaagcuguugagugguucagcaggaacuccauggccuucccucccagugcacacugugccgcccuccugugauucaca

SEQ ID NO: 4568 - RNA, 3731 nt, Mus musculus
cugagguuuagcaucagucuuuaaugcugucacacugcauaaugacaagucacacacuuuggucuuguguugguaguggcaacuuacaaugaguugaauggucagaacaccaggcuagcuccaaagaacagauacuuucacgcccaggucugaucccaucacagcccuggacaguaguugacagggacugcuuucgucugagugcacaccagcuuccaauggaauuauaaaaacauauuuacauacguuccacagugcuccuuucaucagaagcaaagacccuuuuaucaaaagggauuagaucuaggacugugcaaaauccaaaaggauuguauccuucuagaguucagaguccauuacacacacacacacacacacacacacacacacacacacacacacacacacaaaaucaccugugccucugagaagugccagguguggccaaggucuaccucuggaccagcaaguacugugacuguaagccagccaucugaugucaauggagccagagguccaggggaucuccuggcuggccaggccccagaaccuggaaggaggcuggcccugugguccugcaaccagguauugcuugugaugcuggccuggcaguccuagggaauuggucucaauuugagauggccaagacaagacaggacucuucuggggaggaggaacaaggcaugggacaaauacagauaaaacaagaaccucccacacaguggagacugacuagugcacagggucuggcaacugagauggcggaccacugucacaugacagccagacuaaggacaacagagggcaagaguccaguugcaggccugccucacacccuugggcaggagcuggggugcagaggguggguccauuccaggagggcugcuguucccaccgccugccuaucgcucgaaaaaccacuguagucuagugcgcgacuuugaaagauuguaauauauucuguggaaaacauucggcagagcaaaagcccucccugggcccucccgcaguaugcaaccaguggaacggucuggagaucugcagcucugaaagccccuggcucaguccuugaggagugcagguggcuauaugggaagaaccugcuccaggaugguucuggaugagacgggaauccuuuccgggaagaucacuucaaacucgauaacaaggucuccacguuucucagguguuuuggggagagggaggccuucuccagggacuuuccgccgcauaccaggccugaugacaucuuugaauacaacagggaugguccugccguccagaguagggacauucacagugcaaccacagagagccuagggaagcaaaaggacagugucaggcaguggcuggcuuaggagcuucacuccuccagaccguccggagaagggucaggucuaccagaccaggcccgcugacaccccacuccaaagcccccccaaccccacaacccauuauucucacagcagccaucucuuuuuaugacuccuccacccaccuagcaccuuaccucccgaaggcuaauccuggcuggauagaugacaucagaaccaucucucuugaagauauuguguggcuuguccuuuaaaacaaagacgaugucugcuggaauguuguucgaggucugguccccuuccuugggaaaggugauuuuggucccuucuuuccagccccucuucacuucgauggucaggaucuuaucuucauuucgaaugcucuuuccaucaggguucagccgcuugugggagauuuucaucuucuugguacagccgcuguagaucucuucaagggagacccgaaggucaugggugacuggaggaucuugcuucuuccgggugggcucuugagaagggcgggaacguccaaaguucauguuggugaagccacccauacccauuggaaagcuagagaaugugucaucaauguccaugccuucuuccccguugcgcugcccaaaaaagguaucaaagggguuucugccaccgaagaacucagcaaacauggcaugggggucuccguggaauguguagcugaaagagguaccauuagcaccaccacugcuuccuccacuggggcuaccacccuucaggccuggaaaccaaaaccacaagucaggguuacugcuggagagucagccccaccucccuccacccccaacacuucaacacacuuauaaaacauaaaaccccugaaacaaagagcucagaaccccagcacucucaagacaagugcagacugaucucugcaaguuccagacaagccagagcuccaccaugaggugcuggagaaauggcucagagcacuggcucaucuggcagaagaaccaaguucaauuuccaacaccuacauagcagcagaccauggucuaacucuaguuccgggaccuuuaaugcccucuucucuagaagcaugugaaugguauacacauauacacggaggcacacgcucaaauaaauugaaaaacaaaguuccagcaacagugagguccugucucaaauaaauggucacauuuuguuccuuuugcauguauuacugucaaugccacguaacacacaaacuuucguccagaguagccucaaggcaauccuccugacucaaauaccccagaggggggauugucacaacauccgguuccuuuggaaacaggagcuuauuacccuguagcucugauuugaagcaaauucacagcguuccuaauucgguuucccauguggaggugugagcccccgcacucugcucaacaaguuuugcucuuaguaaaaaggccacaggaacuauagcgggagggauuuuauguauauauuaaaaagcuuguuagucaaggacgaaucucaagucuuuuaacucccaauggcaauaggagcaagaaacacacuacuccguuuuacuuccugacaacauauucgguaguaaggccucuagaucucggugcgaccagguuuacgugacugcuccauccucccagcuaugcuguuaccaucuuacagagaagcuccuacgcacuguuaccaaaaaggcucaacccugggugagcgaacacugagcuugcggcuaggaaagagaaucaauacucgggcaauuuucauucccaucgcgaccgccgcccuccaucugcaccauuccggcgcugugcaggcgaccgaccgggaggggcugcggcagacgugcuagaagcuucugugccagcggcgcgcccagagcuccuccuccugucugaggccgcggaucagagggugaaggaggcggcgccgccgcuagauccccggaaugccuguccccggccgaggucuuggagaggcuccgagugccucgguuuccccgccugucaaacggcgggucaccccggccgcgcgcacacguaccuuccucuccauagcggucgaaaaucucgcgcuugcgcgggucgcugagcacgucguaggccucggcgaucuccuugaacuucuccucagcgccgggcuccuuguucuuguccgggugguagcgcagcgccuggcggcgguaggcucgcuugaucucgucgucggacgcgccgcgggccaggcccagcgucugauaguaguccuugcccauggccaccgccgcccagcugucgccgccuccggcuccgcugcugccccgucccggacucuauauacccguccggcggaagcuuccagaucccgccagcccuccagaaccuuccgccccucccgaugcgccgcacgacaccggccaaucgcugcggcccg

SEQ ID NO: 4569 - RNA, 752 nt, Mus musculus
gaagugaagaggggcuggaaagaagggaccaaaaucaccuuucccaaggaaggggaccagaccucgaacaacauuccagcagacaucgucuuuguuuuaaaggacaagccacacaauaucuucaagagagaugguucugaugucaucuauccagccaggauuagccuucgggagguaaggugcuagguggguggaggagucauaaaaagagauggcugcugugagaauaauggguugugggguugggggggcuuuggaguggggugucagcgggccuggucugguagaccugacccuucuccggacggucuggaggagugaagcuccuaagccagccacugccugacacuguccuuuugcuucccuaggcucucugugguugcacugugaaugucccuacucuggacggcaggaccaucccuguuguauucaaagaugucaucaggccugguaugcggcggaaagucccuggagaaggccucccucuccccaaaacaccugagaaacguggagaccuuguuaucgaguuugaagugaucuucccggaaaggauucccgucucauccagaaccauccuggagcagguucuucccauauagccaccugcacuccucaaggacugagccaggggcuuucagagcugcagaucuccagaccguuccacugguugcauacugcgggagggcccagggagggcuuuugcucugccgaauguuuuccacagaauauauuacaaucuuucaaagucgcgc

SEQ ID NO: 4570 - RNA, 12254 nt, Mus musculus
ggaguggugacgcacaccuuuaaucccagcacugugaaugcagaugcagguggaucucugugaguucaaggccagccuggucuacagaaugaguuccaggacagccagagcuacauagugacuuugucuugaaaauaaacaaagcaaaaaaaguaaaguagggaggucaugaccccaaagagaacugaggcccagggggacagaaggggcaguugccagcugauggugggaaauguuggggacagaggugacugcccaguguguuggucccucccaugcgaguacucuauugagguagguggggaacccggcagggguuggccggggaccccaaccaggcugggcaccguggugguacugauuggaguggggccaggaccacagggcauuugcaccccaugccuuucccaggcugcugauuuacgagccucggcugugugcccaggucccggcuguggcaccccuccuggaaaccccagccaggccaagccagguuaucucaagguccagguucaguuccagucuuaguagcggccaaccuuggcauccccgauagcuccccagacaucaaagacaaauucaucugggaaugcgaagucaccgagccgcucauccagggcuucugccagcucguccggguuccuuuuguccuuucccagcuccaccaugguggcagcuggaaaagauggaggcacagaugucaugaugggcagagguguaggcucaacucagccugggugagaccuggaagcccacucccaccuugcaggcaugggugggugccccacucacccagcuccgugucucugauccccauguagcucucuagcaagucauccaccuucucaauggccuucuccucaaaggccgacggcuguggagggcggggacaagacagcacaauaacgucaacaguacugugauaggcacuggaugcccuaagugcuggggacggcucccagggacucagcaacagcucuaccagugagcugcauccccagcuccugguuuugucguuacuuauuuuauguagaggacugcuuugguugcacauguguauguguacaagugucugccuggugccuguggaggucagaacacuggaccucuggaauuggaguuaacagaugacugugagccacccauuauggguacuuggaacugaaccugggugaucugcaagagucacacgugcucuaaacugcuaagccaucucuuuaguccccaacacccagaaaugaucauucucauauugaggcauauucuaaguugcccaaacuuugaacauuaaaucuuaguuucccagguagcuaggauuacauacguacguauccacccugggcuggcuuucauauauuuucaucuaagaccuuggugacaaggucuuacgguuugagcugcccuugaaugugaaucuuccugcuugaaaccccaugucuggcagugcuuuuuguuugcaucauuaaugucugcucugacaagaaguuaccgacucuuacucuacagggaggagucccaaggcucgaugggccacgguaggucucaaaguugggaagaguagguuuaagcagagguguccagggucuuucacauaaucagaaugcugucacuggccagggguggcucacucaccagauccuccacgguggcagggccccgggaucggagacggagggucccucggccagugcccaguugugggccugaaccaggguggccaccggcugaacgcuggcugaucauaucugugggagguaaagguaguggggaauuucagcauacagcgaguacaguacucagguaccuaggcuucacacagccaccucucgccaucgccagguucuguaggcuccuugggagaggggcuggguuccaggaaggcaggacuuugcauggagcgugaggggcagcugggggucaugcagaaaggcagcuggagagagaauggaggggagcuucucuuugaaggauugagggcugagaagcgugaguauagcugcugaauuccagauaagcccuuucuacccacaccaggggugccucaggcccauuccagagaguuagugaagccagguagagacaggggcagggcacaggagcuguacaaagcagccaagccucaccucuccaggcugagggggcuggccaggguugggggcacuuggcugggcuaauggcuccuggaagucggguguggggacaacuuccuucaggcugggcugucagccagcacuuaguucuuggguaggguggggcuguccccauuuugcauugcaggcucgggcgccaccugcuggugguucccaggacugccaccuguauuucuuaagagcucaaggucaucccagugggugguccagggugcaaggauggcucaccaaaggccuuucgagguucugugaguuugagggugaaggugcggccucggggcagcuccuugaggagccuggcaaccucguaaugccgacagcccagcaggcucugcccguugauggcuucaaucaugucccccacgcugaugagcugaauguggucaaucacacugccuuccuugaugcgcuguggaggggcaggcaucaacccuggaagcuccacucuaggucccauuacagacccuggccacugacuaagggugugccacccacccgggcaccuuaaugaaggcguagccggccccguugucggugauggugagccccagagccuccuccgacuugaacacuuccaccucuuugcgcugccccuucacaugggcaaagaugaagucuuccaggccgaucuggccccccaggaguuuguccauguccacuuuguggguguugagggugcagaacaucaccugcagagguagggcaggaugcucaugccuuccucccugggucuucuuucccaacacaucccuacccuagggacuggugacacccagggccaaggagagguccacauacuacgagcaggauuucugucgugguaaaacucagagcuagcuugauauacagagagcacuugauaccuacugaggagugaauggacccuagacucccacccagccuuccuacccgccucuacuugaaucucugccccacugucgcccucccacccugcggcuucucagcuucgagcuuggagucaugccuccagggcaucauggagaaauagaagcugcuccugaccuccagcucccaguguuugggggcacaagccuccuaauaccuuauggaaacccagcuaccacgugucugucaguccuccacaaccuaccaggacacaggcuacuucagaccuaaugggcaauacaaccuccgagccucauaaggccuguugggaacacacauccccaacccccaccuacuagaguacaagccucucaaggccugguaagaacucaguauccuccgguagccacgccucucagauucagcggcugcuggccugcgaggaacaugagcccuagcucauaggaauacguggccaggccuguggcuugcucuuaagggaccuugguccugauaccucagcagcugguagucggaaggccucagcgaucuugccguacagcuccuugacauuagugaagcccucgaugcggccuguggggcugccgugggccagcuggguauggaacacgaggcgaggccggagggcagcaggaggugggggcaagcccaucugggauucuccugcugcgcucccacccaggggcccaggcuccccaacacccagcccacuccggcuuggcuccgccuccucauuuuccaccagaggcggugcuuucuuccuucgccccagucccaguggcaugagcagccagaaguggggacucuggcugggagaccugcagaaagggaaccgggcuucauucucugagugccacccaucaccaccacaugguaucaacaucaacuaacaugguugugcuuugcagagcaggguuccuuaacccgggggucuggugcaggcuggucaggugcucuaucacugagcaucauguagcuguugagaaucccgcucccgagcacgggugccaggauaccuccagaacacugccgccugaaucaagcugugcugaacuugcauucugcugaggcuugcaccgccccugauuggcuggcacuguccacggagcugcagcuucucccauacacuggaguaagcucuacacucuuaaagcuaugaaaacuagcuccucuguguuguuuaaagacuaacaacaaaagauucuguccauguucagcauaggcacagggcucuccccgaaucaaccacuucucccucccucccggguuugguuuuggcuuuguacauguggacccacauaccuagacugcuucuuacuuuuuuauuuugaguaguuaucucuuaguugcucaggcuacccgugaacuugcaguccuccugccucagaccucagagucgaugcgauuacaggaauagagcagcccaucugccuugcccaaguauuuucuguguauaguggauuccaucugggcacccagagcugaugugaagcuagagagcugacucuagagacagcccagaugcuggggcgcagcucauggguggagcacgugcuaaugacgaccagguuucaucccagcaucacacugcacagcuauaauccccacagagauaccuauuuacaagcccacacuacuggcugugaccucauucaauccucauucccaugaggucccugaggcguccagcucugaccacaccugcugcgcacucccugaagggaggauaaggcacuggcacuguccuuugcuuuccaugucucugaaaaaggcucucaauuuguaguccaggcuggcccagaacucacaaacuccugccucggcuucucaaaugcugagaagacagauggaaacaccacacccagcuucuuuucauuuuuucuaucggcuuccuucauuaaugcuaugugcaaaaaaccugaguuuggaucugguuuauguaagaaagcagauguggccgggcgugguggcgcacaccuuuaaucccagcacucggaaggcagaggcagggggauuucugaguucgaggccagccugguuuacagagugaguuccaggacagccagggcuacacagagaaacccugucucgaaaaaacaaacaaacaaacaaggaaaacagaugugguaagaugcgcuuguaaucccagagcuggagagaaaaagaaucccuaggguucaaugccaaccuagccuacuuagugaguuccaggccauugagaaacccugucucaaaaaacaaggagggaggcuagcaagauggcuuguggguaaagguaauuuacuaucaccccugcaugccugaguuugaguaccugggcucacguggaaggggagagccuauaguugucaucugaccuuuaccugugcacugggcuauguguaccuacacacaaagacaugugcacacaaaacaaacacaugcaauaauacuacuacuacuaauaaaaccaaaguggacagcuccugaggagggacaccugaaguuguccuccagccuccauagacauuugcaccugcacaggugucacacacacacacaaagagagagagagagagagagagagagagagagagagagagaaacaaaacccuucugagucucuccuucaaagcagagugcauggucccugucacgccccuugggacagggcuggcagaugacugguucugccccugaguuguagcagaaagaggcaugugacacauccucauagaaacauuuaauuacugggguaagauccucccuacacagagggaucagcgauggcuggcuguggugauguccucgggcuccuuaguaacugaagcugugguggucuacaagagaaugccucauagacucacagaugugaaugccugguuccugcuuaauagacugucuggagaaaugugucauuagaggguggguuuugaggugucaaaagcccaccccaggccugccagucagucagucagucagucugucugucucuacuugacgccucugaauaaaauguaagcucucagcugcugcuccagcacccugcuuggcacuuccaggccugccugcccuuaugguuccaagccagccagagcuacgaagagaaagccuguccccggccuccagcacccaccaaaaaagcgcgugugugcuccugugacagaggcuaaaggaagcagugguguccccaguugcucucccccuuaguccuuugaggcaggcagggccucucaaugaucccccugccgcccccccccccccgccuugggcuagccccggcaaugcugguccucaccagagcagcagcacuggucucugagcugcuccucuuuuuuuucucucucccuccaucuagcaagcaaacauuuuagggggcaguacuuacuauauucaugcacuuauuuuauuuauaauuaauuuuuaauaauaauaauaauaguaauaauuccuggcuguccuggaacucacucuguagaccaggcuggccucacacucagagaucuuccugccucugccucccuagugcugggauuaaagggguguuuauuucccccuccccagguucauuuuauauauuuuuuaggcaaaguccugcuauaguaucuagauuagucuugaguuucuggcgaaugauccuccugccucagccuccaaguaucugacuuucagcacaugcugccaugcccagcccugauuagcagcaucauacuggauguacaaucuguuuaccacaaaguagauguaguagguauuaagguggcaaauggggugaacuucagcccacagcugccugcugagccauaccccuacuuuggcccaucucugggaagaaagcuauuuuucugauuuacuuacgagagcuacaauaaaccagcuggggcugaccauagacuucguguggaccagcagcaguaaaagccugguguuagagaagcccuggucccaucucuaggaccucccucccacacaucaucccuccaggauaagaauauucuagguagcugggaaggcacagagcccuguaguaaagaacuucacauucagcgcaucucugaaggguguggcuggaguggacggaaggagggagggagggagggaggagaaaggggggcaagagaagguggcauuuuucuucugguagugcugggauggggcuaggccucuugaacacuagguaaauaaucauggaccacacccagacccugauuucauuuucaagucacuuguuguccaaagcaaaaaaaaaaaaagccacaacacaagcucccucaagggugcuucauuugcaauaccccagggaguuccuuggccugacacagauccucagggacauuucaccuucuugucuucccccucccccaccagguagcucaggcuggccucaaacuugcuauagccaaaguugaccuugaacuugugauccccgccucauccuccagagugcuagggacacagguguacauuaccacaccuggcuaaauucaucucucuuauuuugaggcagggucacacuaaguagcauaggcuggccuugaacuccugauccuccuccuccucagcuuccguaccaaacuccacuuccuguggacuaggaacugccugugcucugcagagccucuccugaggaagggcacccagcuggcugguucacauccuccugagaggguucccugcucagccaugcucucuucucacuuccggaacgcuauccaucccacucauccacacaacaagcggccucugggucuucaggcuuccgguuacccuccaguuuccugucaagacagcagccagaaugacccuauaaacagucacuuccuucucugcucugaucccccaggcacccacugucauuuaugcccacguggccugcucuuccuuagccgcuggggccucuuccaugcugcugcucagauaguuaggccagagcuagcugcccgcacccucccuuacccuucagcugggauggguauuuuaugucuuuguccacugcuaagggagagcucugucacuaaugucugccccucaguauggggaacacuggcugcacagagcagcacaggccaucuccccagaucacacgcccugcuccugacccuuaucuugcuggcagcacauugccuggcagggggcgcugcgacuacucucuguccauuugcuuuuguacucugggauaaucaauagugcccgaugccuucuuauacaucuuuaauguucuugauuggcuuuuuugugaauugccuguuaacucucuguuacuuuguuuuugguuucgagacaggguuucucuguguaggcuguucugggacucgagcuuuauacaccaggcuggccucgaacucagagaucugcggggauuaagggcgugcaccaccacccguuuucuuuuucaucaacuuaagcauuuuguuuacacuuaucuaccugauguguaugugugcacgccucagagaacaacuuagcugacuuacuucuuucccuccaccauguugguccuggaggucaaacucaggucaccaaguuuggcggcaacugccuuuacccaccgagccaucucaccuucugcccaccaugggugcugggaaccaaauuccgauucccgagaagagcuucaagcacucucaauggccgagccaugucuccaggcccuaugugcucauucauggaugugcaggcacauuuggagguuagaggccgaccuuggcuacuguucuccaagagucauuacuuugcuuaaaaauuuuacugaagcugguucagcggucaagagcauugccuagucucccaaaggaccuggguucgaaucucagcaucuacauggcagcucauaacugucucuaacuccagcuucagggagaaucugacgcccucuugagagcacaggcaugagugcuggugacccauccacacacauaaaaaaugaucacucugaggcuagguugguuaacacagcaagaacacggcaaguucuuggacaaccagaacuacgcagugagacccugucucaaaacaaaaacaaaaacgaaaaaaacaagaacaaaaaaccaaaaaucacacuugugugcacguguguugccacaaugugagugcagaaacuguaggagucagugcuuuccucuaccaugugggucccaaggaucaaacucaggucccagcuuggcagcaggggccuuuacuuugcugagccaucucgccagugugcccacucuauuuacacugggaagucaacucagagucucccauaugcuaggcaaagacucuagcacuaaguuauagcccguauccccagcccuacuuugucugagacagggucucuccugggacugaguccuccacuuaggucagcuggccaaugagccccacacaucuuccuguuuauguccccagugcugggguaacaacagcaagccaccaugccuggcacuuccauguggguccugacugucaaauucugcuggcccagcaagcacucuaccacaugagcuaccuccucugucuacauggcuucuguauggguuuuguucugaggaaaaugaauggcucaagaauuagaacugaagacccugagguguggugugguggccuggaugcaagccccacccuugccacuuaacaguggcacagacaaagccaagcugcuuaacuucaugaggccccaguuuccgcaucugaaaaucuggcagaagucacauuucucgggguaacuucugggauguggaagugcucaucaguucaggaaauguuauuauuugcaagggaaacuaguaccuuuuaucugcaaggaggguggguacucuacugaugagccaugcccccuccuccacgccucacugacugauuuuaggcaggggcuguaccgcugagccacgccuccagaaccuuacauccucccuucccuggcccaagagcaccccaguuccuacgccuggcccaagagcaccccaguuccuacgccuggcaaggccuuuuccagaauucuccaggcagcuggcuugccucagcccacugaagaguuucccauggucuacaggacuuaggccuaugaacuuauaugcuacccugacaacauagcucaucuuccaagcucucggcaguuauugaucuuuaugucucuaguuucuaaguuuguuuuuuuguuuuuuuaugcgaaugagacugcaugucugucugucugaaccacuugugagccuggaccacgugggugcugggcaucaaacucccaguauguguucuccagcaccugcgucucuauuucagaauguaaaccagaugguaacauucauauuauguauuugaccugacaaagggaucccacaguauaggggaaaacaagaaagaaagaaagaaagaaagaaagaaagaaagaaagaaagaaagaaagaaagaaagaaagaaaggagggagggagggagggagggagggagggagggagggagggagggagggagggagggagggagggagggagggagggaagauagauagauagauagauauguccuguguaccaggcauagcaaacucccgugaaucacaucucuagcuuuauuacuugugucgcuauuggacgcuuugcucugcccagguuuuguguguguguguguguguguguuuuccaggacccuggugcccagugaugcugagaccacgcagcacuucuuacaaggaucuacaauggcugccuguuaccugguugucuguucccuaccagacugcaggaaauucugucccguguuuggaguccucuaagcaaaauaugcugucaggcacaguggcugcucaguaucuguaggugauggguguguaguucaggcguagggcaccugccuagcgugugaaaccucggucggguuccacaagggcugaauuguagaaugaaugucuuacauccccgacugccugugguucaaacccccacaacaugacugcuagagagcuaagugugugcgucucuccagucugucugcaaggagcugaagggaaguggguuggauggauuuccggaguccagcacucucaucccaaaaagggccugaaacucugcaacccccgcagucacagaaaagccaaguggggggagcaggaaacggguuguuccaggggcucagauaacgccuggcuuaggggacaccacaccugccccggucgucccucccuccuaaccccgggcacagcauugcuucggggaggaaggcaggagcuucugauucauucuugaaaaaccggauccugaagguuucaucucuccaguguuuccggggcgggggcugaggggcgugaaugcacagcuugaccggucuuggccgccuguagcccccgcgcuccccagacaccaagucucuauacuuccagucaucccuuuaacaguggagaguggacaggguagguggaaaggaaaugggguuaaacgacccaugguauuugggccuugccucuccagcucagagaagggacacgagggcaaccuggaagcugucuagugacccgugggcgaggagaggaaagcaaaacccagcaggugcggcuccgaagugaauauggggguggcggugggcgugagucuaggggcugaucucugggacuaguuucuggacucaaaggauacgggucccuaagccccaugggucauuuacuagcugugugaccuugaguaaguuacuccaccucucuggcacuagugccucacuucuaaaacaaguuaauaaccccucccaggaggguguuuugauucaacugagcugugcagcauaagcgccggacgaggaaacaccgauccgggcuugcgagggggagucauuaaacuagugcugcgguuguuacuguuaucccgaccugggucucgguguuccccccagccagcuuugggaagaggccugggaagggucgggaacacugacccaccaccaacagggagcguccugggagcagagagcagaggcggacgggaggcccggccagcggggagggguccguguuuggggucccgacgcggccagcuccaccccaccgccacggcuccacgcccuggaggccgccccccgggcgggggacacucaccugcgccgccgccaccgcgcgcgcccugcucgguccucucgaaacuccgcccggcuucucccugggccuccgggacuugggcggggccggcgucccgggcggacuaaucagcgacggccgugugcacucgcgaccaaugggcgccucccgucggaacgcuccagagggaucccuccgccgcgccucgggcucccccca

SEQ ID NO: 4571 - RNA, 18320 nt, Mus musculus
ugcguuuguuccagacgcgggcgcgcggcgcgcccugggucuguuuccccggcacuuuccuguuacuuuccagcggggaggacaguuccggggagggcccugcucacgcccgcugcauaaaagcccagcccagccggccgccacagcccucuaucaaccccagacgcuguccguuccgugccgcgccaccaugaggggcgucagaugccccggccugcuuggugagaccucgggguugcgcggagccgggagggaacucgcgggacguggccaggaggggcagggacagucgaagccggcgcaccugugcgccccagagggcucuccagggggugucagauccuaaugggcuugaguguugccaguuuggagacuaagagggagaaacugaggcacgggggcaguuaaagaggguaacaaagcaggcauggugucacagggcauuagggaggcugaggcagcagggucaccaauuucaggucagcuugugcuacacagcaagacccugucucaaaagaacaaaagaaaaagaaaugcaggcuagaggcugggguggugccgaggucaagagcauuaagagaggaccuggcugggucccagcaccuauaugguggcucacaagugucuguaacuccaguuccuggggauucacacugucuucugcauccacgggcaacagacaugcagugcacagacauacaugcaguguacaauaauacaugcagugcacaaacauacaugcaggcaaaacacauacaguuuaaaaaaaaaaaaagcuaaaaagaacuguagguuaaaguacacuuugcaaacuguugcccaaacagacgcucucaaugugaagagaaacccacgugagggugcccauuucuucgagggugggaacucccccugccccagucuguccccugcugucuccgugccaggaacaggcagagaaucuccuugggacuugucugggacggagcugcuggcugaaaggaacuuaccaggcugugguuugaacuuggcuuucaucaugacuuucccgccccacccugggugccucaaccguuguuugauggcuaagucaccuaaguaacuugacaacaaacagugaaaaaauggaacggggcaccagcuggaguuaccccaagauauggaacuuggggcacaaacuggggucacccuaaccacaaugacuggccugagugcuagugacagguggcaggcagcucaguagccauggaccuagaaccaggaaauagagucccagggugucacaguugguggcaaacagcugcaggggccugccuggcugucacuaagcugggucacagugacuuugggcugcacuuuccuccucuguaaaauggaacaagaccagcuguauuuuaccauauuguuucaagggccaagaguuuguguacaaacuuucugguuuacaguuugaauuaacugaacauguggguguggugucugugucugcuaucagaguaccuagcgaguagaggcaggagggucaaaaguucaaggucauucucugcuguauacugaguuugagaccacaugauaccuugucuucaaaaccaaccaagcagccucgcuaguuggauucucagguuuugaaucccaguauuagagaggcggaggcaggaggcuuccaugauccugggaguuggaggccaaccuggucuacauaguaaguuccaggccagccggaacuacacaaugaaauacugcaggaagcacaaaggcugcccuacccccacuucuggauucucuaagcaggagucccuuggcuccagucugagcuugggaaguugaaccagaugugucugggagcagaagggaacggcucugcucccguuugauuaauuuccaagucuccagauguaggcggucuggcugaugccuuuagcauggugggguagagcccagcccagcccaggggacaaggaaccccccugacuuggguaacuauuacuugagucuacuguccuuucucuggccugguuugaucacucaucuuuuuuccaagcuccaagcccuagcuucucuuuguguagauuggacauagccccgccccuaccuccugaucuuccugauggcugauguuacucugagucuguuuguuugguuuuuuguuuuuugcuuuguuuuuguaaacaagcuuucaaaguggcuaaaaugaccuuaaacuucugguccuccugccucuaccucugagugcugagauuacagauuugcgcaaaagggucuggcuucauuuugagucugcuuugguuuuaguuuugagacaggcuuuggcgcucgcuguagcagcucuguagccguaacugguuuugaauguguacuaaucccccuacuucugucuuguuaaaauagggucuuccuacauagccuuggcucccuagguagaccaggcuggcuuccagcggaguucucccacagugcuuuaccagugcuggcucugaaagugugcaucaacaugcacggcugugguuccaagucuuaaagaaauuaccuaaggggcuggagagauggcucagugguuaagagcacuugcuguucuuucagaggacagaaaucgauucucaggaaccacacaguggcucacaaccaucugugacuccaguuccaggacauucaguguccucuucuuaccuaucuaugccccgggcaauaugcaugcaggcagaacauccauacaccuaaaaauaaaucaauauuauuuuuucaaaagugacuugagggcuggagggaggccucugucgguuaaugauuugugugaaggaagcuggaugcggugacacacacuugcgaucauagugucugucccuggggcuugcuggcuagcuagccaagccugcuugaugagccgagguucaagguagaaggcaccucugcuguucacauacagacacacauacugguacuggauguuaggaacugugcauugccccagggcucagggugaagggaaggucauuuuguggucugucccacaaagaggaacugaguucugaugggugugggagaauuccagcucaguggcccaagaggaggaagaaagaauucugacuugaggggacaacugccuggcuggggugccccaccucagaacacuccaguguugagggaguguuucauccaaagccucuccauuggcuugagggaaauccagucagacaaagguugagcuuucaggggacccucugagcccacugucccugccccagcaacccugcucacuguggcugaucccaggaguccccugggaaccuggcaugcagccagcccagagauggcugaaucauuaaggaagugacucacccaccccccaccagcccuucuccugagggcucccucugggauuccuuucuugggauuaguuucuugcugcuguaguccccauauugggaucagcuaaccacuccccaggccuccugcuccugggacaacccccacacacacccacacacuccgccaaaacacacacacucuuuucuucuguaccgagagggaaaacagggauucacagcugccaggccagcaccuucacacauacaacacaccaguuuuuuucuugguuuuuauucugagacaagcaucuaugcucuguagcccagguugggaacuuccaguguccuccuguguuagcaccccaaguaguuggcauugcauggcagccccacugccugguuuucuguucucucucccucucccccagccucuuuuuagauauauuuaguuuguguuuaugagugcuuugauugcauguauguauaugcaccacaugcaugccugugcccucagugaccagaagagggcgccuaagucccuggaacuggaguuacaggcuguuaugaacuacuguguaggugcugggaaucaaacccugggucuaccggaagagcagcgaggggcucuuaacugccgagccaccuaucucuccagcugccaguuugguuuugguuuuguuuguuuguuguuuuagucuguguauaugcgagugguguguguaugugugugugugugugugugugugugcacaugccgugcucacaugccgugacacugauguagacacuggugcucuucuuccaucuugugggcucccuuugcccccuuucauguuuagguccuagggauggaacccagggccuuguuucagucagguucccgcuaagcuaccaagguggcccuugagcuuuguguagcuuuuaagugaagagccuccugccccagcagccuccugccucaaccucaagcuacaggguuaccccacuugccuucacacccugcuucucaucucccucccugucauccaccucugcuuucuuggaugccugucuccaguggcugcucuguugcccacccuugccuugggugggaugccugccaacaacaugaggcaugggcuguguucagcauucacccacccuccaccgcagccacuuccugugugugaggagcccucucugacaugugggcacugggucaugagguugacaguggguacgcaugugauguugggagugucagagcucggaugggaccugggggacguagcccaagcuuucauucuucccuaaaaaaugacacaggucaggccugguagcauaggccuguaccagcuccucagaacacugaagcaggaagauuucaagugaaaacccagucugaacuuaggaauaaagugaaaagaaguguugaggaugaggcucaacggcagagcacuggacuaacauggaagugcuggguucuggcccagcauuuugacacaaaaugauagaaaacaaacuaaaacagagaggagguguaaaaagacaguaucacacugggcugugguggugcauaccucuaaucccagcacuucggaggcaggggcaucuggaucucugggagucccaggucagccagagccgauguuaauugugggggauuggccuggugcuacuguauguucaaaugcuguguacuggccccaaggccggguugccccgugaggagauucucagguacaccaguuuuguuguguaaaccuugacacacacacccuucccgaguuaucccugauugguuaauaaagaugccuacagccugggcuggacagaagagacaggggagagguucucaggcuuggggucucaggcaggaaccaugaggagaauggggaagaaaaaggaaaucaccaugcccuaguguggagcgugaacacauggccuugagggccggccugauggaguaggagcggcccaggcagagcauggccaaugauaucuugggguuacugacagggaagcagacaaaauggcagagagggcuugucucugcucagcucucgugccuuuaagcuuuauuacaaaucuaaagguuuugugccuuugacuugggaaccaucugaucuaagugggguagaaaccccuaauaaagucaaaaggagauguagcaaacccccauaauaauaacuacaacagauuggcaccucacauugggcgacaaauguaaaauaauauguauuaaacuuaaccugaucuagcuucaaaugaauaagacucaaacuacgauauuuauuuauuaggcucugagcaauuacuggaggauuacgccuaaucuaaaucucuaacuguagucuggcuacgacuccaacugugcucugcaaauacuuguuugaaacucauuucugcucuagcagucuggaguccuggggaggcguuucacucuggcacgugcugcugguccaucaugucuuauggagaccaccuguucucugcugucuucuucucugagacccuucucuuucucuucucucuccuucucugugcucucugccugugacccccaggccugaaacucaaacuucaccuccccaguaguuggggagcaagauuuacauaacaaaugcugguagaugugaggaccuuggagcaaccagaucuuggggcacagaauuuggcacugaguacaagcagcauccccuauaguuaauugcuuagccauguaggguuuguccccacaaagccaagccaucaucuucuccuuccccacagagagggagacugagugaggaacauccaacugugaccccauaggccuggagagccaagccuagcuuccugugucuagaccucucuggucuccagguccugggcuggccuacaggcuaccauggguacugguccucuggcugugggaguucugagccauaggagaaaacaccugaguuguauauuuuuucccucuguuuuauuuuuaaggcagaacuguguaacuuaggcuagucucaaacucacaucuggcuuuccucuugaccgcugagccaucucuccagcccccuauuuaucuauuuauuuauagauagaauucauguagccuagcuuggacuuaaccuccauguguagccaaggaugauuucaaacuucugaucuuccugcaaccccccccccccauacauuggagugucaggcauaaaccccauucuuaacugugcaguuuguuguccuugcuauuauuacuaucugcuuauuuagguguuuuaaagaucuauuuauuuauguauauggguguuuugucugcauguaugucugcucaccaggagaggggaaucccauuacggaugguugugagcugccaugcuggugcugggaauugaacucaggacuucuggaagagcagccagugcucuuaacuacugaacucucuccagaccuggcuggucauuuguuuauuuguuuguuuuguuuuugcuuuugagacagggucucaguauguggcccagggucggcuuugagcuccuaaucccccugccucagcauccugagugauugaauuauaagcaagugucauuaggccacccccugggucugucucuuuguaugaguuacagaaccucagccugggcagggucgucacuggaugcccgauguccacaggcacacagcuugggccuccuguuccugcucuggcugaccgucuuuuacuuccuugcaguggugugcauuuuacugagucucucaggagcuggaacccagaaggcagagaguaagaguaagagacacgagggcugcccagucggagcuggggagggaaucccgcugccaaccacagaaccuugggagggcaugagcacugcuggggaacuuuaggaccugcucacaccuuccuaagauucuguucuugguggcacuuccccucuacugaguaucugucccccacagacugugccaaguggugcccuaucaacucaaaaugugucaguaacagaagcugugucugcaagcccggcuucagcucggagaaggaauugaucacuaacccugcagagagcugugaagguacgaagccucagggaugggcaugaaaagagaugacaagguuuggacucagggcaggggucuuuagcuuucaucaaagacagagaaagaaagcaagguagggaggcaagaagugaaagggggcuuccugagaggaguuccaggggucugugccugaacuuggcuuuaggaaccagaaggagaaggcugaccuuccauuccacucccacacugguauuguucaagucccgggucccauccagaggacugagaggagcagagcagaccagucagcuccaggaauagcuuguuagaccugcagcucagccuuaugaguagagcucaucauuuuucucagaaggcuaacucaucagcagaucccagacugguagucagguaggcgugggagucuccuccuugggagaacuuacaggucugggaggugaccccuguuuuguuguagacaucaacgaguguuuacuaccuggauuuuccuguggagacuuugccauguguaagaacucagaggggaguuacaccugcgucuguaaccugggauauaagcuccuuucuggugcagaaucuuuuguuaacgagagugagaauacaugucaagguaagagcccccccugccucaaggucaccaaugucagcuucaaggucaccagcaucuguauucugucugucuguaacaaagagauuuguucuguauuuauuaaacagcacagaaacacacagcaugcaaaggaaugagggcuucucgacagaagucuuuaacagcauuuuauaagggaaaaauaacuuacucagaacagcaaacgauggcaggcagacaucauucuauauccacgugcuauuucuagcaucugggggagauuuguuguguaacauuguucucagccuauugguuguucucaggaaaugauugccacagcacauccucacacacacaaaggcaugcauguacauuauucugggucaggagcacggaaggguccauaacuuacgauugaagcuaugcauuccgcuuagauuguaaaccuugauuaaaucuaaagaacaguaaggcugguaacauuguucucuuaaggcaggcuaaacuuuaccaagcugagcacacaguagauuaaguacguagucuuuuuuuuugggggguggggguucgagacaggguuucucuguauaucccuggggguuucucuguguaucccuggcuguccuggaacucacuuuguagaccaggcuggccucgaacucagaaauccgccugccucugccuccugagugcugggauuaaagacgugcgccacuacgcccagcaaguacguagucuuaagugaucucaaggcagauuuuuaacuuguuggcaagaucuaagaaaaaaauuuguugaaugcaagagacauuuucaaagccaggugugaggcacaaguccuuuaaacucaacacaguaagaccggcagaucuugugaguuugaagccauccuggucuccauaguaaguuccaggacagcagagcuacauaaugagaccauguccuaaagagagagacagagagaaagagaaugguuuucagaaaaauguuauccguacaugaggugacaucuccauggaucccaaggaaggugacagaaaccauccagcuuagagcagagcucauccagugccugaggugcugacccaucacggagcacucccgacuccauccugcgucgcuuggaagacaugcucccgggaaucgcacucaaaagaugucaggauuccuugggccauaucuucuucuucucuacuucuuuguucuggaaguucagaacuucuuauguccaucugcaucucauuugcauaagccacuauccuucugucaucucauuugcauaagccaccaucccucugcccaucugcaucucauuugcauaaaccaaaggcaaggcauucagaaugcucugcaucuaccacaagcacggcccacugcagugucuguccucuucccagcaucagugaacacugggaugacaccugugcccuccaggauccacacaguuacuacugcgccuggaaaucuccccgagcagacaacuacagugcaccagacacagaugggagacucagaagagaggacacccaaggguaggccacauucccugucauuacuucugcuggaagacaacgccugaugcccggauucccuuuuuuggucagagccuuguccauugcucuacccagucaccgguucugacuauccccagcaauucugguuccuugaauacagcauagaauggcauggccggauugggcagggugacgucuacccccaccccuccaccacacacccaagagaguugaaggcuagcacaaugcaagagaaggugucauggaggaucguugcuucauaacccuuaccugaugaugucaaucacccacagcugccaggccagacaauucaguguaagaaagcugggcuacacucagcacauugccgggucuguggccaugacagaaaaagagagaacagaaauaucucacuccugccccagcagcacggcucccucucugggcacugcgaucuugaagggcuggcuucaguggaauagauguucuuacccucuguaacuugagccaggugaugccuggcagcccaucacagcuagcucccacugugaggcaucauggcuaucuaguguuaucccucuugcccugccucuccuguugaguuucuuccuagagggagcguggcuugugggcaacacucaguucuccacugacagagcagagaucuggggaccuagugugacugagguuagcauaguccugaagguuccuggaagucuauguagaacucugcaagggagcaguaccuuguaggaguggggacagaggcuaucacggggaauacagaguuucccaccuucuugcacuggcuccuaagggucauauguaguuuucaccccaaaucuucaggcugggauauugauagcugccgcuguucuauugcuggcaguuagggaacccuugacugcuuccccuauaucuagacaauagaguuagagcuaccauggacccuauuugaugccuuuauaugaauuagaaguuggucuuccuacaaggaggagauuaaaauguugcagaugcuucugugucacguggccaaccuugagccugaggcuucaacuucaagcacauaauccccucugcuucuucucaugagcagaugagggucugaacccuagaguuuguagggacacagcauuugcaccaacccagggcagcuccucauacacagcugugcacccugaagguguacacagguggaaguccaccagaagacaccguaagacuggacaggaccugggaggaggcacagucuguuagccugaagagggagaucugcagggucccagaagcuccaagaauuaugaagacuccccugaggacucagcucccagcaacauguuacuacaggguagggaggccccaggaacuccauggagcucccagaccucagguccuccacaguucugagagcagcgucacauccuguccugagaaagauuaaaaaauaacaagaggccucggucaagaagugcagugcgguggcccagucuccguccugguuuuaccucuauuaauugggaccccugauccuugcugggccugaccugcagaaaccaccaugagguggucacuacauuuguggcagugagaagacgggcaagugacacaguguauggaggagugaguggggacagggaugacccuuucguuuuguucccagaugugaaugagugcaucuccgggcaaaaccauugccaccaauccacccacugcaucaacaaauuggguggcuauucuugcaucugucgucaaggcuggaaaccuguuccuggaucccccaauggcccugucagcacagugugcgaaggucugcaugcaaccuuucuaaggacucacaaucacaauagcuaaucucaccuucaagauuuguuuauuuuagccaagugugcugaucccaccacuuggagggcagcagaggcaggcagauagaucucugugaguuucagggccauuucauauguauguauggguguggaucuguacaccaugugggugcaggugcccaaggaagccagagaaggcugucagauccucuggaacugaauccacagguugagccaucucuucagcuccuguguuuuaucaaaggaaugaaagggggcucuguuaggccaggacuuauucuccugaggcuaaaucugaaaagcugugggguucaggaaaggauccagguuacaaaggcgaggccccgggggaccccagaugccuucaauuacuaaaaguccacaguuucucacauacaucuauaugccuuagccucugcacauucccuaccauccuguaccacugaaugaggccaccaggggucaguaccucaggccagagacuguagcaguacuaaagagacuggggccagacaggaaaggcucuaaccccuuccuuaugucugcagauguggaugagugcagcucugggcagcaucaaugucacaauuccaccgucugcaaaaacaccguaggcuccuacaagugccacugccguccagguuggaagccaacuucugggucccuccgugguccagacaccauaugccaagguaccugacccagccacccagauuccaugccccacaagugcucucugagauuacugaacuauaguccugucuccacagagccaccguucccuacuuggacacugcugcccacagcccacagucaggugaguagccagugaauaccaggagguuggacuuuuucauacagccuguccaugcccgucagcugugcagcugcccacccaugacucaccacccacccaugaccauccuucucccuucccagacucucuugagauucucuguugaaguccagaaucugcuccgugacuucaauccagccacggucaacuacaccauccaggugagggagacacuugggacccuggugcaucguggaacaugucacaggcuucagggcagacugacagcauucuauccguccgagcaguauuucugguuuggggcacauggaucugacaugugcagccauguguguggcuacuacacaaggguuauaauggcagugacuggggcaguuaagauuggaauuaagcagagcaugauggcccacucugcuuggggccuuaagaaggaucucaaguuccugaguuagacaucgaugacaugccugugacuccagcagguagaggcaggaagagcagaagcccaaggucauaauggaagagcaccagucuagaauccccagugagggcugggggggggcauggcucagcagagccuuggcagucccugugccuacuguuguuuacgugcuguugugacaugcagaugcacagggucauaaacuucaccuccuuguuuucuggcuacuguguaagucuuacugcaucccgccagcugacuccccagggagcccgcguggcucuccagugucugcugguaggcagaguggucaggguccuucauuuaguuucugugguucaaaaccuuagcaacucugucacucauuaccccagaaacucaucgaggcuguggacaagcugcuggaagaccccauggagacugaaacccaacaaguagcugcccaguugcucucgaaccuggaacaaagccuucggaccuuggcucaguuuuuacccaaaggccccuucaccuacacguccccuucaaauacugguaagccuucuuccugccccaccccaggaaccauccuugguucccccaaucaugucccugucucuucagaacugucccugauggugaaggagcaagacaacaaagauguuaccacagugcaccacggccaaacuuggauggagcuggacugggcugugacagcuggagccaaaaucucagaaaaugguagggguccagagagggcgccugccagggaaaccagggugaggucuggagaggacagggagacaccagcccacugggaggaguacagagaggggacaggaguugagccuucaugucugcccccaggcuccucgguggcaggcauccuguccagcccaaacauggaaaagcugcugggcaacaccccgcugaacuuggagcagagaagggccuccuuggaggacuucuauggaagcccgauuccgagugucucacuuaagcuucucucaaacaucaauucugucuuccugaccaacacgaacacugaaaagcucgccucgaaugucacguucaaguucgacuuuacuucugugaguccuccaacuggagagaggggagggguggggaugcucuguggcucacccccuaaccaaagucaaaagucagggcagcgccucuugaccuacaugguacgagagaacuaacucccaaaguuauucugacuccuuccuccaacacacacacaaaauaaauguaauaaaaaacacuaaaaauacauaaaaaauuuaaaaucacagcugugggguguguguggugacacaugcuuuuaauucuaguacuugggaggcucucugaguuugaggccagcauggucuacagaaauucaggauaaagcucauaaagacucugucccaaaaaauaaaacagcaaaaaacaaaacuaaauagauaaaaaaagaaauaaaaucugagcuggguguuguggcacagacauuuuccucucaauugcugggaggcaggaaauucaagguucaaagccugccuggagugaaguuaaggcccaccugagcaacuuggcaagaccuuguuuucaaacucagugcuacaguugguuggcauucagaaagucccuggguucagccccuaguacugcugaauugaaugaaugaaugagcaaacagauaaguaacugugaggcaaggccaguaguugacucaaugguggaaugcuuaccuggcaugguaagguuuggucuucaguaucauaaaauguuuuaaaagggguggggagauggcucagugguuaagagcacugauugcucuuccagaggucgugaguucaauucccagcucccacgguuucaccaaaccuuaauuuaauucccagccugaguugggaccuacaugguaguagaaaccaguuuuuuuuuccauauuuuuuauuggguauuuauuucaauuacauuuccaaugcuaucccaaaagucccccacacacucccccacccauuccccuacccacccacucccacuucuuggcccugguguuccccuguacugaggcauauaaaguuuucacgaccaaugggccucucuuuccacugauagccgacuaggccaucuucugauucauaugcagcuagagacacgagcuccagggguuauuggauaguucauauuguuguuccuccuauaggauugcagaucccuucagcagcuugaguacuuucccuagcuccuucauugggggcccgugauccauccaauagcugacuaugagcauccacuucuguguuugccaggcccuggcauagucucacaagagacagccauaucuggguccuucuaacaaaaucuugcuaguguaugcaauggugucagcguguggaagcugauuaugggauggaucccuggauauggcaguuucuagaugguccaucuuuucgucucagcuccaaacuuugucucuguaacucuuugcuguuugaggcagccuggaguguaugagauaguauacauagacugaggacauccaauaaaccuaguuuuuguuuuuaaauuacaaucuguaggcaaccauucccgcuggcucuuuuaauuuccuuggcauuuauuaccugcuacugcuugugauguuucagcucagggcaagggcugguguccuguuguucaguugcuggcuccucaugcucucugagcacaaaguagauacuuauguagccaaaagcaagguucucagcucccccagacuggcccuaagugugcucaaagugugcuuccgacacccucaccaccuaucugcccacagguggagucaauugagccacgucaugagcugauaugugccuucuggaaagcccacaacgggaauggguacugggacaccgacggcugcucaaugaauggcacuggcuucugccacugcaaccaccugaccagcuuugccauccuaauggcucaguaccaugugcagguaagcgguaagcucuagacccacagguagccaggugugcuaggcaggagcauggucuccacucaaggguguuguucaagcaggcuccuuuggauggccccaugccuugcuuuuuagcuccuccccuggaauccucuuuaugacccaguagcugauggaugcaggccucuugucugagucacugcacaacugucaagaacugcuaaaagcacaccagucugggcagaugagaugggucagugaguaaaggugccugcagguagccaaccuaauaacccgaguuccaucuccagaaagcacagugacaacagauacuucacccggcaacccuccuccccugcaaauaaaaggcccuguguagauuguuccagguaguguagcuuccugaacauggcuauuaccugggccacauggucagcuugaauuagccaguuggcccuguaguccaagacaggaugcaggaucauagguaggaggggugugagggcacaccacucauccugguugccugcuccuaggacccaaggcuggaauugaucaccaagguggggcuguuguugucccugaucugccugcugcugugcauccugaccuuccugcuggugaagcccauccagagcucucgaaccauggugcaccugcaccugugcaucugccucuuccugggcucaaucauauuccuggucggcguggagaaugaagggggugagguaaguuccagagcauggaguuaaguccuaggaguaaggcccagcuggggcucaguguggagccagaaccugauggagccccgcugcuggggcaugaggcuuugaagcccagugguccuaccgggcacugauucuuccuaacucuccaucccacaggugggccugcgcugccgccugguggccgugaugcugcauuucugcuuccuggccgccuucugcuggauggcacuggagggcguggagcucuacuuccugguggugcguguguuccagggccaaggccugaguacauggcaacgcugccugauuggcuacggggugccccuccucaucguggccaucucaauggcaguugucaaaauggauggcuaugggcaugcaacauagugaguguacugaagugaggcccaggcugggcggggccagggcuggggcacugacugauggggcaccuucuccuccccaagcugcuggcuggacuuuaggaagcagggcuuucucuggagcuuuucgggacccguggccuucaucauuuucguaaguacucucugggcacuggaggccugagcagccagacugcuaacuccuugcagcccuauaacccgagaccaugauccccacucagugcaaugcugccauuuucgugaucacugucuggaagcucacaaagaaguuuucugaaaucaacccaaacaugaagaaguuaaggaaggcgaggugagaggggcagggaaggaggcuuuggggcaagggcuggagaccgggcuguuugcuacaguuguccacccccacagggugcugaccaucaccuccaucgcccagcuccuugugcugggcugcaccuggggcuucggccuguuccucuucaacccccauagcacauggcuauccuacaucuuuacccugcucaacugccugcagggccuauuccucuaugugaugcucugccugcucaacaaaaagguaggcugaccagagcuggcuauggaagagcccagggugggaggaggcagggccaggccugagucccuagcccagcuccuuuuuuccccauaaccuggugccuuguguucacaggugagggaagaguacuggaaaugggccugcauggucacugggagcaaguacacagaguucaacucuuccacaacaggcacuggcaccagccaaacacggguaaggggcuggccugcaguggggcugggagggcaggccuaggugagcucagccucaaaggccuccuucucugcaggcucucagguccucagaaucagggaugugaaggcgaguuccaugaaggacagcagcacauacucacggcugucauucugccuucuguuccugccaccuuucggccuuugaccccacuucauauaaagaagggaugcaaacccagcaaugagcccugccacggggcaaggggucgcugguccugcuucugguugucucugccucaccacagcuacugccuaccagagaaacagaaugcagccagcccagaccugcagcccacugccugguacacgaggcaggcaguccuaggacaaagggaagagcccuugagaccugggcucuuugccagggugcuggguucaguuuccuuaagcuaagacuguggaugccacgucagccacugaagcccgccugcugcugaggcucacgguacagaggccucgcugcuccacauccagggcagaaggucucacagcuaaagacuagguuuuguaauuuuuuuaaccuguaaaccuuucaauguugacacacaaaauuaaauaucauauugauaaaaaagauggcacguuugcuggugagaaguuugcuggcuugacccaaccccaugagauguugaccgaaagggauggggcuggagccaugcauucacaauaaaaguuuauucuuacaucacuaaagcuuuggaacaauaaaaagagacaucgauuugucaccuagaaagagguucugaagcagcaggugggaaagagaguggccauguugcccuggcuacacauacgguuaccggcucugcucaacuguaaagacaagaaagacacagugagugaggauagagggccuuugcuccugaagccccgcuccugcccugaguggcuccagguacucacuguauguggagauaucuauuuccucug

SEQ ID NO: 4572 - RNA, 14694 nt, Mus musculus
aaucuagaugaagugcuuuuauucuuaagacaaccaaaacuuuuaauauaaaaccuuuuaauauacacacugcaaucacaauagcauacauguagcagcaagggaacuaagggcuuaggauagagguggauggaaugggaguuuuucaggucagccugccaaacaccuccuuuaucccagaguauuuggguauagcaugagaaugaacauguggucaaagcaaacccugaugacucuauggggccagaaugcaugaagcaggaccuccaauauaccuaccuagggcaauccucucagaaagccaggcucagucaggagaugaaaagguggcugugaccaaaguaccugacaucccucauuggccuggggagcucacuuuugcguuuuguaguacuaguuagacugaauguccuagacacucugaaaggauagccauuguauugagcuggccuucgaacuaggacuucuuccuugccuaguccccaagaacuagaguuggaaggagugauaaccucuggccaaugcuagccagacacugcccaagcaagccucacagaaggugguguucagaaagcaucucauagaaacugauaauauauaaagaaaaaugacgcauagaaugagcaauacaaguaccugcuuuuuagaggucaguaggucauaagugagaugauucuucuggaccuggauggaagagauuggggcccauuguuuuuucuuggggcugacagaucuggagacagcuggugguccccaaauccuugagaugaccaagcaugucugacugagggcuuguagguccccuccaggugugcaaggagacugcugugguccuacugagcucuaccuggcuccccugucagaugcaauccauggaguucucagggaggaggccugggaugcaacuagggaggcccaggcuuuuaacaggagugcaacugagggaaaggcugaaguccacauugggguccugguuuucuauggcuuccagacugucuggauuguugucccaguugauauggaaucgggucacccggggguuagaggccaagauguuccgcuguagcuguaguaagaagaagaaugucagcccuugucaccuaaguguucauuauucccucaaaccuccacuuugagccugaaagcagacucaagcaccccuguugcucagauguagaacccuagagauacuugaacacucuggguaggaauagggccuucucauccuggguuugcuuagcuuuguucauuugguuuuggguuguuuugagagagggucucaacuauguagccaugguuggccuauaacuauauagaugaggagggccuuaaacacaugagaucugccuauaucaccccaagugcuuuaacccccgcccccaaguacugggguuagagauauguauuaccaugccuggcuuauuugauuuaaaaaaaaaaaacaaaaaaacuuuguauauggguguuuggcuguaaauaugucuaugucacauaugugugccuggugccuuuggaggccagaagagggcauagauccccuaaaacuggaguaaaaguugguuaugugccaccaugugggugcugggaauugaaccuggguucucuggaagagcacugagccaucucuccagcccauucgcucgcucuuucuuucuuuuuuuaauauuuuuauuuuuauuguaugaauguuuuccuauugagaugucuguuugucacguauauaccagaucccuguggaagucagaagaaggcauagauuccccuggaauugaaauugcagguggcugugagcuaccaauguggaugcuaagaaucaaauccagguucucugcaagaguagccagugcuccuaaccauugagcauuucucaggugcuccccaagccucacacaccuggaaacagggucuugcuauguaaccuagguugggcuggaacucauuauguagaugaugcuggccucuaacuuucagggcugggguacugagaucaguaugcuccauugguccuagcuguagcccucauucuguuaggcaugccuccagaagaaaagacuuacuauauucuagcucuagcuuagcacugcagagacagcaugaccuguuaaccuugacugaccuuggcucccaucuccccucaacuguaagggaacuggccugucuaaagcacaaagugcagagacaggccccaccugagagaagucuggcuuuggggguggguucucucgaagcucugggucuggguacucauuguugacauaguagcccacacggaugaacucuuguccaugguaggugcaggugaugagaaccacagucacacccacggcguccgucucaggaaugagggauggguuuggggcaucagccuagggagacauagucugcgcuuuagcacugccaaucaugcccaaaugucauuaacacaaagacuaccaacaaagcggggcuagacaaacugauuauacagaugacuauaaagagauugugaauuugauuuagcagcaugcuugcccagcaugcacagcccugucuuccauccuuaguuccuaguaauaauaacaacaauaagaaauucacaacuguuugaacuugauuaggagacacagguguucagguggacuacaguguacaaggugacugacgaugagaugaagauggucaggugaccugcugggucaauuaagggcuugggaaagaguggugcuuagcaggagguaaggucugaaaagacuggcagcauauggagggcugcagcagaaguaaggagaccagguaggaaucagccuggaggggcaguagccuaaaccuagcagcagagaagagucacagaucaggguauuugguuuuggauggaauagcuaugucaguacaauaagaaaccaauacaaaugaaaacacagacccuuaaccaaaaccaccacacagcugaguaucaucaauggggcccuguuaaaugaccaagcuguaugcucuggaaguaggccuuggcugugaacacugggcacagugggcuugacagguaggauugugugagggcagguagcuuggaauagggacacagugggaaggaggugauggauggugacuuuggacauagcacuacuuggaagucacagccuaucuuuauauucacugguucugaguuuacaaaucuggcaacuugauacaucuagaaacuucaaaaucggcaacuauaguacuuucauaguugcuuacagacauguacagaacaaggaaaaacccuuugcucagguuccaacauggggccaaacuaggggcuacuuggccuucuugcuuuagcuuucaguacagagcacaaggacccuuuugguuucuuauggugagcuuggguuccuguuugucagggugugaacaguuuugcuauacauuccagcuaccacaauauuugucucucuccugaccuagaaacauaaagcuaagaaaccaugaaacccccuggaacguucccuuucuuugcuacacugccaacaauccuagggcagaauauaagcacuuaaguuuuauauucaccaccaucuuuacuacacauucuuauaaucguucguuaagacaggaucucacuguacagccuuggcuggccucaaacucagagauuugccugccucugccuccugaaugcucacauuaaaaguauaccacaaccugucuaguuguuuguuuguuuguuucuuucuuucucucuaucucucucucucuuucuuuccuuccuucuuucuuucuuuucuuucuuucuuuuuuuuuuuuuuuuuuuuucugucuguauagcccuggcuguccuggaacucacucuguagaccaggcuggccucgaacucagaaaucugcuuggcucugccucccaagugcugggauuaaaggcaugcgccaccacugcccaguucuaauuguuuuuuaacagcaucugguuguauacucuaggcuagccuugaaguugaagcaaucuuucuaccuuagccuuccauguacugagacuacaaacaaguaccacuaaacucagcuaccaccuuuaauagaaacugaguauuugauucauuaugcauacaaauguuaacucacugaugccaaaugauuuauugaaaugucuuaaaaaucaaugaguagcugggcagagguggcguacgccuauaaucccaguacuugggaggcagaggcaggcggauuucugaguucaaggccagccuggucuacagagugagcuccaggauagccagggcuauacagagaaacccugucucgaaaaaccaaaaucaaugaguaaagauuuauaucauacagcaaauaacaaaauaaauaagaucccaaaaugaagugcuaucuggguaaaagcaacuuauggagaaaaucugugcugggaaaaucuuuguucagauaugggcuagugcuucuggcuaaguuccugagucaacccuuauuaguaagguauuugagagaaggucuuacugcauagcuuaaguuggauccaaacuauguguacuggguuauaaguauauacugcugugcccagcccuggcugauaaacaaguaacaaggacucuugauccuuauucuuccuugaggggaauaguucaauauucaugaacuauguuuauggguuuuauacaacuccugugaacagaucacaaauuagugguccaguggucacuaagaacugugacccagagguccccacuucuggggaggggaaggacaucugaugagacugggugaguucagaguggugguccuuuaaaagauagcuucaaucagacagcuccuggcagucaacugagacauguggcucaggcaggccuugaacuuguggucuuccugcuucuacauccuaaguagcugggauuacaguaguuuugucaccaguccaaguuuaaggauuugaacuuaaacuugacugccaaaaccagugugcuuucagguaaaagaggaagguucuaggcuuagguguggcucaguagugaaugucuaguaugucaggcccugauuccaucuccagccugaaacauuucuggaaaucaagagcuaaagcaaaacuuacuuaccugaaagacgaacauaugccuuccugcagggacagggcccaccagcacugaaucuaggaucugaucaaacuccucacucucagcugagcccacauaaaugaucuuccacuccaggucugcaagaacaugggggauaagggaacugaggucuuaaauagcuggagagcaaggcaagggucuucuugucagcauuaggcaaaucugaauauacuagaagguccuaugaacugguguguuugcugggcugucgguucuggcaccacaguccugauuaagagcaaauaugaagaucuauuuuaauggagacauuucuccugugggccuaacuuggccaagugaccuugacucuggcccucccgggaaaauuaggccucucaguagccgagaggaaccauauaguagaggcugacuugaguccugugacaucagcuugugagggaacagcagggaguugggcuaccuuggucucuggguaggaagugccaucucauucucuuucacagaggauuggugccaccuaguagagcaaaucccucgauaacuggggcaggguggcagauuccaauccagcaggagagccagguggcaggaggggaaaggcaaagcugugggggggggggggaaccaacuugucccaaaguuguccacaucuggcaccaacucaugccuacuugugcacauugugggacagaggcucugccagcaaauguuguaugacaaggcauaccuccaaaaccugacaauguacuccaucacuaagggacucaguccuggaguauacccauaagagaucaaagaaaaaguaccuggagacccuuccuauuaaucucagaagagcccugguacucauagccucuuguagaggggccaaguguuaccaggagcaaggucaugcuaguacagagacgcuuggcaccagacccagaacuuauuuuaggcucuuugaaauuacacaaccccuagcuccagcagcugggaaaaguugcacaagcugaaauuuucacagagagcucuuggaagcugccuggcucuugguccagugugguacgggcauccaacacuggaagcacacagauaucagaucauacuauggaguuugucaccugauccauaaagcuuuccuuuauacgucacguccacucucuuguuccuucacaaucccaccuacaucuuucuagguaaccccaugcccaugguucaucagguucaaacuccagccuuaguacuuuggggaaauuauuuaguuauuucauuuuuaaaguuuauuuucuuaugugccuuuccuuuuauuuuauguguguggguguuugcuugcaugugggucuaugugcccuuuggugccuguacccacagaggccagaagaugguguugggucugcuggaacuacagguacuguaggggguuggucuagugcugcuuguauucaaaugcuaaauucuguacccaagaucugguuacuccaugaugagcauaucuucauguauaccagccuuuguuguguaaaccuugcuccacauguuauccccgacugguuaauaaagaugccuacaguauguagcugugcagaagagaggaaggagggccucagguacugggcuuggggucucagacagggaacauggugagagagaaggaagaaguuaccaugagauagguggauuguaagugcaugaccuauuggaguaagaguggccaggcagaacauggcaaguucucaguuauugacagggaaguagacaaaauaacauaaaagguugauaucugcccagcucuaaaauuuuuaagcuuauuauaaagguaaagguuauuguuuuucauuugaaaacuauauaguccaagugggauagaaauccccagaauaauauuuaccacaacauuuuggcaaaccaacauggggugagaacuuacuuauaauccaaauugaaauuucaaauuuccuggaugaaagguauguugucccauuaagauagaaguaguuaaucacuaugugggaugggagcuaacccuggguucccuagaagagcaaucagugcucuaacuguggaacaaucuuucuagcugucccuagcuauuuauuucuuaggagugcuggugauggaacuuaagguauguacaugccaaaaaaagugcuaugcaucugagccaugcucccagacccauaaauuuaguuuuauaaaaagugacacucuagaaucaaugauucuggaaggacagaaaaguaugcgacccuugcuuggccucacuuucuaagauggcucugucaagcucuacuuucuucaggccccuuccccauacuccauggugccacauauucauacacuuaauuaauguguuggagggaagacuaggcaaaaaaagagcuugacacagaagagucccuuguguccccaaggcaccuaacauugcuuaguuuaggucaauacuguugguaaaaucuauuaaaaggaagacuguaguguacgcuggaagcaucuucuugacaugggccagaaacagacccaagaauucacaaaagaccacauaaauacugacuggcuacagucagagcugaucaaaucuucuacagggcccauaaacugcagucauuuaaaauuugaugauuuuuuucauauuuucuuccuucaaaagauagauugcacugguauaugccuuuaaucucaauaugugagacacagcuuuaaaaaaaaagacagaguuggguuuuagaauuggcucugaggauuaaggcacuugccacaaaauauaaagacucagcacaaucauucuccagaaaacacaugauggaaggagagaacugacuccagcagguuguccucuaaccucugcgagcacucgcacauacauacacauauguaaaaacaaaggaacaaaugacagucuuccuauguaguguaggcuaguccagaacuuauaacauaucugcaagccuuccaaguauuggaauuacaagagugcacccaugugugucucucauucaaucuggagcuuacuuugucagcuagucugguagacagugaacccuugggauccccuucauacucccuggcuucuacuugagugcugaacagucaaacucagguccuuccugaaccauuuccucauacuggggugcaguguuuugaauagagagaaacuaaaaauuucauuucagaauauacucaguguuuagcaucuguagguuauauaacuauaaacucaaccaaccagauagaaaauauuagaaaaacaaucugggacuggagggauagcccagaggugggauauucaucuagcauucaugaugccaggguuccauccccagcaccacacauaaaaauaaauuuguacugaacaugaauauguacaacuuucuuguuguuuauucucauaucauguagaccuggcuagccuauaccucagagauccaccucuugagugcuggaauuaaaugcauuucauguauucuuuaaacagcauacaacaucuauuuccauaguacugacacuaagacgaagucauguagagcuggggagauggcucaguaauuacagugcuuucuauauaagcauguaaaaagagcacaguggcucaccuaaaacuccagccuuggaagguggaugcaggggaucacuauaaugaaguggcuagugagccuagccauaccaccaagaccuggguuuaagacaccugucucaauggauaaagcaaaaagagcauucugaagacgauuccugacaucaacccaagaacucccucauacacaacuugucugucccaucccuccaccuaaaaauggaaagucacuuguagaugauuaguuuacgggaaggggcugguuguugugguacacaccuguaacucuagcacuauggagauggagguaggaucuagaauucaagacuagacucaugggcuggagagauggcucagugguuaagagcacugacugcucuuccgaagauccugaguucaaaucccagcaaccacaugguggcuuacaaccauccuuaaugauaucugauggccucuccuagugugucugaagacagcuauaguguacuuacauauaaaaauaaauaggaaauaaauacuuuaaaaaaaaaagacuagacucauauaacauauuaaguucaaccaacauaggguucauaaacccuauccaaaaaacaaaagaaagucaaacuaauaaagucuaggggagacuaugcacaggaucuauacaaccacuauacuaguuuguauauggaccuugaauaucuguggauacugguaccugagggacuuagagcucugagaccaaugguggagacuauuucuucaaaaguaggucugggccaucagaacauucauacaguauaaagucauaauaaccaaacauaggacugaauuucacuuuuuuuaaagacaggaucccacuguauaaauaggcugaccuugaacucacaaagauccucuugccucucccucucaaccacugugauuaaaagugcucacaauuuuugguuuuuuaauauauguaugauguguuuacauccauguaaauauggguaugccuaagccauaaaguguauggagauaagaggacaacccuaaguacaaacauugucaacaaauacagagagcuuuugaagauucucuuucucuauuaacacuuauccacugggcagugguggcacacaccuuuaaucccagcacuugggaggcagaggcagaggcaggcagauuucugaguccagccugguuuacagagugagcuccaagacagccagagcuauauaaagaaacccugucacgaaaaacaaacaaacaaaaaaaacccuuauccaccaaguuaucgcuguagcuuaauucuguuuuguuuugaugcucuaaauugacauugaccccuauuaggauauaucuuuuacaauuugggaaaauaaaaccaaagcugaaaaauauuacuaaagacauguaaaauuuuuuguaguuuaccugagcuuguuuuagacagcacugggacagaauccagaacuugacacaugcuaaacaagugcuuaauuaaugaucuacaccucagcccauuccuuucuuuuuccccuccuuuauuucuugaagcaggucuguguagccuuagcaauccaccugccucugcuuccugagugcugggauuaaagguguguaccaucaugcucuggacuucuuugcuugcuuucuuuuuccauuguugcuuuuuuuuuucuuucuuucuuuucugagacagugucagguagcccggguugacuuggaacuugcuaugaagcuaagcuugauuuugaccuuccaguccuccugucaucauucuccccaagcccugagugcuggggucacagguaugugccauacuuccugcucuuugagacgaggcuucccuauguaucugcuugcacgacaggaguguagcugggcacuguuuuuuuuuuuuuuuuaaacuucugugcauuauugccuggucuuuuguucaucauacagaucaaccaacacugguacacaacaucuggcuucuuuaacuucuucaacuaguacugaaauucuccacugaagaggaggggagcugggccaaauccacuaaauguagacccguaccuuggaacugucuauuucuacauguugaagagaggugaccacagggcuucagagcuuuucagaaaacugggucagaugaccauggcugaggagguuucucaggguuucaggagauagugccaaaaugcaaggaaacaacuucucuacgauucauggaaaggaagucaggaagaugaaggccaucuuucaggcccaucagaauguaaggaauaaaaccaaccaucauaacuuagaggaaaaacacccucuucuaucuuuucaaaggguccugaugugacaagaaauucuacggucauucuuaauauggucuccuaaaauagccuguugagcugaugauacagcucaauggcaggacaacuguuuagcauguguguaguucugauuucuaacacagaaauaaaagacaccaccacacauaggacuccuaccacccccacaaaaaauaaagagguuaaaauuaaauaaaacuugcaaguagggucuggggagauggcucagcauuuuuuuuuuuuuuuuuuuuuuuuugguuuuuccagacaggguuucucuguguagccccagauguccuggaacucacucuguagaccaggcuguccucgaacucagaaaucugccugccucugccucccgagugcugggauuaaaggugugcgccacaaugccuggcgcauuucagaacacuugcagaggacccagguuugauccagagcacccacacaguggcucacaacugucucuaauuccaguucagguaaucugacgucuucuggcuucagaaaaggaaucuggcuagaugucucagcagauaaguguuuuaagaaccugaauucaggggcuggugagaugggucaguggguaagagcacccgacugcucuuccgaagguccggaguucaaaucccagcaaccacaugguggcucacaaccaccuguaacaagaucugacacccucuucuggagugucugaagacagcuacaauguacuuacauauaauaaauaaauaaaccuuuaaaaaaaaaaaaaaaaaaaaaaaaaaaaaaagaaccugaauucaggguacuggagagauaguucaaggcuagaauccaguauugaccuuuaagauccagguuugacucccaacacccaugucgggaaucucaaaucagcuauagaggaucaguugucucugccuuccaggggcucccaugcauaugccaccgccaacauagacacaaaaauaaaaaagaaaggaaugaggucacauguggagguguacacuuugaaucccagcacuggggaggcagagacaagcagaucuuugacuucaaggcccuccuagucuacagaguaaguucuagaucagccagaacuauauagugagacccuguuucaaagaacaaaaagaaaaggaaagaaaaccccauuacugaagagaauaagaugguggaucccuggcuuacuagacagccagacuaccaguauuguagcuccaggcuuuacagagacacugucuuuuaaguaggacaaggcuagagagacagcccaugguuaagagcauuggcugcucuucuagaggccagguaagauuccuaacaccuccauggagacucacaagccuguaacucaaguucuagaauacccaacuccuucugaacuauguggcuaucaggcacucaagugguggcauaaauacauguagacaaaacauacacacaaaaaauaaaauaaaauaaaaauaaaaagguggccaggcagugguggcgcacaccuuuaaucccagcacuugggaggcagagacaggcggauuucugaguucgaggccagccuggucuacaaagugagucccaggacagccaagacuauacagagaaacccugucuggaaaaaacaaaaaacaaaaaacaaaacaaaacaaaacaaaaaaagguggacagcaauugagaaagaccacuugcaguuucucuggcccacacccacaaauuaaacuaaaaaaaaaaauaaauaaauaaaaacaaucuggacucagaacucagagacaaacuucaaugauaaugcuucuacuacuaucuggcugacuuggaaaaaucacccugcuccuauuaaaacaugaccaacaggcugacucuagccucgcuguucugguucuauaaauaaggaauaaaaguaauacuaggcaaugaccaugcaaccauuuuuaaaugcaaggagcacaaacagacugauugaaaccugaucucucagcaucugggaacugugaaucccuuaaucuaucagcuccuuauaucuccucuuggcuuccaaauaaaucguauuccacacuguuacucuaccuuuuauuuauuuauuuacacccugccuuguuccaguaaggauuuaacccagcuuauucuauaguuagucauaaguagauucauuuaaacuuaagggguaagaaacuagggagaggcugagccacugacccaccccaagcacacacauagcagcuccaagugaacaggaguggcuggccuuaacugaauaccaccaacagccaccaagaggcacuaguugccacagccuaggcucucagagcuccaccuccucagcugcuacauccuuucaacacucaguagagaaauggucucguggaguguugaaagcagguccucugaaaacaggacuugccuuuugcuggggagcugagaauccaaagugacuucacaguuuacauguucauggauuuauuugaaagucuuuugcucuuuauggcucuuguucucucaucugugugaugagagccauguccaccuuuaugucccacagaugaauuaagucauucugugaaagauccacaaaagcccguggccucccaguugauggaaguuggaucccaucccuguuuggucaguccacccacuccccagacaaggucagcccaucaaaagggaugagggguuccuugcacugaguuagcuggcagcuaguagaaaucucagaaacuggaagaggccugccuggcuguggcaccccucaccucaggacauucacccagaccaggagcuggggagaccaaguuaccuacaaagccuggagucagaagcccccaucucuccucagagggagcucagacauaggaucugggacuaaccuaaaggaagaaggcuuauaggcaacaccauguuguuacgguuggcaagcaggaguugugggggacaaaucuggaguugucuggggaggggguuuuugggagccauggggugaagaaggucuugacaugggcggacagggcaacagaagagucuggcugcuuuguaggaaaagauacccacaaggaaaagggggggggacgggacuggagguugggauuccauaggacacguggaugguuucuuaggaggaagggcaucaacgcggggucuagccauagggaaaaggcguggcugcgggucuccagggaaagcguacaaggacaagcggugcaagacgaagggugacgaggccuccaccagacaauguacacuggacagagccggcuccaccgagagaccggagcugggccauggaggcguaucuaaugggagaucuaguuggccccgggagauuggggguggcgaaaccccgagggcaggagggucugggguccccggcucaggcccggccucaccgucagacagggccucacugcauucgaagcugaucucgaaccggaaggggcuguggaaagggcucggguucuccagcacagccacauucagcaccgacaccuuggccaucaccgcgcccgggagccgcagcugcuguggagacuucuucacagugacuugcgacagagaagaagggggggacgacaggacggaaaccucccugcgucucccaacucuucccucugaagcgcuccuccgcucagcgcgcucccuucaaauagccggcuccgccuuccagccaaucgccgcuaaggaccgaugacggcgcgagccaucagccaaucucgaggcgucuucaggcgcgcgccuggacccucagaccaaucagagaagcucccucuucacgggccccaggaggcggaacguuaaucucuuagcuucguaaaggucua

SEQ ID NO: 4573 - RNA, 3224 nt, Mus musculus
ggagcuggaggagccuacuguggacgcggauggcugccgaacccugguucacggggucgcuggcccuaggccccggagaagcaccgccuucggaggaacugggacccgggccgccgcccuauggagacccuucguggucgcccgccgggagacccgagacuucagcggagcaggagccccagcgggcacagcccaugauggaagcuccagccuccacguccucccgggagccacuggcagcggagcucgggccggccccugcucgccucccgcuggacucuauguucagccccaucacugaccagcuccguuaccugcucaggaaggcggaugacuuucaaagcuacuugcucuacaggugacccugcacaaaggccgaggucccaggaacaggaggacaggcugugcagcccacaaaggccaaaaacugaacucagggcccagagauacaguauacgagucuagcuaauuaggaauacauuuuacuagugcaccaagggcugugaagaauugagaggcagaagcaggcaauguauaggccuuuaggguagcaaaauauuuuuucuuuuuuucucuagaacuuugauuuugguugguugguugguugauugggcccauauuuuucuucuugagagaaggucucauuccguucugguuggugagccuccuuccucaucuucccuaccaaauuugaaacgcucucuuagcuuuuuaaaacccuguuuaauucagguaaccagguuccaucugcaucaacucuagucagagaacuucugguaugagaggccacccuccacucccaaggaaaaaugcaguguccugacaaguggaaagggcugggaugucuucgggaggcuuucugagcgagcuucgcucuacaguuuugagagaacuugguuguauauacccccaaacacacuggggguggaacucaggcaagcauucugucugccacagaguugugcucccugcccaggugcccacacuuuaacaaauguuucaaaggacagaugcaggugguucugaaagacaacggagaaagacuuggcauuuggggggggggucuuucucuuggggaagcuuuuccuaugcugagcuccagccucucacaccuacuucagcucccagccccccuuuuuaaaaaauguuuaauuuggggguauuggaacccaggacucuggcgcaugcuaugcacaugcucacagcacugagaaaauuucaucaggguucagcccgggauacagguggaggaggggcaccuagagaugaaaggggagagaugccacaugaaggccccuuucucccuucagcagggaccgaguacagaaggaacagcuagccaaggccaugcccaccuucuuaacaaugugugaaccauacuucuuauaccuugaggcugcagcaaggagugucccucccaucuauggagcccugcaggaguugguccggaaggggguguguauaguagcucucuuuccaggccccuuucaccuuuagacucugccuagggguaagaggguugcuucuggcugacugccugaggucaugaagucccaccuuccaugcaguugcuggagaucucccagcagcuaacacugcgcuuggaacaguuaguucucauguaugccuccuuuggguucguggaccuggaggaaaccaacccuuugagguaagugggcaggaaacggggcuguggggggaugggguccagggcccagcuugcuguccauccuccuaucucccgcuagcaucuccugcuuuuucugcgggagguucuccaucagccccucccacgacguguccaucuuccgauacugcacaccagcugccuauacugccagucacuucccaagauaccucuauaagaagaugcgcuggaaccuggaaaccaccacagaggccagcagccaaggagcagacucccauguggauuagugaguccccuugucaaaaucaaaguccucuccuuccuauaccgauugccaaccugagccugccuauacaccaccaccaaagagugaaaagcaagacaaaacugaacgccuucugcagugcuaggguaaaacccagggccuuguguaugauugaucagcacugagcaacacuuugaaccuugguuuucuuaacuccaccuucccguuaaaauaaaaguccucuucuuagccagggcuauacagagaaacccugucucaaaaaaaaaaaaaguccuccucuucagauuaggccacuagggaggaaaguccugaguacugagucacauuccuaccugagaacuugaggcaacuucugauuugaacuugaaccucacccccagaaguaaagccuucagcagaaaaaaacuaaaguacugcuuuuccuucugaucucuuccucucagcuacuucuuguguuaucgagauacaugggaggaugcaggccagggaccagccaauuccugcccccagauccagaaacucugguccauuggccgauggaugccccuaggaccagcagaggaugaucuugacucgugguaggaucccagucauggugaugcgggcuuaaguucgagggagggcaagacacccucaccaaagguuggaacucaagugacaaaguuuccacuguuaauagggaacacauuuuacugugcucugaagggugcuuuaugcagacuaaacaacaauccaaagagauguggauuuucacaaagaaagcauguuuucagagcagauaagucauucucucagggagacaacagccagaaaaguguuuaguagccucaaguccagugcuucaacuccagaguuugucaacagaggaaauucuuucccuuaggguaucccccaccccuaguugaaacaaagacccucccagcugaggggcagaggggcucagguccagaguuguuucuaugcccccaggauuuugugcccacagccacccggggacuaccagcagcuacuaaccaucggcuucgaggagccgucgcaugugcuggccaccgaccugcuggugcagauccuccugggccaggcaggccccgcccggccccccagcgcugccgggcccgcggcuugggcagccccggcauccugagucccaggagaaggcgccagcucgagccugacaaccccaaacuccaggcaggaagaggugcggcugcauagaguacggcccggcaugggccaccgaauaccaagugcggguagacuuuucuguuaauaaaauagcaaggucagagg

SEQ ID NO: 4574 - RNA, 1938 nt, Mus musculus
guaaagggaggaggaguuuauuuuauguuucacucauagguuuugcaggguuuccaaggaagacuagagaauuuuauggagaaaggugguuaauuccauagucaguaucaaagaugggcuggauuucaaguugccauuaaagaaagcuagcccuucccucucuaggccuucugcugaucuggagaguaacccuacccugguucuccaaaggguauguuacuucuguccgcaggucccaaccuucauagaccucagggucugcgcuccuagaaggaaaaggggaagagaaagaacacccucagggagaaguuuggccucuaggccuccaccuccucuucacucucuggaucgcgucuaggacuuuugaguuuggguuagaguggcgcuccaggggaccaagaggcaccuucucccuccaccccagugcccaggugcugcagggagggcugggagaccgacaagcaucggaaagggagucucccaccuucucagaggcccgucuccgcggaggccagaucaccgacaauuuuccaucuccccugcucgcugugggggaaggaacacucagccgcgacugccccuccucuugccagcuggaggauggccgcaccccuuauauacauacaggugugcaccccucuuccccaugaaggccuccacccaguucugaggacccaggaacaggaaugaggcaaacucaauguagagaggcacccgaguacuacagaggacccgagaacgccagaagucaagguuccaaggucugauggauguggggauccucacuccaggagugggagugaagaaaagaaggugaacccccaggagaauaguuaagggucugcaagccuacagaugaaugaucacuggagguggagacagcuggagcucuagggcccagggggaccgcuuacgggugaggcucggcgcuggcuccuggaccucggcgucgccguagaugcugcgccgcugcaacugcagcucccgcucgcgcucgcgcacucgucgcaccuccugcuccagcagugacggggcaacgagcgguggcaacugccccaguaccggacagccguccugaacggcggggugcagccggccuccggucucuggcugccucugcaagccagcgccguccuccgccgcagccucaaagaagcgcuugaguucguccagcggcugcggccgccgccgggcgcuaggcuccggaaccgcggggcucgccagcgccgccugccugugagccucgcguucgaugucccguugcaucuucgcgcccgcccgagcgcgcuccagggcgcgcggcagcggaguaccggagccgggccgacugagcaccggccgcacgcgcaacucaaugaguuccucgcccgcgcgaccgggacucagaccccggcuccggcgcaggcuuuccucccgcucgcagcugcggcggauuucgcgcuggaugggcgucuccaucugcaauuccgccggcgccgguuuggaugccgcgggcuucgguagaaaacacaccuggaggccucugagccgagacaggggcacaacugccccaguaccuccguuauacuagugccaggcggcccagcuguggaccgcccgggcgcucgguccggugcucaacuggcaccugcgggaccuggcucucuggcuccagagucugcaagugcuccucuccagagguuuccaggaccucacugccucccccagcagcccucggugcccuggcucugcggcucccggaacacguagccuucaggcgaccccaggacuccacucucggacacccgaggacauggauguuuggaguuaggcgcccuuugaaaauuuuaguucucagagccgaauugagaugcccaaauagguaggacacggugcccugugcaguaccuguaguuacagccgccgcccgagguucauaggcgucgccagcacucuucu

SEQ ID NO: 4575 - RNA, 1938 nt, Mus musculus
agaagagugcuggcgacgccuaugaaccucgggcggcggcuguaacuacagguacugcacagggcaccguguccuaccuauuugggcaucucaauucggcucugagaacuaaaauuuucaaagggcgccuaacuccaaacauccauguccucggguguccgagaguggaguccuggggucgccugaaggcuacguguuccgggagccgcagagccagggcaccgagggcugcugggggaggcagugagguccuggaaaccucuggagaggagcacuugcagacucuggagccagagagccaggucccgcaggugccaguugagcaccggaccgagcgcccgggcgguccacagcugggccgccuggcacuaguauaacggagguacuggggcaguugugccccugucucggcucagaggccuccagguguguuuucuaccgaagcccgcggcauccaaaccggcgccggcggaauugcagauggagacgcccauccagcgcgaaauccgccgcagcugcgagcgggaggaaagccugcgccggagccggggucugagucccggucgcgcgggcgaggaacucauugaguugcgcgugcggccggugcucagucggcccggcuccgguacuccgcugccgcgcgcccuggagcgcgcucgggcgggcgcgaagaugcaacgggacaucgaacgcgaggcucacaggcaggcggcgcuggcgagccccgcgguuccggagccuagcgcccggcggcggccgcagccgcuggacgaacucaagcgcuucuuugaggcugcggcggaggacggcgcuggcuugcagaggcagccagagaccggaggccggcugcaccccgccguucaggacggcuguccgguacuggggcaguugccaccgcucguugccccgucacugcuggagcaggaggugcgacgagugcgcgagcgcgagcgggagcugcaguugcagcggcgcagcaucuacggcgacgccgagguccaggagccagcgccgagccucacccguaagcggucccccugggcccuagagcuccagcugucuccaccuccagugaucauucaucuguaggcuugcagacccuuaacuauucuccuggggguucaccuucuuuucuucacucccacuccuggagugaggauccccacauccaucagaccuuggaaccuugacuucuggcguucucggguccucuguaguacucgggugccucucuacauugaguuugccucauuccuguuccuggguccucagaacuggguggaggccuucauggggaagaggggugcacaccuguauguauauaaggggugcggccauccuccagcuggcaagaggaggggcagucgcggcugaguguuccuucccccacagcgagcaggggagauggaaaauugucggugaucuggccuccgcggagacgggccucugagaaggugggagacucccuuuccgaugcuugucggucucccagcccucccugcagcaccugggcacugggguggagggagaaggugccucuugguccccuggagcgccacucuaacccaaacucaaaaguccuagacgcgauccagagagugaagaggagguggaggccuagaggccaaacuucucccugaggguguucuuucucuuccccuuuuccuucuaggagcgcagacccugaggucuaugaagguugggaccugcggacagaaguaacauacccuuuggagaaccaggguaggguuacucuccagaucagcagaaggccuagagagggaagggcuagcuuucuuuaauggcaacuugaaauccagcccaucuuugauacugacuauggaauuaaccaccuuucuccauaaaauucucuagucuuccuuggaaacccugcaaaaccuaugagugaaacauaaaauaaacuccuccucccuuuac

SEQ ID NO: 4576 - RNA, 8827 nt, Mus musculus
ucuuaaagccagagugccuuaacauuuaauuuucaaguauaaaggcuucauugcagaagggagucagggccacaggcagugggcagggaaucuaaaagcacagggcccuccggcuccugggugccacuaccaguccugugguacccugucuaugccugggaccuucugcugggugccaggcagcgagguagcugugagaggaggaguggggugcuggcggcaggcguaggcucacaugaccacacaacacuggcacgucuucugcuugggaccacuagcuucuuuggccucagccagcucaagcugcugggcaggggcauacguaggugcaggguggucaccaggguuagugcuggacgcuuccugauggagcaguggcuggcuuuccacaggcugcuccggggcuggggucucagcuaggagcaggguagcauccccugggggacccucucgcucaguacagggcucaggcuuacuggcugccccuucuaccaggccuucuugcuucucugguucuugcuguccuugcuccucugaccugggcucguccuggacacaaacaguggcuccuggugggcuggcauccuccgccuggaacucugcuccuucguuggcuuugccuugcucuucuggacucacaucauccuuggcgccugaggucuuguccaccucagagaauggcucgaugccaucugccucccuguccaauaguuucuuacuuccuucagcuucuucauccaaugagcccucaccuccugucuucucaucuaauaguuucuugcuuccuuuaguuucauccaaugagcucuuaucuccuaucucuccauccaauaguaucucaguuguuuuugauucucuguccaaugagcccucaccaucuuucuccugguccaauggcaucucacuuccuuuucucucugucuccagugagcccucuggcuuuuuuucugucaccaauggcuucucaguggugaccggcucugccucaccucccuuuucuacuuccaacgacucuucaccuuccgucguuuucaccucccacuuuuccucaucuguugcuaucucugcuggaaaggggcccucacugucuuuucucucuaccuuuucugccucguuuuccucucuucccugggucucaucuggcagcacagcuacaccauccucccucucugccccgagcuuuucugcccuucccuucucuucuaugcccucaacuuucucuacuucucucuucucuaccucccaggacgcuucaccuccucugggcugugcuccaaucaaagccucagguucuccugcagacccugcccccugcggugcuuccaaacccuccaucaaaaucuccucccagucuucgcugagggccacucucuccacccaaaugaaggaucccuccucuacuccaggaccucccugcccaacacccucaagacuaucucuggaagcaccuucuucuuuucugcaaguuucagccucaaauugcuccuggagucuccuggaacugguguguguggccucugcaucccugccugacuccccugugacaucaagaucccugccucccagccccucccagaccacuuccacuacaccccugcccuccuucacccaaguggggagcucagggcugcuggugcccugccuggccccaauggccuccagaaccacuucuuccaccuuagccuccagcuccacaucuguggggccuguggcacuguucucaguggcucuaagcccagcccaaaccaccuccacugcaccaucuccuuuggccuuagugacacucgacaccccuagacucagcugcucugggagagggcugugcccagggcaggggccauuggcuucugaagaugucccuauagcuucaguggauggccucgaggcugguagaaccgcaaucgacuccucccugggaucagaaggagacucaggggacaugcccacuggagcaucuggcagggaaguucgcuuguccacaucagucggggcugggggaaucaagggaggacgggacagggaggucaggaugaugggggaauaacaggacccuuaccccagauucuuuugagucacaugaucugguggugacgguaccccaggucuuggggacuccaaugcuuaccgguaggagcugcuuccauggcagacugagagagaggacggggacccugcaaggagaauagagacaaggucaaaauuggucccagguuguacuucccagguauguuugugccccacccgcuuaaacaguauaucauguuagugcuugcauggacagcuucugaggugacuauaaaguauaucauguuaacaguauaucauguuagugcuugcguggacagcuucugaggugaguauaaaguauuugggggaaggaauacuugggauggaacccaagcccugggccacacuagguuauugcaauauugcuguugaaccacauccucaaccuguaaagaccugaugcaaucagacuuuaaguuccaaugggaggagguaaguaauagacauaacaacaaauaaauaagccgcguuugcaaauaguuaaggggagagaacaaagcggugaaaaggaagagaggucuagggugaggagguuuccccuagagacugagcugggcguggcuucaagaggcuugccgagaagggugugcccuguccagagugcugaguuggagaccauuguucgaggcuaaggcuacaguacugcccgggugagccagacguuaaagggaauaauagaagagagacaauguggccagcguggagugaaggaaagaugugaagaaagacgauggggcagcugcacacaccuguauucacacaccugcaugcacacuaagucccuuugugaucaaggcuuggugguaggaaccgguaauccuaccacaaggaaagcugaagcagggagaucacgaguucaaggucgcgggcuucgagauugggcuaauugcuuucaauuauaaucucacuggcccuuccaaaggcacuucugaguugguauuccuacuuuagggaugagcaaacuaagaucuagccaagacaaccaacuugcacagaacacagaacaaaguaacagugaguggguuugccuaccauucucuaccaaggcagaggcugcguuuugagagagcacauuuccgcuguguccuguucuaacccugcugaccacagcccccuccucuccaccucuuucaggcccugcucaccucucugcgccaggcgggccuaccagcaggucuguguugagcaccuguggacgcacuuugcaacagcuguagcugugacuggagucugagggagaaaggaggcugcuggaagccggaauggaccaaaccugcuccauuucuuagagcugcuaaaggcuggggcauggcucaaaaucagggauucucaacucacgaaaacaaacugucuuccagguugcgaauucgagccugggccugucccucaggcgacuguggguccuuggaggcggguuccuccggccguucuggcccuucagcugccccguccaugagccaacguucucggagagauuuccucuggguauggaacgagaguccgggacuagccacaggaagccuaccuccccacccauugcuugcaaccacccagagggcgcauccaucaggaugggagacauguccauaucucguaccccaacaccaugccagcauacagccuucccaagcagaggcaugcaaccauuauccuuccagccugcccagucgacuggcucugcuaggcucggaaagaccucucaaugugccccucuccaccccaacguuggccucagguuccucucaucaccaccaaacugggaugaagcucaccaccauccuccacccccgccccccauacucuuccagagugggacagcugucuccauggcuaccuuucgccugccuccucuccaucucccccuucccaaauuagucagagguuccuauugucuuucagccggacucacacagacaccccacuucacuuccccggacuggauaggagcccccaaccuugagccgcuccacgcggaguuucuccuccuccagcucgcgacgcgcggcgccgaucuccuccugcagccgccgcuucuccugcgcacacacgacccagagcugcgggcuaguccagggccgcccuccgcccgccuccucggggcucccgggacucccggggcguccucccgcgggcgggggcugcagagcgcugacucagcagcgagaggggcggggcggggcaggaccaggcggccgcgcccucaugcugcggaagccaggcccacgcccaauggugguccgcaaaugggggcguggaggcggggccuagagauggggacuaggguuuugcacuucuaagauaggaaggagaauggccaggcgaggcgaacgcgcuugguaaccccaagacucaguaggacgaucuccaugaguuccaggccagcuuggacuagaaagggaguagccaauuagaggcuacuuugggcuacagaaacccugcugggaaaaaaaaaaucguuaaaaaggggggggggggucagggauguguugaucuagauaaagagaaggugcuagcgagauggaguccaaaaugggggugcagagguagacauccagagagauucaggcauauauagagguaacgcagagauaggguacaaagauaugcaguaaaucagggcgcagguuguguugaaagacaugaccuuccaaggugauugugcaggguacccaagagcacugcuuaacguugaggugcugaagagagaccagaaaaaaugggaauggggagguggagaaguuagaaaggugggcuacaaaagaaaggguuagaaaaaggagguuacaacaggugauccgagacuuagggaacaggggcaauucagggucgagguacagaaguggcuacagaaagguggguugcuaagagugccaaaagaggagguacagaccauggaagccagagaaacggagcacaaaggcgggggagaauaagaggggcaggugcagagugguggagucaggguucagaggugaggucuagaaauggguucuagaaaggguucuggaguguggggguguagaaauauagaaugcaaagcauguuuggagaauagagaugcauuagugguagucagaaauauggaguucaaagaugaaggugccaagagcugaggucuuccggaaguaggcuagugaggaaaggggugcagagagggcagucagagaaacgggagcagagguaagaggcacacagguaaacaagaguaauggaggagagagggggccagaaggacagucucacaaggguucccucagggaggacuccaagggugggguacaagaaacagagaucugagcugggcgugguggcgcacgccuuuaaucccagcacucacucgggaggcagaggcaggcggauuucugaguucgaggccagccuggucuacaaagugagcuccaggacagccagggcuauacagagaaacccugucucgaaacaacaacaacaacaacaacaacaacaacaacaacaaagaaagaaaggaaggaagaaagaaagaaagaaagaaagaaagaaagaaagaaagaaagaaagaaaaaagaaagaaaaaaaaagaaacagagaucugagaaguagggagcuuggguugcacuggucucccaccaguguuucugggugugccaaaugacaccuucuguucagccagugacagagaccaacacgggagcugccugaggggugcccuggacaagauggaacucgguucuucacagagccacacucacguccuaugggguaaaaacauucucuacccagauggggcaggccacaaagaagccugaagaacaucugaggauucucagggcucugggaguguaacacuuacagcgaugaccuccagccgcugccgauagagggcgcucuccgccaugacccuggaaggagagcacaugggcucagaguguuuucccgggaccccaucccucagcaggcaggcuccuaagugucucuuuucuaacucagaacacugggcugccaagagagaaccgagugcuuugccuguuuuccccucuccaucagggaagaaccuagagucuggagagagaaaaaggagaguccaugacgcuaaagcuccaucuuacgucuuucuuagccucggucucaucugugaaaugggcagggauagcuugaccccaauugugcaagagaacaauuugaguaauuccugcacuuaguacaccuuauacuuaauuacaagaacuaucucuacagacucccacaaacauucacaaauccugccaggcuccaaauaugguguauggguaguccauauucucucugaaccuuaucuucuacucuguagcccuuagcccuagggugugggguaugaaggaaugugggggagagaaguaaccauuaagccaucaccaugguaacuccagggcugucucuuuuuuacuugucuacccccuuccugcuggggacaaaggucaguggggcauccugccuaguuguggacuuagagcuucaagaagggugauuugagguuuaagguuuaaccugauauuucuccaccauugucuuaacugaauucugucagcaucccugcuucccagcuuccagggagggggaacgggggacucuggaucuucaguuaggggacagguauuaucaaaauaacaugaugagcacugagcaacaguuguggggcugugcaaaccccauaucugccaaugguucuaaagggauaucuaccugccugucauucuccacgccagacauggugggcacugagaucuuuaaguguuuauuaauuuaaauccuaacaugggggaaagaaucccaguaacauuguccaaguuccagcugucuccuuucagauccucccgacacacccugaaggcauaacagugcuauuuauagggcuuuaagugcccugcaaggcuuccgcugggccacaagccaccucugcucaggccccaccccucaccauuugcuggcugcaguccacucuugcaucugacauuccugcucagaacagaccuggccaaaguagccacaaggcacgugccggucaggcuuagacaugcccuaucuguagaaacauuuuaucuuccuugugauccuagaaggcaaacaguacuaauguuccuguuuuccugaggggaaacugagguucugaggaauagcaaauagacucgucugagggacuggagagguggcuccaugagcagaugcccagaacaaacugaaagauggcucuauccucccagcucugcagcagcaaacaagagccugucucaaacaaguugagagucagaaaccacacaggguuguccucuguccacacuaacacauacacacacacuuguacucucacacccuugcacacacucuagcaugcacauacacucuuaacacucauacauccacacacacacaaacaugugcacacauacuuauaccuucacaccuuugcaaacacucucagaugacacacacacucacagaggacacacacaacacauguacucacacacuuucauacacacacacauacacucauacacauacacaugcaugcacccacaccucucauauguacacacacacauucacagaagacauacaaacaugcaaccacacacucuuauauacacacaguuacauccacagaacacacacaucuacccacacacauucacacucacaguuaucacucuucuacacauucacucacacacacacaaaugcauucacacacacacacacacacacacacacacacagcaugagauugucugaagucaggagggugaaugaggacacgaaggacuucucccucaguguuggcaacacacagugcaggguucaggggcucuaaggaccuucauuuggauacacauaggaggccagagacccuccuagaggaggggauuucgacuagggcaagggcugaagguugccugacagaugucccuagggaagucuagacuccuguucaucacucuguccuugggggagggcugaagucccccucagcugucccacuccuaagaugcuaucucccuaacucuuccuuggggggggggaggaucggguucccauugcuaagcaaccagguuuguacuuggugaauaaugcaauggagggcacagagaguaaaggacagaauugggguccauacuggagggaagcccucuuucuagaaguuucuauaaucucuuggaaccccucuacccaucauucccuaacuaaggguggauaaucccauacuaggcaaaagcuggcgacugaaccaaaccucucucacuuugaaagagccucagcuaaggugaacuccccacacgucgcucaucucuuaacuccaaggucgugccucagccauaaucgaguugcugcugacaaggagcggagggguggccauuguugccuaagacuuugccaaucuuuggagguuggggcgcgccuuucucccuggaaucucuagcauuuccucgcugcauucuugagaggguuggugaccaggauuacacuuggaugcacauucuuggauccugacacccuuuguccccuaacucugcaguaggccuagcucucuagaggcuuggcucugaaugggucccagguuuggccaccacguccccucgugcuccccucggcuccuuagaaaggccaacuggggcucuuaggccaggccggugcccccuaccccagccuuuccaccccgcccucccgcccccaccccagacacuuacguggguguggccggagacaacaccggggucugcagagccaucacugcccagcagaggug

SEQ ID NO: 4577 - RNA, 6621 nt, Mus musculus
uguguguguguguguguguguguguguguguguguaugugugugugugugcgcgcucugugcugagagauggagggcaauuguagucacagcagacacuggaggacgugagugcuggacagaagcuggggagaggcacagcagggcugacuauggugaguuaggcagggagggucugaaggcaggucugcccauccccugccugguucugcccacugguccucaccagguggcuuucuggccccuugcuuuccuccagaggccucaagagcugcuauugcugcuccugaugcuaaaguggucguuagcacacacggaggacccugccuucccacacuugggugacagcucacagccccucccgaggcccuguccuuggcgcugcuccuguccccgagaugacacgguggacugugcuggucuggaccugaggauauuuccagacaauaucaccagagcugcuaggcaccucuccuugcagguaagggcuggggaucugagagggaggcauagggcaggguucaugugggagguccacauggcagagcugaaccugcccuugcucugguuccgcuaagccaggccaaugucagagguagaagcaucgugugucccgagaguggaguuuggggucagaaucuuaggacuuacguuguuuuggucaaaacacugaguucagcugcaugguuguggcauucgccuuuaaucccagcgcuggggaugcagaggaaggcagauagaucucugugaguucaaggccagccuggucuacagacuuacagccagggcuacaaaauuagucaauaguugugauguuggaggucacaggaguauuuuggaaugguuuugggcaaaaggguguugggggcugagaucagagucuguuguaguggccccaguacuaaggacacaaguaggaggccauccuucacugcagagugaggcccucuguugggggaugggguguuggggaaggcuagaggagugucagagaccagguucaaaaucagcagcccauguggcuucaggcccaggguaaccgugugguuugcuggguggugcaguaaagagcuuagugccucacaagccucaagguuguuuggggucacggaaugggaugucuucuuuucuccuccucuuccuguucucucuggagauauuagagaugaacccagggccugccuuguggaugcuaagcaaguguucugccacugggcugcaccuccagguugaguugaggagcaagagacaggccuuggugugacugucuuuauuccacagaacaaccagcuucgggagcuccccuacaacgagcugucccgccucagcggcuugcgcacccuggaccugcauagcaaccucaucaccucugagggugagggccucaagcugggaacaaccaggucccaaccccucuccacauccgcuguuugccaguuguggccagcucuuggggguuuccacaacugcugaguacgguggaauuucgaggguugggggauggugguggcuguggcuuuugaguaaggacaggauguggugguuugguuggggggggggagccuaggaauuuaugcuagucccuagccuucagagugggauugcuagaaugcugguccccucauccacugcccacugugcucccacccaggccugccugaugaggccuuugagucccucaaccagcuagagaacuucuauguggcccacaacaaggugagccuguaucccugagaggucacagccuggcuggggucaccuggcgagcgcaaccuggggguggggguuggggaggcaggaaaccgggcaccaggaccagacugcuguuacccuugcagcuuucuguagcgccccaguuccugccacgcucccugcgugucgccgaucuggcugccaaugaagugguggagaucuuuccucucaccuuuggggagaagccugcacuccgguagccuuagcccuuguuccgcccccagccuuugauuccgggauucugcucccaggccugucccggggauccuguacacagcccugccaaaggagaaccacagcgcagccugguuuuggagggucugaggcauaguugugcagugggggggugggggggggguggggagaguaagaaaaggcuggcucuguucuggggauccugaggcuugcccuguacugggaggagggcagggucagagaggguucagaucaguuuuggaggguccaaggcauuagcucagucugggagggggguguuaugucccuaaaaugggaucagaggggcuucaucugcguggggaguuuauaguuauggcuguguacugggguggagguggggggaggaaccugaguggugagagagauccucuuaucaaacguguagacuuaucaaaagucaggacuaggacagaugccaccuacuuaaacagucagacacacaaacacacacgcaucuaugcacuuguguugaugcacucacacacgcacauacaugcauaaaugcacacacccacacgucuuuuacucucaaacaggagcuguuggugaccccagcuggaguugaggggcaacagcaugggggaggguggugugcacaugcguaggcugcuggcugcagcccugcucuccucaggucuguguaccuccacaacaacagacugaggaacaccggguugccaccuaacaccuuccacggcucggagguuauuaccaccuuaagucuuuccagcaaucagcucagcuaccuaccacccagccugccagccucccuggaacggcuucaccugcagguagguucccugccuguuacacacacacacacacacacacacacacacacacacacacacacacacacacacacacacaugccugggccuaggucucuuaccuguggccugugggacuucuccaccugcuccuuugccuuccuuucuuucuaaagauucguuuccucauuuuauguauaaaacauaaaagaagaguacucugucugcauguacacuugcaugccagaaggcaucagaucccacuacagaugguugugagccaccaaccaugugguugcugggauucaaacucaggaccucugggagagaagccagugcucuuaaccacugagccaucucuccagccccauuuccauccuuucaacugcuccccaggauuccagagguuagaagaaucaucaagcaagcaagcaagcaagcaagcaaacaaacacuuccacuccuuugcccaggcaaggcaagcucccggccgggccacuggagagccuucuguggcuuccaugccagacccucuaucuccucuucucccuucugcagaacaaucuuaucuccaaggugcccagaggagcacugagccuccagacucaccuccgugaguuguaucuccagcauaaccaguugacagacaguggucuggaugcaacuaccuucagguagguacacugcaguucugugcucggcagccucuccuacaggauuucuaaccaagacuucauuuagugagcaccuagugcauacccagcugcccugccuggcauaaaagguguuacugcugcgaugcaugacagguguccuuguccccugcuauccuuucuugagguucuauuauccaauaguuagggguuuugugguagagauaaaguccagcucucacauaugccaggaaaugaggugcccaucuggccacaccgcaauaccuccuuacaacauucuagacaggugaacagagcucugagcugcaccucagcucuugugggcuuuguuaugguuuaucaagaaaggauuucucugugcagcccuggcuguccuagaacucaccuuguagaccaggcuggucucacacucagagaucugccugccucugccucccuccagagugaugggauuaaaggugugcacccccccccagcuuugucuguuuuguuuuuaagucagggucucucuauguagccauggguguccuggaguucaugcagaccagauuggccuccaacucauuuagcucugcuugccucugccucuugauugcugggacugaggauuuacaauacaacucccagccuaacuuguuuauguuuaugaaugguuuugccugcacggaugucuguguaccaugcaugugcuguaccugaaggaaggggaaggcuggaagaggacagcaauugccugggacuggaguuaaggcaguuaguugagagcagcugugugggucuugggaagugagcccugggccucuggaggaguagccagugcucuuaacuucugagccaucucuccagcccugucccuuuuuuuuuuuuuuuuuuuuaaacagucuaguuguauguaguucggguuggcauggaacucacaaaccucuuagcuccccuugugaaugcuggauuacacacuucuaucuauggccacucugggcugauuauauauaucuccuauaucucauuaucaaccuagcuucauugcuauaucacuuucaaugugaaaucuccaguuuaaagggguucuaaaaccauuucuuuuccuuccugguaagaucugugggaucucuuuuuuugaagugaccauuccaucaccccucucccaucagcaagcugagcagccuugaguacuuggaccugucccacaaccagcuggccacaguacccgagggucugccgggaacucugaccauauugcaccugggucgcaauugcauccggcacguggaagcuguaaggcugcacaaagcaaggggucugcgcuaccugcugcugcagcauaauaagcugggggccucggcgcugcccaaggggacgcugaggccucugcgagcccugcacacguugcaccucuauggcaacaagcuggagcgugugccucccgcauugccccgccacuugcaggcccugguaaugccccacaaccacguggccgcgcugggugcgcgggaucuggucucagcgagagccuuggccgagcucaaccuggccuacaacagccuggccagcgcacacguacaucccagcgcuuuccgccgccugcgcgcccugcgcagcuuggaccuggcugguaaccaguugacccggcugccugagggccugcccgccaguuugcgcucgcugagacugcaacgcaaccaacugcggacucuggagccagagcagcucgccggccugaauaagcugcgggaacugaacuuggcacacaaucggcuccgcgugggcgacauugggccuggcaccuggcacgagcugcaggcacuuaaggucaggggguuaacuacaauguggucaucuccaucccaccgcuggcccagcuccgagccagggcauggcccagaguccugugugggcauccugagaugguugaaacagacccuguuugggcuguugcuaaguccccaccugacuucugagcacuccuccauucuacccaaugacuguggccucuagguucuggcaauccggcugggcacaaaacagggcccuuacccuucucugaccccaaacauagaggccaugguuagaggccaucuggugaucacagaaagugacugugugguagcugguaaggaccagaggcaggugcgggacggacccggcugcacagcauaggggaggcugagguagaaggaucgaauuugaagccagcugaggcuauggaaggaaagaaaaagcaaaggguaugagugaggaggaugugagggaccaccaucuucacauccuugucuugcugaaucagguaggcagggacuucuaccuauccacccccacccauggguaaaacaaaaacaaauaguauggcucggucaaucucuauggaagaaauuuggugaccaccauuauugagcaaggaucuggaggaggccugcguugggcagggaagaggcagaggacuggagaggagaggggcuggaagcucugagugugcaaggccaaggcccugagccugcugucuugcuguugugccugucaggugcuggaccugagccacaaugagcuaucuuuugugcccccugaucugccugaggcccuggaggagcuauaccugcaggcuaaccguaucagucaugugggcccagaggccuuccucagcaccccccaccugcgugcccucuuucucaggugaggggcaggggagucgggaugaugacgauggcucuccugucgccgcccuaacaucccugccucucugcacagggcuaacaggcuucauaugaccagcaucagagccgaggcccuucaggggcuuacacaccugcgugugguugacacugcagaaaacccggaacagguccuggucuagcugccacgcaagggcaaggagcccugagcccuggaggguggggggagggggguagguggccaaguagcccuggccuaagcucugagacuguggacuaagaaagcucucagcugcggccuaagaggcugugccuguccugcccagagcuggccaaagcaguaggagcaggugucugcuguaagaggugguuaggggcugaaacaggaagcaugcggacuugaacguucuggggcgcagacuacacccuccagcacagauggugaugaggaaauaaagcagaugcccucucauguucacaggggacucagucccagugagcccgacccaucucuucccuacau

SEQ ID NO: 4578 - RNA, 2183 nt, Mus musculus
uggggcgcggccggcgucgucucgcccgcgcgcagcccggcuccccucccccgcggggaauugggguccgacucgggagagacucgcggggcgcgggcggcgacaacuuucccgcgcggcccggggagcagagagggggccgugaccgccugucccgggaggcaagcacuggaucuggcugcgggcgacagcagguagacuuacggggccgaaggccugaccccggcguggugcagcgccgaggccacagcccuuggucuugacgagaggccugcugcugucuugugcuagccccaggcugaccucuagauucgcaggccaccgaaccccucagcugugcgugaccuuccagccugccaggccccacugaccacuugagugucuaggaagugccuuggcucccuguaccuguccccuucccagccagcagcagcugcccgccucuggcaggguggccugagaagguaagucugggggcuggaccacccuggccccgaggcugccccagccagcccagcucaaagccggcacgcccggcaggugcgcaggcuuccaggcgaggugaugcgggcucacccuggccgcucacccacgcacugugccugggccagccugggcacauguguucacaccaccacagugcugggaagggaggauccuucacugggcccauacccugaggagcaucauagcucucuguccuugccgggggaggggguccccaagugcaucccuaagaccccucgacuggacagcccuugcuugaggaccuagcagggggccuuaaaauagcugugggcccagcccagggcuggcacgcggcgcaugugcgugacagggcguguccagggggucgggccugucugagcuggcccggccucugagcuuggcagauuuuuacuugcuggagaaaggcagccaaggcagaugccccacgaggcacccccaugccaugggccacccuaugccuguuguaaguggagggcagauguucccagcaggccccagcuagcccuguccuucugcacuucccugcaacaggccugugugagaccaggagggguucaguggagcacaggccaacuuagagcugauguggcugagguuggcauaggacucgcugugacacuccugccucagcuuccugagugcuggcaugacaagauacagcaccauaccuacccuguucccauagcagcaucgggcuaguuacuuuuguuuucugagucuguuguaacccaggcuagccucaaauuucugauccuccugucuccgcaccugaguacugcaccaucccuggcuuccacaguccuggugauugaacuccggcccugggcaugccaggcgagcacuccacucuuugagcuacaucuuugucuccuguuuaguugacagagacaggguuucuuguagucugggcuagccucaaacuugccaugaaacuaacggcggacuugagcuccgcauucucuuuccugcaacucucaagugcuaggguuaugggcaugggccaccaacuccagcucaggcggccuugucuuuauggagagaguguagacauuccugggauugucucugccgccucaguuuuuccaucugugaaugggaacuuuuggagaugcaguggaacagagcacacucucuagucucccauagggugcugaggucuccucauauccuguguugaauguccucaguggacauggaggugugucuuccuagcuggccauggggaaggauugagggugguggcgugggcgugagaauucuuggguagggaaggacagcaucaugccgggcauggcugagucacacucgagcggcgccuugccucaggcugcuggagcuagaacuggcgccacccuggguguggcuacugagcuguggcccugggcagagcagggcuggguggcaggaugggcacaugggccuugagggacucgggggagcaaaucugggaugcccggugauaccucccuuuugucuccuguguacauuuggggcucuggaacccuaagcuuugggccugggaauaauaauaauuaucgaucuauuaauaaaaguuuuugaggcaugaucuaauguaauguaguccaugcuggccuggaacuggauaaguaguccaggauguccuugaacugguccuuaggccuccaccuccugaaugcuaggcuuacuugugu

SEQ ID NO: 4579 - RNA, 26380 nt, Mus musculus
cauuguugugaagagucuuaaaggggccgcgucguccggccggcucggccggauggagcccccggcggccaagcgcagccggggcugccccgcgggggacgagcccgggaccggggcccgucgcagucgccccgagccguuguuggaccuuagcgccaagcggguggccgagagcugggccuucgagcagguaaggccccggccugccccaggccucacaccucgcccccuccccagcagccagccccccacaccgccaccccgggccccgcaccccgagccucucugcccgcgacccuccgggucucuauucugaccucuuuucuuccucaagagacacaccagcccagagacccacacugccccacuccugccguaggguuucccugucccacccuccaggaagaagacccccgucucugcagggccuauacaugacaccccuguaucccuuugcuccagccuccagagcccaccaguccucuccagauccccgacugugggacaagaggcagggucacugagggaagggcucugugccccuccuccccccuucccccucccuccagcuauuccagagccaagauugggauacagaggcagagaggcuccuggaaccccuacucugugacuuguggaguggugucccgagaaaaaauuccccucucucugucuaagggucccccaagaagaugggaaggguccgaggcuccucucagucccauacagcugucuuucagucugacuuugaguguucuuggccucacaacucuuccugaguuaggauggauggguuuggacugaccguggacugagcaggcucugauucaugaccggaaaaucccuccuuagucaucugccaacugucaggagccgaaucacugacucccccuucucucguagaaaccuuggguagggccuccgugcuguucacccuaugugacaugcacagaagaaccguaaaacugucuucaggacucucacagaucugccuuggcccagccaggugcuaagagaacucugggcagguucuggagcccuuguggaguuguucucacuuugaggaaacuggggcacagagacguugagaaacuugcccaaggucacccagccagucacuagccaacucagauuggaacacagccucgaaugcuggcuccauuccuuggagucuacaggggauggcaggucagcccuucccuccuagagaaggggcuuuuuuuuuuuuccucaggggaggaacaggggaagaaauacccaggguggaacugauguugggagucugaacaauuugguuuagggauccugaagagcugacuucaucucugauguaguaaugcugaccccuucagguucucaagcugucaugccagcuuccucaggcucguucugaggcugugacacugacccagugcuaugguuucagcaucuugugucccugugaagaugccaucuccauaaggggcugagcagagggaaggcuaggaacccacguccucggucuuucucacacguguaucuaacuucuucuuguccugcacaaagccugggcugaggaggguuuuaccccagaccccugcgaccugccaguaagagcuucuagaauguuaacuaugagccaggcacuguuguaaauaaauaugauuguauuggaaccuauuuuguuccugggaguuucauuguaucauccaagcugguguugaacuaguugacacaaguauagccucccaaguuguugggacuucaagguguaccaccauucguggcucacuuauauauauuuuaucuucccaaucuccauaggaugguugauugucacauugcuauuuuauacuugagaagacagacucagagaagucaggugcuguuuauaagcagcaagauugugcugcuuauaaacagcaaagccaggauucaaucccagguuucuaacccaccagcacuccccacagguggaggaaagguucucccgggugccggaaccgguucagaagcgcauuguguucuggucuuuuccacgaagugagcgggagaucuguauguacucaucacugggcuaccagcccccagaaggugagcaggacacccggguaccauucacccgugggcugcaccugcuacagaguggggcuguggaucgagugcuacaaguaggugagugagccuuccacccuggggaggcuuggagaugggggaggcuggaggagagaggugggccagggacuggggaacuuccaagaaccugcucuaaggcucaggugagauaccauggcauucuccagguacagcacugggaaggcagaggcaggagauggagaggccagccugagcuuacauaguaagauccuguuucaaugaggcagauaaaaaaguacuaaaaaguacugaagauaaugauauaguagacuucagagacuagaacauaguggaggcucagcgagaggaaggugaaccagaaaguggggguacagaaggcccggcaucagcaagaggacccagguaaggggagaggagagcaguggagcucaugcuggaucccagacuggcucuugcuguagggauugagacauggcugauaauucuagaaugugggcuuuagacuggagacgggauuaugaacugaaggugaagaaugucaggcagcugaacugaugaauggaaaaaaauguggagaaacgaggaagcagggucccagggagggccagaggguugaccauaggaagagccaguuccugcccucacacagagggcaucugcgaagcagugguguacaaagccaaggggaaaauaaugugaagacuagaugugguggcacacaguuauaaccucagugcuuaggaggcugggaccagagaacucaaggucaugaucagccuggacuaaacagugaacccugcucugaaaaccaaaacagucuuaguguggaggcacaugccuaaggcagagguagauggaucucugugaguuccaggccagcuaaggcgucauagugagacccugucucgcaacaaacagaaugaucccaggccucaguagcuagacccagggagaagcugggagagagugugaugcuuaggcaaccauguccuggaagagacugugaucaaaggccacgugcagaacaguagagugacuauagugacaaaaauuuacugugucuuuuauaaagaacuaaaaggaagaaguuagaggcuuccaaacacagaaguaaucacugugaacagagcuggaaaagccagucgccuguucugcucgucauguguuguguugaggaaccguacuccauggauguggauggcuccugugugcugaugaggagaaugacuuaaguuaaaaacgaaauaaacaaguugucaggccaugaggugcgggcucagaccucaggcagcagaucugggagagagugcagacaucugaggucagcucucagaguugcugucauacaucagggggucucagugaggcugaagagcaaaaauuagagcuagaggagaaaacagacucugaaccccaggcaguaagcccaguaguucugaaauagaagaaaagaaaaagaccagagaaggcuggauuuaggaaauagggaggaaggugaggaaagaucuuagcauugagcauggaaaaggaccaguagugauggagccagaacaugagucagacuuuauccuucaccuuccaugauagcuggucaaggcucagccaggguaacccugccuggcagccucuguaccccuuuuccugggcauaaccuagccacaggccccaugggcaccccugguaugaggaagccaugccuugcaugacgcauguugcaucaggcugcccaaccagucggaugagccugacagacacccaggacugcccagggcuugcuccaucauccccuugcccucaagugccacaggcccuuggcauguucuuaggaaguucagagcuucugaagcuguuguaaccauagcaacccaagggcuggggaaagcauuucaaacauuguaucuauguugauaauacuauuuauugaucauuagaauaaggacagagcagcaagggagauggcucauuuguuaaagugccugcuguccaagugugaggaccuaaguucaguugcucagcauccauguacaguguuagaugucuguaacacaccacugagagugggaggaccuuuguggcuagcugguuagccuagccaaggacuagcuucauguuuaaggaaaaaaaccugucucagagaauaagguggaggcccagggaaguugcucacuguguuucuguucagaugggaggguagccugggacucagaagcccaggaaccauaaagcucuaaggggaaaaggugucccagcagaaggacauccucagacaugggggcccaggagccacacagcucugagaggaaugcuucuuagcagagguguugcaguuccuggagaccaggguggggggagggagggguucccccagcugagcugaggaacucaggagccucagcccuccuccacuuguuugcuucuucgcuucucuucaguaauucuuuucuucuugguuucuucugaugagagagucacaccaggcagaaaaccucaugaaggagauuucuuguaggauccagguguggacagaugaauccagggauggcugcccucugcucccaggagcagacagcagggaaaugaacaaagggcagggcuguaggauuucugaggggguggcacuuuucagggcagaaguuuccagauugaggauuggugguuucaagucuagcuuggggagcucaggaauuggugggguuuccuguucaggcuuggguggguucuccugcucaaggauugguggguuugugugggaaaaucagggauuagugggguuuccugcucagggauuggugccuuuuuuucaccccguuuucacugcaccaggccaauggguuagggugggaaguccuuccuggccacaggcagcuuugucugaggagccaucucuguggagcugcuuagggagguuggagagaagauguagccaccguggacagcuccugcagugguguuucaggaaagccuuaggcuaagacaggaaagguguccaccgugggcagcucuggagggagagcuccugccgagggggaaaggaggugcaucaccguggacagcuccugugaccgauggcugcaggcagaggagcuguggggcacugccauuuuaacaggagccgccauuuugacagcuccugucaggggcaccuuacccugccuguaggcuaggacagcugcugcugugaugacuuuugcagagcaccacuuagggacuuuacucacaccuuuaauacuuuaauccuggcacucaggaggcagagacaggcaucucugaguuugaagccagcuuggucuaaauggccuguuccugaacaugcaaggguacacagagaaacccugugucaaaaaaccaaagguaaauaaacaaggugaagaacaauugaggccauccccccaaaaagaucaggugguuuuuuuuguuuuuuccaagacaggguuucucuguguagaccuggcuguccuggaacucacucuguagaccaggcuggcaucgaacucagaaauccaccugccucugccucccaagugcugagauuaaaugcaugcgccaacacguccggccuaagaucaggaguuuggauuuaacuuuaucaagccauucuaaacgcuugugacuaauucaccuagauauuagaguggcauguggagaucaucguugcugugugugcacagauggugaaacugaggcaugaauagauuaagugguccauacugggcuucucagcagaauugugcaucaaggucuugcuggggugauccagucuccucgguguauguuuugucuuaggguuccaccugagugggaacaucagagaaguggggggcccaggggcgaucccgucuccucaguguguguuuuuucuuaggguuccaccugagugggaauauucgagaaguugggggcccaggagagccagagcaucucuaccacgucuccaucagcuuugaccgcugcaagaucacaucugugagcuguggcugcgacaaucgggaccucuucuacugugcccacgugguggcgcugucauuguaccgcauccgucaugcucgccagguggagcugcggcugcccaucucugagacucugucacaaaugaaccgggaucagcuucagaaguuugugcaguaucucaucagugcacaccacacugaggugcugccuaccgcccaacgucuugcugacgagauccuccugcugggcucugagaucaaccugguucauggugagcagagggagggaggggccaugaugcccugcuuugggggugugacacacugagagacagacacauccuaaggugccugagcccagggcaccugggcaguuagaaacagggaaguuguaacacuggccugucaucucaggacuggggaggcuaagguggauugaaacauagugccacccugucucauguucagagagagagagggagggagggagggagggaggagagaaagagcagaggguuagucccagggugagguguuucagagucccaggguaaagacuuaaagaugagaaucacugaguuaugaaugaggugugcaguccaggagguauuggaagggaggggucugcugcugguuuguuuggcuauaaugguagaaagguaacaguaauggaugggaacuaacucgggucaugggaugcuggguggauucuaggagguuaugauucaucaccagggugaacuggugccguggaagaguauggggauaagcagauggguagaucaguacagugcagugaggggacuaagcguuggaaggguggcugggaagagauggcuugcaugggacucugaaaggccaguggguauccagggauaguggcacacaccuuuaaucccagcacucaggaggcugagguggauggaucucugaguuugaggcuaaccugaucuacauagugaguuccaggacagccagaacuauagagugagacccuuccuuaaaaaaaaaaaaaagccaggcagugguugcgcacaucuuuaaucccagcacuugggaggcagaggcaggcggauuuuugaguucgaggccagccuggucuacagagugaguuccaggacagccagggcuacagagaacccugccucgaaaaaacaaaaaauagacagacagacagacagaccaguagguaugcaugcuggggacugguagguaguuguucugggaggagcauggagcagugauaggugugauggaggcauguuuguggaccagaguagcucaggagugcacaacaugacugauggguugauaaauccaaggcgaaguaguuugagugucgagacaaguccagauggugggcagguggagucauaggaugagugcauacauugaaggugggcuggaggcaagacuggugaaccaggcuguguacagaauguggguguggaggaacugguauggagaugaggagauggauagaaacuggcuuacuacggaugggcggugucugguaagaugauggaugaggaaauggaugagugacugauguuuuguggaagaugaauggauacaaacaguguuuccauaguaccugacuaagugaacgaaggggcuuguaguguuugggaccaaugccuggauggacagauguauucaugguagaauauuagguggauggaagagaaugguggagggauggaugguuggauaaaugaguguguagaggacaaauggauggguggugaguuaauagguggauugcugguaugguggaauggauuguggacuuuggaggaauggacacagcaagaguggacacucuacucuuguccccgcaggugccccagaucccacagcgggugcaggcacagaagaugccaacuguuggcaucuggaugaggagcagauccaagagcaggugaaacagcugcuguccaaugguggccacuauggggccagccagcagcugcgcuccauguucagcaaggugccaaggcuggggcugggcagaguagagggcccgccugguaugcacuucucuuucuuaccacuugugucucugcacaggugcgggagaugcuucgagcacgggacuccaauggggcacgcaugcuaauccucaugacugagcaguuccugcaggacccucgccuggcccuguggcggcagcaaggugcuggcaugacagacaagugccggcagcugugggaugagcugggugaggcucccauucauguuagcaucugugccccaaaucucuucucuacuuagcauuauuaaguauuuccaacaugccagccaccuacugggugcuggaacucccagagagaacaaaacacaaaagucuggcucuccugggauuaauauccaguagggaagaucaugauuaauguuauauguuuuggacuagggauauaacucagugguugcaggcuugcauaguaugcaugcuccagcaaauguggauggauauguucauggauggggaguggaugggaggauccaugcuugcauagaugguuaagugcuacauagcuuugucccauggugucccacauccuccaaggcacagacaucugggaugcccagggaccugacguaaaaccagccaguguuacagagacuuuguacauacccuuucuguauaguuuugucuuguuuugauucaggcugaccucaagcucacaguguugcaagggaugacccugaguuccuggucuuucuucccaagugcuggagggcucacuggucaccaccagagauggcuggauugguugaucaauugauugaugcugaagauagaaccccagguucugcuaagcauguacugcacccugagcugggacucacuugguccuugguguucucucaguuaccuccagcuaacuuaaagugcaagaucagggccacagagauaguugucaucauauuguuugaagaauaauaacaagaaaaagauggcuguuucuauccaguaaagacaccauuuuuuuguuuuuuauuaaguccuuucaauucaauccaugguugauagaaucagcagauguuggauccucuaauguggggcugaggacuuuaggcuacgccacagcucacaguuuuacaaaacuaaauagugucuucagcuuuguugggccccaccaguguagcagaaaaccaaccagaccucugucacauuggguguggcacagccaaugguuggauguuugugugucaggaacaaggccucaggauuguucccagcaccaguguguacacaguuacagaacacguagggaaguaucccaguaagacauagcuauggacacuuucugguuuuagccagucuugcucuguauagcucaggcuggcucaguucugcuuagccuccugggugcuugauuacaggcauguacaaccugcagcuacuccuguuucuuugaacuuuguaucauuugcacaaaucucaaaauaaucuuuuuucuuuuuaauauuuuccucaccauuaaaaaaugugaaaauguggcagagcuaguuggaaauacccauaauacaguaccuuggggucugagacaggaaaguggugaguuccaagcuagccugggcuacagagcaagacccugccucagaagaagagcagagauaaucuuaacuugauagucacuugaagagagaucacaagagagaaagaaacgccaaacuguggguugacuuuauugucuguacaguguuuugcccauuggcugcugugcgcuguguuagauaguaaaaggcagcgucgacaaggagaaagaaacaaugcaaaagcacacuaagcugagcaggcgugaguccuggcuugcagcucacaugcagugugaccuagaacaaguggaguuucucugccguacuucaguuccccgaccuaaguuauauuuacuuauauuguauauauauguguggcuguaccauagugcacauguguaggucaaggggcagcuuuguggagcucucuccuuauguguggggguccgagggacugaacgugggucaucagucuugauggcaagcacuuuuacccgcugugcccuaucacuggcccuacuuuauuucuuuacccauggauaggacacaugcccaggcugcagcagcugcuuaucagccuguguuaaugauguuggccuggauacugagugucugucugcucuucaggggcuuugugggucugugucauuuugagcccacacugcaaaccagaugagcggucgggauggcugcagcuacuuggcacaugggacaagcuagaugugugcccacuggaagaaggcaacuauuccuuggacauccccagccuacagccugcucuaaccuccaggacagguaggaaggggccuauucuguuuccaaaaaccaucaccacuuacucuaguucagccuacugucaccgcacugugucccaggagagagaugagagggccauccagagggagcaagugccuggggcaggaguaacgauggugcucacuaggccucccgauagcaaaggaucagugagaagauggacugggaaaaggacaggaacccagcgugaggggccaugcugugagugugggugcggcaaguaaagagggauacggaagaaaggcaguagagaggucaggaagaagcaaagauggaggagagaagggagagcaaagaggaaaagacaucccaccuguguggcagcaccaugacagaugccagccccuuuccccuugaagauuuguuucaagaacucagauccauuaccugccuaggguggaaccugggguuggcaccuggggggagcagcuggcacagugugacugccagcaccaucauuacacacugagcauaucuccugcaggcucagaggaugaagaagaggugacagccgccagcccccgcaggacaguuuucagccgagcacugcaggcuggagaguugcacuggaaugacagccaccuacagaggauccuggccagugauuccuguggccccacccucacuggcaguaugggaagugacaagccaaccuuugacccucagggccaccccaucuggcugggcgaaccuuucccuacugccugugcacggguggauacuuugcgggcccaugguuauccccacaaggcucugcggcuggcgugugccauaaucaacacccugcgccugcagaggcgacaccagcuugagagcuacaagcagcagaaaaaagguaaguggggacccaagagcccgaggcacacgccagccccaugagagguguggcuacugcugccccagcucccacucucgguaucgcaggcagaaaggacuuuaucauuaaaaaagcacuguuuguuggaucugaagcacuguguaaugggagaacucagugggucaggugcaguucugugguagaagacuguuacaaucaaugccugaagacuucggucuccagaaaaagcaagagugagggaucgggugaaacuguuagcauccaugugcaguucucaagccuccguuugcaccuugccguggcuacccuacuuacagggccauugccucagaacauugauggcauucuuucuguucauccgcauguuacgcaagcaggcugguuaauguagaggcuuccagacccuggaauaggcagguuucugcuacaugacccccgagauaugcuuugcaggguauagagaagcuaggagauugaacuguuugauacagaauuugcucacuuuuaaacaugggcaacaaguugagcuguguuucaaauacacaaaugugggcuaaggguuugguuuauuagguagagugcuugccuagccuucaggaaguggaggccagagagucagaaccucaaggucggaggucaaggcccaccuagaccaugugagacccugucucgauggauggauagauggauggauggauggauggauggauggauggauggauggauggauggauggauggaaacagagcuggggaaauggcuuaguagguaaagugcugguugucaagcaugagaaucugaggguuucugaguuuguuacccuguuacccacauaaaagcugggcaugucgcuguccccuggugcuaggaguugaagacaggcagaucacagggcauugcuggcagcaagucgggcuccagaacugaaguuucaccgaagagccucugucucaaaagauauagguggcuggaggaggagcccaacccugagcuuuauccucaguacaugcauggggcacgcacacuugcauacauauacaccauguguacacagauacauacaccagucacacugaacagaaggagagaggcugugacuaauccggggacagaaggaaggcccuggcugaggucuuggcagaugcugaugaaguugaagaguguaagggaggaacaggcucgagugguggagucagagggaaucuccagguaccucaggggauagcgcaggcagagcucaggcaagguacauuguuucaaggucaguggaggucaguggacgggcagaccuucagaacauucaguuguccaucauugaacuuucauauugcccccucaaagccuuugagcuuggcugcagagauggggaguaggguaggacuaggaaaagagagcacugcuuugcauguugcaggaagaugagguggcucacaggcuggcacguggcauugggagacugcuguggggaugggaggggagccuccagagcuuggguggauagguggguagagcacaccucuucccaucugcagaacugcuccagaaaggugcuacuggugucacaagcacugaagguugggugggccauccccuggaucccauuggcugccucugcagggcacugcuggaggccugucgccuggaggaggagccucacucucuuuucccagguacccacccugaaaacacuugcaggagggccagcacccaacucugcuggccagauacugcccuaucaaggccaggagccauugcuugaagugagggggcuaagagaguugggacucucucugaaccucucuucacuucugucaccaagcuuggggucaaggggggcuggggggagggaggucuaguccucagcagccguggacguguuuuccccagacucagccccagagaagcgaaagcuggccuaccagcacgugcuggugcccgggagcccuggagaguccuacuuggcacuggcacuggaaguggcacuccuggggcuagggcagcagcgggcccugccggagggacuguaugcccaggacaaaguggugcgcaaugaagaacagcuacuggcccugcuggaggagguggagcuggacgagcggcuggugcaagugcugcgaaagcaggcugggcugcugcuggaaggugcgucggcuuccccgcacagcccugcggguuagguaugaggccuugacgccuggccucaaaguacuacucuguggucuaaagaugcuaugacuggucaaccaccacauuguaaaccccgccccauauccuggccccucccauggccuagcccuauuggcucuuugcuaaguguucucccccuauugacuagagcaggugcaccucauccucccucacuaaacccuguugccuagggaccccucuuuucuuccgcgccuccacuugcauuuggagcgcagggauagugcagaugaacucacccugucucuguaggaggcccuuucagcggcuuuggagaagugauuuuccgggagagcguacccaugcacaccugugcccgauacuuguucacugcgcugcugccccacgacccagaucuggccuuccgccuggcgcuccgagccaugagguaagggugggagaaggaguaagcggcuaggagucccaccuccaagccgggccucagucuagugagugaggccucccgcggcucaugaagaagggugucaugaagaaggguguguguguuaccguuaaauggaaauguauaauacaguaaacuugagaaugauuaacagcuagggaccccaaacaagcucaaaguguaggcuuuuucucagccuaccugaagcucaguggagacuuuugaguagcugguuucaugcacugaggguaugacucagcaguauuacaguugccuggaugucggggucagugcccagcaguggccauaugacacagguguuuuuucagcaguuauaguucuacucauguuuaaaauacauagagguuaguggcagcauuaaaucauucagcgacugcggcugcccuaaacagaccagauagugcuggugguugcaaaagcagagccgggugcugacaggacucaugcagauggugcugcagggcguagggagaagagaacagaaagaggaaggacuuggacagaacgcugcugcaacuucacaugagggcuuugaggggaccuggcaggcaauuuuaaaacuaguggagggagcagaagggcuguguggagcuccaggcacuggccugaccuggccuggccuggccugcagaaccugguuggcuccccgagaacacacugguucccagagcacugcaggagugaggguguccuuuucccuuuuaugguagggucugugaaggaaauguggcuucugagcucuccgugggccuguggguagagccagcuagaggaaggggcuaacacagggaguguaucuacuaccuacacacaacuccucccacucacaaaccagcugauucccagggcgucugaaugucuggucuucucugaugaggguuguuugaagcagaaugucauguagcuuaggcuggccacaaacucucuauauagccaaggcugaccuugaacucacgauucuucugccugcaccugguauuguaaacaugcagcaccacgcugcuaaauacauuuucuugcucugucuuuuguuugucuuuguuuuuuuuuugagacaggguuuucucugcauagcccuggcuguccuggaacucacuuuguagaccaggcaggccuccaacucagaaauccgccugccucugccucccaagugcugggauuaaaggugugcgccaccacugcccagccuuaaauacauuuucuugucuuguuuguuuguuguuuuuuugagacccaguuucuguguguagcccuggcugaccuggaacuugcucuguagaccaggcugcccuugaacucugagacucaccugacuuugccuccuaagugcugggauuaaaggugugugccaccacugcuaggcugaaaugcauuuucuuaauaguugggugggaugacacaggucuguaaucccagcacauugagucuaagaucucaaguuucagagcagguugagcugaguaacaagacuggaucucagaacuagauaggugagacaugaugagaaagaaagaaugguaguggggaaacauggguaauuagagucggacggugacagagacauggauguguauuugacaccuaugaucuagcuuuuccaacucucacccuacuccauagcagaaacucuaauaguuagcaucccgucucccccuuugagaauguccccauuguuuucccuuucucuuuuucaaggugacagacugugcagacuggccugagacucuuuuuuuuuuuucaaagauuuauuuauuuauuauauguaaguacacuguagcugucuucagacacuccagaagagggcgucagaucuuguuacagaugguugugaaccaccaugugguugcugggauuugaacucuggaccuucggaagaacagucgggugcucuuacacacugagccaucucaccagcccgagacucuuuuuuuaaaguaguuuuuuuuuucuuuuucuuuucuuaaaagauuuauuuauuauuauacauaaguacacuguagcugacuucagacgcaccagaagagggcgucagaucucauuacaggugguugugagccaccaugugauugcugggauuugaacucaggaccuuuggaagagcagucagugcucuaacccacugagccaucucaccagcccaguaguuucuuuuuuuaaguaauuuauuuauuuuuacuuuauaugcauuggugucuugccugcaugucugugugagggugucagaggcucugaagcuggaguuaggcaguugugagcugccaugugggugcugggaauugaacccagguucucuggaagagcagcaaggacuugaacugcugagccaucucacaaccuuguagccuuagccucugcagugcugguggggcaggugugggccaccagaccuggcuugucaucugcuccagcuccuauucaugacugaagagcugugguguuucucccugugccugucugauccuagugaauguucccaccauauaguugcaccugcugauauuuuauucuuccuaugccugaauaguacuccuuuguauguggguguuacguuuucuguagcuguucaucauguguucacacauguguucacauguguugaccgccccauuguggccauugugaauugugguacaguaugcagcaggcacccucuuuaauauacugauuuacuauggacaugugcccagcagugaguuuguuggguugaucauauacgugcgugugugugugugugugugugugugcgugugugugugugugugcguguguguauggggguuguuucuguuuguagucgccaaggaacuucagaacuucugcuuucugugacaguuacacuaacucacauggcaaccaugcauaagcuucuguucucuguuguuuguuuuuggagcaguggcucaagugcagggugcugugcuuuauuaggcacugcuguaaugcugagcucagacacugcagcucgacgaguuccccuuccucccuacccuuaucaggauguguaucuucucuguaugguaguagccagucaaauuccagcucuucuuuugauaaggugcuggggauggaacccagggccuuugucgugcuggaaucuacagacugagccuugccccuuccccaucaccuucccugggagauucucaugggggcagcaggcagcaguggcagcucacucaguguuuucuucuccccugcuccaggcugccugugcuggagacaacauuccccgcuggagaaucucaccccaacccacuggacuccaucaugaguaaccgcuucccccggugguucauccuuggccaccuggagacccgccagugugagcuggccuccaccaugcugacggcugccaaaggugagggcagugacagcuauccuucuaggguccugcuguccccugacucccucuuuuuccugcuuccauuuccuacccacacucauccuucacuucuuugcuguuuucgcuuuuaauuuucuuucuucuuuagguuucauuucucuuuuugugaacggguguuuaccugaaugucugucugugcaucauggagccauggaggcaucaaaucucuuggguagaguuccagacaguugugagcuuuaacguggguucuagacauggcuaggaucacacuccaguccucugcaagugcagcagugcccauaaccacugagcugucucuccagcuugcuucuaagaaagacauggucucacaugagucccaagcuugccugcaguacaccaugcagcccacacugcccuugacucacgaucuuaccccuuggccucauguucugccacaccugcucuacucuuaccaacugucuccucuguacuacggcuugcacaugcucugugaggacccagugcugccagguggcagguaacaaaacuaucccaaaucccauguucuaugaagaagauguauagucaacuagccagggccuggauuaguaguagagacccugcuuagcacguguaaagcccugagcucccccaguaccacaggaacacacagauggccugggggaugauggcucauuugguaaagcacuugccacaccagcaugagagaggacugggguucaguccccugauuccauaaaacaauggguauaaggguaggugcccugccuuuaauuccagcacuugggaggcagaugcagaagaaggcauauuucagugaguuugaggucauccuggucuacauaguaaaucccaagcuggccagagcucugaaguaaaauaaaaaaggcugguaugguagcauacacuuguugccccagcacugggaaagugagacagaggacccucagggucugcuggauggccagccuugcccuaagggagauggguggaaaggcggcucagugguuaggagcacugucuauuccuauagaggaccagaguucaauuucuagcaccuauguguuagcucacaaccaucuguaacuccaauucuaggaaacccaacacauccuucuggacucugcaggcaccagacaaaacacccuuacauauaaaaauaaaauaauguguucuuuuaaaaggugggcggugccugagggaugacauucaagcuugacucuggccuccccauacauguguauacacauaucuauacucacaugaacacacacauguauacauuacauauuuacacucacaugaacacacacauguauacacacauaucuacacucacaugaacacacacaaagccggcagacaguaaacaaggaggagaucaccaugcacaaagagaggguacuggugucacgugggacacggaacuggugucacgugggacacggaagcaggcagccuugucuucuuuucuguggugcugagggugggacccaggucuuguguaagcuaggccagcacucugccacugagcugcacucccaguucccugcuggaacuuaaacacacacccauaugagggcagagcuaugcuugggcugcaguaacacaguaacacaagcugggcagcuuaagugugauucucauagauuaagaggccaaaguccaagauuaagguggcaagagggucgguuggcaggagggcucccuucuugguuuacacacgcuguccucacuuaguagagguggugggagagggaaggaaacaaaguuccccucccagggccuuggccucugacuucaucuaacccagcaggccaucccaucauggguuuccaacauaagaauuuggaaggagaagggggcacaguuuaauccacacugccuuucaagaacauuugaggcagaaggacauagccaaagcugaggcccugaggcugcaacacagcugugauaucugaggaaugagaugauuggcugggguggaggugcagcucagaguuccugccuagccuccuccagggaugggcugggagugggacuuagagugggcugcuaaccuagaaugugugaugccccggcuucuguucccaacacugaaguuaggauaagcagaagacucgugagacuggagcauagugggggagcauagacuugauggaauuggugaugauuugagcaaagccagcauguagagcagaugguuaacacacacuaggucuauccccuagcuguacaaacaggaaacagcuaacacuuagggagccucuuaaagcuaccucuuugcagaagcauugcugaguucccugccauacacaggagguccugugugaggauuggugugaggggucauucggcuucucuuuacugcuguuccaacuguggccucuauuacuccuucugcccaggagauaccaaguggcugcaugcgguucugggcuccguccagcaaaauauccacuccccagcccugcucuucaaguuggcacaggaugccugcaagacagccacuccagccagcgcaccgccagacaccgugcugcugggcaucgcgcuggagcucggccugcagguaccccagcugacacaucaggagggggcgggcccugcggugguugagggagacccugccccuggggcaaaguuauuauagaccaaaguugaggcgauaagagaucacuguagguuugaugcucgugaaugggacccaucuccaggacugugguugaagcugaggaaugggccacacgaggggcugaaaauggugguagaguacuugcuaacaugcacuaagcccugggucccagccucagcaccaccuaagccaggugugcucuagcauucaggagguguaggcaggagucagaaauucagggucaaccuuggcuacauagagacuuggaagcuagccuaagcuauuugagacccugucucaaaaauaaguaaacucauuuaaaaaaaaaaaaaaaaaaaaaccaagcucagaugccaggugugacugcagggcuauaguagguugugcuagguccucuauuccauacccaguagaaaaaaaaaauuuuuuuugccucuuggugccauugguuaaaauaaaaaccgugaggcuagagagaugucucaacaguuaaagugauugcucuuccaaaagacccauguucaauucccaguaccacauggcaguucacaacaggcuauaacuccaguaucaggggaccugguaccauuucccugccucugcuacugcacagaugcaggaacagacauagacagaggcagaacacuaugcacaucaaguauaagcaaaguaaggaccgugaaugcagcacacucagccaguaaggaacgccccugggacugggacauagaguaaggcuagcggguguguguguguguguguguguguguguguguguguguguguguugcaguucaggugaagggcuuccugggguugagccuuguaagcaagagcuauagcugaauaucacuuucugcaaugcaaagucugagggcagucuucaugccguccauaggugagcagucaagggcauagaucugugggguccucgcaaggcuagccgggcauggggacugaggacaaggccucagacaguucuggagacaaaguaaauacgugcaaacagcuucacguggugaugcacgccugccacuguaguacugggaggcugagcucacagccaguaugggcuacagacccugucucaggaaagaccaagccaugugagagugguugucaagacgacucagucaguacagugcuugaaaggaaaauuaggugcccagaccaagguuaaaaauauaauuaaaaagcauuugggaggcagagacagguggaucucuggguuggaggacagccagggcuacacagagaaacccagaaaaauaugaagaauuaaaagcuaucauuccagcaauggggaguggggguggagacagacaaagcccuaggguuugcugauccaccauugcagccuaacagguaagaccaagaugggcacuggagagcuagcucacugagaguacuuguugcucuugcaaaggucccaaguucaguucccacuacccaugucuggcagcucucuagcaccuguaacuccaauucuaaggggguacaacuccucuggccuccaagggcaccugcauacacaugcacauacucacauccauauacacaugauuaaaaaccauuuuagaggagagggguucaaugcagggucucuguguguagcccuggcuguccuggaacucacuuuauagaccaggcuggccucgaucucagaaacuucccggauuaaaggcaggauuaaaggauuaaaggcaugugccaaaaccaaaaaauuguuaaaaaacaaugcuguggcuagcuccugagcagugcaccuaugguugcugucugaccuccgcaugcaggcacacuguagacuuaaggcacauacacacaaccaaagagacaaccuaggacaacuugcauucccagacuucauaacucuagggaucagugaggggacaacaagacuggagaggagagaccagugugggggcucacagaggcagauucagggcugggccucaggacaagcagacauguaagagguuucuuuagggugcaauucacagggcaggggcugaaggucgugcaccuugggacucggggaagaaucuucugacuugagguguggagcuuuccagaaugggaggcagguugguugguuauaaguaugacuuuagugaggccuuaggucccagcagcacuggucagugucacugcagagagccccagccaugucaccuucauuuucacagcaccaccgugcaauagauucuccuuuugaagauuuauuuguguguguguguguguguguguguguguguguguguguguguguguguguguguguguguguguguguguguuaguaugcacagguacaagcagauaagaaagccaggaaagaggguaucucuuggagcuagaguugggacaugggugcugggaacugaacuuaguccuugggaagaggacuuaagcauuugaagcgcugagccaucucucuagccccugauuuuguuuuauaaggacacuaaggaucacccagguuucugugcuagcauggcaaguucuuuacuaccugagccaccuucacaguucuuuuuuucccuccacuguuuuuuccaggcaggguuucucuguguagcccuagcuguccuggaacucacucuguugaccaggcuggucucgaacucagauaucugcuggcaucugccucccaagugcuaagacuaaaguuguuugccaucacuccacauuucauguuuuaaggauuuuauuuuuaauuuugugaggguguguacgugugugagacgacuugggcuguguguggaugugugcauacgugugugggugcccucagaggcacuggauacccuggagcuggaguuaaaggugguuaugagccgccuaccaugggugcugggaaccaaacucccacccuuugccugagcagcaagugcuguuaaucuuucccggcaccuccuccuagucuguguuuuuaucucuauuccuuagagccagaaacugaggccagagguagcucacccaggccugcugcauuagcucugccuccagccuccuagguccuaagccaucagcuguagcaggacucugaggaccuuccuuuccuuucccucuaggugaugcggaugacacugaacaccaugacuuggcggcgcagggagaugguucgcuggcugguuagcugcgccacggagauugguaaguaccuggaagggccagugaggaaaucagacaggcaccagaaaaacuugcccugccuggcaugcuaugcagcccuuuaaccccaacacucaggaggcagaggcaggugaaccuauaggcugaggccugccuggccuacagaguguuccugagcagcugaggcuucauaguaaaacucugccucaaagcaaacagauagaaacaaaagaaagcaggcccuuccuucccuguuaccagcucuaggccagccugggagggagcaucagguggggugauggucaggcugagcuaguuaggaguccagggaggcuacagggcauccacucaguccaaccacucuugcuccuuugaaaaggggggaaauuuccuauccagacaagacagugcaccuggaauccgugcacugggaggcugaggaagaaaugagacccugucucaagacucugggccagagcuauggcucggagcuagacucguugcuuagcagggacugacuuucccaguggcaguagaaaaggaaggcuggguguaguucauuugauagagugcagaucuggcaugcaccaggcccuguguucucucuggacauggugguacaagacuaaucccggcacuugggagguugaggcaugaagaccagaaguugauccuuagcuacacagcaaguuugagguaacccuggacuaugugaaagcuugucuggucuuuuuuuuuuuuaauuaaucaauuuuacauguauggguguuuugccugcauguauaucugugugccacauguguacuuguggaggucagaugaucccuuugaguuaugacuggcuuaagucaccacgugggugcuaggagucaaacccaaggccucugaaagggcagccagugcucuuaaccacuaagcaucuccagccccaugagaccuugucuuuauaaacaaaaacaaacaaacaaacaaacaaaaacuaguugggcgugaugacccacacuuguuauccuagcucuugggaggcaaagguaguuggaucucugaguuugaggccaaguggggcugcagagugagauuaacugcaccccuucacauacacccccccccaaaaaaaaaacaaaaaacaaaaaaacugaugaagcugggaggauucagagccaaugguuguagggugggaagggaaagggcagggucuggcugcacagauacacacucugcccucuccccacacccaggcccaccagcgcugaugagcaucaugaagaacugguacuccuuguucaccccaguggaggcggucaccauaguggcagugacaggcaccacgcaugccacuuugcugcgacugcagcuagauacagcugggcgagaggagcucugggcuugugcccgcaccuuggcacugcagugcgccaugaaggauccccagaacugcgccuugccagcccugacccugugugagaagaaccacgcggccuuugaggcugccuaccagauugugcuggacgcugcagccgguggccucggccacgcccaccucuucacgguugcacgguauauggagcaucgaggccugccucugcgggccuacaagcuggccacgcuagccuuggcacaacucagcauugccuucaaccaagacagccacccugcagucaacgaugugcugugggccugcucccucagccacucgcuggggcggcacgaauugucggccauugucccucucaucauccgaagcauccacugugcacccaugcucucagacauccugcgacgcuggacacucucagcacccgggcugggcccacugggggcccgcagggcuaccaaaccacuagggacugacagggcaccacuuugucagcuucuggaugccgcaguagccgcguacauaaccaccagccacucucgccucacccacauuagcccacgccacuauggugacuucauugaguuccugggcaaagcucgagagaccuuccuucuggcaccagacgggcaccuccaguucgcacaguucuuagaaaaccugaaacagacguacaagggaaagaagaaguugaugcuguugguucgggaacgguuuggcugaggaacugcagaaagccgggagcaugggugucccaggcccaccuuccucaaacaggaggcccauggcuacuugcaguaaaguuacagaggugggaggcagagggugacaucauuccaggugugugccuaggagugugcagacaaacgggacaugcgaucugaggauccgaagccauacugcuaacuagacccugcagggaguaugugccugggcaccucacacggaagaagcaagcucuggcucuuccagacucccagggucagcugggacuuccaggagaagggcugggccagagugaaguuaggccuccaacucagugcagcagaugcuccagagccggagcuggccggagccuaggcacuucacaucaggguaguuacuucccacuguguuucuccccucuccacagcucagggcuccugucccacugcccugcgcccccagccccagcuuuccagcacaaaugccucaccccacugaaggauauuaagaggucuugggccucugccacauaccucacccccaaauacccuugucaagccagggccugucuucucuugggcaccaaggucacaggguaggcuggggacagcucucugcuggccagaccccaccacuaguaacuggauacacaacucaggagucaggcugcccuccagccuguugugggaggcacaggcagacagccagggaccccguucugucuuccucuugcucugcaccuccauuuguuuccccacucccuuaguuuccccaugucugcaucucucucaagucccagcugcugacaggccuuccuguaucccaggccuuggcccagggaggaagagaagggagagccuccaccccagacgcaccugucuucucucuuguauauuaaggaaaaaguuggcaucauuuuguaacuuuuuuucuuauuuauugaaccccauacuguauucuuuuccuuuuuuuuuccuuuuuuuuuaaaaaaaagauugaacacaacuucuuuuuaacuucaagacuggguugcauugcuaacacaaacacccggggccagggguaccuaccaccugcucaauuaaccaaaaaauuuuccaucucgguuuuugggcacaacuugaaugggacaggagaggcugcugguuucuucauggcaucguggugacacgaagagccaccucuugcugguggcuuuacugcuuuuccaucugcaugucauaaucucugcaagucaggaggcuuaaaacgcccaaaccuagagucuguagguuuuuggaaaaugca

SEQ ID NO: 4580 - RNA, 20560 nt, Mus musculus
gacgaaagugccucgcuccagcuugcgcaggcgcuuuugggccgcagaggcgggcgcucugcggguuccuggcuccgggugugcuuccgggcugguggaggcgugacgucagggagagggcagguagguacggggugaggaccgguccgcgacggcaacggggguggcagguccucaaucccaccacugcguccuggcacgggagaugcuguaucugcggacgcgagcggguucccagggcccagccuccguuuuaggccaauggcaccucuaggcgucuucaugcugaagaugagcccuccuagccugaauugaaacauagugcuugggaacaguagcuugggggccggcaagguggcuuagcugguaguggcgcuuguggccaaaccugacaacaugagaguucgaccccugagcauguugaaagaaucgauucuuguaggcuguucucugaucuacauucucacuucguugcacacucugccaacacacgcagaacaaauaaauguaauuuguaaggggcuggcgagguggcuccgcgguuaagaacuugaccugcucucuagcagaggaccaggguucaguucccagagcucacagcugccuguaucuccagagaauccaacccucuacccuuuccggucaccugaacucacuucugcacacacauacacauaacaaaaauauuuuuuauaguuguuaguaaguaggagaaauuugaaauugucacuuuucuuugucccaugccuguucuucucaauacuuaacaccugucaugacucccaaaggcagucucagcggcugaauccuuuagaaaacuuuuuuuuuuccccaaauggagaaacugggauccagguagccccuggcccagagucaggcagcuaggaagcagcagagaggagauugaugcccaagcuguggucugcuguggcauuugaggucaggaaugacccuuggcacagaagagccccugugcauccaccugagcagacuggguguaaucuggcugugauacuaccuguggugauuagccauuuaagacuucagaagcugaggcuggaagaucuggaguacuaggccagccgggauuacacagaaaggcaugucuccaaaacaaacauguucaacauuguaaagcagaccccaagcacauagcacuucaagcuggguguccacacuaccagcccauacacuuuuucauuauagcaaaccccagagucacucccgcucccauuucccucuguuuuuaauuuuuguuuguuuugauuuugcuuuuugagacagggucuuccugucugguucuggcuagcuuggaacuuggcuuuguggaccauacuggucucgaacucaguguguacccuccugguuccacacacacacacacaccccgaaugcugggauuaaaggcauacaccaucacucccuggucuguauucucuucugacaggcgaugagcaggcacuccacaacagucagacccagguccgcagcugguaaagaauggagcuugaauuuaaacucagguagcugugccucgcaaaccuggcugggcauugaaguacuuggccaccaaagguaucugggucaggacgugugaugaugacucaguaggugaagacacugacaccaagccuggcuaucugaguuccaucccccaugugggggaaggagagaguuaacuccuccucugaccugcacacaauggcacagucacaccuggacacacacacacacacaauguuuuguuuuaauuuagggguggagagauggcucaguaguuaagagcacauacugcuuuucuggaauaucugaguucaguucccaguccccaugucaggugacucaacggcugccuguaauuccagcuccagggagucuaauguccucuccuagacucucugggcacaagcacacacuauuuaaaaauaaauuucucuuuuaaaaaccuuaccccuggagguggugaugcacaccuuuaaucccagugcuuaggaggcagaagcagguggaucacagagcgaguuccagggcuaaggcuacacagaaaaaccuugucucaaaaaaaaaaaaaaaaacagauacaaacaaaaauaaaaaauccucaagacagcugagaagaguggagaaaauccuaaauaaaugcaguuucugaauucuggcacuucaguuugcauuugaagcuuugccccacacaaacaaaugcccugccaacaucagccucugaugcucugugaguccuccgggaucacuaaaugaagaaagagaaaaggaauaaaggccaugguuacuccuaagugaagcagaaaguugauuguagauaaaagggagagcaggggcagagacaucuggggagcccagagugccaacguguccagauugagccagaccauaugggagagaggagaaggugcagcacccaggugggcagacauacaaaaaggaguggguaacucaaaugucuggguuuuauauauauauagagagagagccuuugugggggagcagccuagccucugggcugcaaaguuuaggguaggggauaagauaugucagccauaccccuuaauguguagggacagagucuaagggguacuggaaggaccaggugaccaggucugauuugauauguuaacuaggugccucagccauuuguccuggguuugaaauuuaccacagcagugagauguggcaugacugaagcuaccacaguacaguacaucuagggcaugggcuauagcuuagugcuagggccccugccuagaauccuccagugagggcuggggaagugggacucagugggagagcacugucuuagccuuuggaggcuccgaguccgucucaauaauucaggagcagucuguuugccuggucucugcagacagccaggaacucaacuuggcuagaggagaaggguaagagacuuccucagagggcaaggcgugggaggcagaaaggccuguagauaugauuauaaacuagacagggcaucgugaugcugaguauauguauguauauauauacauauauauauaucuguguguguguguguauguguauguaaguaucaggccgaugggauggcucgguggcuuuccaccaagccuacaaccugagugaugaaagguucaauguggaaaggagagaacugacuccuacgaguuauccucugaccuccaugugcuuaccaugccgugcgcacauacaggaauucauauuuuaaaauguacauuucaaagcccguugcagcuucugcagcaggagcaggacaggcgguaggaauuaagggaaugguuaggacaccaauuguauugugucuucucggucacuccaguguagagucuggugccacaugguucucuuaacugucaugucugucugucuccccuccaggcucuccuuggacauuccuguacucuuuguaggcuccgcaucagguugcaacucagaaguauugugaacuucaagaaauaggaagauccaagugacacagccacaccucuacagaacagccgugugcggccucugaggcuccacaggagggcacgucucacugcaucuucaugcguugaccaggccaauuucauaguugcagccuugcuagugaggaccuauaggcagcucccaagauggugaguagauucccauaucuggacuccuggcagcccugucccucccaggcucuugagugguaguuauugauuguuauguaucgugguaucauggucucagagcuuugcugggaacuugaacuaccacccgacaaagcugucuauccucucugucgagauccugcucccauccugcccgcuucccuuccuuucugaugcuauuuagcuaaggaugaucuugaacuccuggcccuucuuucucagagauccaaucccagugcagagaugaugccucccugcugcagaguuggggauuuaagucagggccuugcaagugcuaggcgggugcucugccacugagcuguacccaagcccuacccuaccccagcccugcccuaccccagcccucccuuaccccagcccucccuuaccccagcccugccuuaccccagcccuccccuaccccagcccugcauuagccgcugugaagugugugagugugucccugccccuuccuucuucaguguagcucuaggaagcugucacucugaaaaggagacccuguacaacuaagcuaagcaguaacuuuuaaaaauagauagucauguacuuuauuuauuguagagcaggugugcaugcaugugggcgucaguuuggaggaauuggcucucuccuuccaccaugugguccccggguuucaaguucaggacuuaggcuugcucgcggacaccuuugacaccuuuacucacaucaucccugaggagccacucuugccucagcaccacugauagcgacuccgcugcuuccagcugagucugccugccgugagcauguaacacacuaugcuguccugucugcuuucucucucggcaucuuguguucaucuuccuccguguacgguguggauagacuuuucccagggcagggcugcccucaggcaaguguuuuaccagggggcuaauccaccacacugaccauggauuuuguuguuugguuuugaaacuguauuuuaauuacaacauuucucucuuccuuucuucccuccaaacucucccaccuaucccuccuugcucugucaucagcuauucuugccugcacauaugaauuuguguauacauucccaaauauaaccuguugaauccagauacuauuacucuuguguauguuuucagggcuaucauuuggcacugggcaacccguugguguguuucucucaggggagggcagccucuccugcuccuagcuucccucaguugccugugguucuuuguauaggguagaggccucggccuaauggucuucacccuguccgcuuugacauguugguugguauucuuguucagcccacauuugggcagccauguggguaagacuucauggguauaccuucugaugucacuaaaagacaugaguauaucuucugaugucucuaagagacagucucacagcaaagucccugauccucuggaccuuacagucucccugccuccuccuccacaauguuugcugcaccauggaugugggacuguguguuuugcaguuggacagccuguauauugauggguuauuguuuucuauaguggucuguguuguaaagauaaguuuccuugaugagggguaaagaccacguuuacuggucuagacccuggaggaggacaugggaaccuggcugguuauagaguggggugguauaggcaaugccacuccgcugggagacauucuggucagcuauuucucccugaugacugacagucuucugugaagaacaagccuuagcuuugaaccccuguuguauggaaaccucugacaccugacacagcuaccacaucagaguggaucuucuuccacaacccagauuuagagaccagcuugacagccauagcuuaggguaguggagaaucuuuaaauauauuucaugaguaaucuaagagaaaugcuaguagggcaugguggcucacccccguaaugccagcucucagaagugaggcggaaggauugcuuugaggucacgaucagccuggcuguggaaugaaguucugucucauucaaaacaaagugaaaugggcuguaacucagcugguggugugcuugccuagcagaaggucuggaguccacccccagcaaccuguaagccaguugugggacaugucucuaauaccagcauuggaaggaggaucaaggccagccuuagcuacaggcagagcaaguuuguggcuagcucagcuacaagaaacccuguuguauuuaaaaaaaaaaaaagacaaaccaucgucagcguccauccguccccacuucuuuaccauugccugcaguccccaggagcgcguaaccacuccaauaaaacuguguauugccuuaagggguuuuccaaagcucuaauaauaauugguuuaccauccggguugcacuguagaucagacacuagguggaaccuucaccacgucgcuagggcccugcaugacccucuccaacucuugcuucccucugcuuccagggugaaaggaaaggccagaacaaguacuaccccccagacuucaaccccgaaaaggugagcagcuccccacaaccccacagcuucggggccaagugucacaagucaccuagagaagacucgaaagccccugggugugugcaggcucuaccccauuaccaugccauugcauagaaagcauuccuagagaugcuggugucccugggggcuccuggaacugcuuccuucagauaccaaggaccagucugucccuggcuccaagcugcguacuuuaccaagaccuccacaccucccauguugcuuguagggaguaagaaugaguccccuccuccucgggaggauugucucccagcaguaggacagcagggcaguaagccacccagcuugguccugccuggcuucacucacccuuuccauacagcauggcucucucaaccgauaccacaacagccacccacuucgagaacgggcucggaagcucucacaaggcauccuuguuauccgguaagaaacuaccccucccuucucccaagaucuccaguuucuaucaaucuuauauccccugauugauugacccagugcuggaacguuauaauuccauaaagcugguagacauugcaucagucagccauugcuguauaacaaaacaauaaacaguuuuuacugauaacaaggcuaggugccucuucugggcuuggaaggaccugacgaggccgucuuccuucauugaugaguaccaggaagcagaagacuaguccuguggggccuuggccuguacagauagacugcuccacagcaggucucucuuccagcagaccagcaguaccauggcuccaaaagaagcagaagugccagggcucuuaaggccaggaccaaacgugacacauugaaccuucuuugccauugucuggucagauccugacuccagggcugggccaggcucuuccucuggguggccaagccagagggugauagagaaggaaaggagccagaagaaagaguggccagccagggccuguacagguguauacuccugccuacccgggacuagguggccugagacaggagggcuacucaaguccaagaguucaugaacagccagaauacaucuuaagaaaaaagggagugggggagcaauggcucagugggugaaguguugccaagccagagauccugagugcagugcccacagccauguaguagaaggaaggaaccaacucaugaaagucgucuucugaccaccacacacacaguggcuaagucguaggaaaaaacuuuuaaaggaaauaacaauaaaaaguccuugucuuuguuuagauuugaaaugccauacaacaucuggugugacggcuguaagaaccacaucggcaugggugagcgugggugagcgccgccaugggugagugugggugagcaugggugagcgcagccaugggugagcaugggugagugugggugaugucgcccaccccaccugcccugcccacuccuucggcccccucugugccaaguacuaugagacacuggagauguugccaaucccaagggcaaaucagaagguggcagguacccaagccagagagcaaugagaagguuaggcccugagguccagauccugggcaagggcagggcagggauuuucuuuggauccaucacuagggcagaaaagcaagggcagaugcuguugcuaggcuaggcuauggggcagagauuguaguguuuuugaccugccucagggucagcuaggcuccaggaaaugaagaugacaaccuagaugcagagaucugggagacaagguggcugugggaagggaaggaaagugagaggcccacagcccagaccuaccuaaggugugcacuguuggggcagagaucgggcccugggcagguuuaagacccuggguccuguucccaggacugaaaacagggagcugaaccacccccagacaccucauggccaccucuagcccaagcuaaagcagcugccccagagaggagcagccgggccaugccaugggcagcacccaggcucaguaccugccacucacaaucagaagauaggacuauauuaccucccaggaaaaaucagauaguuuugaaaagaauaaugaaagcugagcuuauucacucgaguaguauguauguauguauuugagacagggucuggcugugucaucaagguaagccucaaacuccaucuugccucugucucccgagugcugggucacgggcauaccccacacccaucucuccaucgacauuuucacccucaucucuguugacgaaaugggagacagagguccagagggaugaggcaccuugccuaggggacacaguugggagucaguggaagcaggguggaccgggccuuucuguuucaguccacacuguccuauagccuagguaccccagugccucccaaacuucauucuuuccuacugugagcuucugggcccuugcagggcaccugcccucccaggcagcaaacagcaguuugucugucucccacccaaagaaaagcugcugcugugucauggucccagccucucucuccccgcccucucaggugugcgcuacaaugcagaaaagaagaagguuggcaacuauuacacgacuccaaucuacagguaggcgcaucugguggcacuucagggauaggcguggcuucacgggcuaaagagucuauagaggagucuugaagggaaagggaacgcagcaccuuccucuagagccgucgucuguagaacuauccguucuggccugucaaccuccuccagucuuucauggcucccaccuuccccaguaaaagcuuaggcucucuuacucugcuucagaccuuguaaucucugcucccuccacacagaagcuaaacggcuccaucgcugugcugcuccgacacugcccuuuugcaaagcuguccccucuugugggguaucucuucuugcuggggcaugcucaccccaggcacaccugccccucccggagcagauugucuuacuagcagcuuucccaacuguugacacccagccuggcacagaagaaccaguagaggggagugggaaggaguaaacagauggguaggugggugggugugaggaugccuaggugagugacuagauaagugggaaagugaacaaggagaggauggguggguggauggaucugaagauggaugcauagauggaccaaugggcaggcaauggauggguagauagacauguggaugaauaaacugguggggaggugagugggugaacugggggaugggagguggguagauaggugaggaaugagcaaacgaaggaaugaaagagccagcuuccgugucugggugauggacuguagguggagauaggguccuacuguguagccuggggagugcugggaucacaaaugggugccagcacaccuaccaguucuguugggcuauuuugucacccuagaggugagagccaacaugaacaugcugagcaggcuuuauacuuugagccuccaggcccaccuucagccucuugguugcuccaucuguaugcaagccugugugucuuccucaggguucgcccagaugugagcagggauacucagugacuucuggaaguguguaguacaccaaaggaagugggcagugguucuggggucucaggauggagccacagcauccuaacuccaguuccucucuagguucaggaugaaaugccaccucugugucaacuacaucgagaugcaaacagacccugccaacugugacuaugucaucgugaguggugccagucgcaaggaggagcguugggacauggaagacaacgagcaggugcugaccacaggugagcaccaucugcuugcccgucccacacgaccucuggcugcuuccccagagucacacuuauuugguccuugcagagcaugagaagaaagagaagcuggagacggaugccauguuccgccuagagcauggugaggcugaccgcagcacacugaagaaggcccuccccacacucagccacauccaggaagcgcagaaugccuggaaggaugacuucgcucugaauagcaugcuacggaggcacuuccgggugagggaagccccaggggaaacagcagcagacucagaccuguguccccgcauccuaccugcaagcuggucauuucuugacuggcuucaugcucccuauguacagcacaggagucgugcccugccuagaucuuucccugaugcuauagcaaacauaccgcagacugggaaauguauucuagaauuauauuaugcacuucugugcaagcuggaaaucuagcagugagccaccuacagacugaccauguacagagcgcccaaucucauuccuuaagcuuccugcuggaucaaggggcagauggaacacacgcucccugugcacuccuguguaaguccccuuaaacagaaagagcccucacaaaguugccucuccaaagcuucauguugucagcugucacagagggagcuaaguuucgacagaagcagggagccaguuucaauggugucuaccugugguuccagcuacucaggggacuggaaugggaaaaucacccaagcccaggaguuggagacuaaccucaaaaccagaaagcugggccuggagguucaugcuucuaaccacaacacucaggaagcugaggcaggggaacuacuucaaguuccaggucugucucaguuaccaagggagaccuugcccucccaucccccaaauaaaacaguaggaaaaauucuagggccccagaaucgucaauaugcuucaggcuuaaguauugccuuaaauucucaucccugccugggaucacaggcaugggccagcacaccuuuuuuaucagauuuuauaugauuuaucuaguaggucacaccugcagcccaucacugaucaaaguguaguguuguggcacguguccaucuuuuugucaugaauccaggacacugacauucagagagccuacacacgggggccacguuuguaucacagguucugugugggcccuucccuugcuucagucaggcagaagcagacccaguggcuggacugagaccuauggguuucaggauggaggguucugaugucccugccugugugccacacccacccacaggagaagaagaaagccaugcaggaggaggaagagaaggaccaggcacugcaggcaaaagccagccuagccaucccucuugugccagagucugaggaugaccgcaggcuggcugcccugcuaagguugcacacccuggacugugagugccagcucccgacugggagguccuugggaagcaaagguuguaggguuuggaggcacuuggucccuagagccccuguuauuuaaacuggugggaagaaagcucaagacuaggggugugugcucugugcccacucugccccugaacuucuggcccuuguccaaugcucccuuuucccuacagcuuaugaggacaagcagcgaaugaagcggacagagaucauccaccgcucuugguuccccucagcccagggacccagugcuagcagcagcaaagcuagcagcguccugaagaagcugugccagggccgcagaccaccccccagcagcacaggcacggugggggaccugggcauagugaggagaaagucucgagacguuccagaaaguccucagugugcagcagacaacuccuugucagaagaacaaagaaggccaccaggaaccacccaggguagcaagacacuugaagaggcagcagaagcauccaggaccagcaagacaucagaauccaagagaaacuguagugaucaggccuucccccuagguuccucccaggaggaccugcugaaccccaacacccccaaugccucccugguggcugacuacucugacucagagagcgaguaagggagucagaauuccaggaccagaagccaugacgcguccagaccuuagggacuggcacauugcugccagcccagauacagaccuaccuuccuauacagauuauuauuuauuugguuuuggugagaaugccugugccuugauguaacccugauaccugagcauuaaagugcuguucuuugucccugccuuguuucuaaacucaucuaguagcugcccugcccucacuuccagccaacuaagcagaugcugcugcaucguugugacggcaguguggccccacaaagcccgaugaaggguuugagauacugaccaagauuggccacggccuggggugacguccccuuaugaggugucaaggacuacauaaggaagguugaaagagggccaggcugcuggagccagagaaauaaagcuaacggcaggcaggaagaacauccaaacuccaugucaugggcuggugugggucacucauaguggccagccaguagggauguuugugaaacaaccucaaaaacacccuaauccagccaggcauagugggcagacaaccgucauccuggcaccccagcaauagagacaaggugugguccagcuuuaaaauaggguuucucauguaucccuggcuguccuggaacucguucuguaacuauuguggagccagauucacaaauauaucucuaccuccugaaugcuggaauuaaaaucugagguuuauuuuuguguguuugcauguugugaguauguugucucacugagguuugaaagagggccuugaauccuuuaaaacuagcggcagucgugaagccuuugguccucuacaagagcagaaugcacgccuaaccauugagcaaucucuucaggcccugagaauaaacgucccucauggugcuugcuuuuuuuuaaaaaaauggagacaaaaguagucccacggaaggucguuugacacgcugauuaagcgcugggugucugugagccguggauaggcagagcugagaguuccaagucaucgcuucaguaacggauggacgauuuccggcaaaaaaauagccccaucaccaagcaucuuggagcuagaacucggccuugggagaaguuacagccacucuggaagacgcuaaucgcccgauaaccuaggagcgcgugcgcaugcgcacgcggcaggacgcaacuccgccccgcagccugugcaggauuccucguggcccugcaggguaggcaacaugacacuggaagcgauccgcuacucgcccggcucgcugcagauccucgaccagcugcagcugccagagcacugccacuaugaggcacugagcuccgugcagcaggcuagugaagccauccgcgccaugaaggugcgcggagccccggccaucgcgcuggucggcugccucagccuggccguggagcugcgggccggcgccggcggucccggacucgcugcucugguggccuucgugcgagaccagcugcgccucuuagucgccgcccggcccaccgcugucaacauggcccgcgccgcccgcgaucugggucaaguggcagcccaggaggcggaacgagagggugccacugaagagaccgugcgggaaagguacgggauccuggaccagucuugugugcucugcccagcuuuccucucuaccauuuucuuucccaucccacuuccgguccagccacuugguucuuacugcuuuucuguugcaccgguacggcuccugccuguggcugagacuagagucuagagcauuaaagcacuggaguuagaacuucaucuccagguuccugcuccuuccccuccccuucuguaaaaacaccuugucccugauucugccccuuccuguucaucaacugccucucccaccaugacgucaucaucacagagguaaaggguuuccuccuguuuacugcugugcgucagccccagcuccuggcucacuuauauuagugaucagaguggaaguguccucaggcucucagaaccccaccucaccuuuaaagggcggccccuucaaaguuagccagcucccuuccaacagugcuaagagcuucuucuguccccagagugauccgcuucgccgaggauauguuggagaaggaccucaaagacaaccggagcaucggggacuugggagcccgccaucuccuagagcagaccaaccccagggguggcaaggugaccgugcugacccacuguaacacgggugcucuggccacugcuggcuaugguacagcguuaggugaggaggcaccuucaauuguuagggcaugggacauguuaugggaugcaaggcaaagcaacuggagcuggggguguaguucaguggcaagaguacuugcuuagcuagggcuggcucagcagcuuaaaaguauggaccccucuugcaaagaccuauuaaguucucagcacccacaguaacuaccugcagcacccucuucuggccuccacgagcacaugcccuuacaugcauagagacacacauguacauaauuaaaaauaaacacuagggcuggagagauggcucagugguaaagagcauugacugcucuuucaaaaauccugaguucaauucccagcaaccacaugguggcucacaacccgucuguaaugggaucugaugccuucuucuggugugucugaagacagcaacggugauguauucauaugcauaaaauacauaaauaaaucuuuaaaaauaaaaauaaauacuuuaaaagaguacauacuuagcuuagaauacacaaaauccaggauuuaguccccaaaacucaaaugaagaaacuacuucaaccacagaaguguaaauauuaguuuuguuuugauuuuucaaaucauauuuuguguauaccugcugugcauauguguaccaugcauguacauugugcccagaggacagaagaugguuuuggauccccugaagcuagaguuacagaugauuaugagccaccauguggguauugggaaccaaacccagguccucuguaagagcagcaaguucuccuagccacugagcagucucuccagccccgcauauuaguuuguucguuuuuccuacucccaguauagcagcuccuguacagaaacccuuggggaguugucugcagggguggcuacaucaaggaguccaacccaugcauuagaacccuggcccucccugugcacauggauugaaguaguucugcuaucagagucuacaaacuuccccgggucaccugccuggccuggcccgcgccacauaccuacagaaggggcauagugucaacucccagaggacagaggagcugagagugacacccccugaguaaguggccacaagauagcaauuugggagucaaggcagcagauuccuccuggcccuugguugucccagaagcucugcugucugccagagucagagcucaaucucagaaagaagcuccugugccccguuuauugacuccacuaacagucaugaagcaacuacugacuguugcagcgagugagaacacagugaugaaccaugggagagacaccaggcaccugcagccuagaauacagagaggaaugacaaggggcuuagaggcaugggugagcaguggagcacgacugagaauccuccuccgaggagcuguguguguggcuguagagcacuugccuccagaaugcaaagcuaugggcuccuugcauccccagcaaaacagacagaaggcgcuaaaggccacucagcaggcuaggacaaagaaggucaucuuucaaggcuuaaccugagccauauagcaagacccugucucaaugacaaauguccuaaaugaugaggacaggccagggcuaaagaucagaacagugcgguugcugugugagaccaaggagcuucagggugucaggauggagacguaaaaaugaugugggaaagccgggcgagguggcgcaugccuuuaaucccagcacucgggaggcagaggcagguggauuaaugaguuagaggccagccuagucuacaaagugaguuccaggacagccagggcuauacagagaaacccugucucgaaaaaaaaaaaaagaugugggaagagugucgggcacagacaaggcugugcaccacacaugcacacaugcuggcccacccugcuugucugcugguauguccauaggugugauccgcucacugcaugagaugggccgauuggagcauaccuucugcacagagacccggcccuacaaccagggagcccggcugacggccuucgagcugguguacgagcagaucccugcaacucucaucacugacagcauggcggcggcugccauggcacaccggggugugucaggucagugggcugggcaccguggggcaggucaugccuugggcauccagaaccagguaugugaccucccuaacucuccuccgacccccagccgugguggugggagcugaccguguuguugccaauggagacacagccaacaaaauaggcaccuaucagcuggccauugucgccaaacaccacgguguccccuucuauguggcugcccccaguucauccugugaccuccaucuggagacuggaaaggagauugucauagaggaacgccccagccaggagcuaacugaccugaauggagucaggauugcugcacaggguaaggugugggguuggcacucuagguaugaugauggagguuaaauucaaggccaggcuauguaaauaguacugaggccagggauggagcucaguagguagagaguugggaaaggaccugaguuuggggcucagaaccaacuuuuuuuuuuuuuaaauaauuauuuauuuugccaggcaauggcggcacacgccuuuaaucccagcacuugggaggcagaggcaggaggauuucugaguuugaggccagccuggucuacagaguuccaggauagccagagcuagacagagaaacccugucucgaaaaaaaccaaaaaacaaaaaagaaaaaaaaaagaauuauuuauuuuauaaguacacuguaacuguugucagacauaagagaaaagggccucggaucccauuacagaugguuucgagucaccaugugguugcuggaaauugaacucagggccucuggaagagcaaucagcucuuacugaugagccaucucuccagccgccccacagaaccaacuuuuuaaaaagcuaggucugguggcacagguuugucauccuagcacuggggagacagaaggcagcgagcccaggcucacugagagacccugcucaaaacaugagucagacaguuccugaggaaccaaacugagguuugguucuguaugcaagaacacgaagcacacacacacacacacguacacacacacacacacacguacacacacacacacacacacacacguacacacguacacacguaugcugggugugguagugcaaccuauaaucccagcauuucaggagcccgggcagcaggagccacacaaguugaagaccaccacaugguacaagugaguuucaggcagagugggcuaccaagugaugcccugucagaaaggcauacaacuaacaagucucauccuggacaaaugucugcauagaaagccagggaugguaguacacaccauaccugugaucucggcacuggggaggcugaggcaggaggacugcugagaguucaggaucagccugggcuacauagugagaccccacaucucaaaacucagagccagauuaugguggcagcauuacaccccuuuaaccccagcauuuguggaaggaggcagagcuucgaggccagccuggucgauagcaugaguucuaggacagccagggcuacacagaaacccugagcccuggcggcugcucaggaaguugaggcagaaagaucgcuaguucaaagccauccuaauuaauauuaacuucaucccaaaauaaacauuuuaaagacagccaagaguauaacucagauauguauggaguacuugccaguaugugcaagaccugagauuuaaccccaaaaccacaucaaaaacauuuuaaguuaaaagcaaucaaaauacauuguguacauauacaaaaaucucaauaacagagacauuaaaaaauaguuugccaaucuuggugggguacaucugguaaaccuagcacucaggaacuagagacaggaagaccaggacaucauaacuggccuuggcuacauagaaaauuugaggcccaagcuacauguauggcccuguguuagagaaguaauugcaguuuuuaaacugguuuucuuuuuuguuuguuuguuuguuuguuuuucgagacaggguuucucuguguagcccuggcuguucuggaacucacucuguagagcaggcuggccuugaauuuagaaauccgccugccucugccuccuaaaugcugagauuaaaggugugggcaaccacugcccagcuaaacugguuuuugaaauaucugugaagggcuccacccaaucccaagaaccggaaaaacagaugcaacagcaaagcacacccaugucugagucagugcaaagguccugggguggauuucugagauucuuaaaauccuaggggcaggcaagaguuggguagaaaccauccguaaggcugaagccuuccugggaagcacgaagaggcugugcucuuucuuggccucugcuugcaucccugcauuaauuguaugugugaaucacuagagucucgggacucuguagccuaagaauuacuguggugaggacaaaugccaacagucagggaguucucggagccaacccccagccucacgugcccucucuccccugcaggaauccggguuuggaauccugccuuugaugucaccccccacgaacucaucacagguggcaucaucacugaacugggugucuuugccccugaggagcuccgaggagcccuaagugccuccgucuucucagagggacagacccuagauagucccugggugugacuggcuggcccuccgugcccugcccugacuuccucugguuuuauaauaaaguucucaaauggcuacccaaaguucaucuucacccacacucccucuuccagcugcaggaacagauaugguuugccagguucugcagaguuucagcauccacagcaaagcugccuaaggucgcgucccaggcucauccuuggaaugaucuaugcaugggaugaaagacagauguggcggucacacaccuguaaucucagcaccugggaggcucaggcaggaagauuuggaguuuaggcuacccugggcuacagauucaaacagacaaacaaaaguagagauaaucaggauguucucuuaguuacauuugaauuuuuuuguuguuguugauucuauuuuguuuuguuuuguuuuuucuagacaggauuuuucugugucuccuuggcuauccuggaacaaucuguagaucaggcuggcuucaaacucagagauccuccugccucugucucccaagugcugggauuaaaugcaugcaccacuacuggcuauuuacuuuuauuuaugugugaguguuuuacaugcaaaccccuggugcucucccagaccagaaaaggguaccagaucuccuggaacuggaauuacaagugguugugagcugccauaugggagcugggacccaggaacuaaaccucugugcuagaacaaguccuauaaaagaagacaccaaaguucaguaaucaagauaaauauuuguguuuuaaggcagucucuuuguagcucuggcugcccuuggacuugcucuauggaccaggcuacccuagaacucacaaagauccaccuaccucugccucuugagcaaaaggucaaaagugugagccccuacaaccugcuuugcuuuauucuugagagucugugaaccuggaauucagcuaucaggcuagacuccagggguccucccgcuucagccaacuuagcacugggauagcaggugugugcaccagcgaaugguggggauaccacucagguucucauacauaaacaauaugcacuuuaccccugagccauguucccagccaccaggugcauauuuuaaaucuuuuaaaauuaaaaagaacacaguuggggcugugucuauagcuguggcaacucuugugcugaaaauaugaggcugcucucuguccccagcacagcuguaaaauuaaugcauuaaugugagggauuuuuuuuuuuuagugauaucuuuauucugguuuauucugguggaagugaucuaugggagucaguucgcugccucccaagugcugauauuaaaugccugugccaccacccaggaucaaacucaaauaagcauggcagcaagcaucuuuacccaccaagucacaucaccaaugauuacugaacguuuuugacacuccuuuaauuuuccuccaaaaacgagcuccucguuuaccagacuccaagcuuuauuugaaguuuuauguauaaaaaagagcacugacugcuugugcuuggagagguccugaguucaauucccagcaaccacauaguggcucacaaacaucuguaauggaauccgaugcccucuucuagagugucugaagacagacuacaguguacucauauaaaugaaauaaauaaaucauuuuuuuaaaacgcgc

SEQ ID NO: 4581 - RNA, 4184 nt, Mus musculus
cuugcagagucacugacugaguuuauuucuucuccaucucuuguuccccggcuccugugccucugcccuccccauccucucuaucgcuccugucuccuucccacacuucacaggguccucaagcacucaguggaugcuacuuuugagaaccagggccccagccccggguaccgcauggagauguccaucuucuacgugguguacuuuguaguguuucccuucuucuuugucaauaucuucguggccuugaucaucaucaccuuucaggagcagggagacaagaugauggaagaguacagccuggagaaaaaugagguaccgcuggcuaguuguguucccuguuuacaaacugguacaaaacccacauucuuucucucucucucucucucucucucucucucucucucucucucucucucucucucucucucacacacacacacacacacacacacacacacacgcacacgcacacgcacacgcacacguacugcaagaaaccugaaugaaaacaaauaaaaagugauacaugacugccucuagguaugaagaaagaagagguuuauuguagauaaaaggagagcauaggccagagaagggacaucugggagaguccagaguaaacaugacccuacaugaggagauggggggugggggggaagggagaggagcugccaagccuggaccaagaaacuggccaagaggguaaaggguagcccaaaagaccggguuaccaaaauggcuggauuauauagggaaaggcagcugggggaagggcagcccagccuuugggcugaaaaaguuuaggguaagccaaaguuuacggaaagccaaccauaccuuguaauagguagggacugagggaugcugggagaaccucgaaaucaagucuacuuugguauguuaauggacacuucagauagccguuugucucagguuugagaccuaacaaaaccaacuuguggaaaaaauugagaacacaacaacagcaaauguuccugagaggguacagucugcaggauagcucuccuuuggauuuccagggagaaaaaaaugcagacaucaguuaucaggaggauauaucagucagucugaagcauguugugcugcaauaacaagcagccccguguaucuacagaggggcugauuucuugaucaugcuucauauccaguucaguaguccuguccauucuuucuuuauucuuauugaccaaucuagcacacaaucuucuuccaagauacuucagagcaaaggguaguaugccugugaucuagcccuugguucuucucagagggacuauaugacuuucucuaaggacauauaaacagauaucuguuuaguccagugcaccaaagacaaaacaagagacaguuccacccaggucuagcaguaugauccagugaguuuauugccaucacuagagaaacaugggugaugaguuacgauagcuguacccauucuuagaacucccuauacaguuugcaggcagcuccauggaaagucucuuccccagcagguuuuuauuacaugcauaacauuguggagaagccuacugaauauaacuuugugagcuuccuuagucaugugaguuuccugagcugagccuugucaguuuccugaacuuccugagucaugugaguuuccugaguuuccuuagcuauaugaguuuccugaguuuccugaguuuuccucuuugcuuaaggagggagugaguuuuuauaggaaagagcuacauauaacuacacaccuuccucuggcucuuacuuuuuuuucugccuccucuucagcaguguugucugagccuuggaucuggugauaaagaugccuauuucccuccauuuauagcugaacauugaaacacuuugccacaaacagccacauguucucugaaauuugaccaacuuugaaucucugcaauaaccacuaccacucagaacaacaaaaaaaaagaagugugugccuggcaaugguggugcauuccuuuaaauccaguacucaggaguauaaaaacaccccucucucucaucugcuguuccugcugccagaccagcucccugguuccagcagggggcaccaaggcuaucacuuccccuucagccacacugacuacuaaaggaacccaugcugaaugagucuauccuugagugcaggguaugagagaaguaaacacagcuuucucugaggggacagcugcuuacccugaagacgugacuagucucuuccacccauacugccugucacucucuccuccucccuucagugaacuguugcccgggguguaaaguaaaguccuacaaguucuccaaagcacugaauuuggccuccuuaguuuucuuucagaacucaccucagugcuucccaaaguugccuucaaguugucucaacugcuugcagcacuuugcaaaccugauuuacaugcuagugugagucauuaaaaaauauaccagagccucuccuaccucauaaagaccaguaaagcucugaacugugagcacagcccuauguggccuacucagcaaaggcugucacaugcccaguucccuccguaacgccuuuuccuucuggaucauguuccaguccugauauccauggagaccucaacugguuauaaccaaaucccucauggaucuuuuuuucuuccgagacaggguuacucuguguagcccuggcuguccuggaacucacuuuguagaccaggcuggccucgaacucacaaaucugccugccucugccucccaagugugggauuaaaggcgugcuccaccacugcuuagacccucauggcucucuguaagccagucccuuaugacuucaggcccuguagccuuuguaggucuguagcucaguucugccuccacagcaccuggacugacagaugccagcagcuccugggucccagagccucccucacgggccaggagaagcaaaggacucaaagagaaagaauaauuuaucuggccacaguggcaaguacccagaagguggagcaaggggaucacuguuuugaagccagcaugggcuacagagggacauccugucucaaaaggagaggcagcugcucugcagucgacuccuugcuggaaguccugaaagcccugggcuccugucccaagcaccauagaaacucaucaugaucacauaggcagcuuggaaccaggcugggcuacauaaaauccugaggauggggcggggggguggggaauauggggauauggggguauggggggaaaggagggagggaaggagagagaauguaaagagggagcuguggggccugaagagcacugcuucacagugugcuuuccucagcugugccucaagcccagccuuucagaagugguuuuccacaucugcaagcuaguacuguagauaacuucuuacaaggaagauuccaagagaagcagggagguguggugacuucccgauuuggaauagacauagaacugucagguuuuauaaggggccuucaaggacugcagggaucccaucuaggcccagcacaacaagggaucuggacaacugcaccaggagggaggcuauaaauggcuggcaucccucccugcuguggaccccucucaugcccugacaucucccacagagggccugcaucgacuuugccaucagugccaagccgcugaccaggcacaugccccagaacaagcagagcuuccaguaucgaauguggcaguucgucguguccccacccuuugaguacaccaucauggccaugaucgcucucaacaccaucgugcuaaugaugaaggugagccccaccacccucccaauguaagacccacgcacagcaucccagccagaccacacucugccacugagccuucacuguuccaccuucugccugccaugccagcuccuuccuuccucccagcuacuuaaacucagccuggggcugggcucugcaguucucugauauugccccacauaccuccaucucacaugguugcacacuccacagucccaccagucugcacuccuugggagucagaugccuggcuuuuugagcgcagccggagccucaaggagaggaggagacacccuccuugaaggugugccggguggaacaugagaacagaucagagggggacuuccagagcuucaaggguccuagcccuacauggggguccuaagcagggacgcuaccucugagccauguccucagccacug

SEQ ID NO: 4582 - RNA, 4799 nt, Mus musculus
ugggcagaguaugacccugcugccugguaaggaacugucucagaucuucuggcuguauugucaccuccuccugaaacggggacaagaaugaaaucaggucauagguguggaacacugaguccuaggaucucagcagggaccucaugagugaguccaggguagaaaucaugacuuucucaugagugaauccaggguaagagucaugacuuucucacuacccaaggucgggcacuuuccacccuuuguccaagcccaagccuuucuagauggagguagucaacuaugaagauuuucuaggauccccgacccccacaacuccucuggucucuuaugguuaggccucugggugauagccuacauuaaggaccccugggcuuuauucaccagggaguacaggcgcaacacuggcccaccuuggcacaugcccuagggucagaguggcagaaucaaguucaaaccuuagagcaggcccaaacaucuugacacaugugagcaaucccagcacucaaaaggcugacgcagaagaaucaggagugaaaggccauccugggcaacaagugauuuuguuuuaaaaacaaucaaagcaaaccaggcaugguggcacacagcuuucaucccagaaaacaggaggcagaggcagauggaucuuugaauuugaggccaacauaaucuacacagugcuuucuaggccagccaaaacuacauaauauaugagacuguuucaaauaaaaagcugggcauguggcacacagagaguuucaggauagucagggcuacacauagaaacucuguuucaaaacccaaugcugaugagaagaagaagaagaagaagaagaagaagaagaagaagaagaagaagaagaagaagaagaagaagaagaagaagaagaagaagaagaagaagaagaagaagaagaagaagaagaagcagcugcauacaaaaagaggcaagcauggugguauacaacuacaaacccagcuuuuagaaaacugaggcagaaagaucaggaguuugagggccauuagcccccacuuccaaauaaaauuuuugggcaagcaagauggcucaguguguaaaggcacuugcugccuagccugccgaccugaguccaaucaccagcauccacgcacaugaugagaagccacucccacacauuguucucucucucucucucucucucucucucucucacacacacacacacacacacacacacacacacacacacacagaguguaauuucuuaauuuaaaaaugggucuggagauacagcuccguggugaaaaacacuugaagcccuugcagagaaccuggguucagugucuuagaguccagccccaggggaucuuaugaccucuucuggccucuguaggcacccacacacauguacauacguaaacaguacauuucuuauuaaaauaaaaaaugucaaggucuaagaauguggcuggguggcagacucuugccuagccuauuugaggcccuuagucccaucucccacaccuggaaaaauaaaauaaaagccuucaggcacgucccucagggaggucccacaggcagaucacacaggaccgagggaggggagcuugcauccuacugaugaaggcaagauugaguuucccuaucucacagagacucccagcacaccgugcacuaacucacaggagaucacacaccucuuagacuccguggaguguaccgaggcaguaccuccaaaguggcagaacaaagauucuagcucauucugggcacagggaugaaggaguguuggugggugggguccccaguggucugugcucugcuuccauuggucucagcuguggaggagagacccacaagaaaaugcagagagcuaucggucugucucuccgauggcagcagccccagcccucaugaguuggagaggcucgggcaaggcauguugcugggacugguuugggggccuuuuuuaacuuuuccuuuuugauuuuaggucacuacggugggaugcugucccuuccucuaggccacauacccacccacaucaguguagccuauguaaaugagaaaggaaauagaugcacaaaggagcccuggguagaaaggccacugccuagaaccuccagcgcccaugccccauaaaaaccucugucccuaagggcaggugcauaaacgucuguaaaugcauccaagccuuuaccgucccagguucccacuccuucaaaugaggaggucucagccucaucucccuggucucacugugcuugggaagcccuuuucauggggaccaacccaggaccuccacuaaccccucucuucuccuuucagcggccgcauucacuauaaggacauguacaguuuauugcgaguaauaucgcccccucucggcuuaggcaagaaauguccucauaggguugcuugcaagguuugauuuccacuaaaaccugcuagcaucgguugaaugaguguggcuuggggucuuccauauauauauuucauauauauauauuucucaaaaacagagccaucucucucucucucuugcauuaaacuagcaaacucuuagccuccagaaugcggccaugcagacuccacgacgcaugggacacgccucccuguuccuucugaacaccugugcuugcucguagcugcagcugccaucccguggucucaaugacacccccaaaucagaugcaucccuugggggaguuguaauuuugcauuucccucucccaacucccuccuccccacuccccacuccugaagccuccagcccucuucccaacggccaugcccugcccuagcuccucacccaggcccccucagagaccagccucagccaaaccagacacucggccccuaaacaguaagacccugcagcucugcaccuagcugagccacagcuuggagcccaaguggaaucugacuguuucucuuuucucucucucucugccugcuuguaagcagugaaauaaucauuuuuaauuaccuuuucuuccauuuuucuccucuuuuccauuuauuuaauauauccauuuuauuguccucugccucuuucucuauuuuuucggcucgugugguuuuuuuuuucuuuuuucuuuuuucuuuuuuuuucuucuuuuucuguuucuucuccgccuuuccccucacccuuuuuuguucucugccccacccacccguccuguuuuuuguuuuuggugcugccaggggucgcaugccuuacccggacauguaucagaugcugagacacauguccccgccccugggucuggggaagaagugcccggccagaguggcuuacaagguagucuaucuuugccaacaccgaugucccagagcuggggauuuuucgguggugacuacaacacccaacgagucuucugccaacauuccucuucuuuuuuuucuuuuuuucuuuucucgaguaacugagucaugagcgucccucgacucucagcagcgcgcuguguccuuucugaugagugucugcguguuuugagacuccauuauggccgacaagccacggggagggggagggagcacuacaaucccccuaguacccacaugaccacccuugggaagccaaauuguaugucucugcccauccaaaaacaugccccgccccuccccaggcccaggccagacuguguucugugccuugagcccuaggcccuggccuccccacccacaucugaagcugaccucugacuuagggcccuggagaucugacaccucucacagcugaguuuccccuuccccuccccccaaccccgcccugaaguugucuucccagcccugaaucaugccacccaucuacccaagaugccccaacauaccucuccacuccauuguuucagagcaagcaggagggcugcagccgccccaaccccgaacguggugcaccaaucaggccuugcacgcugccuuggaggggccugggggugggaggggcguaugccagcugagggagcgaggagauugcugcuccucuagacuucuguccuggaaucucccccggcccuggaggacaucugcucccucaguucauccucgagauggccagggaugaccuucaaaccccaugccccagaagugacuccguagcccagccuucccccccaccuauguccccuucucccucccguacuaccccaaugauguggcaguuucccucucagauuucagccucuccccacaagugucccucuuguccguccgugcccccacccccagcccccagcccccagccccauccugaucucuggaaaccaacgugcucccugaggcaccuuuguguacauuuaaaguagaguguuuucagaacacugcugggaaagugugcuacagagaauacacuuuccugcugcgcagucugugguuuccuagcaaagagcccuuugugcagugcacaccggcccaagugugcacacugcccuccuuucuguucauugccucagucacugcccuauuccaacaucccacuuccuacccuaccccuggcuuacuggcucccacucucugaauccccuggugagccccagacuugcccuuaacaucuccccaagccaauggcacaucgaagcccaacauuucccccuccccaagccaccaagcaagacagaaccccugucugggacacagaauuccuuuccugggccucaggaaugccccucgcccccuuucccugcuacugcacagacagccaugauccggcaagccccgacagucacuucccacggagcuaugaaugagucucgagauuccgucugcaugugcccguuuguaccgcucuguguaggccucgcugcauguccaccag

SEQ ID NO: 4583 - RNA, 4799 nt, Mus musculus
cugguggacaugcagcgaggccuacacagagcgguacaaacgggcacaugcagacggaaucucgagacucauucauagcuccgugggaagugacugucggggcuugccggaucauggcugucugugcaguagcagggaaagggggcgaggggcauuccugaggcccaggaaaggaauucugugucccagacagggguucugucuugcuugguggcuuggggagggggaaauguugggcuucgaugugccauuggcuuggggagauguuaagggcaagucuggggcucaccaggggauucagagagugggagccaguaagccagggguaggguaggaagugggauguuggaauagggcagugacugaggcaaugaacagaaaggagggcagugugcacacuugggccggugugcacugcacaaagggcucuuugcuaggaaaccacagacugcgcagcaggaaaguguauucucuguagcacacuuucccagcaguguucugaaaacacucuacuuuaaauguacacaaaggugccucagggagcacguugguuuccagagaucaggauggggcugggggcugggggcugggggugggggcacggacggacaagagggacacuuguggggagaggcugaaaucugagagggaaacugccacaucauugggguaguacgggagggagaaggggacauaggugggggggaaggcugggcuacggagucacuucuggggcaugggguuugaaggucaucccuggccaucucgaggaugaacugagggagcagauguccuccagggccgggggagauuccaggacagaagucuagaggagcagcaaucuccucgcucccucagcuggcauacgccccucccacccccaggccccuccaaggcagcgugcaaggccugauuggugcaccacguucgggguuggggcggcugcagcccuccugcuugcucugaaacaauggaguggagagguauguuggggcaucuuggguagauggguggcaugauucagggcugggaagacaacuucagggcgggguuggggggaggggaaggggaaacucagcugugagaggugucagaucuccagggcccuaagucagaggucagcuucagauguggguggggaggccagggccuagggcucaaggcacagaacacagucuggccugggccuggggaggggcggggcauguuuuuggaugggcagagacauacaauuuggcuucccaaggguggucauguggguacuagggggauuguagugcucccucccccuccccguggcuugucggccauaauggagucucaaaacacgcagacacucaucagaaaggacacagcgcgcugcugagagucgagggacgcucaugacucaguuacucgagaaaagaaaaaaagaaaaaaaagaagaggaauguuggcagaagacucguuggguguuguagucaccaccgaaaaauccccagcucugggacaucgguguuggcaaagauagacuaccuuguaagccacucuggccgggcacuucuuccccagacccaggggcggggacaugugucucagcaucugauacauguccggguaaggcaugcgaccccuggcagcaccaaaaacaaaaaacaggacggguggguggggcagagaacaaaaaagggugaggggaaaggcggagaagaaacagaaaaagaagaaaaaaaaagaaaaaagaaaaaagaaaaaaaaaaccacacgagccgaaaaaauagagaaagaggcagaggacaauaaaauggauauauuaaauaaauggaaaagaggagaaaaauggaagaaaagguaauuaaaaaugauuauuucacugcuuacaagcaggcagagagagagagaaaagagaaacagucagauuccacuugggcuccaagcuguggcucagcuaggugcagagcugcagggucuuacuguuuaggggccgagugucugguuuggcugaggcuggucucugagggggccugggugaggagcuagggcagggcauggccguugggaagagggcuggaggcuucaggaguggggaguggggaggagggaguugggagagggaaaugcaaaauuacaacucccccaagggaugcaucugauuugggggugucauugagaccacgggauggcagcugcagcuacgagcaagcacagguguucagaaggaacagggaggcgugucccaugcgucguggagucugcauggccgcauucuggaggcuaagaguuugcuaguuuaaugcaagagagagagagagauggcucuguuuuugagaaauauauauauaugaaauauauauauggaagaccccaagccacacucauucaaccgaugcuagcagguuuuaguggaaaucaaaccuugcaagcaacccuaugaggacauuucuugccuaagccgagagggggcgauauuacucgcaauaaacuguacauguccuuauagugaaugcggccgcugaaaggagaagagagggguuaguggagguccuggguugguccccaugaaaagggcuucccaagcacagugagaccagggagaugaggcugagaccuccucauuugaaggagugggaaccugggacgguaaaggcuuggaugcauuuacagacguuuaugcaccugcccuuagggacagagguuuuuauggggcaugggcgcuggagguucuaggcaguggccuuucuacccagggcuccuuugugcaucuauuuccuuucucauuuacauaggcuacacugauguggguggguauguggccuagaggaagggacagcaucccaccguagugaccuaaaaucaaaaaggaaaaguuaaaaaaggcccccaaaccagucccagcaacaugccuugcccgagccucuccaacucaugagggcuggggcugcugccaucggagagacagaccgauagcucucugcauuuucuugugggucucuccuccacagcugagaccaauggaagcagagcacagaccacuggggaccccacccaccaacacuccuucaucccugugcccagaaugagcuagaaucuuuguucugccacuuuggagguacugccucgguacacuccacggagucuaagaggugugugaucuccugugaguuagugcacggugugcugggagucucugugagauagggaaacucaaucuugccuucaucaguaggaugcaagcuccccucccucgguccugugugaucugccugugggaccucccugagggacgugccugaaggcuuuuauuuuauuuuuccaggugugggagaugggacuaagggccucaaauaggcuaggcaagagucugccacccagccacauucuuagaccuugacauuuuuuauuuuaauaagaaauguacuguuuacguauguacaugugugugggugccuacagaggccagaagaggucauaagauccccuggggcuggacucuaagacacugaacccagguucucugcaagggcuucaaguguuuuucaccacggagcuguaucuccagacccauuuuuaaauuaagaaauuacacucugugugugugugugugugugugugugugugugugugugugugagagagagagagagagagagagagagagagaacaaugugugggaguggcuucucaucaugugcguggaugcuggugauuggacucaggucggcaggcuaggcagcaagugccuuuacacacugagccaucuugcuugcccaaaaauuuuauuuggaagugggggcuaauggcccucaaacuccugaucuuucugccucaguuuucuaaaagcuggguuuguaguuguauaccaccaugcuugccucuuuuuguaugcagcugcuucuucuucuucuucuucuucuucuucuucuucuucuucuucuucuucuucuucuucuucuucuucuucuucuucuucuucuucuucuucuucuucuucuucuucuucuucuucucaucagcauuggguuuugaaacagaguuucuauguguagcccugacuauccugaaacucucugugugccacaugcccagcuuuuuauuugaaacagucucauauauuauguaguuuuggcuggccuagaaagcacuguguagauuauguuggccucaaauucaaagauccaucugccucugccuccuguuuucugggaugaaagcugugugccaccaugccugguuugcuuugauuguuuuuaaaacaaaaucacuuguugcccaggauggccuuucacuccugauucuucugcgucagccuuuugagugcugggauugcucacaugugucaagauguuugggccugcucuaagguuugaacuugauucugccacucugacccuagggcaugugccaaggugggccaguguugcgccuguacucccuggugaauaaagcccagggguccuuaauguaggcuaucacccagaggccuaaccauaagagaccagaggaguugugggggucggggauccuagaaaaucuucauaguugacuaccuccaucuagaaaggcuugggcuuggacaaaggguggaaagugcccgaccuuggguagugagaaagucaugacucuuacccuggauucacucaugagaaagucaugauuucuacccuggacucacucaugaggucccugcugagauccuaggacucaguguuccacaccuaugaccugauuucauucuuguccccguuucaggaggaggugacaauacagccagaagaucugagacaguuccuuaccaggcagcagggucauacucugccca

SEQ ID NO: 4584 - RNA, 1769 nt, Mus musculus
uacuggcagccuacuacaaaacugggucggaccucaacuguggaaccucaguuuccuuuuuagccaaugucaauaaucuugcuuuuguguaacucuuaugggaugacagcgggauacggaauacauuaauuagcuagcucagcgguuguagcugagcacgguggcucacgcuuuuaauccuagcacuagggaggcagaggccagccuugucuacaaaaugaguccuaggacagcuagagcuacauagugagacccugucucaaaacaaacaaaauaugauugcuguucucagagaacacagguucgauucccagcgcccacauaacugacccaauguccggagauccgaugcccuccucuggcacaggcaugcaagcagguaaaauacaaaaagaaaaaaaggagaaaagaaggagaaagaaagaaaaaacacucagaagcagugcaggacagcugaaacuauaaaggugauaucuuguuucaaaaaaaaaaaauuaauaaaaggccagcaagguggcucagcagguaaagggacgugccgccaacacugaguacacggguaguuuccccaggaagacgggaagaaagaacagcccaagaacugaguacuuuguccucuacauaugugagugcaggaggguuucgaagauguuuuuccguaacuccacagggugcgaaucucacuccacccggacucaucccgcaugacggugccgcagcgugugagagcaugagagaaggaaacaucgaguucucuccgggacgccgugcagacuguccaaagaacuguagcaccaaacagacucgaacgacccgagacaacacuuaguuaggcuccugagggcuggauuggaggggcgugcucgccgauggaaggggccccgccccggaagcccucuccucgggcuaagaccggcugcccuuguucuuauaugggcauccggaagugguucgcggcgccaaccuacgucauuacauccaaauuuagccagggaagucggccggcugcaguggcgggaagucugcccgcuggcaggggguguuucuuaaagggccugcacagcaaaugaaagggguuauuugaauuuuucucccuucugcaacuagaagcaaguuuuucuugggaagugaugcaaaguggaaccgacuucuuuuuuucuuuucuuuguuacugugugugugugugugugugugugugugugugugugugugugugugugugugugugugugugugugugagacaucguauagaagucuguucucuuguacggcgugggaccggugggaccgggaaucgaacugaguucguuaggcuuggcaacaaguggcuccacccacugugccaucucgacccagauaucugucuuucuuggaguaauuccguucacgagggcaugaaggcagaaaacugcucuauugacaagggaagaucgcaggcccuauggacauugggacuuccaugccacuggguugcggaaaacugggagaucuuuaacgcugaaaguaaagagcagucgugaggugguggauaucugugguuacgggguacaguguccgugcccacuuuccacccauguccagaaagguggagauagaagggcugcaggcuuuaguugauccuuucgccauaguauaaucauauaaucauucguuuaguaaauauuggucagguggcugccuauuucucaccuggaaaacuguaucuucuauggaguggaggugagagaucagagacauugaauaaaaagagaaaguucaacacuguag

SEQ ID NO: 4585 - RNA, 13504 nt, Mus musculus
cugaaaagagaaagccaaagacccagcgguggcgaguaaucaaugaacuagcugguuccacgcuuagcauacaaccugcccuagaaggggcaccaaggagggagggaaggcccugggaccaggagcccuccuucucccucccccaggcacaagucaggauguguagguaccuguuuugucucaaagacacaacagagcuucaggcagucaccaucccaggaggcgacagaauauuuuaucucccaggaggagacagaauucaggcccaggcagcagguugggccuggaaagcuagggcguauugcaacgcugugagggcucaucuucuagacuggagcccccagguuccggcgccagaaggcugagaacgauuucaggacucuagaauaaucagguaaugucugcugggcugccuccauagugggugggguagggcgguggguugaguaggggccauacacaccgaaaacaagauguuugaacuagguauccggugcagcccacgcuaacucccauccagccgcuggccuguccuuguuagcaguuggccaaggugucagagaagaggcgugggaaagaggaaccccccccccccgguucugacccuaagcaaacauacggagauguguguguguggggggggcagaucccuuagcucacaccagguuuuccuaaccugcuccccacauccuaaaccauaggcccugggccgccugcaaacucccaacacgcccagccuuaccugaugcccucccgucggaguuuacccgcacaucucuagucucugaccucgugcgacccccugcaaauaucuuagggcucucuccaauccgcccccacucgagcaagcuccgcccacccccccccaagucuaacuucccgggcuuuuccucaccuccccccaaggccuguaaccugacccgcccacccccuuccccagcgcccucuaccugcaagcuccggcccucccgcaccccuccaggccuuuucccucgggcggcgcagcccuccgcccucccaccccccgccagcccgaggccuccccuccccccuccagccucgccugccggcuccacgcgauuacccccuccggcccugagacuucaaggaucccgcgacccgcgccucccccgagcggccuucaagcccugcgggccgggcccgcgggcuggacgcuguaggccgccagcugagauucggccaucucacucuugcccucccgccgcugucagcgccgcgggcucggcuucugguucgcagcagggcgcccggaggccucgccucucggcccuccgccggaaccucugauguccucgggccgccccgggcgggaggaggccggaauugggccuggggcgggccaucucaccugcgcuguggccgcgcuccggggccucccggcgggcuccgcagcggcagcuggggccgggccugggcccggggcgcgccucccugcgccucggccucggccuccgccucugcggccuccgcggccuccgccucagcagcagugguagccgcggcggccauucauugugggccaggccgccccagccgagcgccgaggaagcgcacggcgcugccggcagggaggaaaacugccucggccccgccccuuaggcaagcuuagccgcgcuucgagcgcuucgguucucaccagcuccucuuuccucccgggucucgguucuguagacgggcuaaguugagugacugcgggacagguugcucuguaucuuggagcuucaguuucuuguaaaaugagaacaacuguuguuccaggaacaguuuaggcucuuuguggaaaugagguuucauggagcugagcugaguaaacuaucaagaucacaggaaagugaauacgaagauuuaaacuuagguucaagagguuaauaaagugaaaacucaggaugcuuaugcgaugugaaguucuguuagcauuuugcacuaacucagauaauuauacgucuuauaacuaauguuagagaggccugacuacuuuuuggauggguagcagagucaagaacagaagagugcggacuggauuaagagugucuacuggccgggcaaugguggcacacaccuuuaaucccagcacuuggaaggcagaggcaggauuucugaguucgaggccagccuggucuacagagugaguuccaggacagccagggcuacacagagaaacccugucucaaaaaaauuaagaguguguacugcucuuguugaauagaguucaguucccagcagucaugucagauggcuacaguucuagaaacuaucaccuuuuugcucuuugaggacuuacacacaacugcacacauacacaaaaauaacaaaaaaauaaaauuuugaaacaaaauaaguaccguugggccugguagaaaugccugaaaucucaccauaugagagacugaggcaggaaacucuaaucugcccugggcuauauaacuccaggacaaccuggauuaagagugcccucuacccccaauuaacagauaacauauagcaaggcaagcuaagauaacucucacaucccggaucuccauauuuuccugaugcauacauuaggccaacacucagucugaguggcuccuuugcacacuucccaggcauucgguuauuuaaucuuugcccuugacagcuaagauuccuauuuaacagguaagggaaauaggagccuuacauuuuaauuaacuugcccagaguacguggugggacugagauucaaagacagugaauacuauucuagagccugaguuaaccuacaaggugcacacagaagacaucuaaaggugcagagugccuccgcuuuuugcccugaauuaaacuagugaaacucccuuguagaagaguuguauuauuaagaaucacugguguaguguagccugcgcacuuccuucccuagaagagucuugacccuggucgcccacuguagguaaugucucuaauuggucaguuauugucaugugauuggcccgcccucuuugccaacauggcggcucccaggcccuaaugcgagaagcaugcaccgugacucguuggauccugugagcggaagggagacgcuuguccggguggguggguggguggguggguguguggguguggugggaaaccugagccgaagagagaaguuuguccggguguguguguugggaaaucugagccgcgggccuuagccucuguuggguccagugcccucgagaacgcaggauguuauggaggccaccggauuuuaguuucuacuuuauagauauagaggccacccccgccccagaaugcagcucucugaccucccuaugccuuuucccuucucucgaaaacggcaggcggguugaggcgcccgcggaugucccucgcgaggacgauccuguggcuaagccguccucuccguccggcccacagccucuguagagcucaguucauggaacggaaggcccagaagccucccucuccaccagcgauggagaacggcacccgguccugggaagagcgcccacccgcggacccgguugcgacugucacugagggcgccgccaaaaucgucuuucccagugcuaacgagguuuucuauaacccggugcaggaauucaaccgggaccugacgugagcaagggucgcggguuagcuuggccaaggggaguuggucaguuagguagagguuguacgagaauaucaguccgggacgcggcacucaaaggaagagaaaaguugguagagaggcgucagcauuagucgaaggccaacaucuugaaagaugaaggcacauaccggauuuuuauauuaagugccaggacuauacauuccuuuuaggguccuccuguguucaagguguguggcuccccuuuucccuuuacaauguggucguggacuuugacuuccgagaguuaauuccuguaguuguauucacacagaccuguuacuuuucugcaagucaaauuucacgucaguuuacauacauugaauugaagaggggggggacuuugcaaaagucaccuuacgguuuucuggguuuaacuaaagauagagcaguuagcauuuuuagccuuugagaugggauuucucuacuagaauuuggggcaguaaggaagggacuuuauggauuagggagggacaacaaccuuuucaacugucaaagggaggacugaggaccugggccacagcuaaggagcuggcauacaaugugaccaccucccuaccauccccuccuccaggugugcugugaucacagaguuugcucgaauucaucuuggggccaagggaauccagagugaguggagguucaggccuggggggaagaguaucacucacaaaguucacuucccacuucauccacaccucauuuagguuccugaaagcucuaggcucucugcucuuucugccuuucuccuggggguucagggaaacaccuucuugcaugaaucaucaggauuuugaccauuugaaaguuacggugaaauuucuuaaaaggaucauugauagucugguuuuugccugagugacugcagucaagguuccaggagagaaggacucagagaaaauagcuguggacuugucugaucaagaagaggaaacagcuggaaagaaugaaaaucuggccccaggggacuggccacggacugcugcagugggugagaucugugagguacgggccucagaaagaaguggccacuugggaguuugggugagaggaaggagcugaggggcucuagaaagugguugugggagauccaccacagcccagaaaaaaaggagaccuggacaucagucagagggauagcucccugggaaagcacaugccacaagacccuugagaguuugauccucagaauccaguuaguuaggagccaugugggugcuguaaaauggugggaggagagaacugauugaauuguaaaugaacauuaaaacagaaauaagacaugucuuucuuugccuccuuccaauaggaaggucuacgagugcuggaaggccuggcagcuuccggucugcgcuccauccguuuugcccuggagguuccuggccuccagucugugguugccaaugaugccucugcccgggcuguagagcuuaugcacagaaauguggagcucaaugguguggcacaucuuguucagcccaaccaggcagaugcccgguagguugauuagccauugucauugguggugguaccggagauagagcccaggccuucaugcgugcuaagcaguggcugagcaacagcuccagcucccaagaggucccuggaaugaggcuuucuggggacuaauccuaacccuguuuagccuugggucauacucuuugaacucuuuuuuuuuuuuaagauuuauuuauuuauuauauguaaguacacuguagcugucuucagacgccccagaagaagguauuggaugcugugagccaucaugugguuguugggauuugaauucacaaccuucagaagagcagucggagcucuuaacugcugagccaucucuccagcccccucuuugaacucuuuuuuuuuuuuuuuuuuuuuuuuuuagauuuauuuauuuauuauauguaaguacacuguaucuaucuucagacacuccagaagaagcaucagauuucguuacggaugguugugagccaccaugugguugcugggauuugaacucgggaccuucagaagagcagucggcgcucuuaaccucugagcuaucucgccagccccucuuugaacucuuaauucccuuguuugugaaagaauaguaauuuuacagggguuaugcaguucuguuuuuauuuuauuuauuugugcaggagaggccaucaguagguccucaggcuuguguugaaaguacuuucaucuaccaagucaugggaacaucauguagcugaggguagucuagaacuuuaugaacauuuaaaaaauagauggacuucauuuuauuugugugaguguuuagcuugugcaugugugccuggugcccuuccaggccagaagaaggugucagacacccugaaaagggaauuauaguuaguugugagccaugugggugcuauaaaaugaauucaggcccucugcaagaacaacacaugcucuuaacuggugagccaacucucuggccuuuuuuauauuuuuaaauuacaucaagcauguauguguguguucguuuguguguuaagaggacgguuuauaggagucacuucuauccuuccacauguggguccagggauccaauauguagcccuggcuggccugaaacucagagauuugccuccugagugcugggguuauuagcacacuggacucugacuaugacuuucugauccuugagucuuuaccugaauguaggauuauaggcaugugcacuaugccugguuuauucaggaaaggggaucagauggaguguaacgguagauaaguacucugccaacugaacuacauccccagcacacacaccccuuucgguaaggugaagucucauguaguucaugcuggccuggccuccccuuaacucugugggugugaccucgaacgauugaugcccaaccuccagcuuuguacgaggacuuuaggcuugaugacaggauuccuggguuuuguuuuucugguuucuugagacaggguugcucuaucugcccuggcucuccuggaacuagacugaaggagauaggcuggccuugaacucacacagaaccaccugccucuagugccuggaucaaaggugugagugaccaugcaggcccauagcagccuucuuaaauaauagaaguguauagcccacacuuuguaaagugcuaucguuuaaugaugagaaauguaucuacaucuagggacuuuguuuugacauguggucugaccaauuugaacucaagauuuccuucagccucccaagcaguuugagagcuccaggaagucccuuucuuccuuccuuucuuuuuuaaaaagaucuauuuauauuauacuguagcugucuucagacacaccagaagagggcaucagaccccauuucagaugguugugaggcgccgugucguuguugggaauugaauucagaaccacuggaagagcaguugguacuuuuaaccacugagccaucuccccagcucugucccuuucuuuucuaacuuguuaaccuuauaguuguuuacauugcucauucuccugccucaggccauuucucuaggaagcguaguuuacacugcucaccccucccaccgccucaguguagcugcccuacauucaggcugucccucggagaccuguucccacuuuguugcuccaccuccuuugacaagugccugcccuuugucuuguuuuuaaauuuccaagugccugccuuugccucucgagugcugggauugaagcugugcacuagcacaccuggacuuuuuaaaaacuuguuuguuauuguucacagccacccaaccugugugguaugaaacaaacuugugugcucuucugaaccaacuccccaucucugcccaccccaaaaucuuucccccccuuuuaaguagggucuuacuguguagcagaggaagucucaaccucaggcaaucccucaccucagcucuccagcugcagggagcacggcuaugcuauaccuuagugguagaguacucauguagcacagguuagccugugcuuaggcagguaacuaacuaaugcuauagacugccguaauagugcaggugugcaucgccccgcugggcuuuugucaugagaacaccuucgagugcacucacauaguaggacugcaaagauagcucggggacuaaaagcgcugccugcucuccagagaaccugggucuuguuuccaguaccaucaaggcgacucgaaacugcuuguaacuccaggcccaggagcucuaacucccccucuguccuccgagggcacaagaugcacaccaagauaugcacaugacacacagacauacgugcagacaaaacaccuacacacauaaaaaaauaauuuuaaaaagaugucagcagacaagagaaguuguugguugaucuggccggcucagcguuuuuccaucucccuggaguauacagaugcaugugucacugaaccugguucuaguaguagaguuuuuguugcuguuugcuugcuuuagguaugaucuguuucccaggcuggccuugaacuuguaauuuuccugccuuagccucauaguuagcuaggucugcgcuaacaggcuugguguggacccaauuuugguuuaaguuuaauugggggcggggagggggcaucauguguguauuacuauugccaagcaguggucagaggagcaacuuguggcaugugggaguucuuuccuucccaccaugugggaucuggaggucauauugguuuguccaaucuagugauuggugucuuuauccagugagccuguuugaaauuuggggggggggugcgggaugggggaggaaggaaggauggaaggaagggagggcaugugugugcgcaugagggagcacacaugcagcacugugaagcugugaguccuggcaccugaggaggucagaagaggaugucugagggagucaucacagcaccggugcugagugcauacuugugucuuuugugagagugacguucucucaaccacggagcccucacagcuuagguucuuuauggcuauaaggguugagggaguggucuuauccucuuggacuguuauuugucaggguuauagguggggugacugaguccuguguaaaucaagaaaucaguuaacaaguggccaaaggggcugggguuuagcucagcauuaaaacacuugccuagcaugcaugagacccaggguuccauccauauggcuaaacuguaaagaaaauaucaaaugccuaagcuagccucaaauucaagagcaaaaccacugugccauagaggacagggcaggggcuuuguugaaggguugagaacuuggaccccucacaucuaggaugcugauguaccaacaccaaaaggcaccugagcgauuugaugucauugaccuggaccccuauggcagccccgcccccuuccuggaugcagcagugcaggcugugagugauggaggugaggcuggcccguagcauugagaacacccaaucaggugugggggcagaguuguuuggagggucaucacuguccaucuccuccccacaggacuucugugugucaccugcacagacauggcaguccuggcggggaacagcggagagacaugcuacagcaaguauggggccauggcccucaagagccgagccugccaugaaauggugagacuacccccaagccagccuuggaguuggggaauaggcucugagcauuccuacccugacccuucaagcacaccuuccuguccugaugaugcucaguguccucagauggucagaacuggcccauuccaagcucugaugugacugccaaacugaccuuugacauccuuguucaauaggcaguaauauuuuuccuagcauucuauaguuuaacuuaguuuuuaaaaguauuuuuguuagguaugguagugcaugccagcacuuaggaggcagaggcagguggaucucuugugcuacucgucugggcuaaauacaguuccaggauagccaaggcuacauaauaaaauccuguuuccaaaggaaaaaaaaaaaaagcuuuaauauguauguauauauaugugcgcacacacacauaccccuuuuuuauauuagggaggcaugugugccauggugaagucaggacagcauccuggaguccuuucuuccuuucuaccauuuggauccaguaucagucuugguggcaggcgucuuuacccacugagccaucuugcuaccccaaaauggggauggcuuguauuccaagcaggaaugugugaccgcucacgcacugaaucacagacauagcacucugaauaaaacuagguuuucagauuauaccggggaauggauauugugcguucaaaaugcuuuaccacugagcuauguccccaauacaagaagcccugguguugaagguuugagacaggcuuucuuguagcccaggcuggccucaaacuugcuauguagcucaaguucaacuuaaacuccugaccuucccaccucuacuucccaaaugucaggacaaaaaaaaaaaaauacuuaaggauugcuuuuccagaugugagcucugcucagccuguggcucuaacagcaccucucugggccauaguuuugcaucucuuguggcaucugcucuaugcuugggaagguuacuaugggaagguaaggccggaggggagggccaaagaaagguagauucuguccuuguuucuuaaggucucucgacaucuuucaagccuggguggugccuuuucaugucagaggcacacucagcuugugggauaggaucaaaucaccuaugcaggcuguggucauuuggugccugcuaccagccacaggaauaacugacauggcucuguagauggagaaacugaggaacagaaaauccuggcuugugguagguucuaagccaaagaugcauuugcaaauuuguuccuccuggcguuaacgcccaucccugcuaccaggcccugcggauugugcugcacagccuggaccugcacgccaacugcuaccagcgcuauaucgugccgcugcucagcaucagugcugacuucuauauccgggucuuuguacguguuuucacaggccaggccaagguuaaguccucagccagguaagccuacaggaagggaaccugauggacugagggaguggauaagagauuuguccugggaccuuggugucagucugaaggaagaguugaguuguagugaccauaucagggacucaugaucucuccugggcucccacagcaaacaggcccugguguuccaguguguggguuguggagccuucuaccugcaacgccuuggcaaagcaucaggagacccugguggcagguaaauaauguggguuggaaugagggauguccuagguccccaucccucuaacugccuguccuugcaggaucaaguucucugcagccugugguccuccaguaacucccgagugugagcacuguggacagagacaccaggugggcccaggucagaggcagugggccagaaucccgggacucauacauucaugccccuugcucaucuguaucccugguguccacagcuugggggccccaugugggcagagcccauccaugaccuggacuuugugggccgaguucuugacgcagugaccacgaauccuggccgcuuccacacuuccaugaggauccaaggcguccucaguguuguuacugagguaugagcuggaccuacacaggaaaggggacccuccuugcccaacuuugugccagcacuccaugcuacuccauccuuaccucucaggaacuuccugaugucccucucuacuacacacuggaccaacugagcagcacuauccacugcaacacaccccgccuucugcagcuucggugagggcccuuguggggcaguuuggaccaucagaaucugguguaugcuuagggcagagcugagaggucaugaucccuccagcaggugcuuuguuguuuaauuuuuuauguacauguguuuggccuacccauguguaaguaaguacaccaucugcaugcagugccugaagaggccagaaggugucagcuucccuagaacuggaguuaacagaagauuguaagcugcgguggggaugcuggguuucaaaacccagaguucucugcaagagcagcgaguggucuuaaccaccgaguuuucucuccagccccuggcagguagcuuugacgucacagugugaccuggguugcugugaacaaaauggcuaugccauuccacaggaccuggcuugugcccaccugggugagccugugcuuuggggucuagccuccucuuuguggucucuguguacccaggucagcucuccuucaugcugguuuccgagucucucucucccaugcuuguaagaaugcagugaagacagaugcucccccugaggcccucugggacaucaugcguugcugggugagagcaggugaccccugguucaaggcaggagggcaaggaaggggugguggccugggugcuccuugggcuuaccauguccuugaucucuguccccaggaaaaggaauguccagugaaacgggagcggcugucugaaagcaguccagcauuccgaauucuugcuguggagcccagguauggacagcuaugcagggaacaggcuaccccucaggugcagcaggcacaugugcacagagcacgggcacuguuggaggggaauccagaaccucuuuugcacccugucuucacccugugcccuuuccuacucuuuugcaucaucuguucuugagucacacauacgugugaguaucugagucagauuacagagcacagaacccuccauggcuggcucuuuggucuguagcucagcacagucugucccaccuuugcccagguccaucucucucaccucagagaugccuucuggacuggaccacucuguuaagcguuguaucccaacuugucuuuuauguccuaacacaacacuauuuuauuauuuuuauuccuuuauagugcuggggauagacccuaaagccuuaagcauuacugggcaagcucucuaccugagccacaccccuagcccuagucauuucugauuugucuucuugcuugucugucucucaugcugccaacucagcuccacuggagcagauccagaaacucacuaggaaauucaagugguuacugaauaaaugaaagaacucugagccuggcagaccugugguguugccucagggugggcagguucuggggcugaguucacccugcauggccacugccuccagccuccacccauuuguccaggcugaaggccaacuucaacauccgggaagacgccaaccccagcucccgccagcgaggacuuaagcgcuuccaggccaauccagaagccaacugggguccccggccccgugcccggccagggugagugguaauguuguagaagugaggguuuuccagggcugggcaaagacaaagugggguaccagcaccccucucugcacaggggcaaggcagcaagugaagaucuagcagggaggcggaggcugcuacagaauaagaggaaggagccagcugaggacccggcccagcgugcagcucgccuuaagacauuuccuugcaaacgauucaaagaggugaucucuccuuccaccuuccaugcaacuggaccaagguugggccucuggcacagcuggggccagagacugaggaaagaaacccagcucugugcucacagccuggggcuucacacccuguuuucccaccaggguaccugucaacuaggggaccagugcuguuauucacacaguccugcagcuccuguggccucuggugauauccccaucgaagaauguccagagacuaccaccaagaucuccccuggaccaaaggcugcugcuggggguauuccugggccagguguagacugagacaauaaagagauguaaccugcugguugucauuuugaauuggga

SEQ ID NO: 4586 - RNA, 3563 nt, Mus musculus
augcaagagugccugagucuucguugucgcgguuaacaggaucauggaucaagcgcaaccaguugggcuucaugggguagguccucccacacacuugucuagggucuucccgccuccagcagggggcgccgaugagaagcgcggaggcuuccagacccuucccuaccucccucaggaccucugggaucccauggcuacuuggccuugucgauucucuggccucggcccuggcaagaggacacuggcaaagccacugcaaguagccugugggagauuuuucuuaaaagucuggggaucccuggcgucgccggucacccuuccagagcuacagggcguuuccucaucugggcgaccugagauccuuuuacagggaguucacugaacagcaggugaggcgccucugccuugggucaccgcaccucaggacucagggacgucugcuccaacuugaugggucucacugacccauuggggucgccaucacaguccccaggaagcacgggcugugagcgugcagccucuacucugugcccggccccgaagcgugcgcugcccuccacgccccugcgcgcagguggcuugcgggacccgggagcgcuggggccggaggucagcacagccguuuggucucgcagcagccgcaccaggaagccuauauacuucauggccaggcgcagcaccucguucuugcucagcuuccggucgggcgggugggugggcagcagcuuccugagcucugcgaaggcgccguuaacgugcugcugccgccagcgcucacggcuguuggugaacacucgccgagccaccuucugggguuggugcccugaggacccaagggauagcaucagcguagaggacagagggcgcccacugcuguccucacugaacaccacuagcacccacguggggcuugaacccagacugugggcuguguagacaucggaacugcugagucugauuaagccuugaugacagcgaugugaucccuugagagguccaugcugugguuucauuccuagcaaguguauuucuggguucucaaagguccuguucuugccggcugugggccugagggugacuggugaccuaucugauggcugugguugugugggaucaugcgaugugguuguggcuguuguauguguggcugggguucugagguugacuguggucucauagcucugugugauccuaacccaagguugucucucaugacuguguucucaaggguuggggagugucaucuuguggcugccauauccuauuguggccaugucucugguuauaaugcuugcuuguuggggacucacauagcccagguuggcuucugaacugguucuccugugucagucuggauuacaggguaaucccccaagcuaggcuccguacuguagucuugcauuagcuaucacuugugugaguuguccuguguugggguguaugugaacuucccaaaauacuucuuccuguggcagaguacaggccaaucagacaugagcugcaggcaccccacaaguacacaccgagacacaaacucaccgucagccaaguccagcucacuauggcuuggucugcgcuucagccggcuguuagggaagaugcugaaggguccugcuggcccaauguagacacuguaagggguugugggucaugaacacuuuguaggcaaagacccuggcccccaaaccuaagcacugcccauaguccgagcugcccacugaccuguugaggaaggggugagggugguaauguacagccaggguagguggagcucuucccaaggcaguuagcugcagcaaggagggccgaaaggcacugagcucuguggugggcauggcugccccuaugggccuggugugucccagguuuaucacuggcacgccgggaggcaaccagggagugcacguguuucggugguccaccuccucuguagaaaggggcccaggugaggccggcuuagagggaggggcaggugcugggcuggaggcacauaccaucucaguuuucucagucauggcggaacccaccucugcucuggccuggggcgggcacauggaccccacggauagaaugcuaaccugugggagagagugaaguuaaggggaaggaaggccaaagaccaucuuucucccaccuguuuaaccugagcuuuucaauguaagagcacccuuaggcgagaaagggauuggggguucaauaaucaaagguagaaaagugguccuagaaacugcuaggaccuaaaaggagggccuccuccacaagaggggagccuccuccacaagagggggugucuaucagauacuaggcagcguugacccuaugaauuguuuguaaugggcaucuucagucucugaacuaguucccaucuuucagaaucucuccuaccugcagcugggaauaagauaggaaucuccggacuaacucuaagaccuccuaagucuccaagagucacccucugccaccucuccauggcuauuccaggggccucuacccuugcugaaaguuccucuuacuggcccccaaccccaucagcacccuacuuaccacguuugcugggcucuaaggucugggguauccugccagugugugacuucccacauugcugcccuguuuuccccaacugaggacauuucagugccuccucacuuccagugaaugaauaaauaaaugaaguaacaaacaccgaauacaggcacagacacuccuuaauguuuaaagcgucuuucuuacccuguagcaguuuccacagcuuggagaacccggcuguguggucagguuugucaguccaggucaggagacaguuuccacuguccaguucggccggugugcuccagguaaucccucccguugggccucagagcugggcugcgccaccucccgggcuccggagggccugaguagcuucggaggcgucgugguggguaccuccaagagaaagugagcugcuccuggaccgacccgcccuuucccccgcccccgacagccuggcuuccucccucuuacccgcuggcgcagaggccagaggaugcugggccugugcagauaagggucuggcugccuggccgcggcugauaagaagcaaugcugaccccggaggaaaccagcgggcagggaucacggagcgcgcaccuccugauccaccccggcuagucacccuucgggguuugcugcucccacagcacuggaagaccccccaacccucaggagcccagcgccaaacgugugcaaaggggaaagguggcaaggcugccucugauguccucugagguuggucuagcuuugaaccccacccccuaugcugauggggguggaaggggccccuuuccgguccucugaggccccaugacccaugagccucagccuaguuccucuuuuuuuacagaucccccuguggacugcaccccccccccccacacacacacccaggaauagggcuccggaaggagacaauucugguaauguggccuugccguguccugacaccgaggugcaggugucccgaaccuguggcacugcuaacguauuuccaagcccaggcgggugagaugagugucaaagccaua

SEQ ID NO: 4587 - RNA, 3842 nt, Mus musculus
gggcucuaagccaggaggccccaaggaggaagccgggagguaaaccucccugucgcguccuacagaagagaagagaggcauggcagauacagggccaugugcaaacaaaagccaggccuuugcugccagaugggugcugaggcggaagcagcacgugcaggagggccagguucccggguauccugccuggccccacccucaggaagauccagcaucuucucagggccugaagaugcccucagagcagcaagacaguccuuuucauggugagccuuguccuucuggcccagcccuucacuucugggaaaagcagggaggcccagauuuggugccgguuugcucuaggacagacaccaggaaccuggacugcugagcaguacucuuucuaauccacaggagagcaacuuggcucaacuacuugcuggugggggagggggaggcugcaugcagcucccagugagcaugugcagaccaugcacccaacacagacuuaacacagccagaguuagcaugugggagggauucuaggaaccgagugggcagccugguucucagaguuacacugcccaucccaugccaccccacugcugugccacgacccacuuggggagcccagaucuauaacuuagauugaucccuggcccccuguugcuccuggccagcugccccuugcuguggcugccucccgcaguguccccuuaagccccgcccccaucucucaccuggucugacuccagcaagcacaggcagcggguggugggugaaagccaugcguggggaacugcccugagaggagagggcgcugcagaaguccagcuuuccugacuucuuuagagaagcagggccuggggggaggaagcagcaacacgcagguuuagcuggcugggguaggaagccagcuaagcagcccgcuccuucucuucucagcacccagcagcccuuccuccaccucgggcccugcucugcuccuccuggggccugaccucaggggugcaaucuggcuacaguugcuucugcagagaggaaaaugaggccccugguaacaugugggaggauaugcugggcaaggguggcuggcagaggaaagcauccugcuccugacggucgauaaaggaauuaaaauggguacaaggcuggcaucuaggaagggaugcacgaggagcccacagaugccugcuggagagccaugaaaggagccagagcgccaagggugggacgcacaggcugggggcugugacaagacacccuggccugaagaaaccagcacucucuuucuggagaaaaggaaaagggaaagcaugguuagaagcccuccaaagcagcaaaaggagaacaaaggcaggagccagagcugggagcacccugggaacaacuagaggcaaggacugcccuggccauagggcucagagaguggggcucuucucugcccuguugccaaaggcaagggcgguauuagccagagacggguacaaaaagacccccaucugggcuuugccuuugacagucaagagauugcaagccaacaccaucucuguccaguaugcacaguuccaggugacaggcugucaaacagcucccaggagcacacucuuucgguaucucuuauccuggacuuagcuucaaggccaugcccagacugaccaggcaaagguggaggugaggcagacuuugagcuucgaucuuugagggauaaaucuauuuguuuuugaugggaaagggggcugcagaacagaaacucagaguuucaaccacagagagaauuggggggaggggggagggcgagcucccagcgaccagcagagguguuaucuggcggcagcuguguaccaccugauagcuggcaugaugaggaggggggagugccccaccagcugugcacagcugucccugcugcugcacagugccuacccagcuguucccauccugcagcugggcugcuuaauuggcgauuugucgcagcccagggaaacgacgacaaguugggguauaagggauucugggggcgcagugcauggcagaacuaccagaagcagcagaaaugggcaggcgguagagcagacagagggcagacugcagaagccuggcaagggggcucuugggaacauggagucacaggcagucagcggguccucaagguacccuagcagcaguccuugcagaugucaccugcccaagggcgagucuggcugggaccuggcacacagcaaucuucaaacuucucagcucccucucuacccaccuccagagauuccccuagggguguguguaggucacacuggcccagacccugucugccacagggagauccugugagggaccuccaggucaugcugggggugccuuuccacagagcaguccccauuggugcucgagaggguggcaaguccacucccucugccuaagaccaggaggucagcuuugcuugucguugcacgggaagcagagccaaagccagaggcugcaccagcucucucagcccguucucuaccagacaccugguucaaaccaugaaggccgguccccagcccuauccagaguguccccagcuccaucuacacugggcaaguucuguauccacuguacguacgauggcaggucugcacuuucaggucccaaugccucaaggacauucacagcuuuugguguguauaaaucugucccucugggcuucuaggcugccuaucugaccagccuguccuggagcagcccuuggcuggacucagcaggaagccagcucagugaggacugggaaggucuaggcugcuuccucugggcucgacagaaucucuguucuuugcuaguuucccaagacaguucugcucuuccacacccucaguucuaagcuucucuguaaagcugggccccagggcuaggguuagucuacuucaaaucugucuccccgagggagggcacccggcaaugucuaaggacauuuauagucauccaauaggcuggccggaugcacccuguaaucccagcacuugggaggcugagguaagggcauuuagagcgugaggccagccuagcuguuacauagcuaggcccuguugcaaaacaaaaacaaccgacuaaagaagggguagauguuugcuacuggcaucuagugguggagccaggaaugcuacugaguaccuuccaaaacaaaggcugcccuugccucaggaagccaaguggccucacacacaacccugggcccaacugggggaaaugauuuaauccagggaaccacaaggcuaggcaggucucuagaggcaagggaucuaugaagaagaggccaugcccucaauaaaugguacuauaggcuugguagccgucugcucuacccacaaugccgauaggucagcuagcaacucugagcuccucaucccgcuccuugccaucagcccgagagccugaaagugccauccaacaaacgaggccaccggaagcaggggcugucacaccaccacugccaugcccauaccugcauccacgucauugggccauccgcuagacuggcugcugccagcggccggagagcggccugucccaggauagaacacaucaucuacuggacucuccaucucacugucgucgauggacuuggggcgcuuggugcugcugaggaggaggaggaagaagaagaagaagaagcaagucaagugggccaaaguuccaggcaccccaguucuaggagcagagcaucuccagaccugcucucccucagguugccaggacacccugaaggaccaucaaagaacaggcaaagcaccuuuaucugccuuccacaccccacccacucuuuccuauuagcucucagcugugccguggaacucagucauuaaagaguguuuuaagccaac

SEQ ID NO: 4588 - RNA, 6649 nt, Mus musculus
cggaagugcuuggcgcggcgcggcugggcgcuaagauggcggcggcgugaguugcauguaguacgaggaucccggggcugccgcauugcuccggccccgccauggccgucaccaucacccuuaaaacguugcagcagcagaccuucaagauccgcauggaaccugacgagacggugcgggccggagcccgggggcgggagcgaccgggugccggggugggugggggcagggaugccgggauccaacgggaggggcggagaggacgccguggccaggcccugcccucccccagcagcccgaccuccucggauccccccgaucggcccugcccugccccggcggcucgggcgcuguucccgggccagucccugggaguucccaggucuggcucccgugucagcugcgggcuccgcguucccagccugcaagcugcucagguggcacaguuugcccucagugccaacgaggugccgacuggugacuacaaugaugauaauaauaaauggucuuaaucuuaauaguuuuggugguccgucuuuguuggccguuuauucuuuaccaguuuauucuuuaccagaguauuagugucaucuugcugagucugcaaaacaguguugucguuuggggacuccugacuuuccccuuuugacaaccacggaguuaaggaacuuugccacggucacagccaauaaugacagugacaagauuuuuuuuuuucuccauuucacauaacagcagccuaaacaugcuguaugaacuuuuguuugguuuugcuuuuugagaguggagucuagucuuguucuucugggcucaugugaaccuucuuuacuuaaccuccaaguaacugauauugcugucuugggccaccuccccuaaaccuucucaaaacauagguugaagccauugguguacccucagugaagucuaagcuugguagucauguucauaaucucugagcagagauuaccuggaguucuaggccagccugggcuaugauguuuuaggcaagccuggaguugaguacagaauaaaauccuguuccaaaaauggagggaagaaagaugaccucaguaaguacagaaaaguuacuguuugaggccagcgauggauacaccguuucauuuucuuauuacuguuuccccuccuaaccacaucccauuggaaauacaaguuugcuuuucuucucacaucagugucuucuucaugagaacacugacuuguguuuguucuguuccacaggccucuguaaaacaaguuguaaaacagguuggggauggagcuuuugaauauacaaggccugagcuaggggucuguccccaaaccaccacuaccauuacacacacacacauauacacacacggugaacaguucccgugucuggcauguaauagacugcugucagcucgauagauugaauaggaaucucauaggauugaaagcaaagcuuuuucucuaaacaaaagggaagaagaagggaaccuaaggguucgugauggucauuguauucuauuugaaauggucucacuauauaguccuggcuagccuggaacuuaaagagauccacuugucucuccuaagugcugggauuauaagugugcacaacuaugccuggauuucacugagggugucuugguguguuagugcuauuuauaaaugcacgcacacuguacuauuaaacuucuguguuuaauaccuguacuccuuacucuagguaaaggugcugaaggagaagauagaagcugagaaggguagagaugcuuuccccguggcuggacagaaacucaucuaugcuggcaagaucuugagugacgauguucccaucaaggaauaccauauagaugagaagaacuuugugguugucauggugaccaagguggggagauuagcugggaugcuggcaaagagcuuguaugcccaggagagauuagccuuaggcaggguggggccaugauggggcaggguggcaaggcuugauagggaugcugcuugccugauucucguuucuuguugucacaggccaaagcuggccaggguaucccggcacccccagaggccucacccacugcugucccggagcccuccacaccuuucccuccaguccuggcaucaggcaugucucaucccccaccuaccagcagagaggacaagagcccaucagaggagucaaccaccacaacaucuccagaauccauuucuggguaaggaaagggcaguagcuuacccuguacccacucugucuuccugugccuuccaguacccaccuauguggucccaggcacuuucggggagggcaagccaccagaagccaggguccgauuucucucucuugaauuugcagcucuguucccucuucagguagcagcgggcgagaggaagacgcagcuuccacauuaggugggugggugguccucagggcagaggcgacuggaagccccagccaucagccuuugacagccuugucugggucugggagggucugggagcuguccuccugugccucuggugaccccggcccugcugcucccuccacagugacuggcucugaauaugagacgaugcugacugagaucauguccaugggcuacgagcgggagcggguuguggccgcauugagggccagcuacaacaacccccaccgagcuguggaguacuugcucacggugagggggccaucacugccuccugggagucuccaggucuccgugccucaacaggcaguggagguggagccuaccccauaggcuuuuguguauugaguguugccauugaagucuucccagagaggcuggacagagaacguggagggcagggaugagaccuuccuguccugucaggcugcucacuugggagaggggaaggggaucuguuugaaagaacuaaaaagcaggaucccugacagggaauuccaggaagcccugagccugaacaugguucuguccaggaaagccaggcgccugagcagccggccacagaagcaggugagcagguuggaugguguccucaugggcaucugcagucuggauuccgaagccccugcagggagggcucugaccacacuucuuccugccaccagcaggggagaacccccuggaguuccugcgggaccagccucaguuccagaacaugcggcaagugauucaacagaacccagcgcuccugccugcucugcuccagcagcugggucaggaaaacccucagcuccugcaggugcggcccagggugagggagcugagacagccaccuucccaguuccuuaggggaucacccagggagguagcuuugcucugagaaagcagaacuagcagaggccaagccccugcucccugaugacuucuaagguuacauuguaaccugacuccuagggagguguggaugcuaugggcauccaucugcugaagacaucagaggcucagagcaggcugccauaugucuggcuggguccuggacuccagccacagcauucuucucaguucuugcucugucugcagcuccucuguccuggccuucuuccugaucugaccuucaccuugacccucucucuauguggugaccuaaaccugugucauuauaccaggucccuugggacccucucaucugagcugugaaaggauuuccuggaccucugaguuuucagaccauucuucucuguuugagccucucacaaccuccuggggacucucucugcuucuaccccaauaucagccauuucucccacccaguguccuggcauccucuucucgagccuuuuaauucuacacagggcccccgaugaacuguccaccuagaggcuagauugcugaaaaggcccuuuuuaaugugagaauugucagaugucugaagaagcaaaggguggcaucagaaccucuggauuuccaaguagaguguauuuaauagguaccguggcuggucaugguaguguacaccauuaagcccgcacuuaggaagcugagacaggaagaucacugaacuugaagccagccccuucuaguagugagaucaucucaaaacagagaaaaccuaaagguugugcagcuugagugccucacuagugggcugcugcucuuagcagcugcaggccuggguuccacgguggcuuuccucugccagggagaacguucagcuucucugugcuguucuugccacagagcucuucugagauuugcccaguagagccaucccaggacauuuuuacaggcuguguguuuuagccacacauggcucuaccacagacaguaggccccuccuacaaggccuuagggacuuaccuagcacaucugcaguuaauugguuugaacuuuguuuuuguuuuuucccccuuuaaaucucacuauguagguuaggcuggcuuaaaacucagguugauucuccugcuucagccucccaagugcugggauuacagguaugaaccacuaugccgaguuucggcacauuuauuuaacuuuuuuauuugucucaccauggagcucugacuacuuugaaacucuucuguagaccaaguuggccuaaaacucaaauccaccugccucugccuccccagugcugggauuaaaggcaucugccacuauuuccaucuccccaccuuggcaccauuuauuuccacggcuuauuuccauggcugcauggcuguuuagccagagcaugcaccuucagaguauuugacaguuugguauaauaagcaagggguauaacaugggacuugggcauaggugaugaggacugugaauucucacccuucuucuucucacagcaaauuagccgucaccaggagcaguucauccagauguugaaugagccucccggggagcuggcggacaucucugauguagagggggagguuggugccauaggugaggaggccccacagaugaacuauauccaggugacaccgcaggagaaggaggcuauagaaaggguaagaggccuggcugaagagccauucaugguggguagcccaguaccucccccuucuuaccauugcccaucuucccacagcugaaggcacugggcuucccagagagccuggugauccaggccuacuucgcgugugaaaaaaaugagaauuuggcugccaacuuccuccugagucagaacuuugaugaugagugauucugggaggccagggccuccccccuucccucccuccccacuccacagacguuuauaagagaaaguauauauauauauauauaacauauauauauucauguuuaagaggaagaauaucaaaaaccauuaaaaaaacaacaacaaaaaaaaacccagcccagcuucccacccuccugaaguggcccccauucccauaucaguccgagaagaccugggccagacagcuguccccguccucuuaacagcccagccuacucaaaaguuguuggcaagaccaugaggcgacagaugggccccucuuggccucugucccagcucccugcagccagauggaggggcgccugccugcuuccccaucccugaagcauccccaaggacaacccuccuuccuccaccaugaugaggggaagcuggagcccuaagcuuugauccucuauuggaguggcccagaucuuuccaucuggaguaagucuauguuagaagccaaaggccuucuccccagucuggccuuggccuccagccuggaaaagggguuaucaucaguucugaaggccaaggccaccccuuccccaggacagaaccacaucucugauaaagguuuugacgugaauaaaguuuuaaaaaugagcccuaauaaugguucaugccuacuggagcuucucacagcuguuugugagucugagcuagccgggggcacaggugaagugggcaugcugagaaacggggaggagccuaggagccuuacagacgggccccagcaucuccucccucuggaaacuugggccccugccucagcucaacccuagaaggacugcugcuccuucuaucaugcagucuguuuggcuguacucccccugguaauuggcuaauuacuggagauuaauguugguaaacagaagccuccuccucuccugccaucugcuccuucauuauuugcccauccauuccccuuucucucuccccaaagccccaguucauggcauggccuaguguccaggugugaacacagccagguggagggauucucccgcccagguguuggggaaugagccgggcgacccaggaagucacaacuugagggagaauguguagaauauggguugucagcagcuggcuuuauugggaagggagcuuucaggagcuggguucaccagacacugcugaguccugggcuucagcagaggccauagcagcaauucgugccuccuucuucugucguugucuuucuuccuuuaggcgcuuucguugcugcuugucuagguccuguaauaguuccuggaagcgagcacuccuuggguccacgugguagcccaggcguuccugggccucagccuguaaccgggcccuccgcuccuugucagccugaauuuucucccagcguucucgcuucugcuuucgccaguuuucaaucauuuguggcaucuuggccaugcacucugcgauacgcugcucccuguauaggaaagcagacagugagggcagaccaaggcaaaucugaauuucacccagcuguuuaguaaaaccacucucaugcccuugucau

SEQ ID NO: 4589 - RNA, 5132 nt, Mus musculus
gacagcuguaggucuaaaccagucaaaaggaccgaggggcgggcucagcggcugugucagguucgggugagagguaggugaauauaaauugaagcggcgguggccgcguccgucaauaccgcagagccgcugccugaagaucgucuuaaaaggccugugugccgccgcccccucggcccgccaugcuccuuucggugccgcuccugcuuggccuccucggccuggccgccgcagacccugccaucuauuucaaagagcaguucuuggacggagguaaggucugggcccgucucgaggccgcuuagcgacugcugggccccgagaccucggcugccucgucguguguaauguaauuaccguucagagggccaacacuguggccccagagggacuagggccgcgggcgguuccaugugugcguccuugugggacuaggaaggcucagccguuucccgcccccagaguuaggauucguccaaggaccugaagcccaucgagaugucaaguuugagguugggaugggaauccccuuccccacccccaccugcuuguagcuccugacagacguugguuaugggggcgggggucggacggccccgcuaaucugacucuaugcccuucccuuucagaugccuggaccaaccgcugggucgaauccaaacauaaguccgauuuuggcaaauuuguccucaguucuggcaaauuuuacggggaccuggagaaggauaaagguacaagggagugggugcaggacaacuuccuggaggaagcuguagucagcacauacaucuuguuggggcuuuucccaggaacacgggagccaaggacagguggaggaaggaagggaggucagccgugccccucuaggucuaggguauuccggguucaccugaugacagucccauuucaucacagggcugcagacaagccaagaugcccgauuuuacgcacuguccgccaaauucgaacccuucagcaauaagggccagacacuggugguacaguucacggugaagcaugagcagaauaucgacugugggggcggcuacgugaagcuguuuccgagugguuuggaccagaaggacaugcauggagacucagaauauaacaucauguuuggugaggggcccccagccagugcugaccucugccgguuggacagugggugcagacugaaacccuuuguaaccagaaugcugaucuucauaccauggaaagcacuugaaugaugaaaauuuuuguccugaaggacaacuuuauuaguugguguacaauauuacuugaagacuuauauuguucauuuguaugauauuuucuacguguuaauaauuuuagaaaugaugcuaaugacagggucuaaaaaucagugaaaaaucugagcaugugcauauuucuucuguacucaaguaugaaagggugugcuagugugaaggucagagggcaacuuuggaaaucucuuuugucaucuggguucuaggaucaaauuuggauugucaggcuuaguggcaaguaccuaauuuaccacugagccauuugcuggccccagaaugguaaucguuucagauuuguagucuuuuaugccuuuaauggaugcauugaagucagauguauaacuguuccugaacaguuaggacuuuguauagagaaccugucucaaaaaaacaaacaaaccccaaccaaaacagguuuuuauuucuggauagcgauggcuguguauauguguaauuccagcauucagaccacugaaguagaucagaacuuuaaaggcagcuucaguuaaauguaacagucuccucugucaaaaauaaaauaagagcuggagauagaauucagugguuucagagaacacaagcucaguucccagcacucacacaguguccugugacucccgugcccacuucagaccucugcaggcuccuguguaugcaugguauauagucacaaauagaugagguuaggucucccuuucucaaaggauagagccugccaucagccugcauaugcuuccuacauagguccggacaucugcgguccuggcaccaagaagguucaugucaucuuuaacuacaagggcaagaaugugcugaucaacaaggauauccgguguaaggugugccugggguagucauuuaaauggcugucaugggaggucccggcagccuggugggagggacugcucaccuccuucccucuucaggaugaugaauucacacaccuauacacacugauugugcggccagacaacaccuaugaggugaaaauugacaacagccagguggagucaggcuccuuggaggaugauugggacuuucugccacccaagaagauaaaggacccugaugcugccaagccggaagacugggaugaacgagccaagaucgaugaccccacagauuccaagccugagguuaguguugggaggguagcuccaccucugucauagaauggaggacaucuggguccacuuugaccuccacguguacuccuaggacugggacaagccagagcacaucccugacccugaugcuaagaagccugaggacugggaugaagagauggauggagagugggaaccaccagugauucaaaauccugaauacaagguaggcuuggguguuuggguguggcucccuggugggauguuuccuugggugcuaugauuaauguugcacugcagaaacaaaccaagauaggccuugggguccuagucgggguuguuggcuguacugugggaugugucugccucucuauucaucugguuuucuucuacagggcgaguggaaaccacgucaaauugacaacccagauuacaaggguaccuggauacacccagaaauugacaacccugaauacucccccgaugcaaauaucuaugccuaugauaguuuugcuguacugggccuagaucucuggcaggugagacauaggaaagacaaggguuccuggcagaccucaagucaggaucauacugguuuaucuggagggaagaacaggcagaggcaccaacccuaagguguucugaaaugguccgccuaaugaggcauuuccuguuuuaucuccuuuuucuuacucaagaaagaugguuuauuguuaaagcauuuuuauguguaugguuauauagaggucagaggaaaacuuaucagagaaguugguucucuucacuaugugaguccuuggaaucaacucuggucauuaaaaaaaucuuggcaaccaagugccuucauuugcugagcuaucucugccuccacugagcacuuuucucuuuucugcagggcuacuuggcaugugcuaagucuuuugccaaagugccccugcaaaaucaccugggauuacccaguuacagcucugcucacugcccacccuggcuacauaaccaaauaagauuuuaagaaacauugguaccgaguuuuuguuguugauguuuugugucuaggccaguucuuggcaugaguuggaaaaagagagccccagaaugccuguuuuauagagaaaguaguguggaaagugaagccaguaguccauccaggucauuagggugugaguucuggaagcauggcuucuaaacuguaaugcucccaggaucacagcuccccccaccccgcaacccccagccaggcaggcuggucuugguguauguauguaugguauguacugacuggccuaaaauucuuuacuucugccuaccuucucagugcaucaacuuacauacuugccugucccacccacuuuucuuuuggacaugaucucacuauaauccuguuggcuuggaccuccacaaguagucugucuucucagagcugggaucuaaggcauguccuaccacacccugcugccccacacauuuugguggauucaaagacuaggaaaggugggaauagaggccuguccagagccaggacugccagaagucacugcugaccaccugucuuuccguucuuucccaggucaaguccgggacaaucuuugacaauuuccucaucaccaaugaugaggccuaugcagaggaguuuggcaaugagacgugggguguuaccaaggugggucagagcucuuuguuuacucuaggggucaucugggaggacuggcagacagauuugagccagguauuaaaagauaugguugguugguccucacaggcugcagagaagcagaugaaggacaagcaggaugaggagcagaggcuuaaggaagaagaagaggacaagaagcguaaagaggaagaagaagcugaggauaaagaggaugaugaugacagagaugaagaugaggacgaagaagaugagaaggaggaagaugaggaagaauccccuggccaagccaaggaugagcuguagaggccacaccaccugccuucagggcuggacugaggccugaacacccugccgcagagcuggcugcucccaauaaugucucuaugagacucaagaacuuuucauuuuuuccaggcagguucagaucugggguagauucugauuuuguuccccugccucccccauuaccccccccccuuuuuuuuuuuacugguguuugucuuuaauucuccuucagcccucaucugguuucucauuuuugaaucaacaucuuuuccuucugucccucccuuucuccaucuuuuggucacuacccuccaacucuaggaacagggguguagaggagaagcccuaggcuugagauuucaucugcucuccuuccugcaucucagaggagggcaggagaagggggugguguuuucccuccccccgcacugaggaagaauggggcucuucucauccccuuucucccuugcccccaggacugggccacuuguggggcagccaguucuagcacagcucacacugagaguguaagaacuacaaacaaaauuucuauuaaauuaaguuuugugucuucccuauugugucuccuucucugggaggauguacaucaggagcuaaaagcagccuuucucaggugcgggugacguauguuucagcuacuggaguuugcagagucucagaaaugucauuuauauguaucccauagucucuaaaugggagaguagccaucaggucuugauccuaaacucauagacguguaaguuuugauucuagcacagaccucauugacagacugacuagaauuuagugaauuca

SEQ ID NO: 4590 - RNA, 3370 nt, Mus musculus
ugugggcagacaggagcccuccaagaaacuuuccuagccucauagcccaugaggcagaagagagagaggaggccugagguccaggguggacaccagccagccauggccucagcugagacugucuuacccuccaucaguacacucaccacccugggacaguuccuggacacccaggaggacuuccucaagguggggccagugugagugugugggagggggcagguggucuugcauagggcauagugcuuagggguggggcgucuaucuuacuuuaauauccucugcucuguuuuuuggggguggaggagugggagagccucugagccuuguuugggggagauguucuaggggucugagaucaaggugaggccuauuucuccaacaggaagcagaauucuaagcucuauaucuuaagagacuaggcucauagagacaaagguccagauaaagguguccugggauuuccaggcuuugagcuguaauuuucugggcuaugugaagacagggaaaggcuagggaaaacggagucgaagcuguccccuuugacucagaacucugcaaccccuucucccauccugaauacuauucuugguaagugucuuagcugucucuagcaagaccuaauggaguugucuggagcugagaaagggguuaggggaaccguguggguaaaugacaggcaccaacgguguuuccagccaggguuguuugagggccagguacccagugccuaccauucaagcaguacgcucccucccgcagugguggcggucugaggagacgcaggauuuggggccggggcccccgaaucccacggggccgucccaucacgugagucugaaaucggaggacccuuccggagaggacgaugagagggacgugaccugugcgugggacccggaucuuuuccuuacaaacuuuccagguuccgagucucccggcacuucccggaccugugcccuggcgcccagcguggggccaguggcacaguucgagccgccugagucucugggcgccuaugcggguggcccaggguuggugacugggccuuugggcuccgaggagcacacaagcugggcgcacccgacuccgagacccccagccccugaacccuucguggccccugcccuggccccgggacucgcucccaaggcucagcccucguacuccgacucgcgagcgggcuccguagggggcuucuucccgcgggcggggcuugcggugcccgcagcuccaggcgcccccuaugggcugcugucgggauaccccgcgcuguaccccgcgccacaguaccaaggccacuuccagcucuuucgcgggcucgcggcgccuucugcuggucccacggcgcccccuuccuucuugaauugucugggaccugggacuguggccacagaacucggggccacugcgaucgccggagacgcaggcuuguccccgggaacugcgccgcccaaacgcagccggcgaacuuuggcaccuaagaggcaggcggcacauacgugcgggcacgaaggcugcgggaagagcuacaccaagagcucgcaccucaaggcgcaccugcgcacgcacacggguaagggcggggccagacgggcgggggcggggcgggagccgcuagugaacgaagggaggggccggaggguagucagaggcguggcuaaaggcggccccaguucuaggggucgugaagaccgcaccugagacacugggucaagucuagaaggggcgauuccagacccaaaugggcuaauacaaacacucgggaggcagaggcagguggauagcagugacuucgaggccauuugggcuauuauagcgaguuucagcagccugagcuacuuagugagauccugguucauaaauaaauagguguaacagaggaccuggggaacacuuuggggacuucgguguuagaaguggauguguaaggccuggguuagagaugggagaagaaacuagaggggugaacccgaaagguacaagcuuggaaugccagagcucaggauauagccaguauuuacaugcaugcucgagcuggaaccaucugggaucaggagguugagacacucaaguaaaaucaguuucaggggcaacugacagaggucccagaguuaagaaaagaagagaagggggcuggagagauggcucagugguuaagagcacugacugcucuuccagagguccugaguuuaaaucccagcaccacaugguggcucacaaccaucuguaaugggauccgaugcccucuucuggugugacugaagacagcuacaguguacuuacauauaauaaauaaauaaauuaaaaaaaaaaagaaagaaagaaaaaagaaaagaagagaaggaaaugcugagagacagggccuagaaagagaaacggggucaucccaggacuggaagacagcugagggucucccaagcauggcagggcacgcaacaggcuguaacaggaagagagggaaucaccagagacagggccuugaacacugggguggauuucugggcuugaaccaaguugaggaacaagacuggauaucaucgggaggcucugccagagcaagaaauagcugcaacgcggagaacaaagaacgaaggugcagccacauaaaaaggcagggaacuagcacaccggaagugggauaggagaccggaagugagaaaacugcaggauugcagcuguagauacagaaaaggauugagucacagaaggcaggauuaugugaccuuuuaacugugugggcuagguauguccuaagacuuggcucuacuucaucaagggugcaaacuggagcuggguugcuuggagggugguacuuacagcucccuguccuucaggagagaagccuuaugccugcuccugggacggcugugacuggagguucgcucgcucagacgaacugacgcgccacuaccggaagcacacuggacaucgucccuucugcuguggccucugcccacgugcuuuuucacgcucugaccacuuagcucugcacaugaagcgucaccucugagugauccugcacaaggacuggggaugaaauaagaguggauccaaggaccguaucccaaaagaugggccauuauauaguccuacccagaucaaaaacugaccagaagaccauacaaaggagccuucaggacaaaccucacauguccucagggagccccacacauggccccacagacccagcaauauagaccaccagauaaaucaacucaaauggaccccuagaccagaggagugacccuguguccuggacgcagauggacuggggugagauuuccuaagaucuagaagggagcuucacacugugcccaucugcuaggauuguugucguuacuauaaaaauuucccauauaaaaccagu

SEQ ID NO: 4591 - RNA, 3370 nt, Mus musculus
acugguuuuauaugggaaauuuuuauaguaacgacaacaauccuagcagaugggcacagugugaagcucccuucuagaucuuaggaaaucucaccccaguccaucugcguccaggacacagggucacuccucuggucuagggguccauuugaguugauuuaucugguggucuauauugcugggucuguggggccauguguggggcucccugaggacaugugagguuuguccugaaggcuccuuuguauggucuucuggucaguuuuugaucuggguaggacuauauaauggcccaucuuuugggauacgguccuuggauccacucuuauuucauccccaguccuugugcaggaucacucagaggugacgcuucaugugcagagcuaaguggucagagcgugaaaaagcacgugggcagaggccacagcagaagggacgauguccagugugcuuccgguaguggcgcgucaguucgucugagcgagcgaaccuccagucacagccgucccaggagcaggcauaaggcuucucuccugaaggacagggagcuguaaguaccacccuccaagcaacccagcuccaguuugcacccuugaugaaguagagccaagucuuaggacauaccuagcccacacaguuaaaaggucacauaauccugccuucugugacucaauccuuuucuguaucuacagcugcaauccugcaguuuucucacuuccggucuccuaucccacuuccggugugcuaguucccugccuuuuuauguggcugcaccuucguucuuuguucuccgcguugcagcuauuucuugcucuggcagagccucccgaugauauccagucuuguuccucaacuugguucaagcccagaaauccaccccaguguucaaggcccugucucuggugauucccucucuuccuguuacagccuguugcgugcccugccaugcuugggagacccucagcugucuuccaguccugggaugaccccguuucucuuucuaggcccugucucucagcauuuccuucucuucuuuucuuuuuucuuucuuucuuuuuuuuuuuaauuuauuuauuuauuauauguaaguacacuguagcugucuucagucacaccagaagagggcaucggaucccauuacagaugguugugagccaccauguggugcugggauuuaaacucaggaccucuggaagagcagucagugcucuuaaccacugagccaucucuccagcccccuucucuucuuuucuuaacucugggaccucugucaguugccccugaaacugauuuuacuugagugucucaaccuccugaucccagaugguuccagcucgagcaugcauguaaauacuggcuauauccugagcucuggcauuccaagcuuguaccuuucggguucaccccucuaguuucuucucccaucucuaacccaggccuuacacauccacuucuaacaccgaaguccccaaaguguuccccagguccucuguuacaccuauuuauuuaugaaccaggaucucacuaaguagcucaggcugcugaaacucgcuauaauagcccaaauggccucgaagucacugcuauccaccugccucugccucccgaguguuuguauuagcccauuugggucuggaaucgccccuucuagacuugacccagugucucaggugcggucuucacgaccccuagaacuggggccgccuuuagccacgccucugacuacccuccggccccucccuucguucacuagcggcucccgccccgcccccgcccgucuggccccgcccuuacccgugugcgugcgcaggugcgccuugaggugcgagcucuugguguagcucuucccgcagccuucgugcccgcacguaugugccgccugccucuuaggugccaaaguucgccggcugcguuugggcggcgcaguucccggggacaagccugcgucuccggcgaucgcaguggccccgaguucuguggccacagucccaggucccagacaauucaagaaggaagggggcgccgugggaccagcagaaggcgccgcgagcccgcgaaagagcuggaaguggccuugguacuguggcgcgggguacagcgcgggguaucccgacagcagcccauagggggcgccuggagcugcgggcaccgcaagccccgcccgcgggaagaagcccccuacggagcccgcucgcgagucggaguacgagggcugagccuugggagcgagucccggggccagggcaggggccacgaaggguucaggggcugggggucucggagucgggugcgcccagcuugugugcuccucggagcccaaaggcccagucaccaacccugggccacccgcauaggcgcccagagacucaggcggcucgaacugugccacuggccccacgcugggcgccagggcacagguccgggaagugccgggagacucggaaccuggaaaguuuguaaggaaaagauccgggucccacgcacaggucacgucccucucaucguccucuccggaaggguccuccgauuucagacucacgugaugggacggccccgugggauucgggggccccggccccaaauccugcgucuccucagaccgccaccacugcgggagggagcguacugcuugaaugguaggcacuggguaccuggcccucaaacaacccuggcuggaaacaccguuggugccugucauuuacccacacgguuccccuaaccccuuucucagcuccagacaacuccauuaggucuugcuagagacagcuaagacacuuaccaagaauaguauucaggaugggagaagggguugcagaguucugagucaaaggggacagcuucgacuccguuuucccuagccuuucccugucuucacauagcccagaaaauuacagcucaaagccuggaaaucccaggacaccuuuaucuggaccuuugucucuaugagccuagucucuuaagauauagagcuuagaauucugcuuccuguuggagaaauaggccucaccuugaucucagaccccuagaacaucucccccaaacaaggcucagaggcucucccacuccuccacccccaaaaaacagagcagaggauauuaaaguaagauagacgccccaccccuaagcacuaugcccuaugcaagaccaccugcccccucccacacacucacacuggccccaccuugaggaaguccuccuggguguccaggaacugucccaggguggugaguguacugauggaggguaagacagucucagcugaggccauggcuggcugguguccacccuggaccucaggccuccucucucucuucugccucaugggcuaugaggcuaggaaaguuucuuggagggcuccugucugcccaca

SEQ ID NO: 4592 - RNA, 9618 nt, Mus musculus
accagaccaugcuucucagaguuggagagaacaccaucugaacccuagacagaacgggaaggccuuucuuuccuuggguggcagccuguaacugacccaaggucuuggagggcagggucucuggacuagagcgaccucugccggacaacgggaccacaacgaggucugggucaguguguucuugguugauccucacgucugcaccuuugccuguauuauuguugucugugucuuucuuucuuucuuuuggucagcauagccaucucaaugagucucuugcuuguacugucuuuuguucccggcuuguauuuuucucagguucuggggcggaaaagcuguccaaggugcuggccucgugcuacuguccacggugcugaaauaugaacacccugaaugaaaugagggcgcguguguacacagggucuugcgggaggaaaaacccacaaacaggauaaauaugacccacaacgacccuggcccagcccagacaaaaaauggguccuguaacucgguuccuggggccucuguaaugccacuguugaccacagaaagauagaggcaggaguucccuacacccugggcuguacagugcuaucuuaccagaggggaaggcauuacuaauucauuaauuuccuuacucaacauuuacugaguaugugcugugugcaaguguagaacaggguuuggcaauaugggaguucaucaauaaaagacauuaaaaaaacaagaacaaaacaaaaacaaacaaacaaaaucccauccuuggggcuggagagauuucucuucucuucuuuucucuucucuucuuuucuuuuuucuuucuuucuuuucuuuucuuucuuucuuuuuuuuuuuuuuuuuuuuuuugagacaggguuuccucuguauagcccuggcuguccuggaacucacuuuguagaccaggcuggccucgaacucagaaauccgccugccucugccucccaagugcugggauuaaaggcgugcgccaccacgcccagugagacuucucauucauuaagagcacuggcugcucuuccagaggaccuagguuugauugcuagaacucaugugguggcuuacaaccauucauaacuccaguuccagcagaucugauaucuucuuuuggccuccuugaaaaccagguaugcaugaaaacagacaugcaugaagccaaaacaccuauacaaauaaaauaauuuaaacuuuauauauauauaucaguugcugcucaugcaaaggaugggaguuugacucccagaacccacauuggguaguucacaacagcuuauaacuccagcuccaggugaucagagauaucugaccucuucaggcaccuacaguaaaguacacagauagccccucccaaggcauacuaaaaaaauaacuaaauaagucauaaagaaaugccugcuguacacugagauaggaggaagacacauuucugguagugguauacauauucuacaaggauggaugcauauacuuuuaaaacaugcauaugagcugggcaugguggcacaugccuuugaucccagcacuugggaggcagagguaggcagauuucugaguuuaaggccagccugaucuacagagugaguagaccaggcuggccucaaacucagaaaucugucugccucccaagugcugagauuaaaggugugcgccaccacugcccagcuugugcacacuucucaaauaaagcuccaccuguucuccaaaaccucacagaagaggucgggaagauggcucagugguuaagagaauauaccacauuuacagaggacccaaauucaguucccagcacccaugucaggcagcucacaacaccagcucugguugaucugaucagggagucugacuucaccagaugauuauacucauauccaccgacccauauggauagacacacacacacacacacacacacacacacacacacacacacacacacacacacaccauagauacauaauuaaaaauaguaaaauauaaaaaagaagaaaacuacaaacacauaaucaucaaaaagaaucacacaaaacauauguauauaguugugaauauccagcaaacagauucacauaguauauauauacauaggcacauauacauauauacauauacccuacaauaauauaaacauauacuuaagaaacacagacagacacucaucaaaugcaaguacauaaggaugcucaauggugcacaauucccuccuaauacauagacacauaucucuuccaacacagcucaucagcucaacacagguccaugaaagugcaugcauaccccuaccuuuuucuccagggcuguuucccccucccccaccugauucuccaucuuguguuaauucugugaagauugagauuuuuaugccuuguauacaagugcaucacccagaacgcaguacagaguauguguuuaauaaaugucuuuugaauucauggacagaauguuaaaggacacagauuuacaaaaaacuggagaaagacacagaagcaucaccagcguacacaugaaaauaccuacccaagaaacguccucuccacaacacagaagagacacagauuuaggaaucacagaucagagagagagagagagagagagagggagggagagagagaggggagagagagagagagagggagggaggagagaggagagagaggagagagagagagagagagagagagagagagagagagagagagagagagagagagagagagagagagagagagagaggagagacggagaccuuaaaucucaaguuuagcauagggaaagcuuguagauauaaaugcaccagucccaaguacaccuguuuuaggguuguggagguggggcuuuggaagucuccgccucuuaaccaaaccacaccccuuucaguugcggcucuugacuggccuugguucggugguucugaggugucugagcauccccuagacuccagccagcuaacaggugaguggcaguggguggggcgucgggaaucuagucucccauacauuuaccuucuucugcccagaaguuuuuggacccuagcggcagaaccgcagcccugcacaguccggcuugguacuaaaagguccagcccugggugaaagcuccuaagccgauugagaaccgagaggugaccgugaaaggaguggagggcggggugcugcaaagagagaaaggaaguccuggguggaagagggucuuggaagagcugaggugguuccgugacucugaaggaaguugguagcagaggacaaagagcgugagagguuguuugcaugggaucgguguuuuaauccguggaaugaaagagaugaaucuggugggaggggcucuuggagaauccccguaggcuuugaagagccuuggccauugccuggccuccucauuuauggcccauccucugugcugccuggcaacgauugcugucgggcaccuaccagugccaacuuaaaucuccagaaggaaggcaucccucgucccucuuuaucagcuggcucuugucucagguggacauggcccacgaaggccacucucaacacagcggccuggucugggcccugcgaccgauccuggcuuggaucuucuugguggccuguggauggagucacccacugcagacuagguccuggggacacccuggacuggcagccaaggugcgcacaggccagcugcagccggcaggugagcauucucugucaccucuaacacucagaaaccccacuuauaucuuccuuguaagagggcuuaggguaauagaagguggacagacagggcuagugaugacugcugguuuuaacagcccagagucugguugucaaaucagacugcuguguucaaaucccaaauccacacuuuggugcucugugaccuuaagcaaaucagauaaccuaggcaggguguuaggcaagguggugcccaccuguaauccuagcacauggaagguggauguaggaggauuaagauuucaaggcaggccaaccucggcuauauggggagcugggggucaggcugggcuacaugaaacucugucucaaaauaaacaauuaggagcugggcagugguugguggcuuugaucuuaacgcucagaggccagacugaguuccaggacagccaaagcuacacagagaaacccugugucaaaacacuaaauaauacauacauacauacguacguacauacauagggaugaugagauggcucaguggguaaaagugauggcuaccaauaccaauuacccgagucagaucccuggacugaaaacugugaaaggagaaaaccagcccuugcaagcuguccucugacacacacacacacacacacacacacacacacacacucacauacacucacauuuacacacacacucacacacaugcacacaugcacacucacacacacuuacacacauacacucacacuuacacacucacauucacacaugcacacucacacacacauucacacacgcucacacacacacacucacacacacacucacacucacacaguggcacaugagcaguguggcacacacacaauaaauacauugguuaaauauaaauuuaaaaauuaagugguagaaguguuccuaacauggguaguguccuagguccaaaccccaguaaauaaagacauaggagaaauaagaaauaacagaccugauauagagguguuguggacauuaugaugccauuuagaaacacaggcaaauauaaccugauuauuuugagugauacauaauacugcuugaagcuacauuucacagaaaaaaaaaaaaagaauuuuccagugaugggaauugaaccuagggcccuucacgugcuaggcaacugcuauaccacuaagaguuauacccuaacucuaguuauugcuacuguguggguucuucuuuuucucgaccuuaaucccccugguuucaccccuaccacuagauaggagagaaaggauagaggggagagagagacuugaaucuaauuccuuucuucuuguuucuucuuugcuuagagguggucuuuguuaauuugucgguucuuuucccgcccuuuaccccccugguuuuuaauccucuaucacuagauagaagagaaagaaggauagaggggcgagagaaauugagaccucuaagucuaauuucuuuccuuuuguucuuucuuugaccacggcuacuaacaaaccacaaccacuaccacacccugaccaaccaacaaccaccacaccacuucugggggccgagaauguaucuacccucugaaaaguucccagaauucuaaacaucacacaauuggagaaacuaucugcaucuggcaaaaccgggccucugcuccagcacgagacauaucacagucagcugccgaggacaggcugaagcagccccauaccccacaccugggaucaaaacaaaaacauauucuuaaaauauuuguuuuuuuaagagaaaccaaaauuccggaacuaucacuacagguuugcuuuuauuuuuagccaggauuucuuuaaguugccuagccugguuuugaauuugagaucccccugccucagccucccaagaguccgggauuacagauuccugccauguuauccaacugcagagaaacaucuguaaggcuuuucucucugggaaagcagcugauagaauuuccguugucagggcacccucaguccucgguucuaccaucauacccaaggauccaaguuccuggcucacagacaccaccagugccagugccuugcuguacugcagagauagacagaccagagagccuucuagagagcugcggggcaccaagcccagagugaguacuguguccucuagccugccccccuguucucugcucuacuugcccuagccugguaaggcuagacccuuaacucccccugaggaucgcgcgguguuugcccugucucucccgcguccagaugugaauucuuccugggacaacuucaaggagcccuucgcgaucgcuuccacccacagcucuucggggcacgcccagugcagccucucugcccagagcucugccagauuugguaagggaggcgggaacaggggcgugucuuaccggagagugcaggacggagggccuuaguuugcuucuagagagccagaaugggucuauggaaagagaucuaguguguccucugcaagguagagaggggagaggccugagaaugaccuagcauuugaggaacgugaaggaguggcucugguggaccaggaaguuucaaaagguucaggcuuuugacuggcagagaagcuaagagggaacgcaaggagcugcuaugaauagguggccugggcuagagaacggcuugacaguuaagaaugcuuacugcuuuuucagaggaccagaguucaggucccagcacccacaucaggcuuacaguugccuguagcuccagcuccaggguaucugauucccucuucggaaguucccuggcaccuguacuaguacacauaccagacggacacaaaugguucaaacauaauuuuuagccugauggugguggcacaugccuucaaucccagcacucuggagggagaggcagguauaucugaaaggaccucaaauucaguugguacaaagucaccccaagaccaacuucuuagcacaaaggagacuuauuugcccugaucgggaaaagggcggggggggggggggggaacggacaaaagacaggagacaggucaagggagaagguaagaggaacaagggagggggagagauauuugucuuguagggucaaaggacugccuccggagagaggagacagauguggccuacaacaguaaaagaggcaaccccauguuaggaugaggugcuuaauuuuaauuaaggauguuaauuaggugauccaaagggggcuuuuaauuguuggacuucaauguuuugacaucuggaccuugguagucagccucaggaggagaaaguggcuaaauaagaggagagaccuggugguuagcuuuaggaguguaauucauuuuuagcaaggaagaggggaugggggaagagcagggccugccagagacauguuugccugcuacagugccuucaguaucucugaguugaggacagccaacuacagagugaguucugggacagccagagcuauacagagagacccuaucaugaaaaaccacaaccaaaccaaccaacaaacucacucuaucucuuaucuaucuaucuaucuaucuaucuaucuaucuaucuaucuaucuaucuaucuaucuaucuaucuaucuaucuaucuaucuaucuaucuuucuaccuaccuaccuaucuaucuguucuucaagacaagauuucucuauguagcccugacuauccugaaacucagucuguagaacaggcuggccucaaacucugagauccaccugccucugccuccugaagcccgggauuaaaggugggcuccaccaccacccagcuacaugaguucaauucuggccaccuacaucaggcuguuuacaacugccuguaacuuuagcuccugggaguuggcaacacacacacacacacacacacaaguaaauaaauacauuuuucaaagauuuauuuauuauuauaaauaaguacacuguagcuaacuucagacaccagaagagggugucagaucucacuacggguggcugugauccaccaugugguugcuaggauuugaacucaggaucuucggaagagcagucagugcucuuaccugcugagccaucuccccagcccaaaaauaacauuuuuuaaagggaggggggacacauuguguugguggccuguguaacacuugggaaagaggaucaggaguucaagauacuccuuagacacaaaauaacuucuagacuaacuucagacccuugucucacaaaaaacaaacaacacaauaagucccagaaggaaacucugcaaacucugggugucugagggauuggggccugagaagaggccuuggucugagggagggacauuagaagcccauugucuccaaagccuuaaacccgucuucccuucucauggccagguucaccaccugccaagcagauuuuauuuguggcccgacuuggcugcaguccucuggagagagaggcugugagcccagcugccgcaccuaugggcaggugagugaggaacagaggguuggaggcggaaaugggcuuuguaauauggucuggauuacugacaugcaauacagucuggguucuugauauaauuuaauuuuaauuaaucaguuacuuuuuuuauauagggacucuccauguagcucuugcuauccugaaacuuagcauguucaccuggcugaccuugaacccuuuuuguuuguuuguuuuucaagacaggguuuuucuguguagcccuggcuguccuggaacucacucuguaggccaggcuggccucgaacucagaaauccacuugccucugccucccaagugcuaggaugaaaggcgugugccaccacuucccggugacuuugaauucuuaacaaucgucuagcacugucuccccagugcugagauuaauccuuuuaaaggggugggcuaaucuuuauuuuuuaaggauuuauucuuauucuguguuuugccugccuguaugugaaccaccuaugugccuguaagaggucaggagguuauagacuccccuacaacuaaaauuagguuugugaauuaccaugugggugcugggaaucuagccuagguccucugcagcagcugcuggugcuuuuaccggcugaaccauuucucuuccuaaguacccaacacuaucuuaauguaccuaguucauagguucuugcuguacucuuccacauucucagccuugguguggguaguccgcugauucuugacucuccuaucaacucuuugcgaucaguucuaggcuccuccccuggcucugacagacugacuggccccucaaaggaaugcccauacccucccaccgcucaggccauaccuaguccagaagacccagcccagagacucagguuccaccuccucgaacccugaccaccacccuuucuccuagaccuucgccaacgccacagaucugugucacucuguuuugggucauguccugcggguagcagcuccagguuccagucacugccucaacgucuccaucuccucuccaggagcgcgccgccgcccucgugccuggauuucaaauguuguaggcagugguaguggcagcggcagcggcgacagccccgagccaauguuuggcuuucaauacgugucccuucccuaggccaggagccacccagagucaucucccucucuuccucucuccuuccuuccuaaaccaggcccucccaccuguuuuccuagaaaugaucuaacccucacuuauuuugcuuccccaaaauaaaguugccagccuagaccaugccauacgacauggcugcugcuugggaaaacaccuggggagaacuuggcaacaaugauagucuuagggaagaauggagacuagcaacgcgguacacaggccgacccugaugaucuacauucuauucccagaacucacaugguagcaaaagaaacaacuccaacaagauggccucuguccuccagguuugcccugacacuugugcccccacccccaaaauaaauaaauagauaacauaguuu

SEQ ID NO: 4593 - RNA, 5250 nt, Mus musculus
cgcaaacuugaacucacagggcaauuugacuuuaguuuuuauucccauccaauguaaaaacccagugaagauccagcuguuacauaucauuuuauauaguuaaugguaagauauggacacuggucuaagagccagaauccagaaguaaacugccgaccccuauuuuuuuuuuuuuacagaaguauuuauuucaugucuaugcacguucugcccauguucacgugcaugccuggugcuggaggaucagacgaagguguuggaucuggcguuaaagaggguuguaagcaacuauguaagcuccaggaauggaaccuggaucuucaggagaaacauaaagagcucuuaaagaaucccuccaggccuaguaauuauuuggucucacugugucccaccaugcucagaccauggcgugaaugagguaaugccuccaccuuguggugaagaggcauaacuacagagucaguugcacaagccagaguguaaacuacuaaaacuacuaaacacacaccaacacagacuuacacugucccuaauacuuuauugguuuccuauagaccugggcccagcuaggugugcucagggcaggaucacuauucaccagauuccagguggguaaugagaaaaccucagccuagacuccagccccuucagagaguggaggaaaaucuagcauuuucugggccagcacaggacauccagguuggggcacaggugaaauccaagcuucaggcucacccauguuuacccaucucaguuguguuuggagaaguauuccuugcugucauccacauugggcuugauggugucacugccgggcuuccagccagcagggcagacuagaaaacacacaaggaugaacacgugaggcucagcuccaccaccaagggcaguggcaagcaguucauuugagagcacaggcagcacaagaaaaggcugggagcuaaaagccaaacagguugcauguggacagaagacuccguucagaccaguuugaagugacauuuuucugucccaucauuuuguuucuucuguccuuuguuuuguuguuguugaggaaaucuaacuauguagcccaggcuggccuugaacccauggugauccuauuucagccuccuaacugauaaguaucaccaugcccagcuccaaaugcugcaguacugaaauauaagccuuaaucuugugcaagacagacaagcacuguacaccuacuuguccuucagcccuuuuuucuuugcuuuuuuaaagaaugggucucuggcuggccuacaauuuucucuguaucgaucagguuggccucaagcaugcauugaucuuccuuccucugcugcccggaugcuggaacuauaggcauguaucaccaaaucuucccuuuucauuuuaaaauggaaucucauucuguagcuacccuggugacccccugcuccuaagugcugaggucacaggccugagucacagugccucgcuccuucaauccacucucucccuuagccuuaacucuacuaaccuuugcaucuauggucagcuuucccuuccacaugcugagguacugugacugggcuggaggcauagcucagugaguauucacugaguguguguaguuguguuuggggcuuugcuuugaucacuaacacacacucacacaaagaauuuuuuaaaggaggagggggggauggcaucuugugccuuuaaucccagcacuggagagguaaaggcaggcagaucucucugaguucaaggccaguuugauuuacauagcuagcuccaggccaacaugaauauauugagacccuuuccuuaaaaaaaaaaaauuauacacacacacaugguggagggagugaaaaaaaugggaguaacucuugggacacuucucaaauacuuuuuuuuagguaggcucacauacaguuuaggcugaauucacuaaacccuuaaacucugaucuuugcuccuuagcaucccaagugcuggcauuccaugaauacaccagcauggccaguuuuaugcuguccuggggacugaacucagggcuuugugaauaccaggcaaucacuccaccaacuaagccaaauucccagcuugaaaucugugaauaagccuguuaaugcacuguuuucuuuucuuuuucuuuuugucuuuguuguuaucauuuaagaaaaggucucguucuauaucacaggcuagcucaauccugucucagccuuccuuccucggucuuccaaguguugggaugacccagcauuccuaguucaaauaccuucuguagagcucugcuagcucccaacucucccccuucauguacuaauaaucccugccccauccuagacacacccugcaggcaaagaacugaauucuauauggggcucuauuuuuuuaauauguuuugcauguauauauuaguauguauuuguauguauguauguauauuuugcuuuugaaggugugugccaccaugccauauccuauucauucuaccacuucuaccaucaggacauaagauccuggguuucuguuucuuuuuuuaagguuuauuuauuauuaguagauaaguacacuguagcugucuucagacaccccaaaagagggugucagaucucauuacggaugguugugagcuaccauaugguugcugggauuugaacucaggaccuuuagaagaacagucagugcucuuacccucugagccaucucgccagcccaagauccugucuuuuauuauuauuuuuuuuauuuuaugugucugugcaccgagugugcuugguaccccaggauguggugagcauagacuugggugauagggcuagaauuugcucuuuugcaagaacaagugcccuuaaccacugagccaacucuccaguucaucuuguauacauguuuaucuguguaccaugugcacgccuggugcaggaagaggucaggagagagcaucagauuccccgagacuggaauuauagaugauuaugagccaccauguagaugcuaagaauccagccccgguccucggaaagagcagccagugcuuuuaccugcugagccaucucuucagcccuggcaugggacuuuaauguuuaucccacaaagaugcuggagcagacaauucauucaugcugggcagagcugaggcagccuuuccauuugugaauacucaccuuccccaugcucgucuguauacugaaaggccuggacuaggcggagagccucgucuacagagcgucccacagguaggucauugacugugaucuggcgaaggacacccuuggcaucgaugauaaagagaccccugaagacaugagggcccacagugaggaucugggagaccaccugcugccagaacaggaaggggacacucccacacacacccccaccagacacaguggucccuuuagcuuugaggagggggcuccuggagcugggcugaggucccugcuguaccuguaagcaaugcccucaucauuuuucaacacgccguaauucugggacaagcuuuuagucacgucagcaagcagagggauauucagggggcccaagccucccuccuuccgugggguauugauccugaaggugagagagacaugguuggugccuuaggaugcccaggauaguagaagucucccccaugggccuccagagugauaagggcuggagugggagugcuggagacaggagauaaaggacuuaaagcaaggccggggugcuccacccaccccacccagugggauggcagugcagcugggaggagaauggcuccagauaaagcauccucuucaaauggcuucacuugugcccgugggcuccagcaacuugcaguagagaccccguaugaaagugauuagccaacagcagacauggagcucagaggcagggcacuugccuugcaagaaugagcccuggaauuauugacuucuaguucugaaagacuugugugugcgcgcacacagggggauucuucccaucaccaucuagcucugguauggagcacaacccaucauuauugagaauagcaaaauacagcaaggcagccugucuccagagaacugagacuccuuuggcagguaccuuccaacaaggugccaaaugcuaauuacuaucaucuucgugugggcuugggugucauuguuuccauucuuuauaagaugaaaaacgggaagacacaguuugucccuauaauuugggcgguccuucauccucucugcaccucccacuucaccaccuaccucaagaccccugcaacccuccuccugcagccccuuaccacgccaggugggugaacugagaguccacagacacucccagcaccucgcagccuagcuuucggaaguccucagcauggucgcuaaaagcgaugaucuccguggggcaaacaaaagugaaguccaguggguagaaaaagaggaccacguacuucccuagggaagaggagaacggaagggaagucagugcuaacuucuuucacauguagacccugaccccaccugcucccacuccgcucagccucaccucuguaguccgaaagcuugauuuccuugaaggcaccauccaccaccgcuguggccgugaagucaggagccgacuuuccgauuugcgcguugccggaggccaugacugaaaucagagacccacacaagcuuggucuuuagagccuuagaagauccuuugucuugccuuuccaaggucacuuuuggugcuaagucuagauaguaaaaccgagagagguggaaggagcgcucauauucacccucccaguauaaagucugcaaggccucugaauacccgccccccuaaacagggaacgaaugaugggucaccgcugcuacccaaauuauggagucagaccgagugcggguggagggggaagugagcuccuaguuccagaauaggacggcuaagcuaagagcgauggacugccgagcucggugauccagccugcaagccagggcucgggccuugguuucccgggcaaggacaaagcggccaccauugaacauggaaaacaaagaccuccaagcauagaggucgugaugaggccugcaccacacuaguggggcuccucccauucgugugcauucuggguuuucauaccugcgugagcaagagccggacacacggacguccagacacggguagagacaggaaagagaucucaaaaccgagagagcccuaggccggagaaccuuuuaugcguggcccaaaccacaccaggcagugcgcggggaggugggcgggacagcgccgcggucggauccauugcggcugccg

SEQ ID NO: 4594 - RNA, 6015 nt, Mus musculus
cauuaacaggcuuauucacagauuucaagcugggaauuuggcuuaguugguggagugauugccugguauucacaaagcccugaguucaguccccaggacagcauaaaacuggccaugcugguguauucauggaaugccagcacuugggaugcuaaggagcaaagaucagaguuuaaggguuuagugaauucagccuaaacuguaugugagccuaccuaaaaaaaaguauuugagaagugucccaagaguuacucccauuuuuuucacucccuccaccauguguguguguauaauuuuuuuuuuuuaaggaaagggucucaauauauucauguuggccuggagcuagcuauguaaaucaaacuggccuugaacucagagagaucugccugccuuuaccucuccagugcugggauuaaaggcacaagaugccaucccccccuccuccuuuaaaaaauucuuugugugaguguguguuagugaucaaagcaaagccccaaacacaacuacacacacucagugaauacucacugagcuaugccuccagcccagucacaguaccucagcauguggaagggaaagcugaccauagaugcaaagguuaguagaguuaaggcuaagggagagaguggauugaaggagcgaggcacugugacucaggccugugaccucagcacuuaggagcagggggucaccaggguagcuacagaaugagauuccauuuuaaaaugaaaagggaagauuuggugauacaugccuauaguuccagcauccgggcagcagaggaaggaagaucaaugcaugcuugaggccaaccugaucgauacagagaaaauuguaggccagccagagacccauucuuuaaaaaagcaaagaaaaaagggcugaaggacaaguagguguacagugcuugucugucuugcacaagauuaaggcuuauauuucaguacugcagcauuuggagcugggcauggugauacuuaucaguuaggaggcugaaauaggaucaccauggguucaaggccagccugggcuacauaguuagauuuccucaacaacaacaaaacaaaggacagaagaaacaaaaugaugggacagaaaaaugucacuucaaacuggucugaacggagucuucuguccacaugcaaccuguuuggcuuuuagcucccagccuuuucuugugcugccugugcucucaaaugaacugcuugccacugcccuuggugguggagcugagccucacguguucauccuuguguguuuucuagucugcccugcuggcuggaagcccggcagugacaccaucaagcccaauguggaugacagcaaggaauacuucuccaaacacaacugagauggguaaacaugggugagccugaagcuuggauuucaccugugccccaaccuggauguccugugcuggcccagaaaaugcuagauuuuccuccacucucugaaggggcuggagucuaggcugagguuuucucauuacccaccuggaaucuggugaauagugauccugcccugagcacaccuagcugggcccaggucuauaggaaaccaauaaaguauuagggacaguguaagucuguguugguguguguuuaguaguuuuaguaguuuacacucuggcuugugcaacugacucuguaguuaugccucuucaccacaagguggaggcauuaccucauucacgccauggucugagcauggugggacacagugagaccaaauaauuacuaggccuggagggauucuuuaagagcucuuuauguuucuccugaagauccagguuccauuccuggagcuuacauaguugcuuacaacccucuuuaacgccagauccaacaccuucgucugauccuccagcaccaggcaugcacgugaacaugggcagaacgugcauagacaugaaauaaauacuucuguaaaaaaaaaaaaauaggggucggcaguuuacuucuggauucuggcucuuagaccaguguccauaucuuaccauuaacuauauaaaaugauauguaacagcuggaucuucacuggguuuuuacauuggaugggaauaaaaacuaaagucaaauugcccugugaguucaaguuugcgaaccucuaggcucugacccaauuuuuugucugguacucugggcaggagagugagaccgguagugagaguggcugagaacgggugcugguuaggcuaggagguggauguuucacugagcuguaugcacuuggguagcuuuucuuucugaguuucacuuucauuuuacaaaacaagggugaucuggucauuaguuuuacuuuauguuuugacacaagaguccccacacugugacuccuucagccucugcuuauucugggguccugcuguuguugauaccuucugaguguuguucauuccccuuggaauucuuuccccucuuuuuauccucaugcuagggguggauagaauccauagucucgugaaugauuuggaagcccucuaccacagagccccccacugagcuaucucuuggaacuuaauguauucucagagccucugguugggccucccuugaggucauccaccuuacuguggcucauuccauuucaggcacacucuuaggauucuucagaugaucuugcuucuuuggcuacaagaacuauaucgaagggagcacuccuuuccucugucccgaaccuacacuggcaaaucuguuggaaagcugacaguucagucuguagaugagcucgccucccuuaucccagaaggcacuuuuugaacauauauuccucuuccuggcucucaucaccauauucaaaccauguuugcuuucguuauaacaacaaaaaaagugugguguuuugugggugggagggugcagugccuaaggaagccagaagagggcauugcauccccugaaacugaagggggguugugagcuuucucagguggguucaggcgaagcagcauucuuguacggucuggaagacauacccuuaacuguuaagcuauuucuccagcucuuucuuuuuuuucuaagagguugugugugugugugugugugugugugugcgcgugcgcucucaggcaugugaagguaaaugguuuuuccuccuggauccaggaaucaaacuuagguaacaguggcaagcaucuaagcaucucuaccugccgagcuaucucgucucacucacccccaucuacuuuccuuuuuucugucugcacggugucugaggguuuuguuuguuugaggucagguuauguuuguuuuguuuugagaaagggccuuacuauguagccuagacaggcuugaggcccguucccuucacuacugaauuauuccucggcuccaccugagugguacgguuuccuuugcgcuuggaucuuccagcuucaagggcacccagaucccaacagcaaguagcagcuuugaaccucccaccucagcugcuggagccggguuguggcgacgcccagcugcccaaacaacugccgggacaggaccagaccuggcagucgccggcuucuggccuggcacacgggagggggacacuggcgggcgggcgccgcccuuccuggcaggaguugcccugacggcgucugcaacuacaggaaggcugcaguuacucuccgccagggucggucuaauggagggggcgugggcgcgguggggcuccggcgccggucuguugaaagccgcucggauggcucccagggcucaugagagcacggcccucccgccgcgggcgcccuggacccgggccuggggcuuuccgcgcccagaaagccgccugcucgggaaaaucccggcccccuucccggcgccgcggcccugcccggcagagcgggggggaggggauucccggaaucugcccggagaccgcgcuggcgucacugagcugaauaggcccauauaugggcagagcuuccguaacgucagcggggaaagccccggcgcacucugcugggcggggucaugcuugcacauuccgcguuuuguccuggguagcuuguuccccgccacugcccgccugcgcagcgucuggugccaggacucaggggauaggaggucugggcguuuguacugaaccuuaugauaccugaaaggagcgagcuacaaacagcaccgugcuugggguagcccaaucuucucccuccauccgcccagcuuggaagaaaaaagagaccacagaaauuaauaaagacaauuuuuuuuuuacuuaaauagauucaauaaaaagucaaacacacacacacaaacacaucuuaaaauagacuuuagacacgaagugcguguuucuucuccacaguacuaugcagagggggagggcagggggcggaggucccucccuaguauccccgcaggcugaguaccaagcggcggggccagcuccgccgcgacagcccccuucuccccucccuguuaaauacacaaauauauuauauucaauaugaauucagucucuuugcagaaaaaaaaaacauacaaaauacgcuggaagggggccauguaaaccucgagguggaaggacugggcgcaggcgggcgggccggaguccagugugugagcugcgccccaggccuuuuggcgggugcccaucgccugccccccucaccccaguggggggcaggcgcccagccuucaaggcuggggguguccguauggggcaagggaggcucucagaaggcgugucccuugaccccuagcagcaacuggcagccguugcugacaugggucaugaccuucugcuugagcugcgccacuugcucccguaggagaccggcagcacucgacagccccgcguucucagccuugagugucuucaccuuguccuccaggcgcgcgaugcgcuccagcuuccgcuuccggcacuugguggccgccagccuguuccgcagccgcuuucgcuccacuuugaugcgcuccuggucuuccauguugaugggggacacaggcggcguggcgucgcggcugcgugccuccgguacggucugcgguuccucuuuaaaggcggaagcgccgcgacucaagcccagcugugccggguggccgcccgcaaaggguggugcaugugggagguagcugaugguggccgucggguaugagcucccagucccgacggcggucccggagccuccagagggugcagaggcuggggaguaacugcugagguugguguagacgggaggcggcuccggaccagcauagacgcccccugggccggccuggggacccccgcuggcgcccagggacacguuggggggcgucacgugguucaucuugugcaggucguccagggcuuugacaaaaccguccgcaaagcccuccugcuccucggugacgccgcccccuguaccuccaccgcugccacccccacggggguaaaaguacugucccggaggcgugggcgucgucgugaucacgccguugcuguuggggacgaucaagcgcuccaguuccguggaggcuagcuucagagaugcgccugugucugaucccugacccgaaaaguagcugccugccccacugcccuccgggccuggaccccgcgccccaggacccuugagaccccgauagggauccgccagguugagcgccaagguggguuucaggaguuuguagucguguagagacaggcugccagggcuccgaccguaucccgccgcugcguaagagucgucgugauagaaaggcuguuccauuuucgugcacauccgggcggccugggcgaucugggaaaggucccccugaagggccgccccgggccucgcugcggcgagcggcgagcuguccucggcuguggcaggacccgguguccggucgcgcguccucgggagcuggagacggucagcagcggccaguuggcagcugugcguaaaggcgcugcugggcuuccggagauuuucucucccuccguggugcgccugcuuucucggcgucgcuucccucaguuccccgcucccagcaggauccuacgcuggccuggccacccucaaaguccccagugcucggccccagccccaagcuuuuauac

SEQ ID NO: 4595 - RNA, 12800 nt, Mus musculus
uauggcuagggggcgggguggagcggggcggcgcucuaggccgagcgggaggucugggcuucgggcgcucgcugguggcggacccggaggcugcugcugcgugccggggcuccuuggcccggaucgaauucgauccggagccaugaguguggacaaggccgagcuaugcgggucucugcucaccuggguaggucggggggcggggcugggucaggugugcgcccucuccucucguccugucuuggucuucuuuccucgguuuuggaccuggaaggaggaauagaucguaggcuugcugggccguuggacucugaccugaccaccugcgucugucacgugggcaggccugagcgaaaagaccaggugaggccacgccccucuggagggcacaggccuggucacauguuagcaguggggaccaggugacuggugguaacgcccugaccuagguuugcaggguuugccaggauagguaaaaugaagccacgccccguccuugccuaggcguguagaagucacgcccccgaagaugugauauguuggugcuacaggcuaaugccuuucuaaccccgugaaaugucugauggcuggggaaaaagucugcaauuccagguccucaauuuuccuguugcccuuccgucuucccccuuuaguugcagacguuccaaguuucaccccccugugccaguccccaggaccugagcagcggacucgccauagcccaugugcugaaucagaugugaguguggcggcugagugggaggauccugaagggcuccccagccugcucaucccaucuuucugccccuagagacccuuccugguucaacaacgaauggcuccagggcaucucagaggacucaagccccagcuggagguugaaggugacagguggacucaugacuagggaauaacuagaggacuuaaggaggugaaggcaaagggaaagcuagauacauguccugugcgauggacaggcagucuugucaggaagagagccagaugucuggugaucagcaagcuauuuuuguuuauauugagcacccacaauaggacaaaaaaacuugccaccauucuuaugaugugggcaaaagcacacacacaacacauguuaacuuccaagaggugugcuggcaaaugcuuguaaucccagcuauggugguguguuaauacaggagggugguaaaccauccaucaucccgucucaaaaccuuuaaaaggccagggauauaguuggcaaaagagaauuugcucacccuacacaagguccugaguucaaucccaaguagcaggguaugcuggguggggggugggaggggggaugggcagggguagccagaccauguggcacacauggagucccaguacuuagcaagccagaggaucaggacaucaagguuaucuuggguggcuacacaguaaguuagaacucauucugagccacaugacacacugcuucaagaaacaaaacugggcuggaagaauggcuuggugguuaaaaauggauacuguucuuccagaggaacuuacugcuucuccagagaggacgcacagacaucaaacagcucucaaccaccugcaacugcucuaggggaugugacacuuguagccucugcaggcauccucauauucucuuucuuucucugucugucucucucucacacacacauacacacauacuuucacacacacacucucucucacacacacacacacacacauacacacauacacacaugguuaaaagauaaaauaaaucuuaaaaaaacaagaaaacaaauucauauaaaccuaugaagacaguaaaaggagggucaugauagcgaugggagguggguaggugcuuauuuuguuuuuuuuuugggggggguuguuuuguuuuuguuuuguuuugaaacagaguuuuuuuguguaguccuggcuguuuuagaucuugcuguguagaccagguuuggccucaaauucagaaaucuaccugccucugucucccaggugcugggauuaaaggcaggugccaccauuccuagcagggacucuauuuuaaguacuguggaauggucuuagcaaaggaaaaacacagccuggcuaagccguuucgaagcugcccuuggcuaccugggaagagaugcagcacagguagcaagaguaggaaaugaaagguugggaauggggcucagcagaccacagcugguccagacuccagcacuuaagggcuggacgcagaauaggagaauaguaaggcgccagggaguggcucaguggaaaaguccuugucuaccauaccuaagacccuggauuugaucagcagaacuucuaccccauccaacaaaggugggagaugagaaacaguggguacagucauccaagugagagauaguagcaguugggccagagagugaaagccauugcauucuggaacuugugaauuaagaaggucagguagacacuauagaccaugcaguuuagcucuagaggagaaggauauuuagaacagggccagacaacaaggugggauaaucagggaaugaaaauugagggacggggaggaagugaggauagguuggggggggggaguugcuguagacuugcaugcauagauaacuccuuggcgucaccaggucaggaaacuggagaagaucuuacagagcuugguggaauacucgaagaaugugaguaacugcaaaggaauuuaggggcuggguugggagucaggguucagucugugagcccugaaagcucccucucucgguguucucagguucuggggcacccugugucagaucagcaucucccagaugugagccucauuggcgaguucucaaauccugcagaacuuggcaaacugcuucaguugguacugggcugugcuaucaguugugagaaaaaacaggguaugaagagggguagaggggaggaaacugagagcacccagaggauacccugaggaaauguucuuuccucuccaagccaucccuggucucagccucucgccuucaccuucauccccagaguauauccaaagaauuaugacccuggaggagucuguucaacauguagugauggaagccauccaggaggugggugcaggcauccccuauagaaauccagaagggucgggggaggggacauuuauuucuaggguagaagcaagugagcacagaccuggcuuugcaugguaagguuaggccucggccuggaagucagcaggccaggucuuauauaugucagcucucagucagaauccagcagccucaaaaguuguggucuuuuucuacacuggaaggagccucugggcaggaguuaucuggcaaaaacuagccuuggggaagaggaagaggagggaagaguuuccuaggcugaauuguagaaaccuugaagguuguaucagagagccuagcuuaccauaaugcccccuuccacagcucaugaccaaagacacuccugauucccugucaccagagaauuacgggaauuuugauacacagguaaugaucacaaaacuugguaaaagauucaaccccaccacugguucucugggcugcugaggcggaaaggcuuguccuuagguaguccagacagcaggggugaacuuuugauucuccugggacugccuggcuuguagcugagauuacagcugaacaccugauaagggggcuuguuauccuugagcuuuuaaucaacccucccagucucuuggugucuuagccucuucccuugccacaucccaaugguuagaaaauuauucuucuuccauauucuuaggaccccagcccagucuuaaauccuggggcucccuaaccccuccccagcaucccuagacaucacaacuuucccacucccuucugacuggauccccaaguccuucaucuucuauuccccccuuuacccuucucagucccgcagguacuauuuccugagugaggagguggaggagggugaucaucuucagcaacauuaccuggaucuggagcgccagguggguggggccgcuugcguaaauccuaucuguguaagaccugguuugugcuucaguucaccuaucuccccugcccacagcucuugcuccuuucagaggagaagcagaaucuggcacaagagaacgcugcccuucgagagagggugggccggucggaaguggagagugccccgggccucacagcuaagaagcuauugcuucugcagucacagcuagaacagcuucaagaggagaauuucagguguggucaguugggagguggggguggggauggguggggccagggcacuggggccaaagggcauccuccuuuaucuuccccuugauaccccaggcuggagaguagccgggaagaugaucggcuucgcugccuggaacuagagcgcgaggucgcugagcugcaacaacggaaccaggcacugaccagccuaucccaggaggcacaagcacuaaaggaugagauggaugagcugcgguagguggcaggucccgagugcccaucauauaucugcagcauugacacaaaaugcccccuuagugcuauggcacauucaacucccagaugcuaaguggaccuauacacaauaugucgcaggcuuccacaugacacccugagccacaccaugccacuuaggcccacugcacuguccugaacuuaugucuccugagagacucccuggauccguggagcccccuugguuuuacauugccaucagucaauaccuuacagcacccuugacaaauacaaccccuccuaacacucuccagaccccagugcaccauuuggaucccaucaugccucuggauucaaggaugcccucuaagacuauaucauuguagcccccugugaaucuacugugccuucuguauccugaaagaccucuccuguaacccuaaacacucuuagaauguuaaugcaccuggugaaccaucccaccccgauucugaagacuccuuacaguucccccacgaccccaaaguguccuuaucacucugcuaucucacaguucuuccugucugccguuccugagaaccuuucuauuauaaccuguuucccuaaugaccccuaccggcacuacagaccugacugaugcuuucagcuugaacccgaaucccucagguugaacacccuucccugcccagcccaacuucccagccagccucugaguuuuccacucccuaucccuuucuuaggcaguccuccgaacgugcaaggcagcuggaggccacucugaacagcugccgucgucgccugggcgagcuccaagagcuccggcggcaggugcggcagcuggaggagcgaaaugcaggccacgcggagcgcacgcggcagcuggaagaggagcugcgccgugcaggaucccugcgugcccagcucgaggcucagcgcaggcagguaaggcacgggcacguagcuccaccccuuaacggcccgccccaucacuacacuucacuagcagcaaggcucugcagcuuucucucuuuuguuacaagacucaccccuccccugccuggguuuguaagccccaccgcuucucuaaaacaccccuccucccaacuucuuggcgcugcccggucccucugguuccacucccucuucugcagcuugguugcugccucucuuuccaucucugcuguccccaugguuuccccuuucacucuuuuucuuucuuuaaauaauuucuuguguauggguguuucagcuacaugcaugucugugcaccacauaugcaucuugugcucauggaggccagaagagggcaucagauccccugggauuguagucauagauaguugugagccaccacaugggugcugggaaucaagucccuauccucuggaagagaggagcgagggggcccuuauuuguugagccaucucuccagcucccaacuuuuuuuuuuuuuuuuucaagacaggguuucucuguguagcccuggcuguccuggaacucacuuuguggaccaggcuggccucgaacucagaaauucaccugccucugccucccgagugcugggauuaaaggcgugugccaccacgcccggcagcccccaacuucuucuuuuuuuuuuuuuuauuaaagauuuauuuauuuauuauauguaaguacacuguagcugucuucagacacaccagaagagggcgucagaucuuguuacggaugguugugagccaccaugugguugcugggacuugaacacuggaccuuuggaagagcagucggguacucuuacccacugagccaucucaccagccccagcccccaacuucuuaaguuauauuuugugugugaguuuggguaucugugugugagugugcaggugagguucagaagacaacuuguagagguugguguucucuuuuuaccaugaggguuccaggaaauccagcucagaauugaauuaucuugcaggugcaagaguugcagggccaguggcaggaagaggccaugaaggcugagaaguggcuguuugaaugccgaaaccuagaggaaaagugugaccuggugacaaaggagaaggagguaaggcugaagcccugcggcccaggcucuacccuuugcauccugggauagcccaucuuccaggagguucaccugacaucuugcaucugccccuguagcggcuauugacugagagggacucccugagggaggccaaugaggagcuccgcugugcccagcugcagcccaggggauuggcucaggcuggugagcuucagauccggcuuggggaugggcuggggcuguacuugaccccucaaagaugcucccugaaaagagaacccagggauggagacuguggauguauagaaaccugaagaucucuuguuuucagaucucucccuggauccuaccccuucuggccuggaaaacuuagcagcagagauccugccugcagagcucagguaugcugggaccuuuuaaggcucuggacccaucuaggacaggcaaggcucuuccucagccgcacucuuacaguacaagcacugacguggcuaagggcuuuacuguuccaggggcuuucccauuccaggauccguguucagaacauaaauuaauguguagugaauacggcuuugcuccaggugcaaaauucuuacauuuuaguccugcuuacucugaucugaggaccaggggcaucacuggugccccuacugugugcaguuccuuuugcucugcucugguaacccccaucucagcucuuacuguuuccacagcuggaugcaaguguuuuaaucccugacccccacacaccuccuuuagagccccacccucuuugauuucccucaccacacccaggucagcucccagagccuaagccaccagaguccaugcuagguccucaguacuccuaccccaaggcaggcuggguucuuugcgaagcagcauucggcccaggguuucaucuaauagucugucuaggacgcagcccuacucacuucccccuguuucucagagagacgcuagugcgacuucagcuggagaacaagagacugugccagcaggaggccgcggaccgggagcgacaggaggaacugcagcgccaccuggaggaggccaaccgugcacgccaugggcuggaagcacagcaacgguaagagccugccuucuuguuugaaagcgcaaccaagcgcaagcacugagcacuguucccugccaggcugaaccagcagcagcugucggagcugagggcgcagguggaagagcuacagaaggccuugcaggagcaggggggcaagaccgaggacgugagugccugccuccucccugcuuggcccucccuugugcuccccaguaaucccccuuucucccuccccccuugcugcccgaugccugaagaaggccacugugaguaccacggguccagggaggcgcaccacuguuaccugcacagcuucucagaccuuguccccguccccucacuccccgcugcuucucuuccccagcccacccugcugaagaggaagcuggaggaucaucuguaagugcagagaaccuucacuccuggggugggaacucuugggacaaagguguggagaauugugggugaagagacccagucagcucaggucaaguagagucuuuauuuugagacuggaaguuguguaccugaaacuggucuugaauuccugauccucccaucucccaagugcuaagauagaagguguguacuaacaugucuugcucucaagggugauccugugcuuguuuuugaaguguacugauuuuaugugugugaguguuuugccugcaugucuguguaccacaugaucucauggaguuccgaggaaggccguaagcugcugggcggugguggcacacgccuuuaaaaucccagcacuugggaggcagaggcaggcggauuucugaguucgaggcgagccuggucuacagagugaguuccaggacagccagggcuacacagagaaacccugucucgaaaaaaucaaaaaaaaaaaaaaaaagaauaguugugagccaccauguggguuauacuugggguccuccacuagaacagcaaacggaucuuaacucccuccuuuguauuauuauuaaacaaguucucccuguagcuuagccuggccuggggcuuguaauccuccugccucagccuccuuccugucaugcaucacugggucuggcucagaaucuuauuuagaaaaagaggaugcucauaugggacugugauuccagcacucaggagguagacggaagagggacaggaggucaaggccauccugggacucuguuucagaaaaaaaaguauguccauauguguguguuaauauaaaaaaauauggggcuggugagauggcucaguggguaagagcacccgacugcucuucugaagguccagaguucaaaucccagcaaccacaugguggcucacaaccauccguaacgagaucugacucccucuucuggagugucugaagacagcuacaguauacuuacauauaauaaauaaauacaucaaaaaaaaauauauaaaaaaauauaauguuacauaauauagucauuacauuaugguauuuauuguguaauauaugauaugaaucauauaucuauaucuauaucuauauauauaucugaguuugaggccagccuggucuacaaagugagugccaggacagccagggcuauacagagaaacccugucucggagaaaaaaaaaaaaaauauauauauauauauauaucacaccugacuaccugacuuagugguagagcacuggccucguauggacaaggccucuagguucuauccuuagugccacaagaaguaaaaguaucugugcggcuugagaaauaguucucucucucucucucuguuuuuuuguuuuguuuuuuguuuuuugagacaagguuucucuguguagccuggcuguccugaaacucacucuguaaaccaggcuggccuugaacucagagauccacccaccuucugagagagaguucuuuuaagaguacagaggagggcuggagagauggcucagugguuaagagcacugacugcucuucuagaggcugaguucaauccccagcaacuacaugguggcuuacaaacauguaguggagucugaugcccucuucugguguguuugaagacagugaccauauauucacauacauuaaauaaauacauaaauaaauaagucuuaaaaaaauauauuuucagagaaacccugucucaaaaaaaaaaaaaaagaaaaaaauauuuuauuuucauguugaguggcucacaacuaccuguaacuccagcuccaggaagucuaacacccucucuugcuuccccaagcacacacacaagugugucauaccuucagccccacacaggcacacacauaauacauccuaaaaaccaaagcaccugucugcuggguggagagagagugaaaccgaggugcucaaagaggaagaggcagguuggagagaaggcucagugguuaagagcacugacugcucuucuggagguccugaguucaauucccagcaaccacaugguggcucacaaccaucuguaaugagaucugaugcucucuuauggugugucugaagacagcuacaguguacuuacauaucauaaaucuuuaaaaaaaaaaaaaaguggaagagggccaggcagugguggcucaggccuuuaaucccagcacucgggaggcagaggcaggcggauuucugaguucgaggccagccuggucuacaaagugaguuccaggacagccagggcuacacagagaaauccugucucaaaacaacagcaacagcaaaaaaaaaaaaaaaaaaaaaaaaaaaaaguggaagaggauggcuagggauaaaggaaagaugaggaccagaccaacuuggggaucacaggauggcgagaugauuagacagcguggaggccucugacuugcuguugauagaagagaaggaaccagugggcuaggagugugucucugcuauagagaaugagccuggaguucaguggggugcucauggcagagaacaaagcccuggauuauaucuccaacaccacagauacauggauagguggagauagauggacagauggauagauggguggguggacggauggaaggucaccccacugcuuccaugcccacaggcagaagcugcaugaggcugaccuggaguugcagaggaaacgagaauacauugaggaguuggagccucccacugacagcagcaguaaguggggcccaacaguagccaggacuagagggagcccugaguucagcauggaacuuggggggcccuuauuuguucuucagcagcucggcggaucgaggagcuacaggacagucugcagaagaaggaugcagaccugcgggccauggaggaacgauaccgccgcuacguggacaaggcgcgcacggugaggaugcuggugucugcucuccuaccuuagauccuacucugugugcuucccuucagcucaugccuccugccaguuuguuugucucugcccucugcauccacaccugcacaccauaccaugucauaucauaggcgucugcgugguacugccgccaagggcugucaaauccauuguacucagcguguuaaagggucuguaaagaagcuugaguggcauagcaccauucugccucaaauccacaaauaaggugcuggagacauggcuuagugauagagugcuuaucuaaaaucuaccagccaggguaggcauauagguaugugccuggguaucuggcucacuaacuauacuugcuuagcaggcaggagguccuggguuuagucccuagcauuccaaaaaauaaguaaggccgggcgugguagcacaugccuuuacucccagcacuugggaggcagaggcagguagauuucugaguucgaggccagccuggucuacagaguaaguuccaggacagccagggcuauacagagaaacccugucuugaaaaaccuauaaaaaaaaaaaaaaaguaaauauauaacauaaacccaaagcaaggggccugggugcuucagcucuguguucccagcuauucugcaggcuuaggcagaaugagcggggaauggugcuguaaucuuuuauuccuagcacuagggggguagaggcagcaacaacucugaguuugaggucagccaggcugcauacugagacucuguacgaagaaauacaugcgcgcgcacacacacacacacacacacacacacacacacacacacacacacacacacacacacacacggggguggggugggggagugguagagguagaaccagguaugguggcaucugugacccagaggcaagaggaucacaaguuugagccuugucucaaacaacaaaacaaaaugaugcuaguaauacaacuguguugccuagaaugcaugaggccuuaggaacaaucaguccccgggacugcaaaaugucacuauuauuauaaugaagguugcucuccugugcuccacaccccccccaauuccuaggucauucagacccuggaacccaagcagaggccacccacugugguguccccagaauuccauaccuugaggucacagcucugggagcggaaccugcggauacggcagauggagguggguauccucauccuaucaugccauguggcccucagccccacccagccccugacucuugucuccuggcagauggacuaugagaagagucggagacggcaggaacaggaggaaaagcugcuuaucagugccugguacagcauggugaguggguuccuccccagggaggucaugugggucauagaugucauaccagguucacauggcucagguaggcucacuuacccugcuaauuauaccauuucucuagggcauggccuuggagcaucgggcuggggaagagcacgcuccugcccaugcccaguccuucuuggcacagcaaagacuggccaccaaugcucgccguggaccccuggggcgccaggcucugagccuccgccccacugacaagcacugacaagaccucgacuuccugcugccugcuggagucuuccaguuuacauuuacccagcugggccuuugaccuugauugagccugacuucugcccuuugcuuccuuagaugggagagaaggggacaggcagguagcagguguggaacuauuccuuuuagcaaugugauucuucuugauucuucuccugggccucguguacuaccugggaagagccugauuuuauauuugaaaagaauaaagacuuuaaaucugucaugaauguacucuagacacaaugacgaagaauaaaaacugcacuggggacacagaccauugcuuuuaaaauaaaguuuuuacauguaugagcguuuuugccua

SEQ ID NO: 4596 - RNA, 7332 nt, Mus musculus
ucugaggcuguaacucaacuaaaggggauggacuugggaggggcugcccacgcccacuccccagcuccuucccaaacagucuggcuucagccccacccaauacugaagacacccucccuuuuagucucugucccuugugucccuguacggccacaggugagaagggccaggucugggagaauaaauggcccuggacuggcaggcuuugggcaggacuccuggagagagaggggcagaguggaaggcuaggaggggcagcacaaaaggaagaaagguaaaggagaaucugaagaaggccuggaggugucggagcugggggauuaaaugggcauugggguaagcugguuccuugucagaggaagggaggcugcuggacagacuggggagccggagcuuuagagacgccauucagagcaguucugaauaugagggggauaguaguucugccggggcagacuguagucucaagagaggacagagagaaagccaaacuugggagagugggcaacaagaggggggauauugaacccugaggauuagaaacugaagacucaggaagucaaaaagauugaguguuguacaggugaaagggauaggagggugugugggaggaaggucaaaaagugacuagauucauccaaagguuuaggagugagggaccuaagauaaaguccaaggggcuuggaccaucagucuagagaaggaaggcagagcaagacugggagaugggaacucgagaaagggccaggacccgggaaaagggggggggcguuuggggguugggguagggugguaccaggacgggagugaggaccgcccuagggcaacgaggugcuagggugcugagacauuggauaucaucaccugcugcgcugucgcccgcaccuccaccuucaacugaaagccccaggaucagccccucccagcaucuucccuuggcucacaggcccggacccaggcuaaaaccuucuccauuggccacacuggccaggcgcagcgaugaccgucaccuacacagccagaguggcgaaugcccgcuucgguggcuucucgcagcugcugcugcuguggcgcggaagcaucuacaagcuccuguggcgagagcuguuauguuuccugggacucuacauggcacuaagcgccgccuaucggugagaagaccuggaguuggggcuggggaucugagcccugcggaagggacugggaguggaggggagaccuguagcuacugcauucccuaccccacagcuucuuacuggcagaagagcagaagcgcuacuucgagaagcuugucauauacugcgaccaguacgccagccucauccccgucucuuucguacuuggugagguugggcccccugagaaucuuauuccuacguaagggagaaaucuguuuuccauccaugcuucuuggagacccccauuccuaccccucuaagacucaaaucuaaccuccaaagcugggugugguggcgcacgccuuuaaucccagcacuugggaggcagaggcaggaggauuucugaguucgaggccagccuggucuacagagugaguuccaggacagccaggguuacacagagaaacccugucucguggugggggguggggaaucuaaccuccagagcuucccacuuccaaauccacaccugaaagaugaccauaugacccuacauccugagacauuuuuuaugauguccucuaaggugccccuugggagcaucaccucacccacagacaucacaaguuguaucugcgucagguuacuauccuccacacacacacccauucugagcacccuccccccaggaaauagauauuauuccauucaaauccagccuggccccuagcccuacagaaagcucacaucccuugcaucacguggaugggaugaacugccugcccagcuuccccuuccccgcucacacaggcccacacucuuucuaugugugggguuuggugguggugguggugguggugguggugguggugguggugguggugguuuuguuucuuuguuugucuguuuguuugggacaaggucucuuacuauguagucucggcuggccugaaauucccucaguaaaacaggcugaggacuaaacucucucucucucucucucugugucucucugugucucucucugacucucucugucucucucucucucucuguuucucuuuuuguuucucucugucucucugugugugucucucucugugugucucucucugugugucucucugugugucucucucucugucucucucugucucucucugugucucugucucugucucugucucugucucugucucugucucugucucucucucucucucucucucucucucucucucucucucucucucucucugucaagguuucucuguguagcccuggcuguccugaaacucacucuguagaccaaguuggccucaaacucagagauccaccugccucugccucccaagugcugggauugugccaccacagccaggcuuccaggcuuaaacucuuuuauaaauuccugguuuggggacuacauguggcugcugugguaaaucuaucuagauguccucgguguacauuccaccuucacacaccaguguccucaccuuguuuccaguccagauaacccaagcaagcccagugguucccuggggucagaggaauguaccuucuggauccuaggaucuccacuuccauauuaggaccacaacuccccaucucaggguaccucaaccugcuccagucucuuuggcuucagggcuaaauccccacguucucagaccagauggccuguguggucagggugaccagccuuuucuaaggucacugaugcaaagacuguaucagucccagagcuugagcucccagacucuuggcccuugcauccuugcugaguuuccaucuccggcuuguccccaggcuucuacgugacucugguggugcaucgcugguggaaccaguaccuaugcaugccucugccggacgcacucaugugcauaguggcuggcaccgugcaugggcgagacgaucgaggccgccucuaccggcgcacgcucaugcgcuacgcagggcucuccgcggugcugauccuucguucuguuagcacagcagucuucaaacgguuccccacuauagaccacguggucgaggcuggugagucucuggccagaggauggcagggccagacaggugagcggugcgaguaacguuggaucacccccccccccgcccccuccaggauuuaugacccgagaagagcgcaagaaguucgagaacuugaauucguccuacaacaaauacugggugcccugcguaugguucucgagccuggcagcgcaggcgcggcgagaggggcgcauccgcgacaacagugcccuaaaguugcuacuagaggugagccugagaggaagugauuguuagaauaucagaaacugugcacguuggagugggucgaagguggcugaccucgcaaccucccacuucacaugaagcaguauuccaaacccccuuaccagauuuccaugagggcagcccuguugugugugguaacccuacccaguuguaugucaucaccaaauacccugcagcuccaggauacaccagccuaauucauaaugugugaccccaucuucaucugggcacccguacuuaaucuucauccaaguuccucauccacccuaggagcugaauguguuucggagcaaaugugggaugcuguuucacuacgacuggauuagcauaccccucgucuacacccagguaacuucuccaugccuccauuuauagucagcauaggaggcucuauuccucuuagggaaaaauggugguacccauagugguacccacgucuguacuaauuccuagcauuugggaaacuaagauaaagaauccggaguuugaaaccaggcuagguuacagagagagaugguuucuuuuucuuucuuucuuucuuucuuucuuucuuucuuucuucuucuuuuuucuuuuuuuaaagauuuauuuauuguuauauguagguacacuguagcugucuucagacacaccagaagagggcaucggaucucauuguggaugguugugagccaccaugugguugcugggauuugaacucaggaccuccagaagagcagucagugcucuuaaccgcugagccaucucaccagcccuaauauuuucuuuuuaaaaauguaagggcuagggcuggugagauggcucaguggguaagagcacccgacugcucuuccaaaggucuggaguucaaaucccagcaaccacaugguggcucaaaaccauccuuaaugagaucugacucccucuucuggagugucugaaggcagcuacaguguacuuacauauaauaaauaaauaaaucuuuuuuaaaaaauauaagggcuagccgggcgugguggcgcaugccuuuaaucccagcacuagggaggcagaggcagguggauuucugaguucgagaccagccuggucuacaaagugaguuccaggacaaccagggcuauacagagaaacacugucucgaaaaacaaaacaaaaccaaaaaaaaaaaaaaaaaaaaguaagggcugaaagucaauuacaacucaaucacucugauguucaaugccaguacugaucuuuccaggacucucuggggcacacggggcagggggugggguuaggagagaucugguuuccauuugccuggcccguagguagucacuaucgcaguguacagcuacuucuuggcuugccucaucggccgucaguuccuagacccugcacagggcuacaaagaccacacccuggaccuaugcguacccaucuucaccuugcugcaguucuucuucuacgcuggcuggcuuaagguggguagggccgugaggcaggaacggaagagugggauuugaaagguucuccaagcuccaccugccucucuucucugaacucagguagcagagcagcuuauuaacccuuuuggggaagacgacgacgacuuugagaccaacuuucuuauugaccgcaacuuccaggucagcgucuccuccuggugcacacaccuaagaguuuccuaaaguggucccagacucuccuagaccucacccuaaacacccuucacucuuugaucacacaccgugagggcuccacccacccugcccugccuguccgcauccucagguguccaugcuagcuguagaugagauguaugacgacuuggccaugcuggagaaagaucuauacugggaugcagcagaagcucgcgcgcccuacaccgcggccaccgcuuuccugcuucagcagcccuccuuccagggcuccaccuuugauauagcguaaguuagcgggguggguguggcuuagggcucugcaggcuuagaagggucuacggucuguggguucauggggggaaaaggaguucuaguaaccaagauagacaauuuugccuggaaagguggcucacacuaagaacccacccuaagcugggcgugguggcgcacgccuuuaaucccagcacucgggaggcagaggcaggcggauuucugaguucgaggccacccuggucuacagagugaguuccaggacagccagggcuauacagagaaacccugucuugaaaaaccaaaccaaaccaaacaaaacaaaaccaaacaaaaaacaagcacuaagaacccuaacacuugggagguggagccgaaggaaucaggaguuuggcuaugcaacuagaucaaguucggggcuguggcugagguggaaacuggucaucaguuggagauugggggcagagcuaaagacuuuuaaagacaagauguggccaugauugagguuacagcaccagaagauaugccuagguccauagagguggcuggagcuaggcggguuucaggugcuaugaauccugccuuguggauuaagaagagaaaagcccggaugagaguagggucuagucuaucauggaagagguccuaguuuccaccucaaacaccgcuaaacaggcagagauagauuggcagagcgggaugugagggcacagaccuguagucagucccaggacuggggagacaagacccaaaagguugauucacccacaaguuugaggccagucuggacuacauagugaauuucaggucaguaagaacuaaggaaugaagcuuugucagaccaaacaacacagagagaggaggggggagagagggagagacaguguuucuccuuugaaaccucuucuacuccugggagugccucucuuuccuuaaucuaccuuuccucuacuuaaaaauaaaacaacaacuaaacuaauaccaaaaaacuagccaaguaguggaggcacacuauuaaugccaggucuuuaaugccaggacucaggaggcagagguaaguagaucucaguaaauucaaggucagucugguuuacaaagcaaguucuaggacagccagggcuacacaaacaaacccugauagggcagggaugggggagcagaaaacugaaauggaauaacacaucaacgcgaagcaccaaggcuucagugaugacuccuguccacccuguaggcuggcuaaagaggacaugcaguuccagcggcuggacggcguggauggcccgcugggagagguucacggggacuuucugcagcgccuccugccggcgggggcggguucuguggguccgcuggggcggcgccugucgcuguuaaggcguaaaaacagcugcgugucagaggccuccacugcugccagcuguggcugugcaggcgcggcggauggcggaggcguugagugcgguuguggagacccauugcuugaccccagccugcgggagccugagcuggagucucccgcauguccugagccgccugcccccaucccggggccaacuccugaaccuuuuaccaccgugucgauuccggguccucgggcuccugcgccacccuggcugcccagcccuauuggagaggaggaagagaguccggccugagauccugggaccaggaccccuacggacaccuaccuaauccugcacuagacaugcuggcgaccaccagggucugcacaagcuagcuaggccuucagaaagccgaccuacucauuuugaccagcggaaucucccacuggggcuggugguuuuagggguccauauucucccagcuguugcugcuucccucacccccaaccccccacucuuuaagagguuuugccuuccaaacaccaccaccugaccuguggccucuguuggucuucugaccguaccuuggguucuucccuucgaguggaauugacggccuaccucaugaaauugugaggaugaaaaaaauaaauaaaauaaaauaaacgaaac

SEQ ID NO: 4597 - RNA, 7361 nt, Mus musculus
agcuguguaagauuauuuuauugaggagugugaggcaggaagagguggggggcauugcagccuccccaggccccaccagggggaacagacccccucccaccuccuaaguggcccccugcauuaugggggacuuugugcaaacucugccccauggggaaagaggaggguaugaaggcagcagcagggauggggguggcuacugggugcuggggggcuuguagggcuccaggaggagggcagagaagguguugacuuugucggcuccccgaaccucgugagguaacaguggcagcuuuacaaugugaaagucuucauauaggucuuccaucuguaaucagguuagagagcagaaagcagagacugagggcugggagguuagggcagaagcuaaggguaagguaaguggggccaguaaauccagggauggccugggugucaggcuucccaguugagcuccaguccucugaauacagaaggcucaggacucgcgugcaugcacacacacuaggcaagcauucucuacugagcugcagccccaguccccagagaacacaguaaaagacaggggacucuuggcugggcaggugggcauaccugguccagguacuuggccuggaucuugugucgggccucacacaucuugcaggguuucucagggucagggaagacaagcugguugacgaugauguugugggugucgaucuugcacuuagccagcuccuggaucagccgcuccgucucguacaaggacaagaauucggcgaugcacacacagaugaacguugucuguuccuguagggcacaagacaggagagaggaagggaucuggcugaucccguccucaggagccucucacuaccugcugaacuggaucauaacucacaggguccuugaacuguucgcuaacagaucggaugacaggcaacgucucuucuagcuuggaggccaguuggucagcauucaugucccccaggcccagcauguugcacaucuguggagaugagggaauagauuugccaccuugcugggcccaucagagccucggggucaggggcuuacugaauacugaaguaucuccacuaaaggugugggcccuggggccaacucaugggguaggucuguguaauguagcucuuccauuuugugggcaaacauggacacauuaucugaccuccugaccucucaggucucccaucuucacaccuucccuucaagagccguugugcuuugugagcagucauguguuuuauuacaaauuggugugaggcacuuaguagaugcuuggcagacauuauuaucugaggguggaggaaggcacauguaucacaugcacgcucuagagguggacaugggaauggggcaagugucacugacuguauugauggcucacagaaccauugcuguguucucccuuuuuuuugaagugagcaccacaguugacagagaaggaaaggaagacccagggaggugaaaagauuuacuuaagggcacacagcaggugggauguggagggagggagaccaugccucuuacucugccccaaagaacacgguuuggguuaagacacugagggcaggaggggcguggcaccugccugugagaugaaggggcugaucugguucuugaucugcaucaggcggcccaggccccucuccacgauggucgggaaguucaggagccugaguguauggccggugggugcugugucgaacacuaccacugagaaguucaugccuuucaccagccugggggggagaugagggucaggcucaaaccagaggccagaagcccucccggggcaggcaggcacccccaaucccuggcaggcugaccucaugaccucagcauaacucauggcuucaucgaugccagggaaggcgcucauggccuccugcaucaucuucuugcccaugcucagcauguugucuuccucgaagaacucgucggggagcucugcaacgcccaggcuggggucuaucuccugggggccgaggggaccagacucaggcugcugcgaugacggacucccagagggggccucaacuccuaggugcaggccagaggaagcccauguagggcuccaaccacauaggaucccgggucugucccaucagugguuuaaccuucacaaucaaguaagaaauugcaaacuuggacuaggggaggccccaaagacaaguugaaacccaaacccacugcaggaauuugcaaaggcaacccaaaauuugcuuucccgauaaacaaccacggcuagcuccauccacuuucagauuaugccucuaaugugggucaccucugaaugagauucuuuaauuuuuaaaacaagacgauauguagcugagccuagcuguccucacccuccuggugcugcgauuacagguagguguuccaccaggcucgcuggccaguuauucuguagguuaccuugacccuuguuuucucucccugcccaucugcucucccucuugaguaguguucucuauuuugagggguggggagcaggguugcagguggaaccaagggcuuuauacaggucaggcuagugcuccuucacauuauacuccuaaccacucacugggagauuauaagcaggugcucuaccacugagcaauucccaagccccuuaaugguaacuaccuucuagccgggcauuagacccugugaccccagucucugauuaguuuuaauaagagcucuacuacugagcuccagcuccagccucaggcugcucacagcucuaguucuucuucuucacugcuguaggcagucuccuccauucugcuuauccacagcugucugguauugauguuuuggggacaaaaccagacuccaacagucauaccugccaccaacuccuaaugacagguccucaauggaugcuugaaagacacacuaucccuacucugacaagugucuguaucucauuccuccucaaauaucuccagucucauucaccguggaagucccagccuuugcaugaaggagaagccucuggcugggccuggcggcacaggcuucuaacuccaacaauuaagcagaaggacaggaagguugcaaagugaguucaaagugggcuguaaacuuaagugagacuaaaaccaacaaaucaaauccacagauuaaaaaugcaaugagccaggccggauggcagcgucacccccauugcuugggaggcaaagacaggcaaaucucuaugaauuugaggucagccugguuuacagagagaguuccaggacagccagggcuaaacagagagacacugucuugaaaaaaccaaaaccaaaccaaaaaccuguaccaagccaguaagaugguucagcaaguaacgaaacucaauccaugacagagcugaguuccauucuggagcccagggaagaagagaggcagcaggcagccacacacacacaggaauaacagggaacaaagggcugagaguccaguggcgaaucuggcauuggaugccccaggcccugccuucaaucccuacuccuggaaaauagguugaggaaaaagauggggguguaacaucucaucugccucaggaaacaccccuaguucuacauacuuccuucugauuuccacccuuggcagagucuaagucccggcucugugugcuuggcagggcucaaccuucaagaacuaucccccaccaccucuccccacugcaaucaaauaugcccuaccaccaccuuuagaagcccuucuaaaggcagggguggagcugugcuccugcagacucagcugcucuagaggcugaggcaggagaagcaucuguacucaggggcuagucugggcuagccugggcagcacagaacaguugcucuguuccagcaacuccacuucccugcugcggguucccauucucagcuuccaucaccacaguuaccauuucccucauuaaaaccaagcugucacaggcacuggagggauggcucagugguuaagagugugggcugcuguuccagaggacccagguucaauuccuggcacccacauggaggcucacuacuaucuauaacucuagucccaggggauucaacacccucuucuggcuucugagggcacugcaugcacauagcacacaaacacacagguagccauaacaacuacgugcauaaaaauauuaaucaaaacgaugcgauuuuugucaggcaccaggacacauagcugucacaccagcacuuuagaggaggaucaggcguucacggucauccuugacaacauaucaagguuuagcccaugcuaaaccgcaugagacucugucucaaaaaccagccagcuagccagccaaccaaccaaaaccaaaccaaaccaaccaaacaaccuagaauaacgugaacuggagagacaccucagaagcucaccagucaggaacauuugcugcauugcagggaaaugagguuugauuucuagcacccacaucaggcacaucacaaugaguuccagggcacacagcaauuguucguucuagagcaccugaagucaagaacccacguaaagguguaggugguaacaggauucuguaauccccgugcggcuaggguaagauagguggagaagcccuggaagcucucaggccaccuagccuaguguacacagcaguaaacaacagaccaucucacacgaggaggaagagccaguaccaacaauguucugagcaugucuugacuuucacagugacacauuggcaugagcguguguguacacuaaaguacacaccgcacgcacgcacacacacacacacacacacacccacccacgcacaccccccccccacacucacagagagaaccuggagaucucacuacuuuacuuccaaaauauacuguaaaucuacucaccccccuccccauucuuuccuuuuaugagacuaccgugucaugaucugggaacauccacacauccuucucguuacucuucccaacuucauccucgauuugcaguccaauuuccauacgacugucagacauguggcuauuuauuauuuauuuauuuauugguuuuucgagacaggguuucucuguguagcccuggcgguccuggaacucuguagaccaggcuggccuugaacucagaaaucugccugccucugccucccaagugcugggauuaaaggcgggcaccaccaccgcccggcguggcuuuaaaaaaaaaaaaaaucuuuagaaacagaauuucucuguguacccuugguggugcuggaacucggucuuaaacucugagaucguccugccucugucucccaagugcugggauuaaaggugugugccgcuacuccuggcugauuuacuauuauuguuuuuaaagacagggucuuacuauguagcccugauagccucaaauuuacaguaaccggccuuccucugccucucuagugcagggauuaaaggugugugccacccugcccagcccuuuucaaacucgagagcugggaaugcagguugucacuguguaacaugcgggaugcccuggccuucaccucaagcagcaucagcaacagcagcaacagcaguagcaccaccacuaacaacacaauaacagcaaccaaaacacgaacauggagcuagagagauggcucagcaguuaagagugugugcugaucuuccagaggauccucauucauucccaguacccaccuagggguggggguucacaagugucuucaaacuuaaagcucaagggggcccugguaucgcuggucccugcacacguaacuaaaaauaaacuaaaucuuuaaaagaguaacugugcauauuaaaaaucuucuaucacacguagacaccaagccaaacugcuugcccagccagcagagccccacagugugcaucucugguugggccuccuucuuguuugcucuguuccaguuuaucgccuuucuccccgcuccucaaagguuuccuucccacaagccucucuggguguauguugggggugugacgccuagagaugaguauguagacuaugauuggccugguggcugcugguagguacguccucaaaaggccuuaugguuggggccggagagauggcuugguguucagaguacuggcugcucuuguaguggaucugggcuggauucccagcacccagaugguggcucacagccaucuguaaguccagucccaggggaucugaugcccucaucuggccuccauggguaccaagaaugcacucuggguaaaacaccugucacuaaaacaagaucugccuuauggggaccucaggcagagcugaggccagcuuuacuuaccauagcaaagagguugucauagccuuugaccuugguaggcaccuuggagaacuucuggucaaaagcaucugagauguugugagcugggucuguggaaaugaucagaacacucucacgucccuucgacagcuggacugccaggcugcagcugcgaaaaagaaacgugagaagaugaggagugaggagucaguuuugguagugguguuuguagcaggaucugcaaggucaggccacagaaaccuggaucugcaaggaccuuaugaccaauguauaggucccagugagaucaagccuuacuuaauccuugaagaaaucaccaccugacuucgauuccgauaggacuggugugcaauauucagcugacugauaggaucuuuuugaaugccuguuucugcuuuuuuuuccccucccuuuuuggcacucaguggcacaaaccagcuguccagcaggcagaaugcuuucccucccucccucuacuuguucaggacaauguacuucaccucucaacgaaccgaggcaccauaaucacgugcccuuuccacuccguuuuacuucuucccucucuggcaucaaauagaagucuguuauacuaagacagcuugccuuagugucgcucccucuacucugaacucccugggggagggugggggggguacuguccggcgggcugcgggauuuacguguuccucugcacaucccacacgcugaauucacaagacccaaagagagaugauccaacccaggaugcuaggcuugcauucaggagguaucuucagcaggcugcaguaauuuccagagagaaacaaccccguagagccaugcucaguucgcuuugccccgcucgggaagagaaagccggucccuguccucccuuugguccagugguacaucccacccguccucugggccccgcuagagucuccuuaccugcagguggucuuaccaacgccacccuugcccccgacgaagauccacuuaaggcuacgcugcucgaugauauugcuaagcguggguuccagcggcuccacaucaggugcauccucgaacucuucugcuucaaccccccacccggccacccccgccgccaucuuggacccggcucacgugauua

SEQ ID NO: 4598 - RNA, 3466 nt, Mus musculus
agacgaagccagucccgcgccaagcgcgcggucugagagccuuucccgacguccuuugcacggcaucuggccacaaaauggcugcccgagggagacgggcggagccuccgggucgggaggcgcccggcccggcgggcagcggcaggagccgaugggcugagucgggaccgggaacgucacccgagaguggggacgacgaggugucgggcucgaguccgguguccagcggugugaacuuguuugccaacgauggcagcuuccuggagcuguucaagcggaagauggaggaggagcagcggcagcggcaggaggagccacccccgggcccgcagcgacccgauccaccggccuccgccgcggcgggcccagggaauccgaagaggaagggcggcccaggccccacgcucagcuucguaaggagccgcgggggugggggcgggcgccggggcccgcguuggcugggggagucgggcccgggaaggggcgucaugguccaaggcaguccuccgcccggcugccuggacggucccggucgcuugcugagaaucucgagccuggauuccggaccagagguguuucugggcgggaaugggaauccuuagaucucauucgugggaccugagaaccgggaaauugcauuggaagcagcgcucugggguuagggggcccuagaugcuaggauucccguuugauuuguacccagacuuugaauagugaggcccacauauaaugugggggaaaaagaggagacacauuuaaaucccgagucugcuguaaucguuagacucgacucggaccacggaccguagccgggcguggugguacacgccuuguauuacaagcacuccggaugcaagaagaggagaauucgaaaaagugagaccuugucccaacuaaacaaaaccaaccaaccaauaacaaaaagcaaaucaccgacuuuguggccuuagcaagaucaaucgauuccuuucuuuauuauuuaacuaauguccauuuauuuagcaccuuaucuugugcugaguauuuauugguggugucuuugacagaaaagaacguuguuuguuuggaguguggguggccuauccugauuuucuguaguucuaauaauugagauuuugauguauuucaugaagugguccuaggaaagucagaacagacucuuaaagaacaagaccagugguucucuacugggagcaagucucuucauccucauguauuugguaaagucuguagacauuuugguugucaaacucuuaagaggagaugcuagugacaucuauagguagauagcagggaugcucuucuguauccuauaacgcaagggauaacaaagaaugaucuagcugaaaaugucaagugucauguugaggagccucggguuaaauaaguuggacauauacucuguuaguuuugagcuugcuuugucucugauguugagaccuuguaguggggaggaagaaauguugguuugagaauaacagacugugggucaaaucuuggauccaguucugugguuugggguaaggcuuaaguuuguuuaggucuuaaaagggggugugugugagccuccaaaguggcacauacauggaauccuagcacuguggugcuugaggcaggaggauugcagagucugaacaaagguuacauuguuucuaaaaacaacacaguguguguguguguguguguguguguguguguguguguguguguguguccaguagugugugccuguaguaucagcuacucaggagcugagaaaggaucugacgugaaaggaucugacguccagaaugaguucagagccagccugagcaacuuagugagaccccgucucagaaacgagaucuggggauuuaacucagcagaagaucgcuuugaaugcaugggauccuagauuccaccugcaguauugcacaaaagcgauugugggaauaguccagcagucacugccuaguuaaaggguaagaacaggauaaucucuugaaggcccccaguuaaagggagaacauggggccagggugaaaacccagagccagacuguucuuagaggaaguggaaaguaacagggccuggguugaugugacaguccaggaauaggagcaacaguggugucacugccucuuugacuuauuccugaguagccauugucauuauauuccuaaaaacgccaggccagcucaggguaggagaaugagggaugcuuugugguucagggugcucccgcuggccuugcacaucugauccugagucuguuguuggcagccuguccuauuucucccagaaacuugucuuuauuucuaaaaggagauaguuauuaccuucaaauagcauaacugugaauaugagaggagauaccacggucacagcgcucuguguggucuguagggcucaauagauagugaagcucaauaaaggaagcuguguggucccugacaggacagugugaggccuggcagaaagagugaggacagagccaguucccagcaaggucagcacuccucugcccccccugggaggguagccuggggcccaggacugccugggcauggcagcccagggcaggugcugagucgagugugcuccucucugauugcugcgcaggucggccggcuggaggagcugggcgaggcgucgcuaggaagguguagugggccucagcaccgccaagggcgggcccggcuccuguaacccuugcagucuucugucccuucacccaggugggcaagcgcagaggcgggaacaaacuagcccucaagacgggaauaguagccaagaagcagaagacggaggaugaggugagugggcugcccaggcugccacccuaacugccuuuuccuugcagacccagugcccaguggucaggcuuuggaugggugggccuuggagggugggagguuccccagauaaccugcuucugcuuauucuuuccucaaauccagggccuuuaagugacacuggggaugggucagcugucucaugguguuccugacuuuuguccccagcuuguugggcaucugucuuccaaccauuccuucccuccuccgaccccacagguauuaacaaguaaaggugacgcaugggccaaguacauggcagaagugaaaaaguacaaagcccaccagugcggggaugaugauaaaacucggccccuggugaaaugacucccucccgggugcucacuaccugggacucucugcgauguacauaauauuuaaugcgguuccggcagcagccuucucuggaggacugauacacagaaggaaacgaaggcgcuugcuguggccgcagaccguucuccaggacucuuuuuuuaccuugagcacuugccuccucagacuuuuagaccagugguuuacugugcccuuucuucccaucaccuugcucucucuggcucugucucuucuugcugucucucuccuuuuagcagucacuucugagaaguaaagaaccugacuuagugcuggag

SEQ ID NO: 4599 - RNA, 3466 nt, Mus musculus
cuccagcacuaagucagguucuuuacuucucagaagugacugcuaaaaggagagagacagcaagaagagacagagccagagagagcaaggugaugggaagaaagggcacaguaaaccacuggucuaaaagucugaggaggcaagugcucaagguaaaaaaagaguccuggagaacggucugcggccacagcaagcgccuucguuuccuucuguguaucaguccuccagagaaggcugcugccggaaccgcauuaaauauuauguacaucgcagagagucccagguagugagcacccgggagggagucauuucaccaggggccgaguuuuaucaucauccccgcacuggugggcuuuguacuuuuucacuucugccauguacuuggcccaugcgucaccuuuacuuguuaauaccuguggggucggaggagggaaggaaugguuggaagacagaugcccaacaagcuggggacaaaagucaggaacaccaugagacagcugacccauccccagugucacuuaaaggcccuggauuugaggaaagaauaagcagaagcagguuaucuggggaaccucccacccuccaaggcccacccauccaaagccugaccacugggcacugggucugcaaggaaaaggcaguuaggguggcagccugggcagcccacucaccucauccuccgucuucugcuucuuggcuacuauucccgucuugagggcuaguuuguucccgccucugcgcuugcccaccugggugaagggacagaagacugcaaggguuacaggagccgggcccgcccuuggcggugcugaggcccacuacaccuuccuagcgacgccucgcccagcuccuccagccggccgaccugcgcagcaaucagagaggagcacacucgacucagcaccugcccugggcugccaugcccaggcaguccugggccccaggcuacccucccagggggggcagaggagugcugaccuugcugggaacuggcucuguccucacucuuucugccaggccucacacuguccugucagggaccacacagcuuccuuuauugagcuucacuaucuauugagcccuacagaccacacagagcgcugugaccgugguaucuccucucauauucacaguuaugcuauuugaagguaauaacuaucuccuuuuagaaauaaagacaaguuucugggagaaauaggacaggcugccaacaacagacucaggaucagaugugcaaggccagcgggagcacccugaaccacaaagcaucccucauucuccuacccugagcuggccuggcguuuuuaggaauauaaugacaauggcuacucaggaauaagucaaagaggcagugacaccacuguugcuccuauuccuggacugucacaucaacccaggcccuguuacuuuccacuuccucuaagaacagucuggcucuggguuuucacccuggccccauguucucccuuuaacugggggccuucaagagauuauccuguucuuacccuuuaacuaggcagugacugcuggacuauucccacaaucgcuuuugugcaauacugcagguggaaucuaggaucccaugcauucaaagcgaucuucugcugaguuaaauccccagaucucguuucugagacggggucucacuaaguugcucaggcuggcucugaacucauucuggacgucagauccuuucacgucagauccuuucucagcuccugaguagcugauacuacaggcacacacuacuggacacacacacacacacacacacacacacacacacacacacacacacacuguguuguuuuuagaaacaauguaaccuuuguucagacucugcaauccuccugccucaagcaccacagugcuaggauuccauguaugugccacuuuggaggcucacacacacccccuuuuaagaccuaaacaaacuuaagccuuaccccaaaccacagaacuggauccaagauuugacccacagucuguuauucucaaaccaacauuucuuccuccccacuacaaggucucaacaucagagacaaagcaagcucaaaacuaacagaguauauguccaacuuauuuaacccgaggcuccucaacaugacacuugacauuuucagcuagaucauucuuuguuaucccuugcguuauaggauacagaagagcaucccugcuaucuaccuauagaugucacuagcaucuccucuuaagaguuugacaaccaaaaugucuacagacuuuaccaaauacaugaggaugaagagacuugcucccaguagagaaccacuggucuuguucuuuaagagucuguucugacuuuccuaggaccacuucaugaaauacaucaaaaucucaauuauuagaacuacagaaaaucaggauaggccacccacacuccaaacaaacaacguucuuuucugucaaagacaccaccaauaaauacucagcacaagauaaggugcuaaauaaauggacauuaguuaaauaauaaagaaaggaaucgauugaucuugcuaaggccacaaagucggugauuugcuuuuuguuauugguugguugguuuuguuuaguugggacaaggucucacuuuuucgaauucuccucuucuugcauccggagugcuuguaauacaaggcguguaccaccacgcccggcuacgguccgugguccgagucgagucuaacgauuacagcagacucgggauuuaaaugugucuccucuuuuucccccacauuauaugugggccucacuauucaaagucuggguacaaaucaaacgggaauccuagcaucuagggcccccuaaccccagagcgcugcuuccaaugcaauuucccgguucucaggucccacgaaugagaucuaaggauucccauucccgcccagaaacaccucugguccggaauccaggcucgagauucucagcaagcgaccgggaccguccaggcagccgggcggaggacugccuuggaccaugacgccccuucccgggcccgacucccccagccaacgcgggccccggcgcccgcccccacccccgcggcuccuuacgaagcugagcguggggccugggccgcccuuccucuucggauucccugggcccgccgcggcggaggccgguggaucgggucgcugcgggcccggggguggcuccuccugccgcugccgcugcuccuccuccaucuuccgcuugaacagcuccaggaagcugccaucguuggcaaacaaguucacaccgcuggacaccggacucgagcccgacaccucgucguccccacucucgggugacguucccggucccgacucagcccaucggcuccugccgcugcccgccgggccgggcgccucccgacccggaggcuccgcccgucucccucgggcagccauuuuguggccagaugccgugcaaaggacgucgggaaaggcucucagaccgcgcgcuuggcgcgggacuggcuucgucu

SEQ ID NO: 4600 - RNA, 20695 nt, Mus musculus
aauucccugccucuggcucccuccuuccgcgcgagccucuggagaagcugcagcacuuaggcgccgccgcugccucccggggccugguaggugggccucgcucggccggggccccuuggcuucagcucgccucgaaccucccuggguucugggccugcgccgcgcgccgcccaggcgucggggucgcgcccggcugagaggcgggguaccggguugggccagcucucgaggccggcagaacgggccgggcgggggagggggagcugaucugaucucaagggguggggccucggcgcccgggcagguucgggugccacgagaugcgggccaguggggcggcuggggucgggcuggaggggcgcugauugggggaaucgucgggggacgucgcguggaucggguguguguggggaucuguuucggcggggcuugguugggucugauucgggggagacagccuugaaaguugagaggggaagguuguuuaguccuaauagggaggggcgucagacuugagaccagagggcuuugcugagucuggcugcgaggcgguggugggauccguugaggguagcgcaccgggcggguguuugugcgggacucuguaagggaagcugcagggauuggacggauggggucuccgacgugaagugaucgggggugagggggugggagggggcuuaggggaauuugauugggggagcugccagagguccgucagcauuaauuccugcugacuggggcggaggguaagagcuagagaagcuuggccagaucugauugggggcaggcagcgggcauugggggcuuuggucguggguugggugauucugacuggcucucauucaaagagacauuggaaaccuaucggguauugcuuguauucugguuaaggagggucacagggccgcgucuaggucagaaagggggccauguggcgucuacugagcuuguagagccgguuuagaagagggagcagggaugagcaagaucugggcgcuuagggaccuagaggagcucagaaaucuaggaggcggcuggcaucuaguggagcuggaaggcuggauuuuggggaagggaauccucguggacugagccuucaccugaaagaccgcuggggcggggccccucgcccuggagggaggcggaagccgugaggcccguaaccgggggcggcgguggcguggaucgcuuuggaaagaggguuccucguuaggcucgauguggauccgucgcgcccccgccgcugguccugauggcccgcuuuuauauuccccccacucgcacucccgagcccgcgacugcguggccgaggauggcuuagcuggcggggaccccgcacuuggacaggcgcggauuggaggccuccgcuucucggcggagagcgcuugcgucugcaugcagccgccucugccucggggacucaacuugggucucacacagaacuccagcgacccagcgcugauccaggcuccuaccccugcaguucgccuugcgccauggacuggcagccagacgagcagggccugcagcaggucuugcagcuucucaaagacucgcagucgcccaacacagcuacucagcgcauugugcaggauguauccuucuuuccuuccggggcucacggaacagugccgaugucugcaccucgugaaggccagagagggagggacuacuucuugauucccagacuuuuucugcugagagagaacaugaauuaaagguuuaggucuuugguuccauuucuggaguggagaaaaugaugggcaugucugauguucacugaguacuuaauccuguaacuguugaguguugguaacuuuccuuuaacagacgggaaccuggaggcuuaaacagggaaaaugccucagcaaggacccaggguuaagaaguccagccaucgcagauuuuagugguaugccuugucagaaugaggguagauagguagggacguuggaguugcaacaugaguguuuuugaaguugaaaacuuuuuuccuaagagcucuuuauaucauauacauauauauguagauagauauagauuaguuuuguuauuaauuugauacaccuaugaagaggggccuucaguugaaaaauuaucucaaucagauuggccugugggcauggcugugggaaauuuucuugauaauaauugaugcuggucuguauaagaaagguugguggaugugagucggggaaggaaccaguaagcagcuuuaugcagagguuucuucuucaguuauauuccuggaguuccuaccuugggacuucccaaugaugagcuaaaacaaacccuuaguguuuuaucacagcaacagagaagcaaauuagaguaagaucagaauuuuaaaugauauauggucaugacagcauccaccuuuaaucacagcguucaggaggcagaagcuagugaaucucggaguuuaggaguaaccuggucuuaugaaaacuuucucaaauaaaaaaauugaauguuugaagcaguaucaaauuucacuugaaaaugggacuaguccaucaccuuuuccugcagggcugagacuggaacauacaagccuagagcaugcuagccacuugcuuuauucuugagcugcaccccaaaguccugcuccugaaacucagccauucacuuguguuuucucucucucucucucucucucucucucucucucucucucucucuuucuuucuuucucucuuugagacaggguuucuguccuggaacucacuuuguagaccaggcuggccuugaacucagaaauccuccugccucugccucccaagugcugggauuaaaggcgugugccaccaugcccagcuuuaguuuucucuuaauggcacuggagacucaguggucuggucucacacaugcuagaugcauauuuuaccacuugagaccccuuggcugguuuuucuuguucuuuucuuuuucuuuuucuuucuuucuuuuuuuuagucauggucuuuuaauauaacagauuaguuuagaacuaaauauguagccagguucucccuaaacuaagagugaucuuccugccucagcuucccuggggcuaggguuuuaggcaugcaccacacucaaauagccuuccauucugcuugagaaaagcaggcaucacuggaaugccaagaucagaagugaguagcagcugccaguuuaagagaagccuagcccucuccuguccugguaaggauauaagggucaugcaggaguucagacaugugcccuaguuccuguguggacuugauccuccugagaaggcccuguggugcugagguuagaaauugaauugaugaguauuaucugaggaguuggcugccuaauugauuuggucacuagcauucugagcaauguggcacugggagaauauugccuaagaaaggcucuugccucucaaguucuuugguuuguuuguuucuuuguuucuuugcuuguuuuguuuugagagaaggucuuggguuaaugcuggccuggaguuccaagaucuugccucagucucccucaguguugggaucacaagcaugccccaauauaccuggcuuuccaaguuccuuaacagccuggcagaaacuuaaacaacucaaccaguuuccugacuuuaacaacuaccugaucuuuguccugaccagacucaaaucagaagguauguucucugucccuccaggccacacagaucuugcuucucccuuagucuucugaccuuagcacuuuuccuacagaugagccaacccgcucucugaguggccucauccucaagaacaaugugaaggcgcauuaccagagcuucccgccuccuguggcugacuucaucaaacaggagugucucaacaacauuggcgaugccuccucucucaucagagccaccaucggugagggggcugugggggucaucaucaaggacacacuaagggcuugcacugggccaagaagcuauucaacguguucaggguauugcuuacugaaugcuccagcacccucugauagcacucuuacuacugccaucugacuggagaggaaacugaggcacagagaugauaaagggacuugccuggcaaguaacagcuuggaaacaagccaggcagugcaggucagucuuuuuuuuuuccccuuuuuuuucuuuuugagaaaagguagcccagacuggccucaaacuuugcacucuucugccucagccuccugaguacaguguccagagucucaaacgacgagccugaugcucagcaguuagaguaccuguuucuacuguccauacggagucauuagugaugccccucaaacuauucauacacagugggaguuaguuaauggaggcaggcgccuugcugaagagauacccaaggacauugcagcagugcugcuaagguuuacuuaaggacguucuucuugaagacuuuacacuaaaaguauuaauaggugauuucuuagcaacauuugagucugaagauuagaggacaacauuggagagucaguucuuaccucccaccuugucaagaugguuucagguuuuugcuguacaauguguuauuccgggcucauuggcacaguagcuuccuguccuuucuucuccgaguagacgugauggauuauaggugcacaccacugcauccagcccauguggguucuggggagcaagucugggccagcaggcuugguggugggugguuuuaccugcugagucaucuucccagcuccagaguuuuuaagccauuguuuuucuugaaaucugucaacuaaaaaagugguuuuguuuuuuuacuuauuuguuugugcuauguguguggagauuagaggacacuugguuguuguuuuucuccuuuuaugugggguauaguguuggaacucaggccauggugggugggagcaagugccuuuaaccacuaagccaucuugcuggccucucuguagacuguuuaaaagaaaagacaggaaagaaagccuuaaaaauaaauacaaggcuaggugugguagcacauguuugugauuucagcacuuaagaguuugaggccagccuggucuaaauaguuccagacuagcccuaggugagauccuaucucaaucaaucaaucaaucaaucaaucaaucaauaggcauggugguccaugccuuuaauuucaguauuuggggggugguagcaggugaaucucuugaguucaugcaacacugaggugcauagugaauuccagcccugucaagauuacaaagugagccucccucuaugaccuaacaaacuauguaaugaagacagaaaaauacuccugaauuagagcuagauguuugggccuguuggguuaaaccaaauauucagggugggggggggagauugagucuauauauauuuagauuucuuuccuuagcaauauaguguuuuguuuuaaacuuacuuguguggaggguagaguggcguguauaguguguguguguguguguguguguguguguagguuagaggacaacugugaaagauuguuuucuccucccacaugggucccaaggauccaagucagguugguaggguugguggcagugaccuuuauaugcucagcuaucuugcuggccccauacuauacuuuauaacuauguauuauugacauuauugcaggaaucguaagucaucuagaggugauuuaaagucugugggagguuggggacauugauacguugugccugcuaucuacaggagguguguauagguucugugaaagcacuguuccuguaaugcgcuugguuuuggccuuucugacgaccuggaacuaauaccccauaaaauaucuguacuugcugggcgugguggcgcaugccuuuaaucccagcacuugggaggcagaggcaggcggauuucugaguucaaggccagccuggucuacagagugaguuccaggacagccagggcuacacagagaaacccugucuugaaaaccaaaaaaaaaaaaaaaucuguacuuaaagaagccuugggcgagcuuuagggugcuaguguuguuuuugaaaugggguuguuucagacuuggaaucuuccugccgcagcccuccaaggacuagcuuacaaaucuccugaucaaagcugauguucuuuguuucuguagaaagcugagccaugugguguaggagguuuugugagauggucagcacagagcauggggccugucucagaaugggauggcaucauccucauagucucgccagucauuucagaaaggcuucacuuucggggguuggcaucaccugagaguugucaguggcagcuucugcccucccugccauccuuuauuaaugaguggugugugcauuggccacaaugucgaguucugccggguggcuccauugcccucaggccucagaugaagauacuguggauuucauuauuccaaaccaauuuauuguaaugugagcauuaguuccaauguccauauacuugcuuacuuaagcaaacauucccugauguucugcauaugagcuugcacauacucacauucauguaguagacaggugugcacacccauauacauagacaugggccaacagaggauaucagauacucuguucuuuuacucaaaggaucuggagcuaggcugguagccagcaaguccugagaucucaacugauuacugucauuacagguguaccacuacaccugucuuuuuauguauguacugggaacugaacucaggucuucauacuggucgagcaaagcacucuuaccaacugagccaucucccuaggccccacccucauaucucuaauugucaguagcauccccucucccgauacagaggcuuucaggacuugguuauuugauccccaucaccguccuucucacugccugcuuccccacucuggccuuucuucuguuacuacaccaggacugcaauaccucuagccaagaaucuuugcuccagguaacuggaggccacgcccuguuuagcugguccaaguggcugugaucccagcuacuuaggaaccugagacaagaucugcauguucaggucuugccuuggggccuuaacucaaaagguuaggaaagcaacaacaacaacaaaauagggccggggauuuaguucaacaggagaaugcuugcccaccgcgcauagggcccugaguucagucuuuuguacuaugaaauaaaaguacuugaaagacaauuuacucuccugagggcuugccuuguggcuacccacaucuugagcuuaugcaucuucacuucauaccccucuccacuuguaaaagcagugauuuggggcggauuccuauaaccuggaacaguugucucguagugaggcuaugugcagaauaggcaaggacgacuugaagagggccugucacucuacaauggagugcguacuuggcauucaugaggccuggguuuuguccccagcaccccaaagagaggcucagggugccaugcagaacaugcaugggagaggaaagaaagcuggugagccagucccuugguggggaugguugagggaccaguagacccuugcucagccugacuggccuccucucccuggcugccccaggcauucucaucaccaccaucgcuuccaagggugagcugcagauguggccagagcugcugccucagcugugcaaccugcucaacucagaggauuauaauaccugugagguaggugaugggcaguaccuggccugacccaagcagggacuacagcuuagagucggcucacagccauccaucucucugcuuagggagccuuuggagcccuacagaagaucugugaagacuccucggagcuuuuggauagugaugcucucaacaggccccucaacaucaugaucccuaaauuccugcaguuuuucaagcacugcagcccuaagauccgguacgugauguuccucagagcagaauggucuuagaguugguaggcagacgcaggaguucauaugugagccuugccuucacugccuacuaggucccacgccaucgccugugugaaccaguucaucauggaccgggcccaagcgcugauggacaacauugacacuuucauugaggugggucaccaggcuccagguggauagggugaggcuaagggguccucaggcagcugaccuuucccuuuuacacagcaccuguuugccuuggcuguggaugaugacccugaggugagaaagaacgugugccgggcccuugugaugcuuuuggaagugcgaauugacaggcucaucccucacaugcacagcaucauccaggugcgaaugcucaauaccaagggcuaguggguggcuugggauggggaaucccccgcaguugagcuaggucucagccucucucuguugcccaguacaugcugcagaggacccaggaccaugaugagaacguggcccuggaggccugugaguucuggcugacgcuagccgagcagcccaucugcaaggaaguccuggccucucaucugguccagugaguacucauaccccaugcccucagccucuaguccucccuggaccugucccuucuccuggaugcuuugcuuacuguaucuuaugugguuuaagucaguuuucuuugaauccuguguacacugauuuuuaugggguguaaccuuaaugacuuuaaaaauuagguaacagaaaccaagugugguggcucaugcaugucacuuaggaggcuaagcuuggauuauagccacaaaugcuguguaacgaguuccaggccagccuggguuacauaaugagacccugucucuaagaacagcuagaagacaaaaagagaagaaacaacccuuaagcagaugaaggcuucaucauggcugcucgagaugcuuaagagaauggcaucuacguuaauuccaggcacggcccuccuggauaagcgaugcuguagcucuggcuugcuuuuuucuuucugauuuugagucaggguuucuccauguaguauagccauggcuguccuggaacucgcucgguaaacuaggcuggcuuagaauuuaaagggauccugccucugccuccggagugcugggguuaaaggcugugccuacgacuguaggcucugguguucuucaguuuaggaguucagagucucuugggugguacuuuaacaagagcuuacuuuuuggguuuuugagacaagugggccuagaacuuaagugcuaggguuagaggcauguggcaccaugacugguuugagcccccuuguguugaccauuuuggaucacuuggcuaucucagauuauugauagcaaguaggaguuguggcuagagggacagaggacuuugaggaggauugagacucuugcaaacagggacaggaagguuguaucaguuuucuuuuucuuuuucuuuuuuuuuuuucuuuuaagauuuauuuauuauucauuaguacacuguagcugucuucagaugcaucagaagagggcaucaggucucauuaugggugguugugagccaccaugugguugcugggauuugaacucagguuaagucagugcucuuaaccgcugagccaucucgccagcuguaucaguuuuuguguuuaaagcugugugcaaccaugcucucuacuguuucugccagcagccugcccggcagcuuuguuugcagggucugaacaaugggucagauguuuguguuuuguguagugcuagggaacagcauugcugaaggucuucaggguucuggcauucaugugugcauucauguuugggucaagaggcuguguggugcuacuugucgcugagugauagauggggcagcuggauguggcaguaaacacuuguaaucacaguauuggagguugaggcaaaaagaucauguucuuuuuauuuuuuaaacauuuuuguuauuauuuacuauuacuuuuaaaucaguauuuugcuugcauguauguaugccuguaccacaugugugcaaugcccacagaggccaaaggaagguauuguguuccuuggggcuggaguuagagcaagucaugaucgugacugcugagcuaucucuccagccucaagaagguguaugauuucuaggccagucauggcuucacagaccguuucaaaagagggagaaaacugugucuccuacucauggcugaaaauauguugcucauucccugaagggaagugaacagaaacaggacagaggaauauggguguguugagcauagucugccacuugcuccguacuccuauucacaccucugcuuucuuuucaagauggguaccuagccagagucccugcauccuuacaaccagucucuuucccaauagguugaucccuauccucgugaaugggaugaaguacucugaaauugacaucauccuucuuaaggucagccaaggggcauccacagcugacuguggguggccaagaccauuggguauuggguuggaggucuccagccagugcugagagaaauaugccugggcuggucccuagggggauguggaggaggacgaggcgguaccugacagugagcaggacaucaagccccgguuccacaagucacgcacagugacauugacucacgaggcugagcggccugauagcucugaggaugcugaggacgacgaugaugacgacgcuuugucggacuggaaucugaguagguaguaggcuggcuccugggggagggggagaagcggguggggagcacuuuaugaagaacuggucucagggcugaauaccugccccacaguccucccuaagcuuagccuccuuguccccuucagggaagugcucugcagcugcgcuggauguccuugccaaugucuuccgggaggaacuguugccccaccuacuuccccugcucaagggccuccuauuccacccugaguggguggucaaagagucagggauccuggugcugggcgccaucgcugagggugagucucuccauuucguuggcacugccugaccugaccugaucugaccugagcaaugcagauggaggcagccccauagcacaggcaauuaaaucuuacuuacuuauucuuuuuuugagacaagguuucucuguccagcuuuggcuguccuggaacuugcucuguagauuaagcuggccuugaacucagagagauucuguguguugggauucaagguuugcaccaccaccauuuggcuuccuuaucuuuuucaaauagcucugugaucuuuuucuucuccuggcuuggccugaaaggugucccccucccccuaacagauucuuaacaugccagcccucccccauucucauaagcagaugacucuguaaugguucaagcauauggauaguagcucuugcccacuguagccgucccacuaggauacuccuugcauaagaauccauucaugggaacucuguucauauauccagugccagucccaggcuucauacauggccaaacagcuacauaggcugguaccacuucccucauuuuccaguuuacaacugggcugaaaccugauucuugcuguuagacugcccaccagaauuagaaaugccuagcuaugaaguuuucuuaaauugauguaguguuaagcugagcacaguguguccaugccuguaguuacagaacuggaggaggacugcugccagcguagucugcacaacgggaggucaggcaugcuagggagauaccaaaaccagaacccucggggcguccuguaguuggcauggcauuucagcuucuuucccccacaagacauaggauauggacuguggccauuuuugguaugugugacuaucucaacacccagaauugucaccuaaacuacaggcauugggcagcaagagcucuuagucuggggagcuuuuauuaccugugagugaggccuaggguuuggacugggacacaauuuaucaguacaacauuugccuggauauuaaaaggcucuuggguuccacaucaagaaaugguuucaugauuacuuucuugguaaugaugcuaucucagauaucaugcaacaaugugugcaugguaguuuuuuauuuucugagauaaacuugcuauguuguggugucucuugacucagacucccuagugucugauaauaauaaagagauguguucauaguugggcauaugcuuuuaaucccaguacucagagacagaggcaggcagaccucuuugaguucaaggccagccuggucucgaaagucagggcgaagcagggaugggguggggguggggguuggcggggugcuagcauacauaaagccuuuuauucccauuacugaaaaaaacaaaaccccaccaaacaaauuaaacaauuauaaaguuaaaaaauaagggcuggagauggcucagugguuaugaguguuugcucuuucagagaacaaguuucauuccuagcauccauguagcucuuuaugauuuccuguaacuucagcuccuggguaguugaauccucuacugaccugugggcacuugcacacaccaugcacauaccuaugcccacucaacaauaccccucauacacuaaaauaaaauaaaucaagcgagggauaggaggaagagagagacagagaggggaucagagaaaaguacaaguguagacgguuucagguugagagucgcuuccuguccaggcuugccugcuuuuuuaauuaauccuacagcuuugauuauuguuuuguuuugaaguaggaggugggaagagguaggaguguuucccuccaugauuaugcuggccuccugccuucagugcuagcauuauagguuugggcuucugcccagccagaauuuggaccaccuucaucuguaguguaucugugucccccuuugcuccugccuuuuaugggcucuuugaagagccucaguuuuuccaccuaucauguuguauuggauaugccccagccuucuauucccuuucuuucucuuucuuucucucucucucuuucuuucucucccccccuucgcccccccucuuuucgagacaggguuucucuguguagcccugacuguccuggaacucacuuuguagaccaggcuggucuugaacucagaaauccgccugccucugccucccgagugcugggacuaaaggcgugugccaccacgcucagccuucucuuaaaagcccuccugucuccugguaauugcaggcugcaugcagggaauggugcccuaucuaccugagcugaucccacaccucauccagugccugucagauaagaaggcucuaguacgcuccauugccugcuggacgcugagccgcuaugcccacuggguagucagccagccaccugacaugcaccucaagccucugaugacggagcugcucaagcguaucuuggauggcaauaagcggguucaggaggcagccugcaggugagcccugaccccugacccccauucuuacgguggcccucacccugggaaaugaugaugccugugacugcugacaagacucugaugucuguuguauucguacuggcugauccuggauacacccucccuagcugccuguggugcugcuccauccccuaggguugaugaagcuuuccuuccuaucuucucuccaccagugcauuugcuacccuggaggaggaggcaugcacggagcuggugcccuaccucagcuauauccuugacacucucguuuuugccuuuggcaaauaccagcauaagaaccugcucauccucuaugaugccauuggcacccuggccgacucugugggccaccaccucaaucagccggugagacccuagacauacucuguccaugcuguguccuuuaacaucuggugccuugguuugaccuguguugcaugccaaggacauggccaugaccuugucaggcaggcugaagcucuuagcccuguccuuacucugcuuccagucuagugggaugaccaagucagcucagucagucaacagguuuuccagggagggaucaaggauuaaaaagaaaaaagaccauuagacaacacuguagcaugaucccaggcaguucugaggcuggggcagguuuauuuuuuuccuagucuguuuuuguuuuuugguuuuuuuuuguuuguuuguuuguuuuuugcuuuuucgagacaggguuuuucuguguagcccuggcuguccuggaacucacucuguagaccaggcuggccucgaacucagaaaaggcgugcgccuccaccgcccggcuuuuuuguuuuguuuuguuuuguuuuuuuccuagucuguuuucauaccauuuuaauuuauaccauuuauaccauuuucauugcaugcaaguucuagguuaaggaacaagcaaggcgauaaacaccgagaggcaguaaacuucacuguuucuaagggcuugucaggaugaccaagauaucugagccuacuuccccguccuagcccaaagucauucuugccugaagccuacuuccuuguucuaucccaaaaucagauuucugccugaacuuacuucccugucccggcccacugucagauuccucccuuaagccuacuuccuuguccuggccaauggcaaauuccugugaaguuucuagaagcagccccagaagcucccacgguggaagagauggacaguuauuagguagcauggccgcugcugugcugggauagugcaagggccuuugugcccagguuccugggguugggaggaaggggcauaccgaugagaagauggagcggggcacaggucucauccuucaaggcguagacagcacugugugacuuaggcugcaacuccucuccaggaguacauucagaagcugaugccuccgcugauccagaaguggaaugagcucaaggacgaagacaaggaccucuucccccugcuggaggugagugggcucagguccuucccucagagcccuccuuccuggccugggcuuaccuuuucccuuuucccugcuagugccuaucaucuguggccacugcccugcagaguggcuuccugcccuacugcgagccugucuaccagcgcuguguuacccugguacagaagacacuggcccaggccauggugagcacccugggccuccugaccacauguucuacugcccaggcccuagacuacuucccucaucugccucauuuauaucuagauguauacacaacaccccgaacaauaugaggccccagacaaagacuucaugauuguugcguuggaccugcuuaguggcuuggcugagggccuggguggccacguggagcagcugguagcucggaguaacaucaugacauugcucuuccaguguaugcaggugaguggguauaauaagccacucccaagucaggccauaccuaaacaggccaaguuuucuuuuuccuuuuccuuuuucuuuuuugagacaggguuucucaguauagcccuggcuguccuggaacucacucuguagaccaggcuggccucaaacucacaagagaucuccaguguacugggauuaaaagcacguguuaccacuguccaacuaaccucugguuauauaagcaaacaaaugaauaaauguauguugggugguuccucaggauuaacucuggauuuugccugcccucccccacacaggugugcacucauacccugcucacacauacauagaacaauaaaauuuuugucagauacuauaaugcaaacugaucugcaaaauaaaguacaggcauuugugguggcauagccuuuaauccaagugcuuuagauuuggaggcacaggcagguagauuucugaguuccaggcuaaacaaggcuauguagugagacccugccucaaacaacaacaaaacaaaauauagguaauggggagauggcucaguaagugccuguuagacaaggacaggagccugagcuugauccccccccccccccccgugaaaagcuggggguagguguuaaagagguggcuuagguuaagggcacuuacuguucuuccagagaaccuaaguuuggcuccagcaucaacaucaggccacuaauaaugacaacugccuguuguuuuagcuucucaggggaccugacucccucuucuaguuuccaaggauaccuauaaauguguacacccucucacccaacauacacacgccauuaaagauggaaauaaaagggugcaucugcauagaggugcccgugauucagagcacuggggaagcagaggcagguggauuccugggguugguucucuggccagcuugucuaguugaguucuagugagcucagguucagaaagaaacuuccucagaaauaagaugagguggcagcugaggaugcauacaagcgagcgccacacaguggggcaugauggggucuuagcaggaacaagguagugucuaggucagccaggucuauguagcaagaccuggcucaaagagaaauuaagaguguauguaauacaauuuauuuuuugcgguuuugggaggcgggauagguagggguaaaaugggguucuagagaguuuucaaaguaaaugcuuaccaaugaacuccaaccccguguccugggaaacaggcuguaguauaguagaaggcuagugaaguaaggucugugugguggacaugguggacagaccuguaccucaguauuuguggucagggugugcucgagggggacugugccaccuccaauggcuuagauggaaggaguaggagcagcccugccauuuccgccaucuuucccaacuccaggauuccaugccugagguccggcagagcuccuuugcccuucugggagaccuuaccaaagccugcuuuauccacgucaagcccuguaucgguaagcuacccuguuugcccccgucccaugaccucaacauuggccuuaagugauggagacauacccugggaggcccaugaccggacugggauguauucguacugucugauggggcugcccagucaguucugggagcuuggcgggccucaguggccuuucugcucaguugggguuuuuuucuccccucccugcucugcucuuugcauuagcugaguucaugccuauucuggguaccaaccugaacccugaguucaucucugucugcaacaaugcuaccugggccauuggggagaucugcaugcagaugggugagugccucgagaguggcagacugccugccucuucauugcucugucuccauccuauuggucaggggaaagaacauacuuugaucccccugacaagugaagucaaauaacugaagggccauuuaugacgugggguagacaguuuguuccuacugaccggaccaucucguguaauuguuuuucugaaagguccacugggaucagugacuuugacuuccuguccuuggggaagacuggguggaguggucauguuaccuucuggguaaugacuucagagacuccuuugggugguucuguuguguguuggcugcggacuugguggggagcaucccgagaagggucuuuguucucucggguguggugguaugccaguccgcauguaacugggaucauggcgugaggucagcuaugcccagcuggcacucuguggguggagugggccaugcagggcucugaauggcugcucccuaggggcagagaugcagccuuaugugcagaugguccucaacaaccugguggagaucauuaacaggcccaacacacccaagacgcugcuggaaaacacaggugaguaccaggccggggcugagggggccguucccggaaggaaggcuucuaagaccugaaauagagucgggagggacgaaggaagaauacuggcuuuagaauauauggaugggaagagauccaggcuggguggggagaacaccucuaugggccaaacucaagggcccaggauagccacaggaucguucaguuggggccuguggggcggggcucggugccuccugucagaggccccgccacguaccgucccggggccacucgggguugcaggucgccugacgagucccucugccauuccagccaucaccaucggccgccugggcuacgugugcccgcaggagguggcacccaugcugcagcaguucauccggccuuggugugugccugccugggugggaccugaugggggugggcaggacagcuguacccuccagcgccaccccccccccgcccccauggaugcaugugggagaccucuacccacugaccccacccugucccauucccuccauccauccuucauuugugcuuguccagccccaaguccauccacugaccugcugcccuccuccauggccaggugcacgucccuuaggaacauccgggacaacgaggagaaggauucugccuuccgaggcaucugcaugaugauuggugucaauccuggggguguugugcagguccgggcagcggggcucagagggcagggcgggggcuggcuugggcggccccucacaugggauccgucauguuucaggacuuuauuuucuucugcgaugcuguagccuccugggugagcccgaaggaugaccuucgggacauguuuuauaaggugaggcuccugguggucucaugggaguccuggguaauagacaccacaugcuugccccagcccacugugacccugccucacugcagauccuccauggcuucaaagaccaaguuggggaggagaacuggcaacaguucucagagcaguucccaccucugcucaaggagaggcuggcagccuucuauggggucuaggugaacguggagaccaccaggugagcaggucuuuaagcacuggggccgaugggagagugaaaaggaagaagacccugagccccacccucccuuucccuugcagguuuuugucugcgucaucgucggagggugugcugggaaugugcugcuuccagaagucacugugcccuggucgagggggguuagggaggagucagugggaccuaaauccaggugcaacgcagucugugcaucuguccaucugucgguccacuugccccaccgggccugaugagugggcagguggguggggacuccauucucauccuacaaauagggaggggggugggacuucuuggugggcaagaguucucugggcucuaaucugggucaucucgggcagcccacuugggccagcuaugugggagggaggaauccauaaggccuaccgaauccggugucagauaaggcaagggaauuacagguggggagggggguuccuuguagagaagcauacacucacauguacacauguggacacacgcaugugcgggcaccacagccagcuaggcugggccaaacgccccaccauuuccucgacugcauggagacaguagaauuagugaacccccaaauuaugccuauggccucuguguaccuugcaucuagaguauaagaagcuucugcuguucugccaaaauuggcgggaauugggggggcugggagguuugggggaccucagcugggcucccggggccaagggaggaggguggucauuuuggggcugccaucucagcacuggcucacuuggaccugcuccauacacuuccugccagcuucauggcagccucauguaguguguccccaucguugucacauccuagccagcagcagaguggggaucauuggagcagcugagacuggcuugaggcuacccuguuccugugcuccaaagguaauuaaaggcacaggccugggacuaguuuuccuugagaaagcuaauaaugguugccagagcugcuuuccuggaucucuugaaacagcuuuaaggauaguucaguucucugcaccugagaaccccauucucaagagcugggguaacagcaugugauggugagaacaaaggacgaaguuuacuggguccagcaagauuugaaagcuuggaggagcaggguguacccagggccucaaacuuugucccuuuugggacuuacguuuaucacaguguccgcuggacucagaccacgccagauugguacacugacucaaaaccuuugaagaaauuuguuggcgaugccaucggggugggaggggcuucccgagaggagaggggcaugauuauuuccagauuagcuguggaaaugagucuuguaaggucccugagguuuauccuccaucccuuucuuugcuuccuacauauuugggagcccauuauaucuugggcuuugacuggaguucugcauuuuagggccugcuccaucaucccuccaaggacuuggaccuuuauccuuuccaggccuuguguccuuucuuaaguagggucaggcccugccucuguucccagggacacuuagugcacauuccauaacucagcuacugguccccauccccuccagccugaaacuugagcaggucucuggaagccauuuguaggaaaaaaaaauuuuuuuuaaagaaaaauaccauuagcuuucugguaauuccacuucuuaggagcauccucugcugggucuugggguguauugauggauugacuaucugauguaguuguggccccucuuuguccaauggggagggggagggaguuccaacuaccuucaggaaacgggagccugauucuuguauuucccuuuuuuuauuuuauuuuauuuuauuauuuuuuuaaaagaaauuauuuaauuuuuuaauuuauuuuuuaguugguuuuugcacaaugaaguuugaguuucuuaaccucccuuguccggggcugcugacauggacugaccuugaucuguagcccucccugcugccauuccccugagucuuuauuaccaucaccccugggcucccaggucuauccaucuguuacugugcugugcuggggacuagcgccuagguggcgugagauuccacucguguagaacuuuguugaguaaaggucaguuucuugugaaacac

SEQ ID NO: 4601 - RNA, 7367 nt, Mus musculus
aagguagugucuaggucagccaggucuauguagcaagaccuggcucaaagagaaauuaagaguguauguaauacaauuuauuuuuugcgguuuugggaggcgggauagguagggguaaaaugggguucuagagaguuuucaaaguaaaugcuuaccaaugaacuccaaccccguguccugggaaacaggcuguaguauaguagaaggcuagugaaguaaggucugugugguggacaugguggacagaccuguaccucaguauuuguggucagggugugcucgagggggacugugccaccuccaauggcuuagauggaaggaguaggagcagcccugccauuuccgccaucuuucccaacuccaggauuccaugccugagguccggcagagcuccuuugcccuucugggagaccuuaccaaagccugcuuuauccacgucaagcccuguaucgguaagcuacccuguuugcccccgucccaugaccucaacauuggccuuaagugauggagacauacccugggaggcccaugaccggacugggauguauucguacugucugauggggcugcccagucaguucugggagcuuggcgggccucaguggccuuucugcucaguugggguuuuuuucuccccucccugcucugcucuuugcauuagcugaguucaugccuauucuggguaccaaccugaacccugaguucaucucugucugcaacaaugcuaccugggccauuggggagaucugcaugcagaugggugagugccucgagaguggcagacugccugccucuucauugcucugucuccauccuauuggucaggggaaagaacauacuuugaucccccugacaagugaagucaaauaacugaagggccauuuaugacgugggguagacaguuuguuccuacugaccggaccaucucguguaauuguuuuucugaaagguccacugggaucagugacuuugacuuccuguccuuggggaagacuggguggaguggucauguuaccuucuggguaaugacuucagagacuccuuugggugguucuguuguguguuggcugcggacuugguggggagcaucccgagaagggucuuuguucucucggguguggugguaugccaguccgcauguaacugggaucauggcgugaggucagcuaugcccagcuggcacucuguggguggagugggccaugcagggcucugaauggcugcucccuaggggcagagaugcagccuuaugugcagaugguccucaacaaccugguggagaucauuaacaggcccaacacacccaagacgcugcuggaaaacacaggugaguaccaggccggggcugagggggccguucccggaaggaaggcuucuaagaccugaaauagagucgggagggacgaaggaagaauacuggcuuuagaauauauggaugggaagagauccaggcuggguggggagaacaccucuaugggccaaacucaagggcccaggauagccacaggaucguucaguuggggccuguggggcggggcucggugccuccugucagaggccccgccacguaccgucccggggccacucgggguugcaggucgccugacgagucccucugccauuccagccaucaccaucggccgccugggcuacgugugcccgcaggagguggcacccaugcugcagcaguucauccggccuuggugugugccugccugggugggaccugaugggggugggcaggacagcuguacccuccagcgccaccccccccccgcccccauggaugcaugugggagaccucuacccacugaccccacccugucccauucccuccauccauccuucauuugugcuuguccagccccaaguccauccacugaccugcugcccuccuccauggccaggugcacgucccuuaggaacauccgggacaacgaggagaaggauucugccuuccgaggcaucugcaugaugauuggugucaauccuggggguguugugcagguccgggcagcggggcucagagggcagggcgggggcuggcuugggcggccccucacaugggauccgucauguuucaggacuuuauuuucuucugcgaugcuguagccuccugggugagcccgaaggaugaccuucgggacauguuuuauaaggugaggcuccugguggucucaugggaguccuggguaauagacaccacaugcuugccccagcccacugugacccugccucacugcagauccuccauggcuucaaagaccaaguuggggaggagaacuggcaacaguucucagagcaguucccaccucugcucaaggagaggcuggcagccuucuauggggucuaggugaacguggagaccaccaggugagcaggucuuuaagcacuggggccgaugggagagugaaaaggaagaagacccugagccccacccucccuuucccuugcagguuuuugucugcgucaucgucggagggugugcugggaaugugcugcuuccagaagucacugugcccuggucgagggggguuagggaggagucagugggaccuaaauccaggugcaacgcagucugugcaucuguccaucugucgguccacuugccccaccgggccugaugagugggcagguggguggggacuccauucucauccuacaaauagggaggggggugggacuucuuggugggcaagaguucucugggcucuaaucugggucaucucgggcagcccacuugggccagcuaugugggagggaggaauccauaaggccuaccgaauccggugucagauaaggcaagggaauuacagguggggagggggguuccuuguagagaagcauacacucacauguacacauguggacacacgcaugugcgggcaccacagccagcuaggcugggccaaacgccccaccauuuccucgacugcauggagacaguagaauuagugaacccccaaauuaugccuauggccucuguguaccuugcaucuagaguauaagaagcuucugcuguucugccaaaauuggcgggaauugggggggcugggagguuugggggaccucagcugggcucccggggccaagggaggaggguggucauuuuggggcugccaucucagcacuggcucacuuggaccugcuccauacacuuccugccagcuucauggcagccucauguaguguguccccaucguugucacauccuagccagcagcagaguggggaucauuggagcagcugagacuggcuugaggcuacccuguuccugugcuccaaagguaauuaaaggcacaggccugggacuaguuuuccuugagaaagcuaauaaugguugccagagcugcuuuccuggaucucuugaaacagcuuuaaggauaguucaguucucugcaccugagaaccccauucucaagagcugggguaacagcaugugauggugagaacaaaggacgaaguuuacuggguccagcaagauuugaaagcuuggaggagcaggguguacccagggccucaaacuuugucccuuuugggacuuacguuuaucacaguguccgcuggacucagaccacgccagauugguacacugacucaaaaccuuugaagaaauuuguuggcgaugccaucggggugggaggggcuucccgagaggagaggggcaugauuauuuccagauuagcuguggaaaugagucuuguaaggucccugagguuuauccuccaucccuuucuuugcuuccuacauauuugggagcccauuauaucuugggcuuugacuggaguucugcauuuuagggccugcuccaucaucccuccaaggacuuggaccuuuauccuuuccaggccuuguguccuuucuuaaguagggucaggcccugccucuguucccagggacacuuagugcacauuccauaacucagcuacugguccccauccccuccagccugaaacuugagcaggucucuggaagccauuuguaggaaaaaaaaauuuuuuuuaaagaaaaauaccauuagcuuucugguaauuccacuucuuaggagcauccucugcugggucuugggguguauugauggauugacuaucugauguaguuguggccccucuuuguccaauggggagggggagggaguuccaacuaccuucaggaaacgggagccugauucuuguauuucccuuuuuuuauuuuauuuuauuuuauuauuuuuuuaaaagaaauuauuuaauuuuuuaauuuauuuuuuaguugguuuuugcacaaugaaguuugaguuucuuaaccucccuuguccggggcugcugacauggacugaccuugaucuguagcccucccugcugccauuccccugagucuuuauuaccaucaccccugggcucccaggucuauccaucuguuacugugcugugcuggggacuagcgccuagguggcgugagauuccacucguguagaacuuuguugaguaaaggucaguuucuugugaaacacuuggugucucauuuccugguccuuggcuuuggugguggaguggugacuguggaugugacgagggguauacguggccuagcaguacacagaacaccugcccuuuucuccuagcuucugagggugugcgcacacacaaguggagauguacugcugcuccuggugcucuaccugacugaggcaggaggaugucaaguuugaaaaaauggagauaaauagaauuccuuuuaugaaaaaaugaggcuaguaugaaaauugaggcuagcgguagccaguuuagcuggauacauaguucugcuuuuauucccagaacuugaaaaguaaauugagugaccaaggaaucucccucuucuuucaucuuuaugaggugggagagugcuuagacaugguagguguccuccuugacaguuaacaaccuaguaaaggccugccguacagugaacucauuugcaaagcuuuacagcagacauaacacaacuuugggucacuaggcagauuggaaauucuuugugaucuuagaggccaggcugaauggugguggugguggugauugccuuuaaucccagcagugggcauuaaagugaggagguaagagguggguagauuucugaauucaagaccuuccugguugagcuggagagacagcucagcaguuaagugugcugacugcucugcuauagguccugaguucaaaucccaguaaccacauggcugucacaaccaucuguaaugagaucugacacccuauucuggugugucugaagacagcuauaguguacucacauacauaaaauaaauaaaucuuaaaaaaaaaaaaaccucccucugcagagugugaguuucaggauagccagggcuacacugagaaucccuguuuuggaaaaccaaaaaagugccaaaugagaccauaugauuauauuagcuaauagaagauggaagcaggaugaaaucaaaaccaggguaaaauugucagaagaaaagccuuuuaugccgggugugucuguucauaucuuuaaucucagcauuuggaagcauuuaggguucaagggcuagcccugccuauauagugaccagguuuauauagagaucaagauaaggcuacauagugauacccuuaaaaucaauuaaaaagaaagauuauaccuggacaggacugauuguggggagcugugacucgucuaugugaaauuauccuggccuacuaccuuuaguccuuaaccauuuauugcccacaguuuugccugaccuauuugaaauugaaucagaguuccuagacaauggucauuugaccccaaaauaaacuuaggcguggagcuuaacuguugaagccaugcaaaguugaagaccuaaauuaggauugcccacaucaguguugggcacaggagagcaacuccuggugaacagagacagaaggcuuccugaggcucacuggcuggccagccagucuagcuaaaagucauuagucaauagcuguuucaagauauaagaugccugcugugagaguuggcucagcacauaaagauguuugcugccuguuuaccuuaauuugauuccagaaccuauguaaaggugauggagaagugacuccacagaguugcucugauacaugugaccuguggugcacgggagcacacacaaaauuuaggacaauaaacuaagauggagauugaagaaggccuccaaccaucucaaccucaggccuccaaaugcguacaaagcauaaacuccagggcugaaacggucgauggcccauggcuuaagagcacuuuaagugagcgagauaggugccuuucauuucaacagagagagcagaggcaggucacccaccgaauuagaggccauccuggauuacuugucuaaaacaaagcaguuggucuuggagaagaugaaaauuggguuucuagcauccacaagaggugauugccgaccuguaaaccuagcuucaggggauuccaaauauaagaguagaagccggauuaaaggcgugcccacugcccggguugaggacccagugaccauuuuuuuuuuuuaagaauuauuuagcuggguggugguggcacaugccuuuaaucccaguacucgggaggcagaggcagguggauuucugaguucgaggccagccuggucuacaaagugaguuccaagacagccagggcuauacagagaaacccugccuuaaaaaaaaaaaaaaaaaaggaguagaaauaaaagauaaacgccgggcgugguggugcacgccuuuaaucccagcacucgggaggcagaggcagguggauuucugaguucgaggccagccuggccuacaaagugaauuccaggacagccagggcuauacagagaaacccugucucgaaaaaccaaaaaaaaaaaaaaaaaaaaaaaaccauucacacccgcacaggacuagacgucugauuuccaagcaauaucuggcagguguuagucucugacgucaucuaaugggcgccggaagugaucucgcgcugccuaggaaacaagacgcggcucuggcuaaaccuguacagccgcgcccacccgggcgccauggaucuuuccucagggcggaguggggauccucgcucuugugaggaggaaucugaccccgagccagaucccgacccugacacucaagcugaggccuacguagcccgugugcuuaccccucccaagcuuggccugaccccgcggcgcucgucacugcaguccauguucuccgcgucccuaggcgugccggagcgaaaggccgccuccaaagucccggccgugcgccuaccgggccucuugagccuucccccggagcugcugcuggagaucugugccuaccuggaugcgcgagucgugcuucaaguccugccgugcgugugccaagcguugcacg

SEQ ID NO: 4602 - RNA, 308 nt, Mus musculus
uucauaggauagcacaggguuucuuuuccuugaaaggguugguggcagcugggaugcccacaaggaaggggucgcucuuggccuguucagugcagaacugcagcagaucuguagcugccuuggauaccugcagaccccaucaugucagccacaucuggguauccaccuccucccuacacagcugugcccacccccaggcugucccaacccucaccuuuaugcgguugaugccugcuuccauccgcaguugcuccacugcccgacgggccuguccgaugucacugccaguggccaccuugcuagacauc

SEQ ID NO: 4603 - RNA, 646 nt, Mus musculus
ggaggaguugguaaccugagcugaaggaaaaggugauuggugaaaacugccaagaccagaagacccagaaaauuccuauuacauaaagacuucagagacacuauuuuuccaacgauccccuucauuuaaccaauaucugccaucagugcccaguaccacuaccuggagggaggucugcauacauccgggagggcaaagugacuugaauccaugauacuuaucaccuccuccuccuccucuagggaaaaaguugaaugaagguagcuauggcuacucugacuaagauagugauggcgggggggcuagagagauggcucagcuguuaagagcacugacuauucuuuuuuugguuuuuugagacaggauuucucuguauagcccuggcuguccuggaacucacucuguagaccaggcuggccucgagcucagagauccgccugccucugccucccaagugcugggauuaaaggugugcaccaccacgcccggcacagcacugaauauucuuaggaagguccugaguucaaaucccagcaaccacaugguagcuuacaaccaucuguaaugacaucugacgcccucuacugcuguaucugaagacagcuacaguguacucauauaaauaauaaaucuuuuuuuaaaauac

SEQ ID NO: 4604 - RNA, 6458 nt, Mus musculus
caggucuaugcugaugcuucucugguuuuccccuugcugguggcugagacauucgcccaaaaggcagaugccuucagagcugagaagaaugaagacuaagaagauugguaaagacugaggcuuuuugccacaccuuuauuuauuacuuuacaugccagccccucccuaggcccacuccuuggucagcagcaucucuagaauaaauggcccuuugguuggguuuucugagucagucugcauccuuggugucagguccguaagccucagccugcuccacccucugccucauaggucucuucucgccaguacuggaugcugccucccauggcagucaguaggcaggguuccgugggaugguaagccagugacuguaccacauuagaacccacaggcagggccagugccaaggcacccuaaggaaugagugguggggaacuauuacuaucagucggucuccuugagaucuugccugaaguccucagucagcuugucccugacuuucuguugguacugagaaugcuaggcaaacccugccacugagccacacccuuggccuagagacugcuagccuuggguauagaaagcaccuagcucagccuuccuugugacccaccuggaaccagcuacagccaccaccuucuccaaguccuuuagcauaugcuauuccccuugcuucaaauaucuuuccugcuuuccccucauccauccuucauauuucagcuuaagaaacggaggcaggaugaauucaagcccagccugggcuacaaagugagacacaccccucuacccucugccagagguuccugcacaaauaccugucauuauugcucuuuucaagcuugggaaacacccagcugaugcccuuggcaaggagcacaaggggaaggcucaccucuaccaggucccagaagaacacuuucccgucuucagagcagcugaccacaugugugucgcgcucacucaggcagcaguccagcuuguacugcugguucuuauggccaacauaccuaggaguggggguggggaggaucagaggggcuuguugcaccccagaaguggggagagggggaagggccaaccacuggagacucacucgcccagcagcuccccugugucuuuaucuagaagccgcagaguagaguccaggcuggauaucagagugcacugcccgucccggcugaagcaggugcaggugauagggccuuagagagcgaggcaggcagguaaaccuggguacucuugucugucccaccacuugcccugacugucccacuguccacacucacugcccacguagucugaggagaccugucccauccuuaggucauagcgccucacgcggccauccacagagcugcaagaaagaguagauccagccuaaagcacugaccuuuuuuugcuccagggcagccugugugccuuggaaucccuggccuucuaggaaaaugugagcaaggcaaugaugcucuucugcugugugacucagucucgggacaguuuggucccacucagagcuaugcucucucuuccaaccucucagagcuuucuagauccuguaccuccugacugguacagcagucaacucuaccuguaccuggguucuacaucugcacaucugaccaacuacacauuuuauaaagauuuuauuaucuguuuuuuuccucuguauagcccuagcugauauggaaaucacgcaguagaucaggcuggccucuuagcaugcacaggcccugaguuccauacucagcaucucaagcaagcaaacaaaccaaaaccauguagcagaaugggcagccuaacauuugcugucucugguagauccugaagucagccuacuacagauaccaaggcaacuguauucuccgagugcgacuccuuccccacccacagcacuaccaccaucuuauuuuguguguaugaaggcuuugccuggaaugcccaauccuuaaugccccuaagcagcuuucuccuuuuuugaggcaggaucucaagaguccugacuggucgaauacucacucugacugaguuuguccuugagccucucaugcuaaggauuauaggugugucuguccuaccacaccugccucaccaggaacuuugaaagcacaaccucagcaaugccagucuuccccucaaagaaauauggccuuucaccacucucagaaaaauagauguccaaaugucucuugcaggccucuagacucuguugugccugaguuccuucaguagcucucaucggcagcugcagcagcuagccacuagguggcgcuaguccaccuaagcuugcucucaccaggccuucacugccaccaguccucccucccauuucugcugucucacagcucaacuuuugucccuaaugugacuagauucauuguacuuaauuucuuuuucuuucuuccuucuugucuuuuguuuuuguuuuugagacaggguuucucuguguggccuugguuguuuuuaauuucacugucaagaccucugccugcuucugcuucugcuuccugagcgcuaggauuaaaggcacaugccacuacugccuaacuguagauaggcuggccuuuaacucuuggacacccccccccccagccccccgggucuucucauugcugggaagcugccauagcuggcacucagugauuuuuguguguguuuguguguuuugagacacgguaucuauuuaguucuagcuggaacuuguuauauagaccagaauggccuggaacucacaaagauccacuugccuuugccucccaagaacugggauuaaaggcgcaagccaccaugccugccuggcucaugguugcauuuauuuauguaaauuuuauuauuuuuuggguuuuuaucucguacaugaauauuuuaucugcauguauguguauguauaugaaucaugugugugucugguucccugaggaggccaaagaaggguguuagauucucuagaccuggaguuacagaugguugugagucaccaugugggugcugagaaucaaaccuggguuuucuacaagagcaacaaguacucuaagccauagacagucuuuccagcccucaugguugcaguuacugacuguccuacuaggcaggacagacuagaaacugcagcucuuucaguggaagagguuacacaauuucuaccauuaaguaaccuaugcuggcugcuggugagauggcucaguggguaagagcacccgacugcucuuccaaagguccggaguucaaaucccagcaaccauaugguggcucacaaccauccguaacaagaucugacucccucuucuggagugucugaagacagcuacaguguacuuacauauaauaaauaaauaaaucuuaaaaaaaaaaaaaaaguaaccuaugcugaaccaggaagaucuagaaacguccaaguagguaauaucagaaguuggccuugaagaugaggguagcuacaggugcagccaaggagagaaauacaaaggccauuguuuuugcuuaaguucuuggccugggcuacaguguggagucagccacaacagaguucuauaucaccaaggugaaacuaagugaugucuguaggccugggaggaagaaagcaagacuggugauccaaguuugaucucuggaaaccacacaacagcuggaugagguagcaagaucuaaugucuuggcacucucucuggggaaaugggagguggagcuagaagagucucuuggaaaggcaagggccagucagccugcaguacauagcauggcagaaacagggagagagauccugucuugccucagcauaguaaaggagagaacugacuguccucugaccuugacacauaugccugcacacacacaauacuaaaaauaaauaacuccagccccagagaggccucugaccucugcugacaccuucccuccauacauauucuccuauacagaugcaucuacacuguuuuuaaaacuuuuuauguguauucguguuuuugcuugcauguauguuugugugccaugugcaugccuuaugccugcacaggccagaagaagguaucagguccccuggaacugacgucucaggcaacuaauuguaagucaucacgugggugcugagaauugaagcuagauuucuuuggaagagcagccagugcuuuuuaaccacuaagcuaucucuccagcccccaugucuuugaccuuuugggacacuuauuuugauuuauaggaugaaguguugccucguuaucugaguugggccaggcuuugagguguauaccuacaauugcagcuuuuggaaagccagccuggacuguauagugaguuccaggacagaaugugucucugucagaaaaacaaaaagacaucuaggcuggaauucaguauuuguguguguguguguguguguguguguguguguguguguguguguguguguguguguguuaguuguuguuuugagacaggguuucccuacauagcccugacuacuuggagauccaaggccucugccaccaugcccuucacggcucauucugauacucagcacuugggagguagaggcaagaggauuaggaauuaaagaccgccuuggauuacaaaagacccugacucaaaagaccaaaccauggccacuaugaccuccaguggcaccagggcaaggaguguggcccuggacucacucacccugccaagaucucauggucugacaccuuuacacuggauaugccgucucuagcuucaucuaguguuugcaccggcucaggcuuccgagaacgacaaucccaacaucggacacuggaaucgauagaaccuguaaggucaaugugaagaugaggucagguuugggucucugggcagcgggcaguuucuagcuguccagaccuagacucaccagacaggaugacuguagccucuucauuaaacugaacgguguucaccuucugagaaucaggaauuaccaauuuagaggagugaggcuuuggaggauugggauuaaggcaaggcucucagugcauguuaaagcaagggcacauguuauagguagggaaggugaaagguucuagggaaacuggaaggaagacagugcuugguggcugucacgguauacuagaugggcacaaugggggaagacugugauggaaggaucuuccucguaccaccuacgggcuaauauggaucuccacaaugcacacguuaacgagggucuucucgcuuguacucacuccagcguggccccgaaauuugcgcacgaccugcccaguugcuacaucccacagcaccaccgucuuguccccgccaccagaacagagauggcuguuaucaaaggagcuggaggacagggaaaagaaggucaauauccacucacgacccuagcuagccucugcgcuccuuauuccagccuagcccggagcucacccagccgcaucuagcacuucguagccguggccacuguagguccgcagcagcgucccacgcagcggguuccacagcuuuaggguuuuaucgcugccgcacgucaggcaguaguugccguccacuggggaacaaagggcagggguuacgggaccgccggucucggguggagggacgcccgggaggaaggcgaaggcgcuuaccauuaaaucgcacggcucgcaccgcgcccuggcugcaguccagcgucuucauccguuucugcggcagcuccggugcccgcggcuuuggcucgggaaaagccauacuuuuaaaugcaucaguccgcugccugcuuuacugcugauguauugagaccaccguccucccaagcuuucaaagagacuugcucgaguguaacauuauuauugucccccaggauuuauuuccugcuuugcacuuccgugcaaaauuucagcgcguuaaugacaguuuuggggauacugaaaaguccuuucaguuuuuuuucccuagacuuccuacuuuccaggaacuguuuuggccuuuucucauucuccuuuuucuggcugagagucgucccucucacugcuauugggaacagaagcgcuggcuacugguguuacucuaaaagccauccuucauucccacgcccggaaguugcucuucuagcugugaaagaaggacggcguggucuucaguuugcuauguccacuaacaauauguccgacccacgaaggcccaacaaagugcugaggugagcaguccagcaagucauggcaaggcgucuuugguuguggccgugggucauggcuaagguggcccaggugggacuugaucgcuccugauccuugaacaugucgcagguauaagccucccccgagugagugcaacccggcuuuagacgacccgacuccggacuacaugaaucuucuuggcaugaucuucagcauguguggccucaugcuuaagguggguggggaugaaccucccugagugucuguugguccgccugaaacugaggucugggguggguucagaaagaggcggguccucuggcugugcuagagguggggaagggg

SEQ ID NO: 4605 - RNA, 6458 nt, Mus musculus
ccccuuccccaccucuagcacagccagaggacccgccucuuucugaacccaccccagaccucaguuucaggcggaccaacagacacucagggagguucauccccacccaccuuaagcaugaggccacacaugcugaagaucaugccaagaagauucauguaguccggagucgggucgucuaaagccggguugcacucacucgggggaggcuuauaccugcgacauguucaaggaucaggagcgaucaagucccaccugggccaccuuagccaugacccacggccacaaccaaagacgccuugccaugacuugcuggacugcucaccucagcacuuuguugggccuucgugggucggacauauuguuaguggacauagcaaacugaagaccacgccguccuucuuucacagcuagaagagcaacuuccgggcgugggaaugaaggauggcuuuuagaguaacaccaguagccagcgcuucuguucccaauagcagugagagggacgacucucagccagaaaaaggagaaugagaaaaggccaaaacaguuccuggaaaguaggaagucuagggaaaaaaaacugaaaggacuuuucaguauccccaaaacugucauuaacgcgcugaaauuuugcacggaagugcaaagcaggaaauaaauccugggggacaauaauaauguuacacucgagcaagucucuuugaaagcuugggaggacgguggucucaauacaucagcaguaaagcaggcagcggacugaugcauuuaaaaguauggcuuuucccgagccaaagccgcgggcaccggagcugccgcagaaacggaugaagacgcuggacugcagccagggcgcggugcgagccgugcgauuuaaugguaagcgccuucgccuuccucccgggcgucccuccacccgagaccggcggucccguaaccccugcccuuuguuccccaguggacggcaacuacugccugacgugcggcagcgauaaaacccuaaagcuguggaacccgcugcgugggacgcugcugcggaccuacaguggccacggcuacgaagugcuagaugcggcugggugagcuccgggcuaggcuggaauaaggagcgcagaggcuagcuagggucgugaguggauauugaccuucuuuucccuguccuccagcuccuuugauaacagccaucucuguucugguggcggggacaagacgguggugcugugggauguagcaacugggcaggucgugcgcaaauuucggggccacgcuggagugaguacaagcgagaagacccucguuaacgugugcauuguggagauccauauuagcccguaggugguacgaggaagauccuuccaucacagucuucccccauugugcccaucuaguauaccgugacagccaccaagcacugucuuccuuccaguuucccuagaaccuuucaccuucccuaccuauaacaugugcccuugcuuuaacaugcacugagagccuugccuuaaucccaauccuccaaagccucacuccucuaaauugguaauuccugauucucagaaggugaacaccguucaguuuaaugaagaggcuacagucauccugucuggugagucuaggucuggacagcuagaaacugcccgcugcccagagacccaaaccugaccucaucuucacauugaccuuacagguucuaucgauuccaguguccgauguugggauugucguucucggaagccugagccggugcaaacacuagaugaagcuagagacggcauauccaguguaaaggugucagaccaugagaucuuggcagggugagugaguccagggccacacuccuugcccuggugccacuggaggucauaguggccaugguuuggucuuuugagucagggucuuuuguaauccaaggcggucuuuaauuccuaauccucuugccucuaccucccaagugcugaguaucagaaugagccgugaagggcaugguggcagaggccuuggaucuccaaguagucagggcuauguagggaaacccugucucaaaacaacaacuaacacacacacacacacacacacacacacacacacacacacacacacacacacacacacaaauacugaauuccagccuagaugucuuuuuguuuuucugacagagacacauucuguccuggaacucacuauacaguccaggcuggcuuuccaaaagcugcaauuguagguauacaccucaaagccuggcccaacucagauaacgaggcaacacuucauccuauaaaucaaaauaagugucccaaaaggucaaagacaugggggcuggagagauagcuuagugguuaaaaagcacuggcugcucuuccaaagaaaucuagcuucaauucucagcacccacgugaugacuuacaauuaguugccugagacgucaguuccaggggaccugauaccuucuucuggccugugcaggcauaaggcaugcacauggcacacaaacauacaugcaagcaaaaacacgaauacacauaaaaaguuuuaaaaacaguguagaugcaucuguauaggagaauauguauggagggaaggugucagcagaggucagaggccucucuggggcuggaguuauuuauuuuuaguauugugugugugcaggcauaugugucaaggucagaggacagucaguucucuccuuuacuaugcugaggcaagacaggaucucucucccuguuucugccaugcuauguacugcaggcugacuggcccuugccuuuccaagagacucuucuagcuccaccucccauuuccccagagagagugccaagacauuagaucuugcuaccucauccagcuguugugugguuuccagagaucaaacuuggaucaccagucuugcuuucuuccucccaggccuacagacaucacuuaguuucaccuuggugauauagaacucuguuguggcugacuccacacuguagcccaggccaagaacuuaagcaaaaacaauggccuuuguauuucucuccuuggcugcaccuguagcuacccucaucuucaaggccaacuucugauauuaccuacuuggacguuucuagaucuuccugguucagcauagguuacuuuuuuuuuuuuuuuaagauuuauuuauuuauuauauguaaguacacuguagcugucuucagacacuccagaagagggagucagaucuuguuacggaugguugugagccaccauaugguugcugggauuugaacuccggaccuuuggaagagcagucgggugcucuuacccacugagccaucucaccagcagccagcauagguuacuuaaugguagaaauuguguaaccucuuccacugaaagagcugcaguuucuagucuguccugccuaguaggacagucaguaacugcaaccaugagggcuggaaagacugucuauggcuuagaguacuuguugcucuuguagaaaacccagguuugauucucagcacccacauggugacucacaaccaucuguaacuccaggucuagagaaucuaacacccuucuuuggccuccucagggaaccagacacacacaugauucauauacauacacauacaugcagauaaaauauucauguacgagauaaaaacccaaaaaauaauaaaauuuacauaaauaaaugcaaccaugagccaggcaggcaugguggcuugcgccuuuaaucccaguucuugggaggcaaaggcaaguggaucuuugugaguuccaggccauucuggucuauauaacaaguuccagcuagaacuaaauagauaccgugucucaaaacacacaaacacacacaaaaaucacugagugccagcuauggcagcuucccagcaaugagaagacccggggggcuggggggggggguguccaagaguuaaaggccagccuaucuacaguuaggcaguaguggcaugugccuuuaauccuagcgcucaggaagcagaagcagaagcaggcagaggucuugacagugaaauuaaaaacaaccaaggccacacagagaaacccugucucaaaaacaaaaacaaaagacaagaaggaagaaagaaaaagaaauuaaguacaaugaaucuagucacauuagggacaaaaguugagcugugagacagcagaaaugggagggaggacugguggcagugaaggccuggugagagcaagcuuagguggacuagcgccaccuaguggcuagcugcugcagcugccgaugagagcuacugaaggaacucaggcacaacagagucuagaggccugcaagagacauuuggacaucuauuuuucugagaguggugaaaggccauauuucuuugaggggaagacuggcauugcugagguugugcuuucaaaguuccuggugaggcaggugugguaggacagacacaccuauaauccuuagcaugagaggcucaaggacaaacucagucagagugaguauucgaccagucaggacucuugagauccugccucaaaaaaggagaaagcugcuuaggggcauuaaggauugggcauuccaggcaaagccuucauacacacaaaauaagauggugguagugcuguggguggggaaggagucgcacucggagaauacaguugccuugguaucuguaguaggcugacuucaggaucuaccagagacagcaaauguuaggcugcccauucugcuacaugguuuugguuuguuugcuugcuugagaugcugaguauggaacucagggccugugcaugcuaagaggccagccugaucuacugcgugauuuccauaucagcuagggcuauacagaggaaaaaaacagauaauaaaaucuuuauaaaauguguaguuggucagaugugcagauguagaacccagguacagguagaguugacugcuguaccagucaggagguacaggaucuagaaagcucugagagguuggaagagagagcauagcucugagugggaccaaacugucccgagacugagucacacagcagaagagcaucauugccuugcucacauuuuccuagaaggccagggauuccaaggcacacaggcugcccuggagcaaaaaaaggucagugcuuuaggcuggaucuacucuuucuugcagcucuguggauggccgcgugaggcgcuaugaccuaaggaugggacaggucuccucagacuacgugggcagugaguguggacagugggacagucagggcaaguggugggacagacaagaguacccagguuuaccugccugccucgcucucuaaggcccuaucaccugcaccugcuucagccgggacgggcagugcacucugauauccagccuggacucuacucugcggcuucuagauaaagacacaggggagcugcugggcgagugagucuccagugguuggcccuucccccucuccccacuucuggggugcaacaagccccucugauccuccccacccccacuccuagguauguuggccauaagaaccagcaguacaagcuggacugcugccugagugagcgcgacacacauguggucagcugcucugaagacgggaaaguguucuucugggaccugguagaggugagccuuccccuugugcuccuugccaagggcaucagcuggguguuucccaagcuugaaaagagcaauaaugacagguauuugugcaggaaccucuggcagaggguagaggggugugucucacuuuguagcccaggcugggcuugaauucauccugccuccguuucuuaagcugaaauaugaaggauggaugaggggaaagcaggaaagauauuugaagcaaggggaauagcauaugcuaaaggacuuggagaaggugguggcuguagcugguuccaggugggucacaaggaaggcugagcuaggugcuuucuauacccaaggcuagcagucucuaggccaaggguguggcucaguggcaggguuugccuagcauucucaguaccaacagaaagucagggacaagcugacugaggacuucaggcaagaucucaaggagaccgacugauaguaauaguuccccaccacucauuccuuagggugccuuggcacuggcccugccuguggguucuaaugugguacagucacuggcuuaccaucccacggaacccugccuacugacugccaugggaggcagcauccaguacuggcgagaagagaccuaugaggcagaggguggagcaggcugaggcuuacggaccugacaccaaggaugcagacugacucagaaaacccaaccaaagggccauuuauucuagagaugcugcugaccaaggagugggccuagggaggggcuggcauguaaaguaauaaauaaagguguggcaaaaagccucagucuuuaccaaucuucuuagucuucauucuucucagcucugaaggcaucugccuuuugggcgaaugucucagccaccagcaaggggaaaaccagagaagcaucagcauagaccug

SEQ ID NO: 4606 - RNA, 1604 nt, Mus musculus
ugcuuugcacuuccgugcaaaauuucagcgcguuaaugacaguuuuggggauacugaaaaguccuuucaguuuuuuuucccuagacuuccuacuuuccaggaacuguuuuggccuuuucucauucuccuuuuucuggcugagagucgucccucucacugcuauugggaacagaagcgcuggcuacugguguuacucuaaaagccauccuucauucccacgcccggaaguugcucuucuagcugugaaagaaggacggcguggucuucaguuugcuauguccacuaacaauauguccgacccacgaaggcccaacaaagugcugaggugagcaguccagcaagucauggcaaggcgucuuugguuguggccgugggucauggcuaagguggcccaggugggacuugaucgcuccugauccuugaacaugucgcagguauaagccucccccgagugagugcaacccggcuuuagacgacccgacuccggacuacaugaaucuucuuggcaugaucuucagcauguguggccucaugcuuaagguggguggggaugaaccucccugagugucuguugguccgccugaaacugaggucugggguggguucagaaagaggcggguccucuggcugugcuagagguggggaagggggugaggucagcuagggguggagcuagggugacgccccaaacguaggggaaguugggcuugcacuugacuuguacacugccuagcggggucugaggguggagccuaacuuaggcaaguuacagacgacuuguggaaaagaggccgggaggguccuuagcaugugggaauguuagagcagucugagaggaugcgguagggugagaggugcaggacacacauuggcaucagaagccugcugcuucgaguaggcucugaggguugguguugaggugcuuccccgggaacaagguccgagcugcagguagaaccugauaucugaggaccuugguggugggagcuccuugguauacuugucacugacccggucuucucacccaccuuucuucagcugaaguggugugcuuggguugcugucuacugcuccuuuaucagcuuugccaacucgcggagcucggaggacacuaagcagaugaugaguagcuucaugugaggaugcugaauaaggggauggggucccaugcgugcuccccagcacugacagcucuuuuccaucucaggcucucuaucuccgccguggugauguccuaucugcagaauccucagcccaugacgccucccuggugaugccaccuaggaggguuggauccuggacucaggcccaccuucucucuggccuagccuuuggcugccuccgcccucccucagcugcuguccuaaacuuuccugaguguggucucugggcucccagcugaauggaaggaaguuggcucuuucuuuggggcccugcuucugcuuugacaaagagauaaaccugcagacuucccuuuuaccuucucccccccccccaaacccggccacuguuaugagaaacacuguucauguuucuacguagucacuuguuuucuuauugaaaccaguugauauaaaacuuuccgcucugguuggcuugcacug

SEQ ID NO: 4607 - RNA, 1604 nt, Mus musculus
cagugcaagccaaccagagcggaaaguuuuauaucaacugguuucaauaagaaaacaagugacuacguagaaacaugaacaguguuucucauaacaguggccggguuugggggggggggagaagguaaaagggaagucugcagguuuaucucuuugucaaagcagaagcagggccccaaagaaagagccaacuuccuuccauucagcugggagcccagagaccacacucaggaaaguuuaggacagcagcugagggagggcggaggcagccaaaggcuaggccagagagaaggugggccugaguccaggauccaacccuccuagguggcaucaccagggaggcgucaugggcugaggauucugcagauaggacaucaccacggcggagauagagagccugagauggaaaagagcugucagugcuggggagcacgcaugggaccccauccccuuauucagcauccucacaugaagcuacucaucaucugcuuaguguccuccgagcuccgcgaguuggcaaagcugauaaaggagcaguagacagcaacccaagcacaccacuucagcugaagaaaggugggugagaagaccgggucagugacaaguauaccaaggagcucccaccaccaagguccucagauaucagguucuaccugcagcucggaccuuguucccggggaagcaccucaacaccaacccucagagccuacucgaagcagcaggcuucugaugccaauguguguccugcaccucucacccuaccgcauccucucagacugcucuaacauucccacaugcuaaggacccucccggccucuuuuccacaagucgucuguaacuugccuaaguuaggcuccacccucagaccccgcuaggcaguguacaagucaagugcaagcccaacuuccccuacguuuggggcgucacccuagcuccaccccuagcugaccucacccccuuccccaccucuagcacagccagaggacccgccucuuucugaacccaccccagaccucaguuucaggcggaccaacagacacucagggagguucauccccacccaccuuaagcaugaggccacacaugcugaagaucaugccaagaagauucauguaguccggagucgggucgucuaaagccggguugcacucacucgggggaggcuuauaccugcgacauguucaaggaucaggagcgaucaagucccaccugggccaccuuagccaugacccacggccacaaccaaagacgccuugccaugacuugcuggacugcucaccucagcacuuuguugggccuucgugggucggacauauuguuaguggacauagcaaacugaagaccacgccguccuucuuucacagcuagaagagcaacuuccgggcgugggaaugaaggauggcuuuuagaguaacaccaguagccagcgcuucuguucccaauagcagugagagggacgacucucagccagaaaaaggagaaugagaaaaggccaaaacaguuccuggaaaguaggaagucuagggaaaaaaaacugaaaggacuuuucaguauccccaaaacugucauuaacgcgcugaaauuuugcacggaagugcaaagca

SEQ ID NO: 4608 - RNA, 15967 nt, Mus musculus
ugaguuuucuuauuagagcaacagagcaaucacuagaccagcgggaguugggaaggguucucucuucccuacaagcucacaggcagcucaguccagccugggaugggugccucaucucuggcauuccaguggcaguuuguuugaagucccaguccuacaaggcagaucagaacuguuuucgaccccagcuucuauccacucuaggucccuccaggacaccaacccuaaagagaguugguacccuagaaucccaucuacacuuucacuccuuaggaaacauugaaguccacugggaaagcagaauccuucgcucacacucauacaaaagcauaucaaaaaaaucuuagugcuaaggucuccugccaaaagagcucuggguggaauggggguggggacagauccaguacuucccugugcucagucuacugccacagguccuugaugacccaggcccugcccccuuccucaccgauuggcgguucggguucugggggcggagcauucucagggauuuagcuaggguagagaaagccacggaagcggcgucgccggaaccaugggcaccggaccgcucaccucugguguccgugcugguggcgggaacaccggguggcucuggaugagcuccugcaaccuagguucgccaguccugccuauuuccuuucuuuuuuggcuguugcuggccgcgccuggcgcucgggccgcggguuacaaggugggugagcuggggcccgcgggcggaaauguauuugggcagaguugaacuagagguaugggugacacugauccauaggaaacugcuguugaucugacggugugggcuaagagcaugcauuggguuucugaaaaggucuggcgugagccugaaaacaaggcugcacgugauuuuuuucgccucccugugacuccaaguggccuguuuggacuuugcaugcacuuuacugugguugucgggugaagaaugagcagccacaugaacgcaggacucuaaguuuugcacagguugugcuugcaugguuccucuuguuggugacugcaucccccaaaauccauuuggcauggcucggcuggaaaaccuaucuugcaaaucugacgacaucaccuggcgccccuucuuuucuuugcagagguugacuaggagaugugagcugggcugcccauuccuagcuucccuuucccccaggauucucagcuuccuggcuccuuccugugcaagucacuucucagcacuguggcacaguguccuagccugacaauuagggcuaauauugccccguaucucagcugucugcaaaugcuuagcuaaccccgacaaaaguuauccuaaaguaugugaucucugcucuaugggguuugugcaaagugggaguugcaucuauagaguauaugggcacuauacucuguguguccuuccugggacagauuauagcuuuuugaccucucugcaucacuccaaaguuaaggccugugcuuguaccaucucccugccugcgugugaaaguggaagucaaaccuauggucuugaacaugccaggcaaggguucuaccgcagagcccccaaccugccugccucuagaacuaucggcuacugacagggaauguguauguugggggggucuuugugcagacaugucccccaacgaagccaggcaugcucaaugugcaccugcugccucauacacacgaugauguaggcuggcugaagacaguggaccaauacuauuacggcagugaguagagaggggugagggccucugcaauuuuuuucacagauuuggacauuggggugggaacagugaguuuucuggccucuguagcaaugcauaucuucuaguggaccuugacuuccugaacuucaugcccacaguccugagugauguucagcacgcaucuguucaguacauccuagacucaguagucuccucucuacuggagaaacccacccgucgcuucaucuauguggaaauggcuuucuucucccguugguggaagcagcagaccagugcaacccaggacgcuguacggaaccuggugcgccagggugagccuaacccaagaagugaaaagaggaagcccagcccagcuuguacuucugcaaacccgaccucucagauuacuuauuuaucuauuuacuuauguguguggggggggugggggaggggaguggggagcagugucuuauuauauagccaggcccuuccuggccuggaauuuguuauuagauuagauuggucuugaacuugaggaaauccuccuuccucccuguuuuccuagagcuaaaacaaaaggcuuggacaaccaggcaucucugagauuuuuauuauaucaucguguacacacacuguacccauaguucuacccgcuuagaaucugucuucauauagagaacccugucucacaaggucccaucuccaguggcuccacagggaggucagccaugcagaucugagcacacugguuuggaaacucgccucuucuucaggcuucgguauauagcauacuagggucuguuuuccuagccuugcccacgguggcccccgcuucuaacagcuacccuuuucccucugccuuauuugaacagggcgccuggaguuugucaaugguggcugggugaugaacgacgaagcagccacccacuauggcgcgauuguggaccagaugacacuugggcuacgcuuccugcaagacacauuugguagugauggacuuccccguguggccuggcauauugacccuuucggccacucucgagaacaggccucccuguuugcccaggugccaaccacccuauucucuuuuggaccugcccuuaaccuacucugacucugccuuuagcuacucaaacccugcccuucuuuaguagucccugggacuagacuguggcuugcugagacacaaccuugugggugaaauugacucuugugaguugaguucaagcccugauuggucuauauccuagggcaccgcagguuuaaacugcuguguugguccuuugccuugaccaggccuuaucugaauuuggacuccacuagccugcuagugcugaggcaacucucuaaucccagugaccguuggcgacaacuuccuuuaaaaacagcuucauguuuguguugaccucacccaccucagacuggggacauaacuagggagguggacguggguugggguuugacagcugcuucuuugucccugucuuucucaaccuuggaaauaaacauucaggcuccgugggacccaugccuguaaugccagcaggcuggugcaggaggccugugagguagagaucaguauggucuauacaaugagacccaguaucaaaaaaaaaaaaaaaaaucuagggcuggagcucagcaguaagagcacugacugcucuccucgagguccuaaguucaauucccagcaaccacaugguggcucacaaccaucuguaaugggauccaaugcccucuugugugucuaaagauaguuacaguguacuuacauacauaaaauaaacaauuuuuuuuuuacaaaaagaaaaauaucuagcuuuaaaaaaaauuauuauuuggggcuggcgagauggcucagcggguaagagcucugacuccucuuccagagguccugaguucaaaucccagaaaccacaugguggcucacaacuacauauaaugagaucuggcgcccucuucugguguaucugaagacagauacaguguacuuauauauaauaauagauaaauauuuuuaaaaaauuaugauuuaacauauauggguauuuuaccugcauguauaucugugagccacauaugugcaguguccacacaggacuguaggauccccuggcacugagguaaugggugguugcaagucaccauagugauacuggguauugaacucugguccucugaaagagcagauaacgaucuuaaccacagagccaucuuucuggcccugaaaaccauaguuuuaguuguguauaccuuuucucucugugcucuugcccgacugggcaagaaggccuuacauuccuucacucagccucucugugcuaucagauggguuuugauggcuucuuccuugggcgcauugacuaucaagauaaacuuaaucggaagaaaaagcugaggauggaggagcuguggagagcuagugacagcuuggagccccccgcugcugaccucuuuacugguaagagggugggagaguaaaccauacacaaccucgagcccagaagaguccuggugucguguugugaugugcugagguuaucuuaggauuuuuaaugauuuuuugagcagggcucugugcguuccuuuuguaucugcccuuuugaauuuggacgucuauccugggugggaugugacaggcucugaccccaggacaggucuggggugcugagucugguuuugucuauaggugugcuccccaauaauuacaaccccccgaaauaccugugcugggaugugcuauguacagacccucccgugguggauaauccccggagcccugaguucaaugcaaaaacguuggucaacuacuuccugaagcucgcuucuucccagguaauguagcuauccagaugacaguccagaaucuguaggcacaggcacuagccuuccccaaagcccagggggaugccuccaagggacaugaggggcuggagagacugcucagcauuuaaggguacuuccugcucaagugugagggucagaguucagaguccagcacccacauaauacaccagucauucuaaccacaugcuccggaaugagaguuaucuagagcucuggcuccaagagacaaaaagacaggaggaucauugggcacuggauuucagccuauggaagaaaaugcaagucccagauucaaggagagauucugcccgaaggguggggagaaggcagcuagaucucugugagcuugaagccagcugaggacaacauagugagacccugucucaaaucaaaaccaauaaacaaaucaaggaagugggccagugagauggcucaguggauaaaggugcuugugaccaagguuggcaaccugaguuuaguuuccagaacccacaugguggagcaaaggcacugacuucugaaaguucuucuccaaccuccacgcugguccuauagcuauaacuggugcauacuauaucauauguaccauccccucauaaauacacauuuaaagggaagaggaggaggaggaagaagaggaaaaugaugagagaggguggcucagugccuuguagccuuaucugaguaaaggacccuuggcaacuauuggcuguuauguuguuuucagacaaagcuuuaaguaauccaagcuggcuuugaacuugcuauguaggugaggcuggcuuugaacuucugcuccuccugccuccauuuucugagugcugagaaucagaugugcaccaccaugccuggggcucaaagccaggccuuaauacaugcagucuacugacugggcuguauccccagcucuucacugguuauuucuguauuuccuucugcuccuguguaccaugguccccauacauucuuguguguguguguguguguguguguguguguguguguauuuucuuugcuuguaugcuuguacugggggggagggucuagccugaggucuugagcuugcuaggcuaguacucacacacagagcuccaucccuaggcccccacguguauuuucaaacacuugggcacagggacaguccaggacccccuggccugaggacacuugggcacagggacaguccaggacaccuuggccugaggauugccuuuucaucuauagaaaggguuuuaccgaaccaaccacaccgugaugaccaugggcucagacuuccauuaugagaaugccaacaugugguucaaaaacauggacaagcugauccgccuggucaacgcgcaggucagugugacuccggaguguguuaaucacacuuucugacacuaaaaucaaugccucagaugguugagugacuaaggcgaaauagucacgcauaacaguccaacccagugcuaggaauccugaagauugcuuugaguugaaggccagccugggacaaacugggacacacacagacauacacacacacagaggcacacucacucgaccauuuuuuuuuuuaaacaaaacacacaguacacuuguuucuucaucucaucaguugaaagggagccucucucucaccaugaagaugaugucauucauuggcagagcuuguacuuggcacauuuaagguucugagucuaucuucaguaccacuuaaaaagaaaaagaaaaaucuaccuuuugauagucugacagugcuagaagaaucacuucugcccuauaauggcauuuucccuuaauuaauuaauuaauuguuuuuugagacagaaucuccuguaacucgggcuggccucugcuugcuauguagcuggggaugaccuugaacucuugcuaggcuguaccuagagggguuggauugcaggagugcugaggguuaaacucaggugcuguacaagcuagacaagccgcacacaccagucucuuccuguaguuccagcuauaggagaggcugaggcaggaggaucacuuggacuuaaaaauucuaggucagccgggacagcuggguaauacagggagagugccucaaucaaaacauguuaaaaagaaaaagaaaggguuguguaagauaauaggauuaucccugaaauccuuuuaagugcaacaguguuuggucuuggccaagacauaugcccacguuugaccauuguuuugcacuaaaaaaaagugucuuuacgagcuggaaagaggcuaagaggacuggcgcccauucagaggacucacauugcugggcagugguggcgcacaccuuuaauuccagcacucgggaggcagaggcaggugaauuucugaguucgaggccagccuggucuacagagugaguugcaggacagccagggcugcacagagaaacccugucucggaaaaacaaaacaaaacaaaacaaaacaaaaacaaaacaagcugcucacagccauuuguaacucuagucucauggguucugacauccuuuucuggucuuuguggcaccaggcaugcauguggugcauagacacacaugcaggcaaaacaucuauauacauuaaauacacaaauaagucuuuuuuuguuuuuugggguuuuuuuugggggggguuuucaagacaggguuucucuguauagcccuggcuguccuggaacucacucuguagaccaggcuggccucgaacucagaaauccaccugccucugccucccgagugcugggauuaaaggcaugcaccaccacgcccggcacaaauaaaucuuuuuuuuuuuuuuccauuuuuuauuagguauuuagcucauuuacauuuccaaugcuauaccaaaagucccccauauccacccacccccacuccccugcccacccacucccccuuuuuggcccugguguuccccuguacuggggcauauaaaguuugcaaguccaaugggccucucuuuccagggauggccgacuaggccaucuuuugauacauaugcagcuagagucaagagcuccgggguacugguuaguucauaauguuguuccaccuauaggguugcagaucccuuuagcuccuuggcuacuuucucuagcuccuccauugggagcccugugauccauccauuagcugacugugagcauccacuucuguguuugcuaggccccggcauagucucacaagagacagcuacaucuggguccuuucaauaaaaucuugcuaguguaugcaauggugucagcguuuggaugcugauuaugggguggaucccuggauauggcagucucuacaugguccauccuuucaucucagcuccaaacuuugucucuguaacuccuuccauggguguuuuguucccaaaucuaaggaggggcauaguguccacacuucagucuucauucuucuugaguuucauguguuuagcaaauuauaucuuauaucuuggguauccuagguuuggggcuaaaauccacuuaucagugaguaccaaauaaaucuuaaaagcaacaacaacaacaaauguauaggacucaaccuauuggauuccugugggccccgggaagguacagacccugaggcucacauacaccuucccccagcagcagguaaacgggagccucguccacguucucuacuccaccccuacguguuaccucugggagcugaacaaggccaaucucaccugguauuugaacagcggacuggggagcuugggguggggcuggcaugagccaaugauuugugacugcccucaauguucccgggcaggacagugaaggaggacgacuucuuuccuuaugccgauggcccccacauguucuggacuggcuauuuuuccagcaggccagcccucaagcgcuaugagcgccucaguuacaacuuccugcaggugagugagcaugugggcauuccagcaacccagaggagcugcugccuaacaugucucuuucuccucagguguguaaccagcuggaagcacuggugggucccgaagccaacgugggacccuauggcucgggagacagcgcaccucuucguaagugucaucuguugaccauggauugaauggggugggugaggguaggauugaaguuagaacccuguuggcuugcaccggaccuuuugccugugauugcuuggugguggggcucagaguucugugggagacggcauccaacuuauguucuguuggcagaggaggcaauggcggugcuccaacaccacgacgcugucagugguacugcaaggcagaauguuguaaaugacuacgcgaggcagcuggcagcaggcuggggacccugugagguuugaggggcagggucuugaaccuggagggagaguguuccauagugauaggcgggccucugggcacuuguaggggcggggagaaggagggguccauucuugggaaagaaggguggcgccuccgggaacggggcggaguguagguaggagaggaggagcaagaccaggcugccuggggugcagaccuuagugcagaucuuuuggugauccucgccagguucucgugagcaacgcucuggcgcgacucagccauuacaaacagaacuucucauucugucgugagcucaacauuagcaucugcccagucagccagacuucggagcgugugagucgccagggccgggaggcaagugggauagggccccagaagauaacgucugcagggaugcucuccuagaugggugguauuggaggccugcugugaccaugccuuuacugccauaguuccagguaacucuuuacaacccccuggggcgaaagguggaucagaugguucggcugccugucuaugaaggcaacuucauugugaaggacccucaugauaagaacauuuccaguaacgugagccugcacaauauauucucccuucuccacugcauuuaccccagaucuuguagauaucuucucgaguuucuucuuccucugugugucuucuaccucuguuccuuaauagcagccuccugaggauuagcuccuucccacaagagacaacccuugaaaaugucccccuaggaguuucccucccucccucccucccucccucccuuccuuccuucucccuccucuuucuuccuuuagauagguuuucacuguguagcccaggcuggccuccaguuuaugaucuuccugccuuaacccucugaguguuaagacugcagguuugggucaccucacuguuuccccagcaaauuuucuguuuaugggauagcucccuuuuccugaaccucugaccucaucucuuccucuguuuccucuuuucucccagacuccuaccuagucccugucucuaacucccccuuccucuuucuguuugcuuucuuccuguuucuucuuccuugagcuaguuauggaaugugcuaggcuaauccucguuuccccuccccugcacaccuaguuuucuucuuccaucuauuccuuccccucugagguugaugcuugcacacaugacuuguuuccuaagagucuuccugauuagcauucucuuauucaagguggugaugguuccuagcuauuacagugagacuuaccaaugggagcugcuguucccagccucagugccugcccugggcuucagcaccuacucuguggccaaaaugagugaccuuaaccaccaagcccacaaccugcuguccaggcccaggaaacacaagucccaucaugucuuagucauugaaaauaaggugagacucuccuuggauccucuuccuugccucggugacaaauuuaaaguguuauaaaaugacuuggauucugggucaguggguucuggguccuugguuuauguucaucuguccugauuauguguucuuuagugaggagggugaccuuuugagccucaguuuucuuucuggagcagcuguguaaaucuaguaugagacugauaaggucagagcccaugguagguagguguugaagggucauggaaggcuucuuuggugaggagacaguugaaggcugggaggauacagcagugauggauacagcagugauagagcccucaccuagcaucugggagacccugagcucaauccuagcaccucaaaaugcagaugcaucagaagcuggggucuuaggguuuuuacugcugugaugaaauacaaugaccaaacuggggaggaaaggguuuauuuugcuuacacuuccagguaacagcccauuauugagggaaaucaggacagaaagucuagcauggagggaucuuugaggcaggugcugaugcagaggccuauagcccuuuuaucugauagaggcauuuucucaauugagguuauuggucaagcuuuggagcagaugaagugugugaucaauucuggguaucguauuguccucugcugccgugggguagacuuguuaagcauagaagugaggguuucugcaaagggcuguucguccauccuagagggccugguguguagaggaauggccagguagaggcuaaagugggcggaagcagcugucccaguagcguucacugacugggucgggaacaacccuggcugaggugaggggagaugauuccaggaacggcgggggugggggggaugcuuguuuacaucugugcuccauuuccccaccuaguacaugcgggccacauuugacucuggcacgggguuauugaugaagauugaaaacuuggaacagaaccucucgcucccugugagccaaggcuucuuuuggugaggaagggcggcuaugucagcgcaggcuggggguggggugcccagagcugaggucucuccuugaugcucauuuacucugguugcagguauaaugccaguguuggugaugaggagaguucucaggccucuggggccuacaucuucagacccaaugucgguaaaccgauaccugugagccgcugggcucagaucaguuuggugaaggucuguggccagggaccgugaguggguucugggcguuggaguggcaauguggacucuggggaugggaugugccucauguaaggugcgggugggaacuauuucaucaucuuuguuauuuuaaauauuacaguguguguguguguguguguguguguguguguguguguguguguguuuguguguaaguuagaggacaguuugugugaaucuaccacaugggucccuaggauagaaugcuggucaucagccuuggcagcaagcacuuuuacccacugauccaucucucugguccccaaggguuuuacuauguagcucagcuuggccucacaacucuugaucuugccucagcuuccagaauaccaggguuacgagagugcaucacuaugccuggcuuuccuuuuccuuuccaugugggaguaagaccccaggcucccccugcugaugggugaaagucacauguuucuaggaagugaguuuauaucucaggguguaguuuagaucccuugcaaaugaauaaaggccugaguucuaucuagguccacaccagcacagcagcacuuggguagcugaggcaagagcaucucagguuugaggccagccuagggugggagggaggagcuggugagguggcucaguggguaaaggugcuuuccaccagggcugagcagcuggguucagucucuagaaugcacgggguagagaggagaaccaguuccugcaagcuguccuuugaucucagcguguauccuacacacacaacacaacacaacacaacacacugaauagaaagcugugagaacaucccauugaguccgucugagguggauguugguggaaucgccuucauguggcauuuuucaacauggcugacaccagcccccacugugugcacacagacagccuuggugcaggagguacaccagaauuuuucagccugguguucccaagugauucgccuguacaaaggacagcgccauuuggagcuggaguggacggugggaccaaucccagugagguaagugucgcgagcuucucugcaguggggagcacgcacgggguggugcuuaggggacucacaggguuccuuuuccguugaguacagagaugacugggggaaggaagucaucagccgcuuugacaccccaaugaaaaccaagggacaguucuucacggacagcaacggccgggaaauccugaagaggaggugggaagagggcauugugguggagucuguggugugugggggauuuggugaugguaugaggauggagaggaagcacgagcccaggucugaucacaucccaccccuucccagggaugauuaucgacccaccuggacauugaaucagacugagccgguggcuggaaauuacuauccugucaacacucgaauuuauaucacgguaccugcccugccacugccucagaccaggaagcaucuccuagacuccuggggcaggaugggcucccaggagggcccuacauucucauucacccuuacaccuaggaugggcaaaugcagcugaccguguugaccgaccgcucccaggggggcagcagucugcaggauggcucguuggagcucauggugagaggggagcccuaucugagcugaguuucucccauaggguccacucagacccagccaagcuugagggcuauuuguugguacccauuuucuguuuguggccuuggucccacccucuuuccuuucccugccuuucuuggguugggauuaagggccugcaucaaaaugccuggcuuuggaauuacauuucuagguuccacucuccuuccucuuauccagucccuguucaggccuugacuuguccuugauucucuuguuuggcgugcagucuuuccuuuguccugggcucuugucaauugggccucaucuccgcuagagucuccuaccagccacugacccuaaucuucauuguuuacucagucuucaguuucugaugaaaucacugcaagccuguauccaauuucugaacccagaucacuugcuaguuccucacucucugcuggccgccccuccucccaggugcaccgucggcuguugguagaugaugaucguggagugucggaacccuuguuggagacagauaccggggauaagguucgaggacgccaccuugugcuuuugaguucugucagugaugccgcugcaagacaccgacugcuggcggaacaagaaguccuggccccucagguggugcugucucugggugguagcagucccuaucacucccgggcgacaccaaaaacgcaggugaggggcagugaggugggcagaaagggagcccgagugacgccuucuaagccccucugugagaaugaagagcucugccucagucuaagccuuaccccuucaggagugagcucuucccuguuguaagaaacagcuuccguccgccucgaagccccuucccauuaugcuucauuuccuucaagucagcgcugauuguucuuuccauaguuuuccggacuucgccaggagcuaccuccucaggugcauuugcucacacuggcccgcugggggccaaagaugcugcugcugcgcuuggagcaccaguucgcucugaaagaagauucggaucgcaaccugagcuccccuguaaccuugaacguucaggugaggggcuguugagcugagaaacggacaggauacagacaagccagaacugggcuugucugcucagcuggguucauucauuuccugcagaaccuguuccagaccuucacuaucaacuaccugcaggagaccacacuggcagccaaccagccccuguccagggcuuccaggcucaaguggaugacaaauacuggugaagaccuggcaggcgcugugucuggggcuggcaguagagggugggacagagguuuacagugagcagugcauccaacaagccagcaaugcaccugcaguuugaggcuugggauuuugucuccagcaugaguucaucuccaucagugucugguucaaggauggcgucuauugccuuuggagauuugagagcaguggcuaggaguuugagaggguuuugggaaucuuaggugguacucaggcauagagaaguaguuuaaaugucugggugugagagccugggcacaguuguaagguggguauguaugguugugucaaggccuugaguucucuuuugccaaucaccaggucccaccuccuacccugagccuuccaaguuggacccuaccucagucacacugaagccuauggaaauacguaccuuccuggccucuguacaauggcaagaacacaggccugccugaaggaggggcaggccuccccuucucuugcuguaaccauucacaaaaaucauuaaaaagcuccuacugagacucaggucacccagugcacuaucuuuucuggaggggacacagacugugagauguaggaagaucagcauauccuagcucagcccugaccccaggcccuggugagagguuaccuccccacuggaaucaccacauguucuuccccaucuuacucaucccuucccucucuucccacuuccauccuuuguccacacaggccuucacauggcuggccagcucucagguggccaucuaagaagcgccgaggauaggccugugcaggacaugguaucagaaaaccuguugcacccugggucuuuccuaacccagccuuugagucaaaucuaggcuaggaaucuggaagguugaggaggagguggugaaagagaggcaggucucagcuuuaggccccucacaggcaggggaagcucccaucccucuuccugugagauuagccccuggcuuguaccuuggaggcagugcaucgugcucucugggauuuuaguguguucugaugucuguuuagauacugagucuggaaaggaggcucugauuagaaacauaaacuguguucuuccagaggguuugagguuagcuuccagcaccugugguagguggcucaucagccguaacaccagcccucgagggaucucucaccaguagccuuuaugguccauggucaccuucacucacgugcacacacccacacauaaaaugaccaaaaaaacacaccuaaaagguuuuuuuuccaauacauuccaagcacaguuucccucccuccaucccucccagccuccuccauucccuuuccccccaccccaacagaucuauuccuccucuguuucccuucagaaaagggaagaccucccaggaauauccaccacacacagcauaacaagcuaugauaaaucuaggcacaaacccucacaucaaggcugggugaggcaacccagaggaagaaaagggucccaagagaagaugaaagagucagagacacccccacucccacagucaggaaucccacagaaacaccaagcuaacaaccaaaacauaugcagagggcuaugguagacccaugcaggggcaauggagcuguuguguaauccagcacucacuguguaguuagugagaccuugcuucucucucaaguaaguaaauaaauaaaugaacaaaauaag

SEQ ID NO: 4609 - RNA, 8874 nt, Mus musculus
cuagauggagcaaacagaaguuaauuuuauuuguucaaguggcaaaguagacugggucuuaaacccaggaagucuuaaucuguguucuagguauuagggcucacuacacaggaacaugggcuuuuuuaaaauuugaguagauacagauuuuugccuaagaaagauuacucaaagcugacaaucacaacucaaaugcauauaaaaauaacauuuauugggcuugagagaugguucagugguaaaaagcacuagcugcucuucuagaggacugggguuuaagucccagcacucauauggcaacgcucacugucuguaacucaaggcuuagggaucuggcauucucuucuggcuuccacugcaccagacauacaugcaggcaaaauacucauacacauuuaaaaaaauguuuaaaaaauauuuauuaacuuaggcuauauaacauuuagugaaauaaaauuuaaaaaaccacaaaaccaaauaaaaugucugagaugucuuucagcuugaaauuugcauucuagguuuagucaggaaauuuucuuaaacacauagaagcaaaauggucccaauuucaccccacgugagaggacagaucugagucuucagaggcaauaugguugaucuaauguccaugugaggugcccagugcuagcauccucuguacugagacacuccucagcacaccuggaauucaggcuuagagaagacuuccacacccuucaucucccagacagacugcacaugccugcagugagauggaaaucacucugcuguggcugucugagcuuuggcagcauuuuccaaaaucuuccuuuuccauucuucauaauccugugucagaucuucaucuuuagguaguuuaugaaggguuucuauuacuucuauuucugugagagaaagucagcaaaugcaauuuuaaacaaguuuauaaauggcauaaaaguaaaaauuggcaaguauuuacuucaauuaagguaagagauuaagacccuagagugcaguguaacauggcagcucucacuuuucucuccuauacucuaagcacucuaagacaucaaccuuguaccucaaguaaucccaucacaacauuaugcuaacauuagucacauuuuacagauuaggagaaugaagcuuguagaaauuuuaucaccuuuucaaaugcacacagccaguagguaguguuaaacaauuagccauuaguaucaagauuguucuuguagcuagaguuccuauguagguaacuagaacuuaauuuggaaauauauuuuuagaggaagaaaaaaaaaaaaaaagcagcccaucacaaaagcuaccuuucugguuauccaaacagggaccucacacuagauauccuuaaauaaaguaaaugaguaguuugacucaauuggauguuuucuaucuccuuauaaccuaauuaacucuauuaggacuucuguuuaaccacugggugguguuuucggaaccaauuuuagauuugaagcuguccaauuuaugagucagucugcuugaauuguuuaauuugccuaaagauuuuaacacuggcaaaguaaaauaugaacccagguacaguuuaguuaccaacauucacacuuuucuuucucuucucucgcucuuuuuuuuuuuaaacaaauucucacugugugguucugacugaucuagaacuugcuuuguauaccaggcuggccuggaacucagagaucagccuggcccugucucugagugcugggauuaaagacaugucaugcuguaccagauauaccucuaaaaauuaguaauaucuguauucuuuggccaccagauauauuuuuacucacacuucuguuacuuccuuuaauuauugcuuaaaaggcuguuuuguuguuguugugagaugguaucaauguguagcccacguuggccuggaauucacuauacagaucaaucuggccuucaauuuacaguaauccuuugugucuauuuucuaagcauguagaaguaauuacagguguguaaaucaugccuggcuugaaaaauaggucuuaucaaauaauuaguugucaggcuuuccucuagugcugcuucuugucauauaaacuguugggaucaacacaggacugcucaguguauaaauuauacugcaccaauuucaguaccaagagagcuaguguacccuaccuuuugcuggugguucaaguccuggcuccuuuuucuucaguguuggacuaaacucuggcuucuuucucuucagugcuggucuagcuaaaucugcagagucuccuuuuagaaaaagaaaaguugguuucaagguuaauuuuucuaaucaauuuuacauuuggucaucuaaguccucagcuggaugauagaaagccaguacccagaggagcaaaaagagauggagcggcagauagauaauccugcuccucuuguucuggcuguuucuuuuauuagacauggaaucacucccaucccaagcaguacucagauacuggcacuuaacacugcagcuucuuucuuucuuuugagacagggucucucuguguagcccuggcugaccuggaacucacucuguagaccaggcuggccuugaacagagaucugccugcuucugccucccaagugcuggaauagcaggcaugugccaccaagcuugucugauacugauguuucuuaaggaauguauuuucucagcauagauuuguagaaucauauuuuuuaaagguauaguuguagugguugguuuuguguaucaacuugacaugaacuggaguuaucacagagaaaagaggcucuuuugaggaaaugccuccaugagauccagcuguaaggcauuuucucaauuagugauuaagcggggagggccuagucuuggguucuauaagaaagaaagcugagcaagacagaggaagcaagccaguaacauucuuccaaggucucugcaucagcuccugcuuccugaacugcuugauuuccaguccugacuuccuccggaauguggaaauauaagcugaauaaacccuuuccuccccaacuugcuucuugguuauaaugauuugugcaggaauagaaacccugacuaagacagguacuaaaccacuuuauucgcagggcagacaugucaauuaucucacuaaaaaauuaauaaaaucagcauuuucaaccacagaauacucacuguuaaucugcugcccaaucuuuucuaacugcuuacacagucgaucaaguauugccuuuuucacaccggaugcaguuaucauuuugguuuuauccaccuuuaucuuuagaauucuaaaaaacaauuucauaaauuuguuuuuucaauaucaccaguuuucugggcaagaaaaacagauuacaaaccuauggcccuuugcccacgauuuacuaaaauucuccagcugucuggacuuuccuguuuuccaaaugucauuagcuggaagcuugcagauuugcucucuuaaguccuuuaguuucuuauuaaacugagagcggaaaauucaucuguucagcaguaaaugaggcaaacaaacaaagacaucugcuacagcgcuucaugccucucagauguuaccaauuugcugaauggacucaguaucuguuaaguguucaacucgcuuugagaauguuucuauuuacacaggagugucacaucucuuugcccuacuccugaagccucaauccuguucauauucuucuacagcaagcaauuaaaaagcaaaagaccuggggcuggaaagauggcucagugguuaagggggcuggagagauggcucagcgcuucagagcucuugcugcucuuuaagagggcccgaguaacgcccauauaguagcucacaaccaccuguaacuccaguucuaggggagccaauguccucuuuuugccuccacaggcagcauauauggcaagcaacacccaccccccccaagacaauuaaccauuucguguucaguuuaauauaguuccaaaaguggaguuauuugacuauuuucaguuucuuuuguaacaucaauuacauuccuucuucguacacauacccuuguugaauuaaaagaauauuaucuauggaugacaaucacuccuagguaugcugcuaaaagugccaaguacaccaaaauuaaugacuggaaacugagaaauauauucuuuaacagacuacaugauuuuucuguagaaaguuuucuuuaaaaguaaaauaacaagcugggcggugguggugcacaccuuuaaucccagcacuugggagucagaggcaggaagauuucugaguucgaggccagccuggucuacaaagugaguuccgggauagccagggcuacacagagaaacccugucucgaaaaaacaaacaaacaaaaaaaaccccaaaaaacaaaaacaaaaaaacaaacccaaaaaaaaaaaguaaaauaacaacuucaaagauauaaaaaauuaguauuucauggaauaauucaguauguauacuaauaacuaaguauuuuggugauuuaaauguaagaauuuauuuuagaaauguuuuucaguucuuuuuaaacaauaugccuggaaaaucaaacacgaucacuguccugacagauuuacaacuuacacuuaguaaaaguagggucugaaaggagaauaccuuguuuacagacaugggugccacauggcaaguaaacaucuugaacacucguuugaaguuggcagcucuauuaucagccaagccaagagucucauuaccaggccacaaccguaguguuccagggcuacagugcaaacugugcugagccgaggagaacgaaugacaaguguucucugaggaugagaagcucauauuggcaacauuuccggauggugaaagaacacuuacacuagcuggguguugagucacacacauuugaaaucucagcaucugggagucugaagcaggaggaucaucaugaguuuaaggcuggcuuaugauacauagugacuuccaggccagcauggacuacacauaaaacucucucaaagcaaaaacaaacaagcaaacccagcacaauaaaguaaugcccaagaacucuuacuugcaugcugagaguagugcggcaguggugaaaaguggccuggacaagucaagaucugcucgcuguguuucaggaagaccagacucguagcuaggagacagcaauguuugugaaauuauuugucaggaaaauaucuuaaagggacugaaaaugcaauaacaauugagaaaacaaaacaaaauuuggccccuaacuuaaauuguccugaccuauuguuagcauuuguucgcugacugugcuucuaacaacguuuuuaguauuuauuuaggagcuggagagaugguucagcaguuaagaacacuucugcuuuuagagagcaccugggcucacuucccagcauccacaugguaacucacacccauuucuaacuccaguccaugggaccugaugcucucuauugaccugagagcagcaggcaugcauggggugcacauacauacaugcaggcgaacacuuauacacauagaguaaguauuauaaaauuauacauaccucugcaguaucucugcagccaaguucacugcuucuguacagcugaacuguacagcuaggucucugauuccaacauuugaauuuaauccuaguaaacacucaaaagauuuaagacagcucugauacaccaucuuguucaaaccagagagccuaauuaaauaugccuuugaaaagaaaaacacacauuuuaaauucaguauuauucuucuuaaauauuuauuaagagguauauuaauuaugcuuuugguuuugagccuagccuuuaauggcugagccaccucuccagucugugauauuaauuauauacuaauuuuauuuaacccaaaacguuucaaucacuuuaagagcagacuauuucaaagaauucguauuauagaaagguacaauuaugcauacuuacaaauaauauuuuuuuaguauagaauagaguuuauucaggguaugggaaggggaguuaagaggguaguagaaacagagagggagaguagagaaguagaagaguagaggccagccauaagcauguggagagaggggaagggaauagggagagggcaggagcaggaagggacuagcaagagagagagaggagcaagagcacuuacaaauaauuuaaaaacgacuaaauaguauagcuugucucagcugcacaaaacaaaccacuaggaaaauuaaaggaaguacuggguguagggugaggaaaguguauaucuggaagggaagaacaggauaauccaccacuguagggagccaagucuaucuugggaaaucauggagagcuuuauaaaagauauacaacaaagcagagucacguuaggacagaaaggaacuuggcaacaaagcauuccaggguggaaaaguguuuccuuuacaaaacuaugacucacaaaguguguaucauagcuugaggccaggguaaaagagacugaagaguuagauagcaacagaaaaguuaacagagcuuuaaugaauaaauacauccauuaugacacaaguacuguguacaucuacuacauaaagaagauagauaccuucuuuagucagaauaauaauccaguaaaagacgguuuuuauucuuauuugauggaugaagaaacuagcaguucauggaucuuguaaauaauacugacauuugguuucaacaugugacucuuccugacucuaauuuuaaacauuaaagauuuggacaaacugugagaguuacucucaacuguuaacuugaugagaucuagacucacuuggaaaaagagccacugggcaugccuaggggagauugugcccauuagauuaacugagguggacagaccauuucugauggcaaaaucuccugcaaugggauccuauauguacaaaaaaaaaggagaaacugaauuggguacaaagauuacuugauuucugcuucaugacuguaggugccauguagauucuucaaguugcuuugauuucugugucaggauagaucguacccuugaaguugauuaaaaacucucuccugugauugcucuuccgaaggaccugaguucaaaucccagcgaucacauggugacucacaaccaaacauaaugagaucugacgcccucuucuggagugucugaggacagcuacaguguacuuacauauaaccguaauaauaaaaaagaaacggagccgccaacaagaagauuaaaacaaagaaaccucagggucacaucagaucacucaaauguccuuuggagccaacuuacucuauccaaggggcacuuccuacaggaagcugcaagguccaggcauaugacagcauugcugguuucugagcuacgugcagacagacugacacacuucaccuuagacagccgcaggaacuccucugcuuuccugguuauaaaggcaguauggucacuaaaacugcugcagaacuuugucaacacuuaggcaaagaacugaauucagcaugguggacuugcacaccaccuaacuacugugcaaguucauuuggggccuagaaagcacauccuuuggagagguggaaguucuuuacauagaaccaaaaugacuccagacuuagcuguguccaagcguguuccuuggacauuaccuuuccuucuuacauuauuucaacaaguauaaagaauugguucaggcagauuagaguaaauuaaaucccuuucucuuccuuaaugacugauugggucucaguuucggcggcuugugaaaauaguucugggucccauuguauuuccggucaguagcccugggaauagaccuacgaacuuucuacacacuugccugcuguagcuuuauuuccuaagacagauccuacaaugacccuccuaaucucaagggcuucggaaaauggaagcuauuugggccacucuuaccauauuuucccaugcgugccacuauuuaauaaaucagccccaacgccacugggcccuuucuggaauuuuuuuuuuucgauuuuucgauacaggguuucucuguauagcucuggcuguccuggaacucacuuuguagaccaggcucgccucgaacuuagaaauccgccugccucugccucccaagugcugggauuaaaggcgugcgccaccacgcccggccuuuucuggaauucuuacgcccugcucaucacuucagcucuucacucuguaccauaaucuaccuuucucuugccaucuauagugauuugcacagggucugcccugcaaggcuggcuuaucaagauuaucgagucugaaggaaugacaagagguccuccccggcuuuuccgaccacaguguauccaacagagcuagagugcuucaaggacgacuauauacguccucucaaaccaucuucuacaagccaacaacaguuuuucuugauguugggcccgagucucgcccagaccagugugcggucauucccucaucgccagucccucauccgacgcugccuugggaggacccagggccgcagucugggacgucuacccgcacacacggccacacucaccucaguacacucggcuccgcaaggccgagacgcggggcgaggcggcguaccagcuccgacuccaucgcuggaagaaaugcgcgccaagagcaaugcgcgcgcagauugucagaggguuaagacccacccccggcgcguccagauugguugcgaccagagguugagaccguuccacacaccaauccuggucauccuucuacgcaugugcacacgaugaggcgcgggcccaggcgaaguggacgcgcagaagguucucucgcugcccuuccucggccgcggaucuccuuaacuaaggcuucccuuccugcugucccuaguucgccgcagcguuguacuauucucgccccgccccguccacuauacaccgccggcugcccauucuccccaaacuacg

SEQ ID NO: 4610 - RNA, 634 nt, Mus musculus
uuucacuuuucaaauaauuugcuuuuaauuuuaaacuacucaguaucagugauacacaagaugaaaccagaccaaccucuccacccccuccaaaaacaaagccuuguagacuguuccuugaaggcagacauuucuuauucggugugcuuaauaguggaucguaggcaauuauuuaaugaauagugaaguuuauaccccugacgcuggaagccuagggguuucaucgagugucuauuauaauuucucucggauuagcauugcugacauuugcagagagguuuuccguugccaguaaccauuucaggcucugguucuggggccgacgagggggcgugcccagcaccagggcucggcccaccugugcguugguugguggagucucgucggagccacgcccccgagcgguccaccgccuuagagggcguggcgaugggacuucccuggaagggccgcggcgccccccuccuccaacccgcacgcagccccgcgcacgcgcacgcgcgccuccacggcugggucgcggcuggagugaggacgcgcuguguggagcagcggaggcacggcgcugcuuccaccgcugcucaggaggggagcaugucugcaacucgagccaagaaagugaagauggccacca

SEQ ID NO: 4611 - RNA, 35055 nt, Mus musculus
cggcggcggugggugugcgaauacagggagccaggaggugcuggugccaggcgccaggaugcgguggccggccaccggguuugggagcagcccaggcucaccuuaaccggagcggugcggacggucccgcggcgacaggcacguugcauacccacauuaggcgcagcuccggcaaccuagcgguguagcgucuuggugcugcaguggcagggugcaaggucccaguaaccagagggugggaauacagcccuggagcuaggcuggcgcugccggccgagagccuuggguucuugggggacugguguccaccuggggcugugcgugacgucuugcucuccuucuuucugggccagggcuaaucucggcagguucgcgaugcagcgggcagcggugcuggugcggcggggcuccugcccccgcgccucgggccccuggggccguagucacagcagcgcugcagccgaagccucggcggcgcucaaggugcgaccggagcgcagcccucgagaccgcauccucacccuggaguccaugaacccgcaggugaaggcgguggaguacgcugugcggggacccaucgugcucaaagccggcgagaucgagauggagcugcagcgggugagcgcagggccugcggggggcgaggccagggggcguucauggcgggaagaacuguggcaagcuacuuugggguccuccugaaggaccuccaacccuccgaaaccccccacccccucggcuuucagcuucuucuuugugccauuuuuggcuaaagcgagagaacgcccccucucucucccgucacccaccagugccccgcaucuggcacaaagugaggccuucgacgguucacuuguugaauugugcccaguuauugagcggccucugcugccaggcacugcguguucccuaagugcccuacccucguggaucccuuggaagggggaaaacaagcaaauauagaagugagaguuucagauagagaauaaguaaguucuuugaagugagacgaaggggcuggggggggggguggcgaggugaaaacccuguuaaguaggagcggagggaggaaggaagacugugugacuggcugguuuguucccgaacccuuuuuucuggcagaggccugcuggguguuugccagccacaguggcuugacaagaccgggacucuggaaaagagauggguagaauuccuuauuuuguaccccgagaaccuuugauugcuauagugggagaguuggguccuuaugaccuuaaugaggugaaccugggacuucaucuuggugauaccagccagggaggcuggcuugaacuuagcugugucucccugucccaacuagggugguuuggccguaugugaaaccaaguucuuuguucuggggccaaggucugacuauguagcccagguuguccucgacuccacauccuccuaccugcaccugcuaugcgucgggguuuacaggcauccaggcacagaacacaaugcccugcuaagauacuggguuuuaaacugggugagauuuggaaggcagagucaagagggaacaucacuacuaagauuaaaaagaaaacguuagcuggguggugguggcacauguuuuuaauuuuagcacuugggaggcuaaagacaggcagaucucugugagcucuaggccagccuagucugcagagugaguuccaggacagcuagggcuacacagagaaagccugucuggaaaaaucuuaggaagaagggaaagaaggaaggaaggaaggaaggaaggaaggaaggaaggaaggaagaaagaagggaaggagagaaagagaaagaagaaaaaggucaccagaucauucugauucaagauguggauggaugggaggguuucuugauuuuguuuccauacucagcagaucccagugucugcagaguagcauggucacucaguauccuugaguauguaagaagaacucuuagaaucucucucuucuuuccauuggaauuuuuuaugaagccuaccuacaucagauacccaauucuacuaaaaacgcugugucggauccaucagugucuauugcugacucuuugcagggcugaguuuauuuauuuauuuuuuuagauuuguuuuuauuauuuuaaaauauguauauguguguaguuaugugcacauaagugcaggugcccauggagaccagagaaguuucuuggugguacaagcuuaggcaggucgauuucugaguucaaggucagccuguucuacagcuacacagagaaacccugucuccaaaaaccaaaccaagcaaagcaaaucaagaguuggaucuucuuggagccgaaguuccaggugcuugugagccgccugaugugggaacugaacuggauuccucugcuacuaaccuuccaccaucucuccugcccacugggcuguuuaaagguuggcccagagaaggcuggcuccguuuuuuugugccugacacacuggugggcuagagacauagagccugugcauuucuuuuucaaacuuugauaucugggaggcugcagcugucucuucucaggacaacagucuuccugcuaaaacaaagccaggcugaaaguguucccuguucugccccaccacaguugguuucucugcauccagagcugggagagauuccaggaauucuuucuaucuuucgugaaauagcugcuuuccuguuggacccguaaagcagaggauggggagagcuagagagcacuggccuuagucucaggccgccauacuguuauucccgcuccauugccccccaguucacuauguuuuggggggauguuuuagcggcagagaaugugugagaaugguccaagagcaggcagugcugugaucaaaggcaagaagcugggaaguucugggucuagcggcagguuagggauugauguaguuaguagaagucuguuuggcggagggagguggggugaauucgauagagaagauagacagaagucauuuggacgacucaggacuggaccaugcauccuggcugggcauucgagcuaggaaggguuuccagcggugguaaagcucagguagguauaugucuuggucacugggccagaagcauccugacuuccagagcagaaguuccacacucccaaauguuugagacguccaagcuagaugagaaguccuuucuguccaccccuacucucugauauuugucuuuguuuugagacaaguucucacuaucuuaacagaccuggaacuuucugugucaggcaggcugaccuggaacucacagacgucuauccagcugucucuguuucccaagugcugggaagaaagccgcacaccaccauacccucucugcugcucucauucaacuucauuagccauauuugucaguuguuucuuuucuuuuuggagguuggggguucggggcuggggacuuuagauuuuagagcucuacuaacuggaggcaagcacuccacgauugaccuagagcuguauucagagcccuguuuauuuccauuuauuuuuuguuuguguuggcuuagugguuuuuuccuauuucuguuuugaaucucugaugcaaauuggaccaauauuccaagggauuugaucuggcugagaaguguguauggaauacgacuccaggcaaauuccauguauucucugggcaucaguuucccauucucugagcuuugucccgggcaaccugaggugaugucuguguuaggucccagaaccuuauguuagcuauggaauugcuucagugggugcuccugucaauaucacaggucagacacguggcuucgguguuugucuucaggguggcggacagggcuuagucccaagcuuuuuacuucucugauaagauagccugagggacaaggagaacaggguaagggaugugaauagccaggccagggaggccauugcacccugacagcagcuccaccaagggagagucuguuuugggguuucagaucccauuguucauugggaauaauagcacuuuuuaauaagccucaauuaaagggguuuugaaaggaucugacaguuucucaaccuacuucuuuuuuuuuuuuuuuuuuccucuugcuuuuuuuaaaggcaaggaucagggcuuggugcaguaaagugaaggaauggcuuuauucuuccaguuguaaaaguaaacaccagccagguggggugacuggggccuguauccuaccuauuaggaggcugagacauggggguuacuugaguuuaggaauucagggccagucugggcaauauaggaacauucugucucaaagguuaaaacuagaaaguguuugccagguaagcacgagagcauguguuuguuccccggagcuuccgugaaaagccaggcauugguugugugcacuugugacuccagugcugguggaucacaccaggaggauccuggcauccuccugaccauccugaggaucccugaccagacgcuaaccuacucaaaccaaugggaaacccuguuucaaaacuugaaguggcugacuccugagaaaccacacccaagguuggccugugaccuccacuuguacacauauacacacaugcaccuacagggacauguacaaaguacacaaaacaaaaacaaaagcucacacagggcagaagguuuagaauuagaaaagacugguuacuuuuguugacaucauugugugguuaugaggauaaaacguguggaagacugcguuggccuuucugaaucucucagugugcagcuuucugggucagcuguagcuuugcuauaacaaaugauccugaauggaaagaauucagcuuuacugacagucuuaguuagggcuuugcugcugugaacagacaccauguucaaggcaagucuuauaaagacaacaucuaauuggggcuggcuuacagguuuagagguucaguccauuaucaucaaggcaggagcagggcagcaucuaggcagacauggugcaggggaagcugagaguuuuacaucuuuaucugaaggcugcuaguggaagacugauucucaggaagcuagguuaagggucuuacagcccacacccacagugacacaccuacuccaacaaacuccaacaaggccacaccuccuaauagugccacucccuggacgaguauaugcaaagcaucacagaaaucuuuuuuuuuuuuuuuuuuuaaagauuuauuuauuuauuauauguuaguacacuguagcugucuucagacacuccagaagagggagugucagaucuuguuacagauguuugugaaccaccaugugguugcugggauuugaacucuggaccuuuggaagagcacucgggugcucuuacccacugagccaucucaacagccccuuuuuuuuuuuuuaugauuuuauucugaugccuuuauccuuggcauauagaugauguuucuuuucuuuauguuguauguauucuaauccuuucucaauucuccauguuaaagcaagcaaacaacaacaacaacaaaacccucagaaaacaaacaaacaaauaaacagguucucuuguagccuagguuuuccauccuggaaugcagaaaucuuuuuuuauuuuuuauuuuuuagaucuauuuguuuuagauuuuuauuauuuuauguguauguguguuuugccugucugucugucuguccaucccaugugugcuggugccugugaagccagaagagggugucagaucccccagaacugccacuaugugggugcuaggaaccaaacccaggucuuugguuagagcagggaguacuccgaugagucacguugccuuuccagcccuguuccuuauaaaucuccgcuuuucuuguugucugcaugaauuaaaaaaaaaaaaaaaaaaaaaaaaaaguccgggcgugguggcgcacgccagccuugucuacaaagugaguuccaggacagccaaggcuacacagagaaacccugccucaaaaaaccaaaaaaaccaaaaaaaaaaaaaaaaaaggaaagaaagaaggaaauaaaaaagaaaggacauuuaacacuccuuggugugguagaggagguuuguuguagacaugagggagagcauagccagaggcagggacaucugggggaguccagaauggacauaacccugagccagaccagaggagagaacugggagaguaaaggguggaugacuagagaaagggugagguaccuaaauuagggaagggaagcccagccccugggcuggaggaguuuaggguaggggguggggcaucccagccauacccuguaaaaagucaggacugguagaugcuggagaucuuggcagccagacccacuuugauauguuaaagaggcgcuuuguuaggcauuuguucuccguuugagacuaccauugcaagaguguuacucugugcuaaaucucagcuucuguuaaaugaaccuguuuucaggaccugugggaucucauuggguuuugucuccagugcuucuuucaggacuuccuuccugcucuagucugauuaauuguccauuugagucugggaucuaggggccuuucaaauaguuucuggggccugggaaggccucacuuccacccugugcccaacuccuuuccuguacccacacuuggucaagauuuauuugugugugugcacauguauauguuugugugugugcauguauguguuugugcaugcgugcgugcguaaguagaggugcccacagaagucagaggcauagagcuaguguagcagaggguguaagcugcagggcaugagugcugcuccuguguucggguugucuggcaaagccuuagagcgcacucuccccacugagccuucucugcagccucuguacacuucuucuucuucuucacuuccuguauuugcuuugguuuuucucuuuguuugguucccgccuaccuucucucacucgcaggcuccuuauuuacuguauuaggaguguuuguugaaucaaagggagacccuggccuucuucagcauaucucaugaaaugccugggccaucccuugaacaagaaaacuaacuuguuuuuaucccugccuccucuccagguuuaccaggguguguauaacugacagguguguguguguguguguguguguguguuuguguguguguuuguguguguguggguuuguguguguuuguguguguguguguuuguguguguguguguguuuguguguguguguguguuuguguguguguguguguuuguguguuuguguguguguguguguuuguguguguguguuuguguguguguuuuuguguuuguguguguguuuuuguguguguguuuguguguguguguguuuguguguguguguguguguuuguguguguguguguuuguguguguguguuuguguguguguguuuguguguguguguguguuuguguguguguguguguguguguuuguguguguguuuguguguguguguguguguguguguguguguauuuaacaugggagcuggagaagagcaggggauccagauuugauucccagaccccacacucggaagcucacaaccaucucuaaauugaacuccaggggaucugaugccauuuuagccucugagaaagccuauacuugccccugccucccaaacccuaggauuaaaggcaugcaccaccaccuuuuuuaaauagcauuuuucucgagugugugugugugugcacgugcauauuuucuugcacauauaggugcacacauguguagggugcauuaguagccauaugacaacauugcuaucgcuuuuuagaugcugcauaccuuagauuuugagacagggcucccguuggccuggagcucauugguucagcuagguuggugaaccccaggaguucaccugucuucaccuccccaguacugagaugacaagcauacaccauugcauuugagguugguuuguuguuguuuguuguuguuguuguuguuguuguuguauuaaaugugauucugugcguugaauucaggugguuggaccugagacacaggcaccaauugagcaccuccucagccuuccuguuuugauaacugcuuuugucucgccuuguucccgucugacguguccaccaguccaguguggccuuuaaugcuguuggacuguggacuggaagggcgaugauaaaucuuuuuccuuuucgucggaagaaguauuucaccaccuuccaccccugcagaagugaaagugacaagaagagccccgcucccuucccuaggcccuccccugugcugcaugggaugcacuugggagcuauauguguccagguguguuagacagagggacucacacuguaugucuguuagugucucuguugaggcgcugcgcugggggcacugaaacaccguguguucauacaggccuggauaagcacuuugggcccagucugggguaucuugguguuucccagcccauguugagcuugucugcccagaacgcucuucuuaguggcugcucuuggcuauguagaauggucugcuugucuauucaagggggcuaguuuccugccccaggcucaucugucaugcaaagugucuauagucugugggcacaaagcuccaaguauggaggugcuuagucuucccaggcuuggugucagcaagcccugaauuggcugaauagugccgggggagagcacaaggaagggccauccugggcuagauuccaggcauuaucuccuccuguauugugcuggccuggggcccaggccuacagcuguguguugaguccuggcuuucauugcugugacagauuuauuuuuuacugaagaauaggcugugggguaccacagaagucaucuaugcucaggagcaguagaaagcuccagugacuuagaggcugaugcugauccagagcuccucaacuggaacccaggccagugcuagggcgcgcgagccugccuucuggacacugugccuuagguagguaggugccucguaucucccacacucccagccguggcgccugccuaugggaugagccuugcagcccgcauuccccucucuccugcucucacccagacccagccuggggcagcaaguggugccaccaccugcuguggucuagugguguuugacugccagaguaacgcugcacauuggccaucucugaauagcucaaaaaaugggacacaaguuacgugcaggguccccugucucccagacacaccuuucagagacuugagcucuguuucucgugaagcacuggggccuuuucuaggcugcuuuucuuggccugcuaugccuugucauguagggaugucagacuuagguggcagcucuuucucuuucuggcccacugugcuuuuuuuuuuuuuuuuuuaaguugagagguauucaacuguaaaaaagcaugguggggaagggacagaugacucaguaagagugcuuguuauguacacaugaaccugaguucaaauccccagcucccaagcaaaaagccaggcauggucucaccuguaccugaaacccgagugcugguaggaguggagacagaaggauugccagggcuggcuauugaucagccuagcuaaaaaccagugagcucaggggacaggggggagauauccugucucagagaagcaagauggagaguuuugaaggauagcucaaauccuccucuggccucuacauguuugcccauagucaagcacacaccugaguguggugcacauguaugcacacacguacacacauguggauacgcacauauacugugcacagcugggacaggaggugggcaggcugucccagccuucuccuuccuccacggugacaugcagggccuccguccuggacuagcuguguaaggcuguguuuauuccucauuauauuuucaguuaccugggcagguccuuaaaccugucuagucuaugccuccaggcuaauucuggauuucucaggcuguguguguguguguguguguguaaucccauguuuucacaucuccauguucauuuuuaccuuuguagcagcuaagugucuuuuccucaucucccaagugacauccaaacaucuguuaguuccucugugaccccuacgucauuaccucaucuguccuuacucuuaaaaaaaggaagaagaaaaggaaacuagcaaauuugcaaaacccggauugcaagagagcaaagccaggaguuaacuccugggaugagugucuucuggaggugaacuugagcccagcaucuuuagccccuugugugugguuucagagugaaccugcuugggcacaggggacaggagcaucuaggcucuccacccuugacauuccgcauguuuuacugcuggcuucuguuccuucucuacugccauuuuggucccagugccuucuuuuagacaucccuguaaggugacaggccauggaucugucucuggaugucccggccacugaacagcuuuuccaauuuguccagaaagugggggcauacaacagaguaguugcuaaucacgcugacuccgaguucaaauccuacuacaaauccauuugugacacugaacaaguuuguuagucuuuugaagccucaguuuucucacuugugaaauggguucccuuggccuuccuuguggaaaugguugugaagauuaacuagggucaggcaugucacaggcacugugcuugacauuuggggagggaucaaaauaggauugcuuauuaauauccuguggcagugcuccagcuuguguuaggaauguagggucuaugagucguuaaguaaccaccugccaccuucucucugcaggguaucaaaaaaccauucacugagguaauccgagccaacauuggggaugcccaugcuaugggccagcagccaaucaccuuccuccgucaggugagccagcccucagcaacaggccucugggggcccugaaguggaguggggggagggggaccagaauuccuaggggauggggaagagaccagaacagcaagcacuagcuagcaucccucaggggugugccacagaaguagcagcccuuucagguaccuggugucccuguuucucucucucaacaauuccccuuccauuguuaucaaaaauaccuuaacacacuuugggguuggucugggauaggacacucccagaaaggcucuucuucaucauuguuaggucugggguccuggcagaagagcuucggugaggguucagguauacauguggacaaagagaugcaagcacaggggggugggggcagguagcccggggugaaaauauagccccaagggagccccuggguuugaguguuggaucugcugcugaccgacuaguggccuugugcauguggaaauccucagggugccuuggagggcagauggaggucagccuccagcccagcaaaaaguggagguuauggcagccacagccaccuacucgcauugccucuaggguaaugcagcucccucccagggacucuaagugaugguggugucaggcuuuaugucugaauaucaauggcaaaauguugcuugggggcuggagagauggcuuagcgguuaagagcacugacuacucuucugaagguccugaguucaaaucccagcaaccacaugguggcucacaaccauccguaacaagauccaacucccucuucuggagugucugaagauagcuacaguguacuuacauauaauaaauaaauaaaucuuuaaaaaaauguugcuugggcugacaguacaggaucagcaggcaagagauaggaaaagcuugguaggaaaauaccacuggguagccugaagugagguaggagacagagcagcgauaggaagcuuuuuccuguagaaggacugggccuguuucugaccaaaauaacaguccuauauguguaagguccacaggcuagggcagguaacagacuuugggaguggacagcuuuguccccuuuucccaacccgugucaccaccuucagaagggguacaaaguggggcuucccucaccuuggggcagagggcuuauuggagccagaaggcuccagucacacccccugcaaaacaggaggacaugcaacagggucugagggauacccugcaaucauugcugaguuucagaagacuggagauguguguguuaggguccagcauguggaacugggggacaaacaguaccucugccagaggagaggcaggaagaaggccaagguccuugauuguaagcaggaguguggaucuggucuuggguggcgaguagguuccccaggucacuugccucuacaggcuguaaaggacucauccccaaagccaacccagccccggggccacaguuguccuaacuuguccugcauggugucagcugcucgaagccaucaucugucucucugaucuucauaaugccccugggagagggggaggcuagguuagugcucauuauacagaggaggaaaagccaagaagcugguuugucaccugacugguaucagagaugugaccgguucuucccuuuaguaagccuggcguggucccucagcugccagcuuuaaacaggugugcgugguuuuacuggcaccuagucacacaaagccuuaagcuaauccucucaguuuucauguguugggugauuuuguguuacagggaggaaaagccguuccggcuuucagaucuggggauuaguccaaaggaagacaaggaggaggaggucucaggcuaugugucuucaggggucuuacaaccuuguuccugucagcaaggguuugcuucccacuguggcuuggccccuugccuaagagacccucucguucuuaugauccuggacguuuggguccaguguuuguagaugagugggaaccagggcaguggcgaacccucauguucuaccaugacuucuccuuuggcuccccacucuugggccaggccaugguuguguugccucucauccaucaaauucucuccugcugcugagagccagcaucuugcucuuugguacccugagcuccuucugcccagcccucauggagaggcugugacgcaguguuugggguuguuuucuucucacuuuaccuugcucgguguccugagugcuuggguaccauauuguaaacucaacuguaccgucuuucuauaggugauggcacucugcaccuacccaaaccuacuaaacagccccagcuucccagaagacgcuaagaaacgagcgcggcggauccugcaggcuugugguggaaacagcuugggugaggcacagcuugcaaggcccucgaggaugugaagugaauguggguuccaaugggucugggccuaucagcaaacacgugacuguugaguguguggaagguggcugauguucagaguguguacagaugcauacucaccuucccguguaccgaggcagugaucgaucaugccaucuuuuggugagucagguacuuaaguauaaguaccuccauccuucugaauucaggcuuguuuaggccagcaaagguuuaguucagugaccaucaggaggcuaaauagaaugucaguucccagcguugcucaaguuucuugugucuguggcauugucugaggauaggaagcauccggacucucucugucuuuuucuccaguuuaauuguucccauuaccccuccacuccgcuguuuuccuuccacccugccucuguuccuccugguagaaagcccaggcccagggccagcgguuugccuccugauagagcaccagguaccucaggcuccauagaagagaguccugggacuugacccccuguggaugugaaaaugguauuuuuccucccuacccugcuugaaauccaacucuuggccucuagcucuuuguucucaucucauuuucuuuccuguuuaucuccucugcucuuuccccagugccuguacagcuuucuuaaagcuuucuuaggaugugugcccugauauucugagguccagagccaagagugagauagauauuuuuuucugaauugcuuugucagcccuuuggucucugccucccuccauguucccuccccacuuuucugcucugucccuuacugugggcucugugcuuaugugcuggccguggugucuccaucagcgcucuugguuugggcacggugguaucucuguuaggaaagggccgguguccccugcuucccugccugacagccugagcucuagaccauaggcuggcagggagcagcguguguggcagggcauuucuuccccuguacccuccacccagcacagaggauaaauguguuucucagagacccaguagcccugagauuuccagaagcucuggggaggcagggggagggagcuggcuuuauguguaucuacugugaguggggagggaauggccuuugaccuuuguccugcccacuaaaucucaucuauugauuuuugucccucuuugucagcuagagcuaggggguaggugggaggccaugccuauggaagggcgcucuaggggugucauagcagaccaagaaaccauaaggauuuuguggucuaccgggcccugucccaggaacucgugagugcagaugagggcagugcauucugagccuucuucucaucuuuaaacgaggauguguuuucucuccaccuccugcccuuguaagaaaggcuagugugucugcuagcacuucauguuaggugacaguacaaccaggcccugcccacugcaaggaacaucccucuuaagcauggaugcugaggucucacugucugacugagccucaggccacccaaaguguuucccgccauaggaggaacaggaaguggaaugugucuguguucucuggaagcaugcugaccuaagugccaauuauugaauauguauauggaggguuuuaaauuuuuuuuuuguuuuuuuguuuuucgagacaggguuucucuguauagcccuggcuguccuagaacucacuuuguagaccaggcuggccucaaacucagaaauccgccugccucugccucccaagugcugggauuaaaggcuugagccaccaccgcccagcggguuuuuaaauuuuuaagcauuuuaauuuaauuuuauuuuauguauauggucauuuugccugcauauaugucuuuacaccacuuacauaccuuguaucuguagcaaugagaacacuggaucccuuggaacuagaguuacaaacaguuguagccaccauguggguguugggaguuaaacccagguccucuggaagaacagucaguguucuuaaccgcugagccaucucuccaguucauuuauaauuuuuuaaaaaauuuuauguauguguuuuugccugcuuuaucugugugugucccagcugugugcagugcccacugaauuagaagacaaugucaaauccuccugaaacuggaguuacaggacgcaguaagccacaccugugcagagggugaaucugggaccuccgcaaggacggcagguccucuuaacugcugagcugucuuaaaguucacccaugcuuuccucaugaccuuuaagauuguuuuuccuuagccaggcauggugacuugcccuuuaacuccagcagucagggggcagaggcaggcagaucugaugaauuugagucuagccagagcuacauagagacccucucuuuaaaaaaaaaaaauguuucuuacuaaugcucucuuuauuguccaucugacaagcaauucaguccuuauguuguguccuggauacgaaauauccaggugggagcugugggaguugucuuaccccacucaagacacagcuuagagcaggcgcucuuccccacacugagggacacaaguggcugagaggaauggcgccucugugcucauggaguguccuuccacuuuugagagaagcaaacaguaacaauaaucgggcuggagagaaggugcagccguuaggagccugucuugcuuuccagaggacuggaguugaguuccgagcacccacguaggacuacucacaacugccuuuaacuccugccccuggagggugucuagugcuucuggcuucugcaggcgcuuccacucacgugcauacacccacacacauauacuuacacacacacauaauucuuuuaaaagugacuccuaaggauuuuauaugugugugucguuuggagcuuucaugacuuaccagauaagaggcagagagcuagaggacuauguauagagagagaugaagagaacagacuggagcuugguaugguggagcacaccuuuaaucucagugcucagaaggcagaggcagacagaucugaguuugaacucagccaggucuacauagcgaguuccaggccagccagggcgauauacagagacccugucucacaaaaccugacaauaaugaccaaagguugacagccaggcucgagagggggugagugcaagagagcuugcagaugcccaccagaggggggcagcacagcgugggcuucaggacugggugugagccaacaaaagguggggcugggcuauucaggcuggcuagggaacuugguacuuuagaaaccaaggcucaauauauagaagaugcucaguaaacccugggugggaggauguguggguggauggaugagcccaaauaaguagguaagcaucuugccauagcccagaggaguaagaaagaggccccaccuuaguguucaccgccaucuuuauccgcaguugacuacauggcuaucacacuuacucuauugaacaucuugccucuaauccucaucuugcuugucgucucacaggaucuuacagugcuagccaaggcguuaacuguauccgugaagauguggcagccuuuaucaccaggagagauggugugccugcagacccagacaacauuuaccugacuacuggagcuagcgacgguauuucuguaugugcaaaaguggccuuguuuguuuguuuguuuuucaugacaggguuucucuacguaguccuggaacucucuuuguagaccaggcuggucucaaacucacagagggcugggacuaaaggcauaagccacccauuuguauacccaguguucacuuaggugaugaacaaccuugcaaguuaggaccaagugcuaggcaggcgggauauaggcucgguagauagagcaggccacccucuaguacuccugucccaguagcuucuagucccugauaguuugcauggcccuggguacaacuguagcaucaguuuccuucagaggcucuggcagcaggcccugcugccggggagcuauaggaucccugagguugcuugcuggccucuuuguugcucagcacaugcuguguucuuccuuugcugcucggucucugcuuacaagccggugucaugacagacuagcauuaacacacauacauaaaggucaccccccgaguguucaguuucuguucuguagugaaaaggacauauacuauaacagcagcaggagccauaaaggcccucggaaaaagaccuaaagaugcagcaauguauggggcgggggggggggcgcggaggcaggggaggaagugcuuucuaagccaaagaucaguguaugcaaagaucuugaucuggaaagaggcccaguguuuuagaaaugagucucagguaggugagcucacacagugggggauaguuacccaaaaaagggccagggaagcaaguccuggcuaaguucuguaggguccuagaagccacgcucaggauuuaaaucagaacauuggcacuucaguaaaggaagggaguccacacgauuuaaucaacaugcagcucaacuuuggccuggccagaaagagccaaguaacaguaacugauggagcgcuuaggagaugaggagccgagcagcagcagcauggggcacguggacuagaaucagugguuccguggcugaagagucugcuguggcgugggccacguggacuagaaucagugguuccguggcugaagagucugcuguggcguggggcauguagacuggaaucagugguuacauggcuugagacucuauuguggcacgggguggguggacuagaaucagugguuccgaggccgaagacucuucuguggcauggggcauguggacuagaaucaguggcuguguggcugaagagucugcuguggcuuuggugaggugggcuagaaacaguggcugaagucugaaaguguaggcuuguggaggguuuuuauuuguuggcugguucuguuuauuccucaaugcugaggaucaaaccugguucuuaggauggggcaagugcuucgcuuacuuagcugugcaccccccauucacuuuuggcauauuucucuuaggcucuagcccucugcuaagcaccauuaacuugugcauucuuccuaugagcugagcagugguugcuauuaucuuuucuaucuuauaggggcucuuugucuccucacaggcucuuguuuuggaguugaguguguguuucccagagccuugcaaguagauaaugcauuaaucuccuacuugagcccaugaggaaguaggccccgagacaguaagugcgcaucauacuguucagucuggcgggagucucgcaucacggaacugaaccucagaugaacccugugcauauggaaaauggaagcucucccagcagacgguuuuagcuugcugacuccgagaaccauugccauuuucaccaacaccucacacgaccccacgguuucuuuucuucuuuaagauuuauuuauuuuauguauaugaguacacuguagcugucuucagacacaccagaagagggcaucagauccuauuacugauuguuaugagccaccaugcgguugcugggaauugaacucagggccucuggaagagcagucagugcucuuagccacugagccaucucuccagccccuaugguuuauuuucuuaagaaauauauaaauauuuaccccacuuugcuuaaaaauggguggaaguaccuaucaccugguagcugguggcaccauuucaccagucuccuauguaggagucuuaggugugggccaacugaugauuauauugauaaaguugaguuuaaaugagaauaccagggugaggcaugaauaauucuagggcaggaccagcuuggaaacuguuuuagaaaguguuugcuuguuugggugucuugagacacggucucacaauguagcccaggcuggccucaaacucauuauggcccugccucagcuacccaagcccugggauuaugcauguauugcugcauaccugucacguguccaguccucacuacaugccaugcauuagaucaagaacuuuaagacagucuauguuucguacugcccacagcagcccucauguuccuguuaaggaaacagaaucagggagcugcaguaaccuugauaggcuugcacuggaggcugcagcuagacagccggggcugcagcucaucuggcuugucugcccauugccucuugaaggaugagagaagcagcaggaacccuauagauuaacugugggucucaaccucuuuggggaauguugacugacccuuucacagaggucaccuaagaccacuggaaaacagauauuuacauacgauucauaacagcagcaagauuacaguucugaaguagcaauaaaaauaacuguaggguugggggucaccacaagaugaggaauuacauuaaaggguuguagcguucagaagguugagaacugcugcuguagauuuugcuuguuguugcagacaauccugaagcuccuggucuccggugguggcaagucacggaccggcgugaugauucccaucccccaguaucccuuguacuccgcggucaucucugagcucgacgcggugcaggucaacuacuaucuggaugaagagaacugcugggcuuugaauguggacgagcuccggcgggcauugcggcaagccaaagaccacugugacccuaaaguucucugcauuaucaaccccggaaaccccacaggucuguacuugacucucuggccacguucuuaggggcuuggaguggcuggugugccagacacuugacuacucaaaaauuaaguuacgcaagguuuucucuguuccaguuucccaguucucuccagauuugcuaacagcugugagccucgccccaggccaccucaggagaugagaggcugguaucuuuuuuuuuuucaguuuuuguuuugagcaggguuuuuauuccugacaggaccuguucuuuuucauauuuuacauccaauuguaaagacucaucuccuugagguuauucacacagacuaucaccacucagucuaagguuguuuugaugcuaaguuccucuuguuucucagcuggauucagaaugcugguauaugaaguuuggcuuuuccuuugagaggaaaauucaauauuaaaaaaaaaagagcaagcaacaacaaaaaagccuguuucuagacauugaaaagcacucaaauuuuguauauuucuuuuaaaaaagaaaaaaaaaaaggauccaucccugccuguugugacucccaagcugcuggcucgugugucuccagggcucuuuggaucagagagcaagcacuccuuucuccuuuguugagcuaaauugaauugaggccagaauacauuagaguugauuguggaaucugcugcucugagaugugaaaugaugcugcagucugcugaaaacaagcacuuuaauuccugcgugcaggcagagguguaacuggugcaaacacuggugugugugcucccgugccuugguaggggaauggaguucuacccacgauguacuucagggaaaugacacagaguuguauucucaauugugcuucuaggccagcaucacaaagcgagcuuugagaaccucucagaccaguccagacagcagucuuuacagcugaggagaaccacuuccuuaggacugugguuccuaaacuuuuaaagcuuguuaaagugaaaacuauagacugugcucacugacacuuuaaugacugggcuagggcuggagaauuggcaggucuacucaguccaagaugacacuugugcugaucccagggccacacuuggaacagcaaguccggcagcauuuguaugcugagucggcuguugagucaguacuuuuuuguuugcgucuuuggagacugcguuccugucuggucacauacuugcucugucaucugggcaggccucagacucagagcagcccuucuccaggcucugagugcugggacuacaggugauugccucuggcuugucuuuuaagucaggauuuuuuacucaggcauuuaucuaaaucuuuuuacuuagcugccuuggagaacauaccuccuguucuaaguaaagagauccugugacuguauauuacuauaaguaauauucucucucccucccucucucucucucucucucucucucucucucugucucucucucuuucucucucugucucucugagacuaggucuuacuauauagcucugacuguccuggaacuuacuaugcagaccaggcuggccuugaacucacagacaucugcuucacugccucccaagugcuggaacuaaagucaugcaucaccaugucuggccucaugagucauccuuaugagauuaacuuuuaagugggcaaccaucuuuccuugcuuucuggggucuuaaugcauggaaaucagucagcugcuaaaagagggugggugauaggaaauggaaacuuuccaaccacauaccauagccagcuugguuaaaagaugccaaagagacuugagauguuaagccagggugcuucugguuucaagacgaaaauccaacucaaaacugaaagaccguaugguggagcuguggagcccgggcauaaagcaguaaccugaaucaacauuauuguguuugcuucucagcuccgcuguccucugaguuggguuccuucuuagaaucuguccuuggagggccucagcaacuccagccauugcucaucagaugaaaccuuagaacacaucuucugugaucucacugagagccguagcccaggagcucacugacucugggcuacggacucugauaagacagcucuuuuacuuauucacuuagaagcccuccuuaggcuggccucgaacuugcaacccuccugcuucagcauagcaaaugcuuguguuagagguguaugucauuacaccuggagguugggccagggcuauuccucuuaucuccugcugggguguccucauaggacaucugugguauguuauaggagagaggaaguguaaucacagauguuucugucaguuuauagggaauuccuuuugcccaucuucugguuuggcccuuaggcacuuccuuccagcuuucuggaccuguaucaaagcugugucuuaugucuccucaaacaggguguaaccugaccccuguaaagccauauaugacuuucucuuauucucucaacuguucauguuugucucuuuggugucuucaugugcagugauugcugagucccaagcccuggguaagcauaaauuugucuuuauuuucaagugugcguuguguguagcaguggaauucuuauaucuuucccaucccuuuuccucuaccagucugaagccuuuucaagagucuggcccuucaguuccucuuuguguuccccuuugcauuuugugaacauguuuugguauauucuagugcucacaucucugcuuguauuccauucggauauaguuaggagaucacaagaccccacuaaggguuugcaggcugcaucuacccacaaacuggucagccccugucugcaggaguagugcugguuccauguagaaaucauucuguagauaaauauauauacauuuuuuucuuuuuagccacaagguaacauucuacaugcuuuucuccauuaugucuacacaugcagaaauuauucauguguauagaucuauauuugugcauauauguguaacauacauauaugcuguacacacaauaaagaaaucagcaagcccgacugagcuuccuggucuuacucaaagccagaggaaaacucggggaaaguuccacucccaccuucuuacccuucgcucucugacccaguggugagccugcaggcugcugaccuagugucuugcuguuugaagccacucucugacauggguagugggugugucuucccugugguguugaggcacguccugaggaagccaagaacagcaguguguucucucagugugcagaagcagcuggccggaggcaccagccuggcucauucauucgguguucugcaagcacugauuugcgcacucaggguagaugcugagcuaggauuagcuugucacuuccuugugggcgugugcaucugccuuucucggaagacacccacagcuuuucuucaguaacuccaguucaguuaccaucucaaccaguccaguuugcuucauugcuugcugcuggcgcgcaguccaggagcguuagggaccugaugaacuccacuccgucaguguuaguuccugcuugcugugacacucccaugccuuccuguccuccagagaagacacacauccugcacacaugugcacauggcagccagaugugaaaggccauuccuuccccgugucugacuucauugcguuggucaggaguggagccuguagccaugacuggagcuuggcuuugcugccuugcccaggagguaggaggguggucucuugggaucuucagggaacuuaggacacccaagugauuugggugggaguauuauuuggggacaacuuacauagcauuacaaccuacauuuugguuuucuuggggauuuuguaggccagguacaaagcagaaagugcauagaagaugugauucacuuugccugggaagagaagcuuuuucuccuggcugaugagguaagagcagucccgagauugguggggacauucagagagggagggggcaagcccucuuguauagggggaauuguuauuauucaggucugaugguucuagagccauagagaacguccuaggcagaaugauucugggcaagcaaaggugaggauguucauucuuauccuaugaacuugggacauaaauuaucucucugucgguucggacucuaguuguauuguacacacacacacacacacacacacacauucucuguauauaugggagacugagaauucacuggguaacccaggcuacccuaaacuuacuguauaguuuaggcuggcuuuagauucacagcaguccuccugcuuuagucucacaguguugagacuacagaauuuuaacagauuauuuuaaacuuggaggaggagaugaugaugaugaugaugaugaugaugaugauauauauaugguuggagccuggacucaaacugugucuuccagauccuucuccuuucaucucuguauguugacuaucuucccagccuugaaagcagcuuuucacccuuguaauuccagcaaguuuacaccugauugguucaacuugagccauaauuauugggccaaccacuguagccugggguugcaaugugcaaauuggccaggcccaggccaggugcgaguucucugcccuucccaaacuuccaccuggaaagccagggggccucccugaaggaaaugcaggggcuccuaccuaagagggguguguguggggguagcugcccuguaggggaagaggcugaagccacuccuaaggcacaguucccugccucuugguggucccugccuuccuucucauuuacucuccagcacuuugugagccugggaggaugucaggucuguaacuguaacuucucgaaugccaaucacgaggccugggcuucccguucuuugugugauuuggaggaaacugagaguccgucguagccauugacgcuuucccuucauuucagcauguuuauugucuccuuucucuuuaagcacccugcuccguuaccacauuuaauuugccauaaguaaucaucgaucuaaaaaccuuacuuucuaaagauaaagaaagaggcaucagugagaccuggggauucccucuggaagugugcugacugggaggagggcaggcuucugacugccccacugacgcagccagccagcuucccugaguguggaauaggcgggguggcugugagugcuagauccagagacagggaagugcgggggugugcucuggcaaaaagagcagagacaaaccuggcaaguggcauaaaggacaucccacagaguucaccccagaacagagggcaggggacaggaagcugcucccacucauagaagaaugaacaacgcuuuaggagaacauuugcuggggaggauggaagucccuggugucaccacuggccugaugcaucagacaggcaggcuagaaauggguaaauguagaagucaggggagcuccugggcugucuuaggauccagucugaggcuuguucuggaauguuccuucaggcacauucugacuuauguguggaaauagcaucggaaguggggcuggcuggcuuguucaaagcuggauuuuguggccuucaccugacaacagguuaacuccguaccuaugcaccucuccuggguguagaccguuggcuacucugagccacagccuuccagaaggacucauggcgacugucauguuuccccugcagguguaccaggacaacguguacucuccagacugcagauuccacucguuuaagaaagugcuuuaccagauggggcacgaguacuccagcaacguggagcucgccuccuuccacuccaccuccaagggcuacaugggcgaguaugucugccgcuucuccucucugccacgggcgggucuguggucccagugcuuacacucuccuuucugccugcugcucuacuugugguccacccacaugguuagaaagcagccuucaucacuugccgcugguguaagaaucaggagacagacuguaucucucuggcaaaucuagugguauaagagccaucccuguacagaggcuccagggaaaugcagccaggcucaaaagaaaccagacuguggauaagugaugggaaugaaaacaggucccguagcagcucugagucuggaaucuucugcucuaacguugccugaagucugaagguccaugaagagaggaguuagauggauagguaccaagcucugugugcaagacugccuuagcacuggggugguuauaagaccgauauuuggggcccauauuugugacuaguguuuacugagcacuuacccugagaucgaggcacugaggacucugccgucacaaagccaguguguuaccaaggagugaagaacaaggcagagaggaaagcuaugcagccgguggagaacugaagucagagaagagguaggacugccagaaggugggacuggaguaggaagggagacauuugggggaacauucuaggucgaaggaauagcauaugaagccugaagaaauguuuugguagccaggcgugguggcacacgccuuuaaucccagcacucgggaggcagaggcaggcagauuucugaguuccaggccaaccuggucuacaaagugaguuccaggacagccagggcuacacagagaaacccugucuaaaacaaacaaacaaacaaacauaaaacaaaaaaacaaacaaaaaagagaaauguuuugguuaggucaagggagccaccuccuuacauuguuuuugguuuaauuugauguagauuaaguguauaugaguuagguuucagggaaagcagcucuaacagaauagcccaaaaguauagagguucagaaagggugacaauguauuuuuuuuggacauaguuguucagagaucccaggaaggcagaaaggcagagccggcuccuugaggugguuuaagaacgguggcuugugagucugcuucuucaacauguaguaaccacccgucagacgagaagggagaaaaggaaagagaguucuugcuucucccuguaagagagugacuuguagugacauguucaccuaacacuggccagaacucagccacagcugccugcuggguauggaggguguggcguuagagaucugguguccaaccugcguuuaugagggcuucuucuaacuggcggugggcuccucccucucgucucuccagguguggcuacagagggggcuacauggaggugaucaauuugcaccccgagaucaaaggccagcuggugaagcuacucucgguucgccucuguccgccagugucaggacaggccgccauggacauuguugugaauccaccggaaccaggagaggaguccuuugagcaauucagcaggguaagucagcuugaccuguguccaucacugcuauugccagggucaugguaagugagcagccaccacuccauguggcccugcaucugauggugugucuggguguguccacccgcagccaucuuucaagggggcacccuaaugucucuugguuguugaaccacucucaugaguuaagucuaaagauguaacagagaugcaacaguuuggaagugggaagacuuccugugugagucaauggacuuuucuuuuucucugugagcaucguaaaagucaguucccagaugugccccaccccccuuuggagaggcguguguagggggagguuggcuuguuuguuuuuuuugacacaggguuuugcagccaaaccauuuuuuaagucaagauccuccugcuucagccuccuaaaggcuaggauuauaggcguaccuacagcacucccuucuccucgacaggacucccuccuccuccucuuuuuuguaguaaaauacaaacaacugaacuuuuuucucguuuuaaauauacacuucuauccugcuguaguaaauaccuuuaaucccagcacucaagaggcagaggcaggagaaccucugugaguucaaggccagccugguuuauauaguaaguucuaugacagccagggcuauucagaaagacccugucuaaacagacagauggacagauagacaguucuuuuuuuuuuuuuucuuuuuagagauuuauuuauuuaucuauuuauuuauuuauuuauuuauuuuuguguaugaguacacuguagucuguuuucagacacaccagaagaggguaucagaucccauuacagaugguugugagccaccaugugguugcugagaauugaacucaggaccucuggaagagcaguuagugcucuuaaccgcugagccaucucuccagccccagacaggcaguucuguuucauuaaggaaagccacucagaugguugugcagcccucucucaucccauccauuucaagaacuuuuauccccacuugacacaugagaccuaguaaacacauagucuccacucucccauuccccgguucuuggcagccagcauucuacucuguccccaugaauucccuaagacacauauguauagguggaauuacacaauguguguucuugugugacuggcauauuccacucggcacaguguccuccagguuaucccuguggaggccugcccagaacagcagaggucucuuugggauugaaggcuggggcguaugucacuguguggcugcaccacgcuuuguuuaucuucucauccucagcucucaucuuaguuucccuccuguacaacagaacuuacaggaauucugauugauucucuuccagcuuuggaugcuuguccagcucugggacuguugccgacucugcucugccugagucuccauccguguacaccucacugacggagaguacaaagggauaaucccuagaugacaugauggggcugguccccagggacacucgugacucucagagaaguguuucuaggguauucuacccagggccagggccauucacacugauggaugaaaaaaaaaucuauguagaaagaccgguccaugugucuaugccuaccuucuuccccuagccauguacaguguuuguuacaugcagcuuacuuucugucaaucuguucacauagccuugucuagaaucacugauaccugugcuuuuugucaucauuaggaaaaagaauucguccuugguaaucuggccaaaaaagcaaagcugacagaagaucuguuuaaccaagucccagggauccagugcaaccccuugcaaggagcuauguaugcguucccucggauucucaucccugccaaggccguggaggcagcucaggucagagcggagggcuggcuggcuuccuggauucacuugagcugucucugacaugguuggcuuuuugcuuuggugagccauggugcugaccuuaggaguucugaacucuguguccuccuggacaaacgcaguuuaccaugcaauagcuucuuaagagucccggcugcagcagaguauggugguaauagagcaaguaagaggcuaaccccaagugagaguccagguugagccuccacgguguacucucaggguggaggcauagcuuagcuguuaagacacuugcugcuugcagaugaugagccuggccuucagcaccuacaugguuucacucacagccuucacaacuccagcucuagggcguuagagaucuagggcauuagccacgcccucauccuauuuccaaagacaccaagcaugcauguaggacccaggcauacaagcagacgagacacucauacacaugaaauaaauacaucuaaaaaccacuaaaacagcaaggcauacugacucugaagggcaggacccaagaagagugugauacugguguuggagaagcaaugagaguccucaccucccccagccauugccuccugccacagugacuccugaguguucacgauagaagccuuggguuuggcuuaaugagucuucaauggagcugagagccugcucuuccaaguccucguaugcuauugcagaccaugcucugaagcucaagggaaaguaaugugugcaucccuggagugccugagcaccuuguuagacacuggguauccaggcccacccgagaucagaccccgccugccagagcccgagacuucccgagaaauuguuguauaacccacacuguuugauguugguuucauugcugugaccaaacaccugacaagguagaaagucagagaaaagagaugucuuuggcucccuacguuaugguuauggcccucuggugggaaggcaugagucaugugaugaugaggcagaagcacacggcuccuugcucaucucugggugaggaugcagaagcagaggaaggggaagccauugcagguuuucuuucuccuaccccaaccgacgggcacauccuccacauuuccucugcaaaugccuucaggcacguguucagaagugugcucccuaaagcccgaggcuuuucuaauccuaucggcuuucguagccuuccucagcacugucagcgguugcucccggguguaucuccugcaaggcccugcuggauuuagaucccagggcgccguuuucagaucauuugugugacuuggcacauagauagccaucugcagccagugccuguugaacaguugcugggauggggaugggaauacuggaacccuugaaugcagaucaggggugucacagccccugccuggccaacaguagcuucagaugucugagucccagaaccagcuuccuggcugugaccuggaauccugcuuuacuuugccaucaggaaagggagaaggaggggucugccacagaaaagaggcacugacacugcauuuugguucuaucuggcuuugagcccuucacgccaagugaagacuuauauuuauagcccaggugagaccccacuguguagcucaggcuggcccugaauucaaggcauguuuuuuguuuaagcuucucaagggcuaugauuauagguguaaaccaaaaccagcucuguuuggguuuggguuuuuaaugugugcaggucucguguacagccaggcaugacucucaaguucuguccucuucccacagucccauaaaauggcuccagacauguucuacugcaugaagcuccuggaggagacuggcaucugugucgugccuggcaguggcuuugggcagcgagaaggcacuuaccacuucaggugugacacuuucuuuugggggugguugguguuggucccuugaguucuugcuuuagagacugcagggucugagccucucuucuccuugagugacucucaucauggcaggcucagacccucugucacuacauaaggaaaugggggugcuuuacagccccucuaagucuuccuggacugucccgccucucggcugcuuccugccccugccacccucuaugcuucugaaugcccagggcaaagccagugccuuaguuagauuucuguugccaucauagagagcuuuucaaaagcaacguagaaggaaggaaaguguuuauuugacuuguggguuaaggucuaugcucagggaaaagccagggcaggaaccugaaggcaggaccugagacagagcacaggggaacguugcuuacuggcuugcuuuccauggcuugcucagccugcuuucguauguaauccaggacaucuguccaggggaggcaccacccaugguggccuggguccuuccacaucaaucauuaaucaagaaaaagccuccacaaacuuuuauauuuuauaggcuaaucaaauggacggaguuaguuucuugggagaaauucuucccagauaaaucuaguuugugucaauuugacagaaaucccaaccaggacagccuggcacagaacagguguagcuccuuggcugcacuauaggccaugacacuauccugggccccaaagccucuuaagguacuacacugagacagaauucgguccacaaaccgagaggcuguuuacagccaugccuuguccagcucuguacagauggauacauggauucccagaguuguuaggcaaauguuccucacagaggccaacucugaucauaacacaguuauuucuucacagcuccugcagcagugucucuuguagcagaugcuaaaaaaagaauugucaugaguugcugacgucuagagccaagucuuugaacagucaaagauaugggcuguguccucagauggacuaacugccuaccuggcccuuuuauccuuggucagguucucugcugcgauccacgguccaucugaaacagagagcugggguggcaggguagcccagugguagaucguacgcaagugugaggucccaguguccgugcccaucacgucaccaagagugugauugaggugggaacaguguugucaggacuggagagagagguuacuuuugugggaacugaaaaugucuuugaagugaaaccugugauuugagauuggcuuacugucagcaacugaauacugggacacacccauaugucucagcacacacacacauacacacacacacacacacacacacacacacacacacacacaugggggcgggauucaauuucugaaagaaaggcuaagaguuguguucuaggauuagaauauaguuugaccacuugucuagcauguaugaagcccuaaauucaaucccuaacaccacaaaacaggaagaaaaaaaaagucauguucuagaaaggucucuguacuagucagaauguguuccuggagccauaugugguggggcaugccuguaaugcaaucacuuuaagaagcugaggcagaaggauuacugucaccucaaggccagccugagcaucagggugaguuccagaucagcuagugucauaugaaaaccuguuuuauaaaagaggaaggaaagaggaggaaaaaaggggccgaggaaggcagaucucuguaauuucaaagccaaucugguuuacauagcaaguucuaggacagcuggggcuacguagagaaaccccgucuuaaaauaaauauacagccgggcguggugacgcaugccuuuaaccccagcacuugggaggcagaggcagguggauuucugaguucgagcccagccuggucuacagagugaguuccaggacagccaagacuacacagggaaacccugucuugaaaaaucaaaauaaauaaauaaauauacaaacaacaacagcaacaaccauggugccgccuucugcgguaaugaagaauacauuuuggugacucagaaucugguuuauugcuuuccgggucugacuguaguagaaaugccuguguauaaacacuggcauucuauguugggugguguuggguucauccugugaacagccaggcugauauuguucgccuuccugacagaaugaccauucucccuccgguggauaaacugaagaccgugcuccacaaggugaaagacuuucaccugaaguuccuggagcaguacucaugaggacgccucaggcaccggagccagacccucccaagaccacccaggccuuccucaaggacucugccucagaccucagacaggccaccaacgcuguucaucuucauuuccccaaggagacuucuuucuuugugccuugauguuugagaguucuucgagcaaacagugguuuugcaaugucucacaggcccuguuuuuguuuuuguuuuuguuuuguuuuguuuuguucuuuuuuuaaaugcaaccaaaguagagucaaccugcucggcagauguacuuggauucucugaaucgcuauucuguuuggagaguuccuuugggucuuaagcagccagaguacauggaaaugagauuaugucagaucuggagaaacaagcagguguugggaaauaugugacuugacaugauaagggcugggaauccagaaaucaauagugagauccaugaaaucaaacccugaccagugugaaaauguagccuuuuggacaguaagccugcaagucuagugagaacucagagaaagcugaccauucuggucugaagauaggcagcgcaucacaggcaagaauaucgaagucaguaguaggacaggggucacaucagauaccagcucaaauugcacuagcuaucuagaacaguuuucuccagguuugccugagccuugaugcauaccaucgcccucugcuggucgcagcagagauaagcaagggcugaaaauggaggcaauccuuucccaaggcccugaaaguuguuuuucaugguuucaaacugaauuuggcucauuuguaacuaacugaucacggugccugguuacacuggcugccaagaaggagcgcaugcaaucugauucagugcucucuucacaucaguuuccugccucccucccucaucugcggacagcauccuaucucaucaggcuucccugugugucacaaaguagcagccaccaagcaaauauauuccuugaauuagcacaccugggugggccaugugcgcaccaaggaaacaggugcuauagggagcgccaggccaggcuugucucuuaacugucucguucuucagugagagugggaaagcuguccggagcucccgcgcaggagccuggguacccacgcagcgagucaagggaguuuucggagccagagagagaaagaugugaaggcuguggaguaaggcugaaaccagccuccugcccuauagucccacacugcagggggugcgacuuuaaaacagaacuucaaguuguuaacacucacaagcauugcauuacugugaaggaaguagccgcauccauaacaggaugugauggucuacagcuuuuccuuuaaaagcugaaaagguaccaugugugcucgcuaggcauauaauccagauaugcuccagaguucugagauucuuccaugaaagguuaacuagaagcuagaauauuuuuuuauauuuuuguaacaauuggcuuuuuucauggggggaggggaguagaggguuaguauuuauaguccuaacaaguccaaaaauuuuuauaagugucuucagauuauaaauaacccuccaaauuuugcaauguuuacauguuuuuuuuuuaagaugacaaauaugcuugauuugcuuuuuaaauaaaaguuuagcuguucuaagagauuaacuucaaguaggauggcugguuaugauaguuuggauuuucuacagguucuguugccaugccuuuuggguuucagcaucacucgagucgcagcauguggguggggcuguggaaaccuggccaggcuggaccuggucagccacaccucagagacauuguuuccauuuggaugugagcaggcgcaggccugcaugcucuuuccuacuuagcaucaucaguucuuccgccuccuuagcaugguucuuuguaacagccaugcugggaagcucugaacaauaaaauacuuccagaguggugacugagcagcuuggucaauaaaaacuaaaaguugcguggggcugagu

SEQ ID NO: 4612 - RNA, 17756 nt, Mus musculus
aacugguuuuauaaaccuuuauuggaaaggcuacaaaguuuauauuaucacugcauugcuuaggcuuaaaguguuguggggaaguuaccucaaauacaaaacuauuaugugguugaaucuugcccaggcuuguugcaaaauauuuuuuuguacaauggagguagaguggauagggcaguaauuuaacccucacaggucuugauuaguuuugagacauuuuacauccaaguucuaauagcucuagaaauguacucuagugcuauuaggcucagagaugguaugauacauugaaaaaucugaauuuccauuuuuguccuguuguuccuuugacaaauguaaaagauguguaccugguaugacuuggaccucaaagggaaauguuuuaaaaacacccaaggagugacaaagucaucaucagaggauggacacacacccuuucaucaucccaucaggacagcuguaauccaagugaggcgcucaucagagcauggaucaaacugaacccacaggcacugcuggcucggccacucugcaugagaaccucugcuaaccuaagaaucuuaguuuucuacacagaaaaccaaacaguccacgcucacccaaacucagauauucaacuuaaugagacagagcaacuuuucauaacauuuaauuaaaacagcauuuuaacaggucuauguaaacaugguuuaacuacugaccuauuaccuuauuuuuaaaaaauggggugcaagaggaugaggccuggguuugucccgauaugcagguaaucuaggaguuggguaacuuggauguuuuugaugcuacagagcaucaacugaagugaauaaagccuguuucaaccaacauuaguguuauuuaacuauaaaaugggcagguacccaaggcaaaagccucaggcugauggguuuuuagaggcuguuuaaagauucacuccucaguguaaggauacuuuuacaguucaaaauauguucuuucuaaaaaugugacacagaauaauuuacaccaacugcuuuuuauuaucaaguuucagaaaccuuucacaaaaugguuuuaaaaaaaagccaaaaaacuuuacaaccauggcuaauguaauuuuuuuccauuguucccagucagcuucaaacccauugugugcaaagcccauuuuuccaugcaucuaaaugauagauacaggcuaugaauucuuuauucuauuuguagcagcuuaugcaggugcagccaaacacaaagcuucaggacaaauuguacaaacuuuacaaugcuggauuugaguuuaaaauaugaaacauaaagucuacacaaaacugauaaaaaucaagcagauaccaggacugaaacuuauaacccacaugugaaagggagucuuauuucaagugcuuuacucugcuacagaacagucgaaaugaagauguaaagcucugugguuaguuuaaauuauacacucuguggauacgauaccaauuuuagaaguuacacauagaucaacagauguccaucaguccaucuggacuuaucagguacuccagcagcuggcaaauccggcaaauguggaaagaaaacccaccugugcaguggccugcaguuuacugaugggcacacugcacuccagguccaugauggcugcuacuuucuucaucagagcuaucauuauaggcuucacgucucugaccaccgccagagccucgagugcuaucaaauuccugaagcuccacuucuucugucucuccaauaacauuaggaacuucuggucuagauggcaggagaucuucuaauuccuucaugaaacaaaaacaggagauguguacacauacauaugugcacaugugugcacaaaugagcaaacacuuuuggagacaaggccuugcuauguagccaacacucacacaaaauaaauauuuaaacgcuagaaacgucccugcagauauguuccacuguacuucucaacagugcuggcugagggaucugcucuccagagaguucaaagacuucccaguaccucauacucagccauuuauuaucacuuugcuuggcugucccauaaacacuuacaucagccaacauuuuuccaaaaugaccccccccccccaaaaguaaaauaaaauaaaaccaaaccaaacuaggaaaaaaaaaaaaaaucagacaugcaaacauuaaauaaaagccaccauagagacucugucucaaaagagccaggaguggucgaucacaucuauaaucccagcaaucaaaaaacagauagggaguacacauaacugugaguucuaggccagccuggggugcagguggcgggagacccuauaauaaaacaaaaugaagagaaaagaaacacaagcaaaagaagcaaaagaaggaaaugagaggaaaccaaagggagagccacaaaucagcugcuuaaggaacauuaaaaaccagcuuacagaaaguuugucuggguugauccaguuauucucaggaaacuguacaucaaacuuuauguagagaucacccuuuucaaagggauuacgauacuguggcauuccuucaccucgaacaacacgaacacauccuauuauuuuaaaaaaggaaauuagauaagaauuuuacccaagaaagauagucaauaauauuccuuuguuacccacuauaaacacaaauuguaacaaaacccagaaccuggguaagaagaaaucauuuaccugguucaauuacuuugccagggggguauuucaccacaaucugacgagcaucaagauguuuaaaugugaacugaaauccacauaaagcuucaacaaguccuaucuuauaugucauaugcaaaucauucccaucucucuggaacaccuauagacaaaguauauacaaaauauauuaaaauacaaaaacacauuacccugcugagcauuccuuaagucaauuucagaaucuuaccuuuaccauucacuaccagagccaaaaagccacugucccuaauuucaaagcuuuuuauuagcagagcuagcuacucucaaggaauaugccagaaacuauuacaugaucccaaugaggcaagaagggagucuaaaaucaguguuuauaaaaaagcucaaucaauaaggugcagccaggaaaguuaaggacucaauuuugcacuucauacagguacaaagaaauuuuaucuugcuuaaauuucaaacuugggccgggcaugguggcgcacaccuuuaguccuagcacucgggaggcagaggcagguggauuucugaguuccaggccagccuggucuacaaagugaguuccaggacagccagggcuauauagagaaauccugucaccaaaaaccaaaacaaacaaacacaaaccccaccccacccugccccaaaacccccagaacacuucagguccagagccuaauaauuuaucuuggguuaucuuuagucccccaaauuagccacuucccaccaccgugucagaccgaacaucccgugacuuaacaaauaaaacuacuuucuaccaaccccaggguaagaguccucugacaaauacccgaagccgacagcugagauuucuauacuuugcuauaacuaccuacuuucuaccaaugaauuuggaaaaguguccugauuugugacuuuguuugguuacugcuuccaauacuguaacauugauuuuccuguaaccuuaauuugaguuacagguuauggccauucacacuuaacuacagaguaaauucucugaucccuuugaaggagagagcuguauugcaaagguugaguuaagugcugagaauguccugagcuucaaagucugggagaaaaaaagaucaauuucaaaauaauacaacuuguaauuuuuaguuaagaguuugccacaccuauacuuaaauuuugaaacuuaaauugaaguaaaauuaacuguagagaaaaggucaccaaaauuuguucaaaagaaagugugccuggagccagagugguuggucaugccuuuaauuacagcgcucaagagacagcaccugagcucaaagccagccuggucuauagacaugucuuaaaacaaaaacaaaaauaaaaacccaacaaaaaagugucuugguuuuccugaguacuaagugagccagcuuaauuucuacaccaagcuaaucuuugaugucuacaggccacaaauagguuaauagaaacuggcuggaccaaagacaguuaccaaagugacugucagaucauuuaaaucccauuuguaugcuaacuaaccauucaaugccagaagagacaaggcaaccauuaaaggaacauuuaaaaaaaaaaaaaaaaagacagcuaaauuucugggaaaucucugccuauccccaggacacacggagaugccuugcacgcauuagcuucccauuucuucaguggguucucucuucugugagugugcuaugugcagaugugcaugcagagagggcacguagaagccagaagacaacucugguguucugcugucauucucauuaaaccuagauuaggguggugcuauuaagacccagcaaucuuccugucucugucauccacauguggccaugucaacauucuaugugggugcuagaaucugagcuaaggucuucauguuaguccagccagugcuguuauccacugagccagcccuccaguacucucccauuucuuuuuucuuuuuuuugguuuuuugagacaggguuucucuguguagcucuggcuguccuggaacucacucuguagaccaggcuggccucgaacucagaaauccgacugccucugccucccaagugcugggauuaaaggcguugcgccaccaccgcccagcacucucccauuucuuuauuaaccucuagcucuccaaagguuuaagaaguucauuucacacuucuauuuuugacaaagaguucuccauuacucaauucuuucuuacugguuccacaaaucugagauguaaacucugaagaacaauuuuaguugguucauaggacaccugaaaaauuuguucuuuuccuacaugauucuccuaaauuuaucuaugacauuaaaucuccuaaauguggcuuuagaacaucagagguucaauaguaccagaacauuuuugguccagcaacccaguagauuuaguaagcccuucaaggaauucuaacaugaagcucaaguuugcaaguuugagaaccaaagaauguaaagccgggcgugguggcgcacaccuuugaucccagcacucggaaggcagauuucugaguuugaggccagccuggucuacaaagugaguuccaggacagccagggcuauacagagaaacccugucuggaaaaaccuaaaaaaaaaaaaaaaaaaaaaaaaaaaaaaaaaaaaaaaagaaaagaaaaaaagaauguagauuaguuauacacauuuacucaacucagggucucuuguaacaggaucaucagauuuuuaaaaagcagaauguuucaaugcugauuaaaaaaaaucuauauaacaaaaugccaauguuucaauguuuguuaaugcuacaaaaggagcaagaagcaauaccauguucuucuauagaagcacucaacuuaaaaguauuuauaauuaaaaaauuaccaggguaguugcugucaugggggguggggaggcgucuugauaacuugaugcuaacauuuaaacaaauaaugcccaacuucuuccuucucuuucuuuugccagagaacuugugagaagauuaaugaagcacacagauaaacccucagaaguuucaguaguuucugaagcaguuaccgagaaggaacuaacauaaccaaaauccuaugcuuguauuguacagacaccaacacucccagaacaacacgguaggaugaaugcucaggacacagcacucccagagcucauuagcuuuuaucccauuuauaaguuuucagccacugcacacauccaaucucaauuucuucagauagguauuuggaagggaaaaaggcccaaagagacaaagugacaaugcuuuucuugacauauaacacacaacaagcccucccuauguucuaguucaaaguauaaguuugugguuuuauucuuccaagugaagugaguuaaccaagcugucuaaaccucauccuugacuuauacauuuacugcccuagucacaguaaaaccaaaacuaaaacucuuuaacuucuacccuuuacuuuuuucuagucuaggcaaucagcuguugguuggcaauuccaugcacuauuacuacugucaacaauuuaaccucaagugcaacacucagaaugcccuagugauaucuaaacaauaaaccaccguuuacacucuaccgacuuucaaugauguggcuauugaaacaucuagccuuccaccucuuguguccuauaggcauuaugcacaguaauauugaauaaauagguaguaauagcacuugcaaggcagaggcaggcagagcucuugaguucaaguuucaggacagccaagguuagggagaauugucuugaaaaaccacaaaggaaaaaaaaagaucuuagggcagaauucuagacacuuucuuacuuuccagucaucccacauaggcaauacugagggaaagccaagaugcccggcagcacaccccucuuugugagaucugauuaguacaucagaaagagcuguccagaaaucaaguuacaguuuugugagaauaacucaaauucuaaaaugugcuuuucaauaugaccuuguucucauauuguaauuuugaaaugauuuuaccuuuaaaaaaaugcagcuucuuccuugggaaaucaccaaauagugaauggacaaggcuugggaggccacaguggcuaccagaggauucagccccaccuugguaugcagcaccaagguuguggaacacaugaaggcaaagccuaagacaaggaguggaucccuguaaccacguuggacuaccuaucaggccaugaagaucaagccacagagaucuauguguucucucugcccaucaaaaaaucugagauuauuaauuuuaccuagcaauuaucucuucuauguuaauugugaugacuauucuugguuauuaaccugacuauaucuggaauuaacuaaaacccaaauugcaguccauaccuguacgggauuuuuuuuuuuuaaacuaauuaaaucaucugaaaugggaagacccacuucucuggaucuuugagacaggcaaguauaccuuuaauucagaucuuuugaaguaggaagauacagcuuuaaucuggaucacaccuucuucuagaagccuauauaaaggacauggaagaagaagcuguucuuuccuugccugcuugcucucacucucaaguucacuccuucacuggcuuuagagccuacuucuucaggauucugauguauuuugaagaccagcugagacauucagccucauggacugaccaacuacuggaucacuggaccuuccacugguagacagccauugcugacuagcuggaccacagccuacaagccauuguaauaagucuccuuuauaguaaacuauaaacacacacacacacacacacacacacacacacacacacacacacacacacacacaccagaagagagcaccugaucuucauggauaugggagucauaguagguuguaagccacugugguugcugggaauugaaccaggguccucuacaggagcagcaaguacuuuuuuaccacugagccaucucuccagucccuggaaagcaucuuuuaaggauaagguuuuaaagaucauggcagagcagaagaaacagacuugguuuggccagcagaccagaauuaaagcuaacgagggaucaagguuagaaagaccuacacuacccuaagcaagguacagggccccguggcacugucucugcuccugugcccaagcagcugcuggugguggaugguacugaugaccugcuauagagcaguuaggggcugcacugccaaggccaccucugaugugguaucuaagaccuagaguuacuuauauaacccuggaugauuucaaacuuauucucuugucuuggcuuccuaagggcugggauuauagaugugccacuaagguauuaaaaacuauaggugagcuaagcauggugguauagggcggagaaaggauggcaaguuuaaggucagucuagaguauaacacagaaaaagaaagggggugaggcaguaauauaauuaaacauguuuagugcuuucaucaaaauuccacacaccagaccucaucgcuagacaaguucauuuugccucgaacagauauaaccaauacacauucaacuagaaacuaauuaaaaguguuuuaaaucucuagaacuugggucaguaagauagcucagaggauaaaagcacuugccacacaaaagacugacaaccugaguuugaccccagaacccacuguggaagacugaugccacaaaacuguccucuuauacauacuauaacaugaguaaguccuucgcaccaauaaaacagauuacuuuaaaauauaaacucgugaccucagaaaacuuagcuggcuacuuaguaauuagaguaaaauuaacauaguagugcugagaagagugaagacugaaccuacccacugugcauccaaggagaucuaaagugaaauuauguugccuaacaccaucuagucuaauggcuuauuuuacauaaaggaaaaugaggugcagagacaacaagaucacuaaagggcacagugcuaaucuacaguaagggcacugauggugcuucuggccacaccuuacuugguuuaucuguccagucaguuucuguaagcuagccaugcucacuaugagcugaaaauuaacuugacucccuuaacuucauuuguguucaguuuuaacuucaaagcauccaacagaucuauuucucacaaguaagaucaauucugaguaaaauagaaaggggaaaaaaagugaauaaaucaaaaggaaauuaccucauguucuuuuuccuguagcaaaagaacaauaucuccagguuccacuccuggagccuggucugcuuccccagugaacguaauccucuguccauguuucaugccuuugucuacauggacuuccagaaucuugacuucuuugauuaccuucuucccuucacauuuuuuacagcggucuuuuucauugaugaccuccccugcaaagagucgucauucaagcuucuuguaaaaaagagcacccaacaugaaacugucuugacagugcccuuaacucaaaaagcccaagauuacagaguaaaaccuaucuugacauuuccuuagcuccuuggacagucagcugcuggagcuucuaugaaugcuuuugcaaaccuuuuaagcucuuacuucaaguacgcuaucagcagagacaguccaaguaaaauuuuaauuuuucuuuccaguaaggguuacugaaccuaaaagaacuugcaaaugaccuauacuugguccuugaauauucuugauggugaauuacuagacuguacaguugguacugcaguuuacuucaaagacuaaaccuugcuuagaauuuuuuuaagaguguuaugcuugaaauucacuacccucccgccucugcuuccugaacagauuacaccugguucaauucagcugcuaguuuucagcuaaagguagcaauuuuaacaaccaagaaugcagacaccucaucggaauauaacaugaagcuagggaggagaccaccucaggugucacuccuuagcugucuucuuccacccagcuuuuuacaacagaaucuuucacugaacuggagguuaguagguuaggcuggcuggucagugaggaccugggaucagcuuuccucuuuaguacagugauucuuaaaugugcacuacuggcuuuaacauagguuuaugggacuguacccauggcuaggcccucaugcuagaaggcagucacuguagcaacuauguuaucaccucagcccaauauauaccuuauuaaaaugaccucaucauuuccaagaacuaaguggaaaagugaaguucuacaauuauacuaauuaaccaucaagcaaaggaaagaaugggggacguggcucagugguaaggauccuagguuuaaucccucccaccagggcuaggguagguguaggcaguggaaauuagaguaaggacugguggauauagauaguucaauacuugccaagcacacucaaggauuuggguuuacuauccaguguugguaaggcaaaauucuccacauaaauucaucuaauucaaaacuuagauuucuuaguuacacuagccacaucuuuccuucccuugauuaaagccaacuuaauuuaaaaaccaagcuauuaacaauauucagggcugaagagauggcucagugguuaagggcacugacuccucugccgaagguccugaguucaaaucccagcaaccacaugguggcucacaaccuucugaaaugagaucugaugcccucuucuggugugucugaagacagcuauaauguacuuacaaauaaauaaauaaaucuuaaaaaaaaaaaaaaaaccaacaacaaccaauuucagaaccugauuaggacuuuuuagaauacccccagaacccuacuaguuagugauaaagauuaauuucuagcugaguuugcaaaauaucuuagcuuucagagguggaggcagauuaggaauucaagaucauccuugaacacaguucaaggucagccuagguuagacacacuacaccgaaacaguaaugguauaauaaauuccuaucuucuauuagaucuucauuuuguaaauaaaauaaauauaaguuuaauuuuaaaaaauuguagggggcugaagagauggcucaaugguuaagagcacagacugcucuuccagagguccuguguucaauucccagcaaccacaugguggcucacaaccaucuguaaugggaucugaugcccucuucuggugugucugaggagagaggccauguacucacauacauaaaacauuuccaacuucuauauucccaacacauuccaauccggggccuuaccuucuccauuacagucggagcacacggacugcaucugcugcaccauuccuggagccagcugucugaucauaaugcgcacaccucgaccccgacaagcgcugcauuucugaacagcuccagacuucccaccuuggcuaaagcaaaaguauaaaucacaccuuugccuacaaaccauuacagucauuaaaaaaauacaaaccaugcuuucuaacucccuaguaguaaauauuaacgugaccuuuagagguaucagcaagugcccggugcuuauuaaguuccucaaaaagcagagacacuguauagcaacaacacacuuacccacugcaugcacuacagagcacauucuugcuaaguuguaguuugguugucuugccauuguacaggucuucuaaagauacucuguagagaaaaagaaccagguucaaccaaauguugccaauauuaaaagauaaaaauaguuuacagaguucuuuuuguaacaaagaacucaagaauaacuaugacuauaaacaauauacaugguguuaacacugcucuuuagagggcaaguuugguucccaguccccacauuggaauuaccugugacaacagcucuagaggauccaaugacucugacucuugaacacaugcacacucaaaauuacaaaaauaaauucuuuuuuugagacaggguuucucuguauagcccugacuauccuggaacucacucugaagaccaagcuggccucgaacucaagagaucugccugccucugccuccugagugcuaggaugaaagauaucugagacauccacugccacgaccacccagcaaaaauaguaaguucaccaggcaaugcaaguaaauugggccagcacucucgugaauauggaagcauuccauaccugguuggacaaguucauauuguaaugguugguacagaucuggucugggcugaugcacaggcaaucaaccaauagacauauagcaguuuucuauaggaucagccaaaagcacugugauauacuagguuugcuggcuugugccggcugcugggugagcuaggaggagaggcccucuacaugaagguaugaggcuccuuaguguucaugaugaauguugacaugguggcccugaacaacuuuuaacauaucuucaaaguaucuaacucaaaaggcugaauuuuaaaaaguaccaaaauuguaugcaaaauugcacaauauuuuauauauccacauuaccucaaaaaagugguaaagaaaaaaagucuuacuaaaaauauauauggaggcuagaaagauggcucagcaguuacuugcuauucuugcagaggaccucgguucaguucugaguacccacauaggagcuaacaacugucuguaacuuaauuccagaggauucaauaccuucuucuggccuccauuggcacucacuguacauggugcccagacauacaugcaggcaaaacauccauucacauuuucaaaaacguaguaaguguuuauuuaaaauaaaacaauuuagaaaguguauuugcuagauguggcagugcacacuuauaaucuuaauacugaaacagggagacuggcaaaaguccaaagucagccuuuccuauguagcaaguucuaggccagacaagguuaaauagaaagacccagucucaaacaaacauacaaacuauauauauauacaugcgcacacacacacacacacacacacacagcuaauaaaacacaacucaauuuuauucauauauagcauacuucaauuacaagaccaacuuccaaacuaaucucaaaaaacaaaguagccccaucccucccuaaggagcuguaguuaaugguugcugagagaagggauucauucucagugauguagccaaugguaaguugcccuugcucagguaaauaacucuaccaucccuauucauucaggaaacuauaauuaaguauaaagggccaagggaggaaaggcaaaaaauaggagggacuuguuagaaagagggguuaguuugaaggggaagcauagaaaaagguaauaugaagaucguugccaaacuacauuuuauauuucugugcguaucaaacuguaaaagaauaaaauucuaagaauuauucaacaauacuauccauuuauaucacagauuuaauaauacacauuuguuuuuugauugguuugguugguugguuguugcuuuguuuuuacuuaguauaaauuaaguagcucuggcuuuauguaaggagcaggcuggccucaaauucaagagaucugcuugucucugucccuuugucccaagugauaugauuaaagguucgagcccccacaccuuuuuccagguuucacacaugcuaagugggcucugucacugaucuauacacgugcagccuuuaagccuuccuuacuaauuuaaaacccuugaauucagguuaaaaaacaaagaaauagucugaagucauccuccaaggcaccuacacuauuuugugguauucagccuuucgacaaaguguuacuuuaaacuuucccauguuguagacaguauaaaguaacacuuauagguaggcaagauggcucagcagauaauaaaggcacuuguugcagaacuaaauuugaucacggugaaagagaaccaacuccccaaacuguccucgcugauuuccacggucaugaaaaauaaaaaauuuaaaaaccacuuauaaaugaaaaauuaccaacaauacaucaucacauccaaauaaugauauacugaucuacaucuuaagccuuacacgaccgggaaaggaaaacuaaauaauaaucugacuagauugaugcucuccagagaggcuuaaacuggcaaaauuucucugaagcaauuagguuuuaucagcuucaaaacauggaggucaagucggggauaguaccucacaccuauaaucucaacacuugagagccugaugcagguggguuguuacgaagucaagcuuagccuuagcuacaguaugauacuauuucaaaaagaaauaaagccagggaugcuuggcuuggaaucugccagagauaaaacagcauacaaagaaaugcacagcaacaguauccauucuagcccccucccugcacaucacaugagagauaaaugcuuaaucaucaugaaauggaauuauaaagccacucaaaagaauguuaguuacuaggcagguaugauggugcacaccuguaauccuaguauucaggagggagagguggaagaacauugcuuggacuacauaacaagcuccggcuuaaaauaaagggggggggugugugugucucugaagacagaucaguugguaaugugccugcacuacaguaucuggguucaauccucagcacuuguauaaaaagccagccaucagcuaugguggggcuggggaacucauucuugcaguggacccagcuucaauuucauccacaggguggcucacaaccaucuguaacucuaguuucagaggaccuggcacucucuucuuaccuccagaaccaggcacuuguguaguguacagacauacacacaugcaagcaaaacacuuauauaaauaagaccaaauagauacaucuaaacaaacagaaaacuagaccaguaagauagcuguggauuaccaccaaaccugccuccgaguucaauccccuggaacccacaugguaaaagaaccaacucaaccaauucuacaauuuguucugaccuucaugucugcaggguagcaagcacuagcccccaucucccuaauaacaaaaacugucauugaaauacuuuaaacaaacaacuaagagucaggcaugaucauacacagcagcgaucccugcacguuugagguggaggcaggauaccaggaauucauaaccagcuucaugagaccuugucuuaaaaacuccaggcaggguucgcucuccccaccucaauucagucucuugcauuuguuauuaaaaacauuuuuagugaaauaauuguaaaauauagugaaauggcuauuuucagauuguagaggagcuguggagucuuaauucaaaaucaaaguccacaccgcuuauaugcugacaguuauaccaggcuagaagccaguuagcuccauggaaaccaauuuaggagaguuagcauugaggaucaaguaacgaggaacacugccauguaaauaaucgaaacaaacaaccauucuuuugacuuaaacuacuucaaagaauacccacauuugaaaauuucaaacaggcaaccucaacagcaugugaaaaaaaaaaucucaggaaaaaucaacuauucuuuaagaucuugguuguuuugagacaggcuucuauguaucccagguuggccucaaacuagcuauucaguugaguauuuaugaccuugaagccugauccucuugccccuaccucuccaguguuguaauuauagguaaagaccacccaaucuggcuuacguccagaauuuugugucugugaguuaagcacuuuaucaacugaccuguauuucuagagcacccuuccacccuuuuaaggccugaagcaaaauacaucuaauuaaugucacuuaauaagaacacauuuuaaaguaagaacuuugaaacaaaggacaaaauauucuguagucacccucuaaggaacaccguuuggagaagcauuuuuaaagagacucacuuuaguggaugcaucauguccucgccucuucuucugccauuucgacuucuacucugauugcccauaaagccaaacaauccuccaccaaaaauaugugagaagauaucauccaugccaccgccuccgccgcugccuucccguaggccuuguucuccauaucugucauacagcucucgcuucucuggauuugacaauacuucauaugcaaaacuuauuucuuuaaacuauaaaguaaaaguaaaaaaauuggauuuuuuaguguaaggaugugagaaagacuucagaaauucagaagccacuuaacuucaauaaaaagccuugaguuucaguugguuuccuuuugguccucuucaucaccuacugcuaaauaucuuagaauucucguuguaaaacuauaguccucugaccguuaucaccaucacuauuauauaugcauaugagugugggaguauguaugggggucagaggacaacuuucuauccuuccauuguggauuaagcucagguagucaggcuuauaugguagcaagacuuggaacacagagcuaucucaauagcuauaauuuuucuuaucuuugaagaauauuacaagcaauagguuuuacuaaggucauuuucaaguaaauuaaaauaacagcgaaaaauucacucuguaggcauaaauggacuuuccuuucugggagggugauauauuuuaaguuucaguuuaagaauaaaacucaaugacuuacuuugucuccagcauuuggauucuuaucagggugguauucuuuggcuaacuuucgguaugccuucaaaaaagauuuuggauaagaguuauacacagcaaacaauuuaagauauucacuuuucugagaagcaauguucuaaaguuacagccuuccaaaaaaugucacuuauuauuuaacguuuuccacuucaauaguauuuacuaauaauauacccaaaguuacugaagaaaaauacaaauaaaacaacaaagaagauacugaaacauuuuuucuuucuuuuuuuacaaacuauuaucaaaugucuuugauggccaguagccagaccaaggagaccacaauaaccaaacaaauuuuagauugagugacuacguuuuacagaaacucaagcacuacuacaaauuaagcauaggauacuucuaccaaguaucucuccccaugcuggcuggcuccucugccugcccucuaacaggacacccaggagguccuaagugauguuuuacucgcacacggucggcuaacuggggucuuaggugguggugaaacuacauacuuucaauuaagcgaugugguuaagcaccauguaaguccucacacagacucaugaauuauauaacacagccuaccauuuccgguaggguaacaggaagucuuuuucuuuggacuuuaccagucccaguacuuacgggacauucuuauuuuucucaguuuacaaaugcggauuggaucccgacagccagagaagaugcugacuuuauuaauaccccaagucccgagaugauuuggaacuacuacaaaggacaacaauaagacgugucuuauuuuuagggagugcacgcucagguguuuggcuggggcacacgacucauccccgaagcggccacgggguauuuagaucuccagcccacagaacaaugcuuccaaacagacccacgccgcuccagcugccgggcgagcgaggcugagggaggagccugcucagcgccgggggcugcggcccucagccccacaccggcgccggcggucagcuccuccccggcccggcggcgcgagcaccgcgguccgaccuguuuuuccggguggccccgggcgccgagcuggcgggccgcgucugcgcagggccgggcgggcggaggcccaaggucagccgagccgacugcgcccccgccgccgccgcgccucagcccggcucaggccgcccagaccgcgcaggccccgcgcccucgccccgcccgccggccggcucgcuccaguaccuucuucagcucguucucgcuagcgccgggagggacgcccaggaugucguacagcuucgugucggccacguucgccauggcggccugccgggcagcacucgcaagcaggcggcggagcggaaggagcgcgacccggaccacgagcggcggcggcgcaggccgaggagacggcgcggggaggcaggcggggcugaacuuugacccggcgcagcgcca

SEQ ID NO: 4613 - RNA, 1155 nt, Mus musculus
augcaaaaacagagaacauuuauucugcaaaaauaaucagcauguagggguaaacuauuuuuugacaaaggcacacaggccuucuuacaggaaacccagggaauucucuagaaggauuagggaaucuaaaauuuaauugguggguguuagagaaucacagguggccaguggucuacaacccuaugucauggauguuuaaccauaggaggagauagggcugcccagcacagcuggcccauccugcgauaagauauuuucccauuuuugugguuauccccaggcuguucuuugggagggguuuuuacgaccuuguuucuggauuuuaugguuucuuccugaaguuggugucuuauggccuaauuccuaggacuuaggguuuguuccuggagcuguugccuauggccaccauuuugaaaucaagcuugacccuuaaauagagacaaaugggauuuauguugucuuuucacugaucugucuuuucuuucagucucuguacagaaccaagucugguagaugcucagcaggcugaauuagcuuaugcaggguuucagcaauucaaauggagccgugacccucugaaccucauccugucugaaccuggcuucuuuccugauggcuaccagccuaguccugccaccuuggccauaggacaacugaggagaauguagcccucaggaagaaaggguccauaguagugguuuggugcugcugaaggccaggcauggauucacucuuaucuacuccuguuucucaaggcauggaagggagguccaggcugcugcuucucuucacuggcgugaugggggaugugugugauguucauugagugggucccaauaaggaucaggaagacauuucacauucuauugaugggguagaugaaaaggaaguaaguucaguuuuauaugggauaggugaaaacggugaccacaaaacaucuccacagagauuuucuaggcagaaacucauccccacucacccccaucuguguggaugcacacccugaaccaucguuaaugagcccuggcagaggaaggaggagggaguccuggaacugcugggagcacacuuuguuggaauaugcucaggacaaucacucgcaguuggcggagagucgcugaccuguuaacucuacagcacccacgaccaguacca

SEQ ID NO: 4614 - RNA, 3100 nt, Mus musculus
ggaacagacgguccgcagcggcccagggcguacacacuaaguugcaucugggagcuuggagggaccccgaacuaucccgcaaaggaagcugggcggagcaaggcuuaggcuuaaaggcuggagcugcccaggcgggcguccgcgcgcucgcucguggcgacauaaacaagggaggaggcugcguucuuccccgcacaauaaaggcgcggguccgggggaggccgcccucccggagccgccgaggcaaggcccgaccgcggcccgcgaagcgcgcggcugaccuccgccauguuggccguacaccgggccacacaacaaagacugagcgagggcgcgggccguagucucggcgcgcccgcccgcccuccgccucccggagccgccgcugucggcugggcccgcccggagaggccgagacaaaggcgccgcggcuccgcgaggggacccgccggcccuccccgggccgcggccagcuccucccuccaggccgcccgcuuaccugugggcggagagcgcgccgcggaccccggccccgucuaacgcgcccggucgccagcugccgccgccgccaccgccaccgccaccgucaccgccgccaccgcgggccgcgccuccaccucucccggcaccgagaccgacgggacacccugggccgccgcccucgagagcgcgcccgcccggcagcccggcuucccugccgccgccgccgccgccccgcgcgcucucgagcucgccgcgcgcgcccgcuaaguaccacacacugcggcggccgccaugagcgggagcgcgcaccgaacccggcugggcggggcuucccacggccacgcacgcgcagaagcggcuggcggcugcugcccgcacucgguggcgguuggcgucgagacgcuucgguuaccggagcagcgucccgagcauccccacgaggcggcugcgcugucucgggccguuacugugggauugacuggguucgcgccguccucucuccggguccgcggucuguagcggccuccacgaccccacuccuggaggagaagagggccgcgccucccgguaggcucguugaaagcuggccaguaagaagcacgccuuuaaguccacuuucccacucaucugggaagcugauguuggggacuguccacccugcugcuuuagguuaaaaaacggagccgugcacuaggcaagcagaagcaggaucuucacaaguuuggggccagucugguuuauacagaguuuucugggacuucccggggagaccuuuuauccaaaauaaaugaagaccucaucucaaggguuacgggugcuuucgugaggagugguugccugggcugagacucaguccccaguugcgagugaagggguagaaaccuuuagauuugauucuggggugugggauuguguggaggucagaggacgaguugcgagugcuggggguggagcgcaaguggccagccuugguggcagggccucugcugagccaucucgcagaguccccguuagucuuuccauggaugccucugucugacuagguuaaccgaauguaaggcguuuacaaauccugagcagauuuucagggaagaacuguagaaaugcaaugcugugagaaaaguacuuuuucuaugggguuucaagaaaggaagaaaagucuccucucagccuuccaucagcacaaacuccgcccucuuccagaacucaaauuuguucucaaugaauguucagcuuuccucaauguauuuguaaucugugcuuguguugauauuucuauucucgaucuaguaucucacuguagcccuuccucugagaccauuagcacaaccaaacaguugagaauguaaauuaauuaaguuaaaagcaccauauacuacaaaucuguugguccccaaagcucaacagccagauaaggagcuugcauuauguagguucaugaagauugucgauauuagugguguucuuguucauuuaaaauacuugauuuacauagggagucuaagauaacccaucauaaacucugcuuugucaugaaacuuaccaaguaggaagucauacauucacucucauauucguuggacaaaugauaauuaucaacuaguccugagaauacuaaaucaucaacuaguccugaggauauuaaucaucaacuaguccugagaaacuaagcuaggcacuuaaguauuaucuagcaggagacacaaauauaaacuuacugcuaccacugugagagaaaaaauucccaaaacaagugccugguacuaaugaaauaucuaacucaagugugugagaacacaggugucuaccacaaaaccaaaagacaagaagcaauuaacaagauugggggaaggcuguaaaagguagagacauuaaggaaguagaaaaacaauucugaagauaaccugugacuguccacuucuccacuauugguuuuuuucuuagugggugagcugaggaggagagggugugaggucucugggugcuuagaggccuauggaguucagagaaagcuaugcuuugaggaccaaggcacucuagugcuuuuccuaagggacaauauuucucauccuguugacaccaaaaaaagaauucacggaggcuuugaaguuugaagugggcugugguuaaagggugagaguuuuaccuguggagagggaaagguuuucuaagcaaaggcaaucugugguguaagacucaaucucaagugagagugguaagaaaucuuuaaaacccaaagucaauacgaaugcuauguacaagccugaaugcggauggagggaaggacaaagcagauagggagaaagccccggagaacacuuguguucaggcaaaaugaaagccuaacccaggaggcagccauggaaauggagaagggaucuuaguugaucugggaugguuaauugaaaauaggaucaaaugcuacuuuuaagcaccucaaugccaaaucacgcauuaccucaucagucucugcaaaaauuccaugaaaugagcaaacaaaaaacugaccgggcgugguggugcacgccuuuaguuccagcacucuagaggcagaagcaggcagaucucugagaguucgaagccaacguguucuacagugaguccaagacagccuuga

SEQ ID NO: 4615 - RNA, 95158 nt, Mus musculus
ugggacaaaauggaauuuuauuuauuucagaauugaaaguaagugggcaaacggaauucacaugugaacuuucccaauagcuaacagguaaaaacaacucaaauaaaugccugucugugaaugagcagacuaauacugaacugagguauagccauccauucaauggagaauuacucagucacaaaaagaggucggguacugucacagcuaccucaacguuggcgugcugaguggaagcaaaggcacaggguggcaguauugugucuuguugaugugaaauaucaucaacagaaacagaugaaaggccaagggauugggaacuggcuacuuccuguguguggcuugcucuuggucugaugggaauguucuagagcuuggcagugguugcacgagaaagugccagguguucgcaguggcacauuuccugugagauacauuuuuaccacagaaagucuuccuagaaaucaaaagaucauacuuuguaaaaagaguuaccaagauuuauuucuuuuagauugugugaugacuauuuugucuguaugucuguucaccacgagcaugccugguguccucagaagucagaagagagcaucauaucccauggaacuggaguuaccggcaguuauaaaucaccgugugggugcugggauuggaaucuggaucugcugcaagagcagccagugcccuuagccacugagccaucgcuccagccucagccccaggugacaugcauaccuguuucuuucccauuuccaucuuccucucuggcaugcugaagagaugucuggagccacagcagcuuuuuuguaauagaaagaagauacccaugcacauaaaagcuguuccacuaagaccagcagagggaagaaaaugccuggguccuucuuggcaguuugugacagcuggacuaacaauaaaaggauuuaguaaaugacaaaaacagguccuguguaaagcucucuggucaggcuucuguaaugugagaguagaagcaaucacaacuacuaacguuacaagcauaauggaagaggaaguaaaaauagguacuguauccugguuugugugcugguuagugccaucagccugauacaaucccacauagaccccagaagggggaaccucaguugaguuguucuggugcauacguuuaaagacuacuucugggggguggucacccugccaccuccugggguugggagggggcgcagggcgggccggggacagggaggguagagaagaggguggggcccguaaggagggcucucgguucgccccagcucccucagacugccucagacucaugaccccucuagagccgaggugguucuggguucccaucugcuuccugcuucaagauucuucacccagccccucggcagguguggcuaccucagggaucuggcucugaacccaccggccacuucucagagcaucagguuuuccaucuagaaggcacccagacucacaaugcacguucuguggcugagcccugggaggcccgcagucucacuuuucacaccagccuuccgaaugaggggccaagaagcaaacacccagugaggucugugagcagcugccaguaggcagacucaucuguucauuugccagcaucugugacaaucacuuucccuuucccauaguucaaggcaauggcuuuggaacugaagcauggucuggccugugucaagugcucaucccugccuugguaaugguggccagaagaggguugcaauacaccaggcuuuucauaucccugccuaaaguauggggacugacugugggcccggaagcucaggguuauccugccccaaagaagacauaagccuggcuucccaccuacuugguagacugagagaggaagcucacaaguucaagggccacaugaguaauuuuugugauacccugucucaaaguaaaaaucaaaagaggcgggacagagggugcuggccaguaggugagaggucccggccucucacauaucuguggugcugcuuagguuuuuaucaguuuaauacaggugggggcaucugagaaaaggaaccucaacugagaaaaugccuccaucagaugguguuuucuggauuaaugauugcugugggaggguccagcccacugugagcggugccacuccuaggcuggaggccugggguguauaagaaagccaacugagcaagccauaaggaucaaagccagugggcagaguuccuccaucaucucuguuaaaguuccugucuccagauuccugccuugguuucccaaauaaggccaaauaaauccuuuccuccugaguaucuuuuggucaugaugguuuaacacaaauuauaggaaacuaagagcugcugaggaacaaggguugcuccuguuugccugauugauguguccugaugucuauucaccuagagaggcggccaggcuuagggauguaaaaaguguuauuaagaacacauccagggggcaggaugucucaggaguuaaggauguucauugguuggauccucagguuugaucuucagcaccuacauggcacaucaaaacuccagugucaggaaucugacaccuucuugccuccaugggacacagacaacauaacacccauacaaaacauaaaaacagaaagaacacacaguucagcucagaccuguccuaugaaccuguacaacauacgugucuuagcuugcagcccacagcaggcuugguccucccacaucaaucauuaaugacgaauacaccccacagacaugccuacagggcagucugguggaggcaguuccucacuucaaguucccucuuccaaggugacucuaguuuguaucaaguugaugaguuaaccagcauaccucccugcuuucuccaacaagccaaguucagcuugucuccuauccugcaugaccaagaguauuuucggggcuaaguagcuucuuuggagaaagcagcacuccauggauuggggguguugucucaggauggggcguuucuuuuuuggccagacaucccccccuccccgccauuugguggugguggugggguuccagguaacuuccucaccaucuggucuggucucacugacucagucucugaacaccauguggccacuguagccacguccucagggcaggugaugggaaaucgcuccauguuauuccuuuucaggacagaaccaccaaaccuccgaucuggcuuccauucuguaaguggagacuuggccccuuuucaguuaggccucccaccccucaggacccuugaaaauuguauccuucaucauagcugaccaugugggagguggguuggcuuccaggaauucaggccuccucccgugacccuccaaccuuacugaggucuucuccuuguccuuccuugacauuuugcauaaaggguggucccacaaucagcagagguggccauuccagcaaggccuggugaugcugagaggugaagaauuaggugccucaguccaccuucucuagcauaggcauuccaaauguucuauguucugcagcucugagaacaucaaacgacacaaguauaagauuacauagcacuuugcuucauggaguuaucaaacacaucguauaagagccaucucgagcuaagcauaucaggcaugcaugaaacaaaagucaguuccauguuuacacuugaacccuccucaagauaccucacuauggggaugcugaauauuucaaguauaaaacugaaagcauuucuguuccuaagcauuugaaucagggaugcucagcccaaguauccuuccucuuuccacugggauauuugagaccaucaccuugacuuaaagaaauaggacuagcuaagagaugcuuuuugagcacugugggaagccacaugugccguugcugaguggcacugacuacugcuggccaccacgcauaagauuggacaaacaaccaauguguacauaugcaguaaaguuuuuugcaaagacacugccuggcccaggcaugauaaugagguucuguaagauacugagaguauaaccaaucagaugugagacaugcaaaugagguaugauaaugagguucuguaagguacugagaguauaaccaaucagaugugagacaugcaaaugagguaugauaaugagguucuguaagguacugagagagaguagccaaucagaugaggaacaugcaaaugaggguuagugcauaaccaauccggguguaagacacgccccuccuaggccuauaaaagcagcaccaguucugggcucgaagucuuuucgccucuacaaucaaggucucccaauaaacgugugcagaaggauccuguugcagcgucguucuuccuggccagucgagcgcgcgcaagagagcaccuacuaugugccaaggaauccuguucuaaacuuuucagcuccauuuggggacaagagaugaauagaggauggguuuguucucaugguccuuccugggccucccuguccagccccauacuauaaccaaggagcuuuccaaugggccaucgcccuauuuuacucaauggccuucaagggaucaccacuuaauuaggccacagucaagacaauuugcaugagcuagcagaaauuccugacccuugacaguguaguuccuucugaggugucuccuccucaaguguggccugagauacucugacagcucaucuuuuccuauaugugacagugacaacagggaagcucugcuaugacaucucauaggccccugggagcuagccagacuccuuuuggauuauccaagagaccaaaggcauaaggggguguuggugggugaccuggggugauuggugaaggaggugcucugucccaaccugcagcucaugucagaggcaggcaggaaaaaucaggcagcgcagguggcaacaagaguuuauuaggaucagacacccagaaccuaguaaacaauacuagcaccucuugacccaugcacaaucugacagcacccccacacaccccaaccccucuuccaguugcagacucaggcaguggccuacuuccccuucagaaucuuguucagggccaaaggaggcuaaguagaagauggagccuauggagacuugcauggaugugaggauggaugcuuccaggaauagcuaaggucugaguucucagugggagugaugggacuagaccuccacugacauagacuuggacuccuacaagacccuagauguaguccuugccugggaaauagaaggcacuggaucuccaaagcugugacaccucagacuucuuaugugaaugccaaagguuuaacugaaaggacccauggguucaggguaaagauauuguucaggauaccacaggaagcauaguugaacugaaccugagccaaaugcucccaggacuacaggguuguccgugauguaucagccucucugagccauggggugcucaucuguaaaacaggaauaagaacaugcagcccagagggugauuguaccaauuaaaugaacucauucuucucuuuagcaaugacuaauggaaagcuuuuguaggugggaccuagcuacucucucauucuuggaaauaaauucccaaauuguaauugggagcauugccaccccagaguagggaugcuuuauccauuuguuucuagggcauucguggugguuaacgcuaaggggucugaguggaggaugcuucuauugaaaccuccaacacuucucuuaagucuguacaaagugcccaucggguggcaucuaccuuuccucauaccuguaacaccaccauuuccugacccugugauguaugaggguugugaggguugguuauucaugcacaggucacuggccgucucucuuccuuucagcuccugcucugccucacaaguauccccaaacccuauccucaggcucaaggcgacuuugaaaccggaucucuucugaucuccaugucuggcuguugcaaugauucaucuugauugccaaggugauuggagaaaggucuaugagaucacuaaaacaccccucugugugucucugaagauguuucuagaaaugauugacaugucagacaguaccagacagggaagacccagguugaaugugggccaugcuaucugacagcgugggaacugagauggaauggaugugaagagaagaaagcuagccaauacacacaaggucugcuuuuccacaaagagugcaccuacagcugcugcuguugcccauggaugucacuucuagcuucuccagccucguaccacagacccauggcaguggcucuccagaggauuccagccuucaucuucuggguggggcugcaucacugauugcucucguucugaugcuucuugagcagagaaagcagcuaauagauucucuggcuuuccagccugccagagagccaggggacugacaagcaccccaugcuuacgcaugcuaccuuaauaaaucccacuuuguaacuggaggauuugaagggaacaaaaagaauggagcugggcaugguggcucaugaccauaaucccagcacuugggagaaugagguagaaguguauguagugaguuccaggccagccuagucugcacauugucuuucagacuacaacuugaggcuugaaaaaggaggaggaggaagaggaggaggaggaggaggaggaggaggaggaggaggaggagaagaagaagaagaagaagaagaagaagaagaagaagaagaagaagaagaagaagaagaaaaugacaaucauuuuauuugaggaacuucucucugucaggagggacaaugcacaaagaaacaauaaacaccacagaugggggugagagcaagggggugggacugacugagagauggccuaauggguaagagcgcuuguugcucuugcagaaacucggguucaguuuuaagcacccacauggaaacucacuacugucugcaacucaauuuccaugggaacagaugccuucuuauggcuucccaggcacuacacacacacagugcacacacauacagguaggcaaacagucauauacaugaaaauugaagaagagagaggccaagagagcacagagagagcauagcuauuuggaaaugggagaaagaggagagcgaagagaggagagagacaagaggcuuuccuuuuuuggaaaggggagaaaggggagaggagaagagggggaggagggaugggagggggagggggaggggagggggaacgagagaugcuaggguagcuguggucagagaaaggacaacauaguuugagacaagccagggccaggccaaacaagcuacagugaauucagccuugcagcugcgugagaaggagaucaggaggcuuaggcggcugaacagagcaggugcuguaggguuauaggcagccuugcucucugcccugacucugccugcagagauguaagcaagcaagcagccuugggguccucccaacacggacaagagccacaguggaccaaccuauguugggguuggaggauucaggccuaaggggaucccagcugucugcucccccaagacuguuccccaaaauugugccuaggaugccccacaucuacacaguugccauggaaauuuguuuguuucugagcuuuauggcuguguccuuccuuuucuucccuccccaucugcuuccuucuucucuuuuauuuuauuuaaaauguuuuuaagaaaaaagcugggcgugguggcgcacaccuuuaaucccaacacucaggaggcagaggcaggugguuuucugaguucgaggccagccuggucuacacagugaguuccaggacagccagggcuacacagagaaacucugucucaaaaaaccaaaaaaaaaaaaaauuuaaagagaauugauuuuuauuauuuuuaugugcauugugucuuguaaucuauuaccuggaugugucugugugagggcgucagaugcccuugaagcuggagguagagucuugagcugucauguuggugcuaggaauugaaacaggguccucuggaaaagcagccagugcucuuaaccacugagcccaucucuccagcucccuuuuauucuauuuuuaauuguguguuuguaugcagguguauccucaggagcuggacuuauagauggcacugauaugagagcuuggggaacauuuaggugguagggucugcuaugaguaccgggaacugaacucagguccuccaagaacagucacuccuuccacacagacaucucuccagccacccccaucuccuucuuucucccuucuuuuuuaaauuaaaaauuuuacacuuguauuugauagccaaaagaacaaaaaguuuuuguuuauuuguuuuuguuuuggauguaaaaguaaaaaccucuugaaacuggagaaauggcuuggugauuaagagcccuugcuguucuuacagaggucccagauucaauucccagcacucucaaggcagcucacaacuuucugugacuccaauuccagguaauccaaagcccucuucugaccuccuuaggcauaaggcauaugcacagugcacauacauacaugcaggcaaaacaaucauaaacauaaaauaauguuuaaaauauaaaaaagggaaaaaaucuaagaaaacuaaauuaaaaaccucuaagcugacacuaucccugaaauaacagccuuucagggaucacucguguuuuucaaaauguacauuuuuuaaaguaaauauuuugcuuuugagaauacauuuagauuugugggacacugcuuagugaauacagguuugcacgcucuuucucggguucccuuuucuguuagaaaugagucucaucgucaaugaaccaauccuauacagguuucccaaagaucuuucuguuuaaggaggcugaagcacauuuagauagcuuguguccugcagcuugucacggcuguuggccauaugacacccccacuccauguguguuuaaguuguuguuugaaacaggucuugcuuugcagcucaggauggccuugaacucugcauuaccuuggcuuuagucucugagcuauuaugacuuuucaccuugcuguuucguuuugcucaacuuugacacaagcuagaaucaucugggaagaggaaacaucacuugggaaaaugucuucaucaaacuggccugugggcaaauauauuaggauuucuauugcugugaagagacaccaugaccauagcaacucuuauaaagaauucauuggggcuggcuuacaguucagagguuuaguccauuaucaccauggcaggaagcaugguggcaugcagguagacguggugcuggagagggagcugagaguucuacaucuggaucagcaggcagcaagaagagagagacagagacacugggccuggcaucugaaaccucaaagcccacccccagugacacaccuccuccagcaaggccacaccuccuccaacaaggccacaccuccuccagcaaggccacaccuccuaauaguaccacucccuaugggucuauagggacuauuuucguucaaaccaccacagcaagacuguggggacauuuucuugauuaauaauuaaugugagaagguucauccuacuauaggcagugcuaccccugggcagaugguccuggguuguauaagaaaauaagcugagagagguagggagaauaagccaguaaguacagcuucugcuuuaguuccugcccugacuucacuuuaugauaaacucuaaucucuaaguugccccaaguugcuuuuggccgugguguuuaucauagcacuagaaaguaacugauugucaugguuuguauaugauuggcccagggaauggcagacacuauuuggagguauagccuuguuggaauaggugucacuguggguaugggcuuuauuuaagacccucauccuagcugccuggaaguuggucuucugcuagcauccuucagauaaaguuguagaacucucaccucauacugcaccaugccugccuggaugccuugauaaugauggccugaaccacugaaccuguaagccagccccaaugaaauauuguccuuauaagaauugccuuggucauggugucuguucacagcauaaaacccuaacuaacacacugauacacccuugcuuguuuugaugaucuugcguacccuggaaaaagcuccugcauaucuuugacuaggauuucuuaucauuuugcugaugauaaccuccuccucagaagaggaaccucguaggacggacaauccagagcucccccuggagagagggcuuauuguccuucucccccacuuccuaggccuggcagugucccaggauagcagagcuacuaggaaagaauuuugucaaauaggaguaccuggggguggucaccccucucuggcaucuuuucuaaaugauucaaguucaugacuaaucacggcugauuauuaauaaugauauaugcuacccuaaaagacuucaaucauuauuagcagcacagugcagagcagugccagggcagugucagcagcccuggauggugacaauaccaugcccacuucacagacuagaaaguaaggaaaccguuucaaagguucaguccauuaucaucacagcaggaagcauggcagugugcauguagacauggcgcuggaggaaccaagaguucaucuugcuccaaagcaaccggaaggagacugaauuuccacacugugcagagcuugaguaugucauauauauauauauauauauauauauaugaccucaaaguucacccccacagugacacacuuccuccaacaagacaacgccuccuaguagugccacuccacaugggccaagcauucaaacaaaugagucuaugggggaaggggugugcaugguggguaaacguauucaaaucaacacaggcaauagcaaaaaugaagaauaaaaagucacugagucuauggggcuuaggccuugagugggggaacagguaaugccacacagaggggagcccugugacaggagcaagaagccuccugacucuugucagcuuugucccugugaauccuuucugccuucccaggaaaagccuuucccacccucagcaggacacuucucagucugcugugcucaggagggcuccacggggcuucaugcaggcccuagggagcucuuggaaagacaggucucuccccucaggucucuugcaccccugacccagcagcucccuguccuguucuucagccaccugccggcuccucccaaccccuaccuuccacagccucugucucaugcccucucugacugcagggcccuuuccucuuggaggcaggaccugcccgucuuuccucuuuucuugacuucuuuaucuauuuucacgucuuuugucuucuuucucuccuuuuacuuggaaaacuuucaaacauagagcaacguugcacuaguaauucaaugaguguguuuguaucccucgacuggacucaccaacgguuggugcgcuccuguuuccugcaccccagugugucugugcuuugacaggcuuuacuggcagagccucggagagugaguuaaauccccugugacucaucccuugcaguuucagcuguguuuucuaagaacaggacauucucuuacauagcuacaauuuaaaugucaacaaaagaagccauauaucaacacacuacucuuuuauaaaauaagucccguauuuaaagaucacaguugcucuuaaaauguccccuuuuuuccagagcuucuuuuaaaaaaagauuuauuuauuauuuauaugaauauacugccucugucuucagacacacacuagaagaaugcaucggaucccauuacagaugguugugagccaccgugugguugcugggaauugaacucaggaccucuggaagagcagucagugcucuuaaccauugagccauuuccgagcuuuguuuuugacccaggagccagccugagaauaaauauugcuaugaaucagaaugucuggguuucuccagagccgcuguuccuaggcuauuacucagugagacccuaucucuguuucaguccccaacccacaaaaggaggcuccuggucccucuagcuuuguuuuggcuccucuccuuuuuucuccuuuccauguagacaucucugcaggacacaaccucugguuuaucucccuucccagagcccugucugccagagucuaggggaaagaaugcuugccuggagucagccagaaccagaucucaacuaugguuacuuccaauuccugcccagucucugcuuuccagacuucuguguuguaagaugcucugaguggacuuugcaggcauccaggaggaucuuccugggugcugucaggauuccugggaggauggaagaguguauaugguacccagcugaguucaugaagcaggagaacauggagcauccacucccagcuccuggauguuccucucccccagcucuauccagccugguccucucaugcuugauggagaccaggccucagaugaaaaucacauuuaauaacagcaggagucagggugucugggccugcuguacauaccuauaaugccaguauuaugcaugcagucccacccaucccaugaacgugauaaucacccauaaguuaagcuggcugauaaccuccccuaccaccucuagcuugcuacaucagaaauauccccaaaccuuugcuggguuugaguaucugcggcuucugucuacccacaguaggaaugacaaacugccuauggagcacuguugacaucagacuccuaaggaacaucugggucccauuaagcagcagaauauuaaaaaaccagggcuggccaugauccagcacccagcaggaguggguagggccaccacuccccuuccagggugauagagcuugaggcccacccagcuuccacaggcauucggaggaaggagaggggaguagcuuuugcuagcagcccaauacugaguccucugaagaaucaucccugccugccucucggguuucccaucacagugaggggagugcuaugcugacaugcuaucagacagcuagggggcgcucugccuguaugggcuugaaguugagggcugcaaccccaccuagugcagaggaucaugcacauguggacaucaggccacuccuugccacugcugcacuggguuccuucuaaucaugcucugauaucugcuucccagagccgccagaacauccaguucagucuucacuacucagagagggcagggguccagcaaaggccaugcaucaaugcaggucuccacccagacuacugcccugugaauagagaguaaugcugcuuucacuaggugcagacuuaaaccagagcccagcggcuauuugaaagaucucucagacacugagccaccaaccaggcaagcagacaccagcugacacauguacagcagaggacugccuggucuggcaucagugagagaagauacaccuaauccuucagggacuugaggccccagggagugggaggucugguaggaugggguggggugggguggggacauccuuuuggagauggaggaggagguauaggaugagaaacaguuagaggguagacaggaggggaauaaugacuggacuguaaaaaagauaaagagauaauaauaauaauaauaauaauaauaauaauaauaauaauaagaagaagaagaagaagaagaagaaggaaagccucauaaaauuauccucaaaauaguuggugccaaagcuaagaagauagcuuagaagguaaggcuacuugcuauguaggcaagcaugaggaccugaauuugaauccagcaccuacaugacaagccagguguggcugcaugggacuguaacccuaguguugugggacagggucagguggacccuguauccaaggaauaagacagagauuuaggagaaaaauaccagacauccucuuccaguccuuauaauguacuuacugaugugcaugcagcccuucacacgcacacauguguacacucacacaagugauaaugaaaaacauuucaagggaccagugggacccaggcauacagggacucugccagaucaguggcauggguuucuucuggucugucugggcuggugcccugagcagaccuugggcgcaaauuccccagccagucucacaacacccagaggaagcuccacuccuaggcgcucuaacacauccaggaucucgggaucccaggagcuuggucacaccaggaugccagggucccagaggcagcuugacucccaggagcucugacacacccaggaucucaggaucacagagacagcaugaggaguucugacacaaccaagauuacaggaaggacaggcuccagucagauauagagagggcagguagcacuagagauaaccagauggcaggaggcaaguguaagaacagaagcaacagaaaccaagguuacuuggcaucaucagaacccaauucucccaccauaggaaguccuggauacaucaucacaccggaaaagcaagauucagaucuaaaaucacuucucaugauaaugauagaggacuuuaagaaggacauaaauaacucccuuaaagaaauacaggagaacauagguaaacagguagaagaacuuaaagaggaaacacaaaaaccccuuaaagaauuacaggaaaaaaaaaaaacaaucaaacaagcaaaggaaacaaacaaaaccaucuagaaucuaaauauggaaauagaaacaauaaagaaaucacaaagggagaaaacccuggaguuagaaaaucuaggaaagagaucaggagucauagaugcaagcaucaccaacagaauauaagagauugcugggcaugguggcacacgccuuaaucccagcacucaggaggcagaggcaggcagauuucugaguuugaggccagccugaucuacagagugaguuccaggacaaccaggacuacacagagaaacccugucucaaaaaaccaaaccaaacaaacaaacaaaaaacaaaacaaaccagaauauaagagauugaagagagaaucucaggugcagaagauaccauagaaaacauugacacaacagucaaagaaaaugcaaaaaacaaaaagcuccuaacccaaaacauccagggaauccaggucacaaugagaagaccaaaccuaaggauaauagguauagaagagugugaagauucccagcuuaaagggccaguaaauaucuucaacaaaauuauagaagaaaacuucccuaaccuaaagaaagagaugcccaugaacauacaagaagccuacagaacuccaaauagacuggaucagaaaagaaauuccuuccaucaacauaauaaucaaaacaccaaaauguacuaaaaaaaaaaaaaaaagaaagaaagaaagaaaaagaaagaaagaauuuuaagaguaguaagggaaaauggucaaguaacauauaaaggcaaaccuaucagaauuacaccagaucucucaccagggacuauaaaaacuaauauccugggcagaugucauacagacccuaagagaacacaaaugccagcccaggcuacuguacccagcaaaacucucaauuaccauagauggagaaaccaagguauuccaugacaaaaccaaacuuacacaauaucuuuccacaaauccagcccuucaaaggauaauagauggaaaacaccaacacaaggagggaaaaagcaagaaaguaaucuuucaacaagcccacacaaacauaauuccaccucuaacaacaaaaauaacaggaaguuaacaaucacuuuuccuuaauaucucuuaauaugaaaaugaauauuaccaauauauucuaaucacuugaaauucaaaaauaugaggaauuagaaauuuguuggcugucauccaguggccucucuaauuuuguaaaaucaauauacauuuucugcuuguuuguaugugacugugucuuacuguguaccacauaauggucuuggaaucauguuucuaucucagccucucuauuaguaggauuguuuauuugauguuuuuacacuauacuaugguuuucagaacagcuuacauauuucaaaauuauuuauacagccaaaagaaauguagacaauuaauuugggagguggcuuguaaaagaacaagaaagagugagacugaagguuuugcuugauauuuauaauuauucuaucaauuuugaagaagaggaucuuauaaguuacucuuuuucugagaugaaugcuuuucaaaaucaacacaaccaaugagccagaaucuuacccucaccuaaugucugugccacccuccaagcagaaccauuauucauugaaacaguugaugaaugacuucaugaauagaccaucuuaauacacacaccauuucuuaaaugaauguaaccaguucccugugggcugagaaugaugacaaucacucaagucaaauagcuuugaccauagcaggaaauauguauccaaauaauugugccuacaauucauuccuugacucagcagaacuguugacucuuagcuuagcuacuauggagguaaaauccuuuggugaugugagggacauugaaguacagccuuauuacaaugaacuccaaugucuaaaaauuguucuuauuuuggguuuguaccacaguaagagccaagguuuuaaaguucuacuaaaaacaaaacaaccaaucaaucaaacaaaaauacuuuaucuauuuauguucauuuaauaacauguccaucauuuuuuaugauugguauaaaaauauauauugugcugacuauaauaaaaauaauuaguucaauuuaaaaaaaaaaaaaaaaaaaagcucaugccagccccuguggcucuuugccugcugccugaggaucagaaugcaaagcucucaauuacugcuccgggaccaagccugccaugccugucaauaugcuccccaccaugacaaugcacuaagccucugaaacuguaagcgagcccucggcuuaaugcccuuggucaugugcugcaagaaauacuaaaaagaaauggcaaguucccgcacacauacacacacacacacacacacaaaaggaaaaaagaaaaaagaaaagaaaagaaaagaaaaagaaauaaaaagaaagaaagaaagaaagaaaagaaaagaaaagaaaagaaaagaaaagaaaagaaaagaaaagaaaagaaaagaagcauuuggaagcugguuuaagccacaugcugaguaaaugaagcugggaaccaagcugacuuuguagcgguuggcauggugcugcuaugcauucaaauacuaacuacuguaucccaagaccugguugcuccaacacgaguggauccucaaggaugaacuuuuaaauauaaaccuugccaccuaaauuauccauaauugguuaguaaagaugccuacagccugggcugggcagaagaaaggcaggcagggcuucaguucccaggcuuggggucugaggcagaggacacagcgaggaggagaagagaagaaggaagaagucgccaugggguagguggauugugagagcauggccgugagggcuggccagguauaacaaggcaagugauaucgcaggauuauugacagggaaguagacaaaauaccauagugggguugauaucugcccagcucuagugcuuuaagacuuauuauaaauauaaaggcuuugugucuuuuguuuugggaacuaagugcaaauaauauuugccacuacaugaccuggcaucaaaugacaggguuccugcaugaguuccugaugcugaaauucugccaguaugucccgcuaggcuaugcuuucaacaaggaaguacggaauggggcccacccacuacucaguacgugcaggacaugucauaggcaggaaucuauccagugcccaagucacccagcaucaccagcugugggaagauuuaccuucggguccgaguccagcagaggcaugagacacccugugucucucuguucucagucucuagaacugccucuucucucaguuggauuuaggccagcaggaucccuauggucuacaggggaaaugucuacaccuagcacucacaugagcagcuuaugaggacaagcgaguggcugggaagagcauguugaauuuuguugcaucaggguguguggaaaggcagggaaaaagcagccuuuguuuaggaagcagagccuggcaacugaagcuaagcaaggcacaugggcagugccuaucuuccugcugcugaagccacgccugccaggcucaacccagcagcggugcugguguggugacugcaggcucaugcacaggagaucagagcagaggggauggaagggcccuccaggaccaggcaggccacgcuuccaucugcuauuggggaaacugaggcacaaacacauugucacuuaugaacacuugacaagauguuuuccugagccauuagugguacauacuccaucuccacaaugcagaggucaggccugugaucucccuuaagucaggggggaggugggugaguucuccagugagaagucuucaaagaugugcccucugugagcauggcacccacugggaggacugugcugaauagcuggcuagaagagacaccuagcucagagagcuagcuccagaaaggcagggagauguugucacagaaagggguuguacuauuacagccacccacuuuuuggugguguccucauacugugcagagccagaaguaaacugggcccuaguguucuccuccuuagccaaccaauaauagggcaccaauacuagggcacacccaaugugguguuuguuaugugcaugcuuggcagcagacaagcauuguaauggaaguagaaaccacaggcauuugagaaacuucuucauauaauuuguuugugcccucaggacauccuugggcuugaucaccucuauuugauacuguauuacuaaugucauguccuacuguaaugucauggcgggucuguuauuauccaguucaugaugggcagcucagguuacaugguaacuggugaaccauuaucaaaccuucaguuaccacuaaagccaauggcaggccaagaacugucucucaaagagagaauagcugucugcagaugaugguagagccuugcuucaaaaucccaaagguauuuuuugugaucuguaggcuuagauuuuuuuucaaaaccuaguuuauuuaagguucuuaaaggcuucaguaucccuucuaacccaccaaccagagguaguggagaaaaacgguuaauaggaaaaagguguuauggaccuguuuagaaguaguuccuuggggcaauucugcucuuugaugucaagauaucaggugucuauuucaauaacaaacaccaaacaugaaucagcaacagaggcaugauucagcagaaaccgcaaggcucugcugaaucggcacaacucagcaaaagcggccagaaccagccagaauaccaugacaaguucuuuggcacauuucucucucugaagaccagugaagaccagcaaagaccagcaaagcauugcacagcauagcaaugcaagaccauccucucacuguuugugggguuccauuuauauucuuucuaaacaucacguauccucucaagugucugaucucagcaaaacaucacaugcccucucacaagacagcuuccagaaaaauaucacgcugacacaacugaguuguuaaagaaaccagaaauuuccacuuuagugaucuaccugccaaagauuccaaacagcaucccuaucugccacugauaccucaaauaccagucugauggaucacaugacccaagugguagagcagccugcagggcagccuggaucucuugaagagccuucuuuuguuccaggccccacacucaaagcuagcaguuuuccaacucacuuaguauuugaacuggaguaacauaugcaagugaggaauaugcugucuccagaauccaaauagacccacuagccaugugcuucuuucuuggugauagagggaccagaugcaguaacguauucuuugucuuagaaggaauaucacugcaagacccauugcacaggaguccuagaaauuacacugagguagaggaccuugaguuuuguuuggauuuauuucccauugucuuaguuagggucacuauugcugugaugaaacaccaugaccaaagcaaccuggggagaaaaggggcuauuuggcuuacacuuucacaucacaguucaucaucaaaggaagucaggacaggaacuuaagcagggaaggaaccuaaaggcaggaucugaugcagaagucauggaggggugcuguuuauauggcuugcucagcaugauuacuuauugaacccaggaucgccagcacaagaaaagccccauccacaaugaacugggcccucccacuucaacugccaauuaagaaaaugcccuacaggcuuaccuacagccugaucuuauggagguauauuuucaguugaagcucccucuuuucugaugacacaagauuaucuugugucaugugacaugaaacgagcuagaacagcccuccucugaugcguauguaucaccaacaaguccaaaaugguugcuaccgccugcucaccugguccaaucagcauaaagucaucaguauaguaaaucaauaugauaucuuguagaagagacaaaugaucaagaccccuuugaacgaguuaugacacaggacuggagcauuaauguguccuugagggcaacuagaaaguguguugcugaccuugccaucuaagagcaaauuacuuucuggcaccuuauggacagguacugagaaaaaggcaucugcuacauuuauaacuacaaaccauuuaccaggagauauguuaaucugcucaagucaggacaccacauuugguauagcaagagacuguaccaaacaggagacuuaaaagauguggucaccaggcagugucagcacacacaggaggcagaaguguguggaucuuugaguucaagguuagacuugguuuacagagugaguuccaggacaggagggcuacacaaaaaaauuaaaaauaaaauuaaaagaaauucaucuuuaugaucccauuucucuagaaccaacacugguaugaauuucuauaugaguugcuuuucuguggcuguguuaaaaugccaccacuaggggcuggagaguggcucagcguuaagagcacugacugcucuucuagaggacccagggcuacauucccagcacccacauggcagcugccugccucacaacugccugcaacuucaagaucugacacccucgcacaaacagacaugcagauaaaacaucaauguacacagaauaaaaauaaauaaauaauuuuuuaaaugcccugacuaaaagugacuuacggaaggguuuauuuugguuuaugaauacagagggaaaguccucaaugauggggaggcaugguggcaguaacggggaccugagauagcacauuuucacugcacauaggaaacagaugacaaacuggaaguggggugaaguuacaaacacuucaguuaaauaguguuuuggauuuauuugauguuauguguaugaguguuuugccugcauguaugcauguguacugugugugcuuugucauaauaggaccucagaaccccugcaacuagaguuacagaugguuguggaccacuguguggaugcugggaauugaacccaaguccuuagcaggagcaauagugcucugaccaucucuccacucuaagcugcaaacucaaagccuaccuccagugauguucaucuuccagcaacucuccaugcacuaaaaguccuguaacaucucugagcagaaucauugacuguguacuagguguucauaaauccacagaccugugagaacucauucaaaucaccacauaggguucucauccccaggaggaacuugugccucugucuucagcugugcuuccuuaagcacaaaggaaaaaaugaguggcuguuccaggcagaaguccucagagaacucugagaccugucucuccucaacaacccauucuccauguagcccagacagaaugucuuagaagaccuguuuggguaguuuaaaucacuguguggugaagaaguagguaggugauggguuucaugugucuccuucugccuuaaaaauuuuucuuuuacugguguguguguguguguguguguguguguguguguguguguguguguguaugugugugagugucuagucacuauggguuuuccaguggacuauauaucucugugaugauaucuaaacaaguugaaaguuugcuuagcccaacuuccucacugcauuuuagccuuaaccagauucagaagcuguucugauguagcauguauauucugcugaguuugacuguguuuagucauuuaggaacaggaacuugcuauguggcccaaguuguccuugaacuugugauucuccugccuuaacucccaaguguagggauuuacugacuauuuuuaauaaauuggauuucauugcugagguuaugguuaccaacauuugguuuugucuacucagauuuaugaucucaaugggcugagugugugugccuugggaggcaugugugaggcucuggcuucuauucuaagccuggaaaaggaagaaagaaaagagggcaugggaggcagugugggagagagggagggaaggagagagagaaggaaggaaaaaaguuaauaauuugauuacauuaaaaaagaaagaauaagcaacuacccaaucaagucacuucacagaauucugaggcuccaggugucaucuacccauggccugcagggucuugcacaaccucauucugaaacaccacucuuuccacgggugugccacuguccccacuucucucccauucccaguguucucaacuuuucccacugcuuagaauucucuuucuugguaccuggcccacuccagcucccaaaagcucagcccagccccaugggaguaaaugggcuuucagacaaccccagagccuugucuucaaaucccugugacacccagacacuacagaaccaggcuagucccacugugcucuuccuguguuucugacccaacgaacccauaagagcuaacgguagggcuagagauggcccauuguuaagagcacuggccgcuccuucagaggacuuggguucaauucucagcauccacauagcagcucacagccauuuguaacuccaguuccaggggaucucccacucucucuggccuucaagggcaaugcccagaaagcaaaauauccauacacaugaaauaaaaaauaguuaacauuuuuuuaaauuaaaaaaaaagagcuaauaauguuuuugcuugcuaucuuuggggggauuuuuguuacauagcauuggauacccuggccaucacuccucugacacaauuguuugcucacagaaucuucuuuguacccauccuuuaucagcacacaugcugauuucuuugaggaauguaucauucuuccacaaagacagauggacccaggcuggaggacacagacuggccuccuuuaccuaccaucagugucuggacuuauauucaauucauaccuccuccuccauguucucuuccagagaucuucauucuuguuuucuaguuugaugaaaauguugacaugcacacagggggacagaacaaaaugcauuauauuuccaugaggccagaggaggacaccagauucccccaaagcugacguuacagacaguuuugggcugcuuguugugggugcugggaccugaacucagguccuuuggaagagcaguagugcucucagcugcugagccuucucucagugacccagagggcuaucuauagagagaaucucuuauaagcaucaccugucaauaaaaaagccaaugggccaggcaaugguggcacacaccuuuaaucccagcacuuagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagguggauuucugaguucaaggccagccuggucuacagagugaguuccaggacagccagggcuauacagagaaaccuagucucagaaagaaaaaaaaaaaaaaaagccaauggccaaugagcugaggcaagaaauaggaggugggacacuggcagcaagagagaggauucugggaaauagugagagaauaaaaggagagacacgggagagauucaagcgagggacuaaggggauagacaggggagaugaagcuaaaccagccuucaggauagaauagagauccaagagagguguguaugugugugugugggaggguggggauguuggggguggacgacacugaggaagacacuaaagaagaagcuugccaggacugaaggagagguaacuaaccaagugguagacagaauaguuugaauggguuagguaacccaucucuugguccuuaugccucucucacacacaaacacuggggcaguucaccuggagguccaagggcucugguugucagugaugacuccaagcuggggugacuguuuccuuggggaucucacuggaaagggaugggacucagcuuuccacgcuccucuccaaccacaaugcuugcauuuccaguuaacuuugauuuuucucaaaugggcucccagcucagugguuagucuugguagccuguggaaacgucuggugggaggcaugcaguuagcacaggguugcuagccuguggcccucggcucguaggguagcaaggacuuugaggaauccuuggucuugugugucacagaaucuaucuaguccaggauuucucccauggcuuuggcugggagaugacuauuggcaagcaauccacuguugggggugggaguagggguuccugcaggcauugccacuagcaggaaagcaaauugcagaaagacaagaaugaaagcccaggacagugccaguuuugcagguacugggucaacacuuccagggacugacccuaugguuuauuuuccuuacacaccuaacauagaccaugugaccugucaccguuacaauaagaaugaauucuauuggcugauaggcagagcucagggcuagggucuagagaaggaucugugguaagcauaaggaacagauucaauggguggaagaugcaaaguacaugggcccucuuucauagggcuguguucuagucacuugagagacaaaacucaggauauuggggguuugggaaggcuggcucacagaagagcagaaagaucaccagguucacugaccacuuuuacuuugguauuucaggugaccagaugucauccaucuucuuccaaugaagaaaauaggcccaugugauugacaauccugguuucucugauguguauucugagcugucccucuuacacucuaccacugagcuauauuaccaggaagcgacuguugaccgcccaugcacaaagguggaaagugaccagaccaaggcugcucugaacuguauguggugaaguacaugccaaggugggucagccagccccagauuuggaccagaaugaggauguagggauacagaagcuggaagcaggggacaggaaggacuguggaugccaccagauguccuggagacagaacggacaccacauacaucacagugugguugagcucuacuguguagcacugguacuuucuguucccucucucaccauggcgccaucuuggcccccaccuucucagcggggucaguacuuagggguuucaucuccuguaaguuuugcauuaggcauaugagccaccuugagcucuucccauucuaucugcucugaaacaagguagacguucacauuuuguuuggcguauggauuauacuaguuuucugugccacagaaugagugaccacacucuuauucacuugauaaacacacacuugucaucuuaguuccugggggucuggaguuugaguggcugcagagccccucccaggucaccaccagacugugaccaugugguguuccccacugaggcuugccaacuguggugguuugaauaggcauggcccccacagacucaugugucugaaugcuuggccauagggaguggcacuguuaggaggugugaccuuguuggaggaagugugucacuagggcgugggccuugauaucucagaugcucaagcuacacccaguauagcacacagccucuuucugcugccuguggauuaagauguagagcuuucaacucugucaccagaagcaugucugccaacaugcugccaugcucuuugcuugccaugauaauaaugaaugaaacuguaagccaguccugugggguugggaagccauggagccuuggagccacggggaacaggccuggagcaagaguaggguagagacauguccgaaccacagaaaucucauccuguggaucaauucccccucugccccagaccuguguacucccugugcacauagcccugugcccucaccuccaccccauggaggucacuuagcccaguauccagguuaaacuuccucuccccuuaugcaaaugagguguccccagcacucuggccccagccaaugauguacacucauccaugagccgcuacccccuaaagguuuuaauaguguucccccccccacccccaaaugaacugucucacugaagcugucuccugagagacuguucuugccauagucaccacugugggaggucucauucacucccagccauuccugucaggauccaucaguugugaccuugggcgaucccaggggaguggagcuugaacagaauaucuuccuuuauaagaguugccauggucauggugucucuucacaacaauaaaacucuaagacaccaacaaagaauccacuucccugcagugguaagaggaagguucccggcuggucacaagccacccuccaugucuacagauuccugacagacccuucuuucaugagcuucccacauacaccagcuuccuuaucagccagcaaagagagucugcagcagcugcuuagggcaugauguaauaugcccuugggagugauaucccuaccacaagacccacucacacucagcgugugaaccaucagguugccauccauuuauagcuccuugccuuggggguucaccacgugcugaaaauaucuuuuuuccacugaccagucugagcacucagaaaaacaaaacaaaacuaugaacaagaacaaugugcacccguuccuacuccgauggccuguaugucugucuguuaaccaagaugagcccggaugaccgcuuucagaccauuuggaaaccagagaauuuaagucuuccuugguuguuucugcuuuugagggugguuggguuucagacaggggcucacucuauagcucaaacugggucccaacacaagauucuccugcuucugcauccauugugcaugguccagaguuaguguaacccuucaccaaccugcugggaccaugaguugcucugacugcuaagaacauuccucuacacgucuucuuucuccuaccuucuuuucaccaaggacuagaacagcugggucaagggcagauguggaucacuucuguucuguauggacuccuggguuuauuccuucuauuggccuucucugcucugggcaagaagagauucuuccaaucagacuagagaguagcaguuuucagagauuggcuccuuucccccauuccuggguuggaaccuuugcccagggugggggcuuguacucaguucugugaggcccuaacagggugggagcuaccacugggcucuagacuagccucuucaauggccaggcaccugaaaaccacaguccacccagugcugggccuguuucugaguccucuguagaaaucugcucugcccucagccagguugagagcguaucaacuccagcagcuagcaaccaaguuuaucacagacacaucuuauaucuauuggcugcuugcugccaucagaaagcaaagagguacuggcuaaguggguggccaaagccacugcccauaagaacaugccuuguacacuacacuuagccaugugucccugugccccugugccuguccugaaugcccugggggcccauagccacccaguccagcagcaguguggucacuuacauaugugucacauucugaggugacacacacuggggaagaaugagcccauaggaagccagagcugagcuggggccaguauuggguguccuugaccaaagaggagaugucuuguggaugacaggcagccauugcuacuauuggucaccuagucauucuucagugaaccucaggcaccucugggcuccggaauuucugcucuggacagaugguggcaauuacagagccugggaggacagaggaagagcaagcuugcuggcuggggcucggagagggcacugugaagggaccuggaguguagacuugcugaacacaaauccuuaaaauuccaaguuaaaaauauuaagcgcuguauguauguguggguggggugggguggggugugcaucauagccacaauacagccuucuuuuucuucauucucucuggucuaccugauggcacaagacucuaaccucucauacaauauauguuuucuugggaagcuguaguguugcuuuucaguagaugggcucuuaggaguucccucucggggcugcccaggugagaaguccagucccugggaaggaaaguccuacguggccacagaguuccacacaggggacuuguggucugccuugauuguacucugccugauucccauuuuaggguccuggucagccaugugcagaaggagcuagaaaagaccauugucuuuauuuuugaauuuuuucaagacuggguuucucuauguagccauuguuuguccuagaccucacucuguaaaccagacugaccucaaacucacugagaucugccugccucugucucccgagugcugggaucaaaggcuugcaccacuaccacccagcuccagaaaagacuuuuuaaagacuauuuauuucauguaugugauuacauugucacugucuucagacacaccagaagagggcaucauaucugcauuacagaugguugugagcuacuaugugguugcugggaauugaacucaggaccucuggaagagcagucagugcucuuaaccacugagccaucucuccagcuuccagaaaagacuuuuuuuaaaggcuguuagaaguccaggcugaagcagggcgugguggugcacaccuuuaaucccagcacuugggaggcagagguaggcagauuucugaguucgaggccagccuggucuaggacuauacagagaaacccugucuugaaaaaccaaaaaaaaaaaaaaaaaaaaaaaaaaguccaggcuguggguaucaugguagaagugaggacugagaggugaaggggacucuggcacugacacagucuuuuccucugggugucacugauguagaauguugcuuuuugauaauuuggcaagccaugugauuaugaucuguuuucuuuccuguaugucaguuaugugaccacaguuuagcaaagagaaauuugcuaaacugugauauuugagcuuugagagguaaaaugacagugguuuuugucuugucuuuccuucuuuccucuucuucccuuuccuucuuuccucgucuucccuuucuuucuuuuuuuccuuccuuuccuuucucccuuucucucucccucccucucuuucuucccucuuucuuuucuucucuucuuucuuccccucucuuucuuccuuccuuccuuuucucucuuuucuuucuuucuuucuuuuucuuucucucucucucucucucucucucucucucucucucucucucucucucccuuccuuccuuccucuuucuuucuuucuuucuuucuuucuuucuuucuuucuuucuuucuuucuuucuuuccuuucuuuuucuuucuuuucagcaggcugaccaaguauauagagugauuaggggacucuuuaagagaggcuacaucuuaugccaugaucaguagucaaucuuugcccccccccauucauuugcucugugugugugagauauguauguauguauguauguauguagacagauagaugauagauuguuaguugggcaugggucccaaguucuucugcaugcuauccaacagguagcugcucuaccccuagcuucacuucagaccucucacaaacaggaagcacacauucuuccuaccauagaggaauggcuucauccugacuaaccaugcaaugcacacaugaaacccugcaggggcgauaacccaucuccccugauaucccuguuaucugguccaaggcacccuugggccaccacauauuauugacaggccaagccacugagaauacaucccuggaacucagcagugaacguuggagaagcuacaccaguacuaccccucaacagcuacugcaguggaguggcuuggcuggaaacugaggucaugcucuuaguucuucaucaggugucucugaggugcagaacagaggaccagcaagggcuugccaaagagcagagcuuggagaucacugacuuuccauaggccucuaccugaagaagaaaagcaggccauagccaggucuuuuccccuaucuuuccagcuuuggagcuucugagcucuuugaaccuucuggaugcuuucugaucaagauaaagaacucucaacuccuucuccagcaccuuugucuuaguuaggguuccauugcugugaggagacaccaugaccauggcaacucuuauaaaggacaacauugaauuggggcuggcuuacaguuucagagguuugguucacuaucaucauugcaggaagcaugguggcaugcaggcagacauggugcuggaggaggagcugagaguucuacaucuugguuugaaggcagccaggagacuagauucuacaugggguggagccugagcacagaccucaaagcccacaccuacggugacauacuuuccgcagaaaaucacaccuccuaauagugccacucccuauggaccaagcauucaaauacaugagucuacgaaggccaaaccuauucaaaccgcccugcuuaucagauugcuggugguuguggacauccagagccagcaggaucaauacacacuguggucgauggcuagguaagguaaugaaugaguuuagugaacagacccaacuguacccuucccuuguuucuuucuucagaaauugcccuagaugugacuagucauuucuuccagaaugugaggacacagugguggggacagggaucaggaugagucaauggcagccagccacagcaggugcugagagccagcuucaagcuugacacccaguccugacugcagugcugucuccuucccaccucuucugacagaaucucacuuuauauuccagucuggccucaaacuugcggcagcucccuugucccagcugcccaagugccaggauuucagguaugcacagcugcgauagcuugcagcaacacuccaguagggcaauguucagcucugagggcaugcugggaucugugggggcaguauccaugucaucaagccuuccuuccagagacuugagaggcugaggaacuuucucaaggucacacagcacuaggugugucagaccaggguccacauauucacaacagggccauucuaacugccucguuccuucccuccagcacugucucugugguuuguuuuggguagaagggacucagagaacagguaaagugaccugcugcuauagcccuguaggccacucaggaggacccuucuucgugcagccuguuuaguuacugcaacuugagacugauccaggagucagacagguggccgaccagugcaggccugauucccuuugcugggucugaauccagacuguguggauaagcagggcuagcuguaaaccuggagagagauggcaagcaaaauccuagaagcugcuggcuacgguguagaguucugugauuugcagcaaaacccaccaaacaggaagcaggagugucaauuccagccccugggccacgucucuggcacuggcuguaggacucuggcuuagcuuucccaagaagucacccccggccuuggcagcaccaggugucuagagaauagaaaccugaacuguuuuuagaagaccggcgaagcaugguagcccucaccuguaaccccagcacuugggaggcugaggcaggaggacuaccauaaguucaaggcuagccuggacuauagaccgagagggucuaaaaaccaaccaaccaaccaaccaaccaaaaccugcugggcauggcggcacucaccuguaaucccuguacuuaggaggcugacacagaggugggaggaucguguguuugggaacucaacccaaccccaccccacccaacccaacccaacccaacccccaacccaaugacauaaugugcuccaggccuccucccacagcacauagggcaguggaggaagccuccuaagauagaggaggggaggggcacuagggaaguuggugggggcggggcucacucaagcaggacacacagagcugcauguuggcgcacuccuguugugcugcucgcacacaucuucgggcccucccuggacauuacgcuggaugucuuacaucagcugagccugccaugcuuugcuaaggacagugaggcgcuucacuaggagcacacacgugaucucaagggauuaauuccaacaugaaacugcuucagcaacagagaauccugggccuggugacaugugagaaagcgcuuccuugacaaggggagcucagaaccucagggccaggagucucuugaccaugcaucuuccccaugguagaaaacggugccaaaggcugcuauggaucaccccucggcuccaacuagcaauggggaaaaucccaaggaaggcugucaggagaggcuugggccaacugacugcucgggaugguuccaucuggucaggauuccagggcuaggcaacucuguccaggaugguaugugcugaauuccucccacccccaccuccaaagggggacagaucgagccaggcaauuggacccacccccaaauugaacaaaggugggucccgucucugaacacgaucaccauagauccuccagggaccucuugccaaagccgcagucaagaaagcaccacccuccagcucucacuugaacagacauuuauugagcaccuaccaagugcaaggcacuuuuaggugccacaagagauacagagugaccauauggucccugcccacgaggagcucacagucuagagggaggcaacacaguacacaguuggcugcagcuacaccggccagagugguaagagccagaagcaagacaccaaauugccauggggccacagaauagcauagagcugcuucugcucugaacacaaagagaacucagggcugggccuuugaggaggcaggcuguagggaagaagggcaugucuaugagaggaagaaacaugaacagggccuauggggaaccuagaucuggguggcuggaguaaggaucauggcaagagaaagcagacagucaagugcggccauggggcagcagccgcggacacauggcucagaggguaggaacgugaugcucuggucgaagaucacagaggaagaggaugaugcaaaauggcccucuagaugaacuuggaguccccuggaauuagggagagggaagagcuguaagguagccaaugagggagggaacggugucacggaggauugugggaacaggugguaggcaguagcaagccaagggccaagaaggauuuaagggaccucagaguuaggugagagauggcaggaugcaggcugagguucugggagccaagaucccacaggguuagugagaggacuggugucacagaguggaggguagucaggagaguggcgacuccuaaggaaguccaguuccagaccaccuaccagggcccugcacucaaggcguguggcagugacaagccaccagcuuuccucuaaagcacugaguccaucccucagggcggugacagauugacagccugccuuuuagcaaggguagcaaggguugcccuuuucucuguaagcccaaggggugguucaccuugagagccaccugcugagaaacugaauuaaggcuaggccuucaagaagaaaggaauggagcgcuucaagaaggaaaacagagaaagggaggccaauggcuuugcugucuguagcuacuccauuaaugaugaaauggcaaccagugauuucccaggcuacucccauguggugggcagaagccaaguuuccaaaucugggaggggaaagugggaagccagagagaagcauuagcaacagaacgaaggguguuuuaacuaaagggaucagaggaaccaaguaacgauucgggcgaacagugcaacugauggacccagcugagguggcucagaaugcugaggagggacagcccuggagagguauggggagcaggcaagggccugggugagccuggugcagagggccugcaguagaugccccucccagggggagggcuagguacuugggacuggcaaggagagguggagcucucuuucaugccuaacauguccuagaaauacagcugagccugucaaccacacuggaccaggacacacacacacacacacacacacacacacacacacacacacacacacacgacaccuuguccaaugaccaaagguaucagccuuagcugcacuggccgccucaaccaaaugccaggauacacaggaggcagaggcacuccacacagggaggaauuccaagacgcucccaaguucacugaggaggcacuggagggauggaggucaagcaucuacaagcaccuagcagcaacagagcuuuggaugaggcaaagaagcaaguugugagcuuucuucaguggcuggauaacugggcuguaaauguuauaccuaaaugugacagauuucacaaagaaucuagaauuauauuucacauuauaaucuacaaaguaauuaaugccuuuugguuuccuccagcuuuuuccucccuccuauauggggcaaggggaaaugggcagguaucucucagaaacaauacuaagaacacagaggcacacaacucaaagaucaggcuagccgaagggccuuugagagccugugcuccucaggccagcaucaggcugaggcagcuauggaguacucccggcucuccugguucccagcagugcugggcugggauugaccacaccaggaagcccuggagacagcuccaccuuggcaccuuugcugugcucccaagcugaggcacugggugggggacuguggugggucaacuccuggggcuggccagaagucucuguucuguacucacacagccugcaggucugaaacccccuagggacagaugacaaacagcuucccagcaggcuggaucaucaacaaauucaggagagaucacguaaguauggccaccuagaaggcucuguucaucuccugaugggugcagggaccaaaugaaccaagacacggcaugguggcagcauucugugaucuacacagucccugcacuacggauaacaaaccagcaccaaguccacgguuaccugcgggaccgggagaacaacaauccacagggcagugaauuuaaccacaagggccuggagacugcauggauggagaacacaaagcccuuugaagguccaggugagagccaagacacuaagaaugaccaggaggggguucacagacacagacuucaagcuacaccgagaagagacaauacugagauaacugguucugaaagacucaggaauugcugcuaagaaaccucuaaguagacaaaagaagggaaaugcaggggcuuugaggcccuucugaaaggacuaaugcuauuuauuggcuugggucauccuugagaauagaaaacuuuuuggcaaagcuguacaaacgccacaugggggggggggggucuccucaccagaggcuucagugccuaccuugucuucugaggcuaagguagcuguggagccagggugggagcauggcggccauggcuggugagugcacuacggagcuacgccagucagggagcaugcuggggcuguacguccucuaagacuucccaccugcuccucagucugacuuugucuggccacuggugacagcccgggugucagaugccaucuaguggcuccacuucuucacucucauaauggcucgcugagaaggccccacaagagcagagcaggcccacucuagggaugaaggcaggggagcacacgccauguuuagugaacaggacaaauuaccucaagaaaauagacuuuaagaagucuugcuuuccuuaaggaagcaacuccuuuuuuuuucuuaauuuuuuuuuaaaauuuuauuuagaaaggcuaaccauauuuauuugucauuuuuucuucagcuuuaaggaaaauaguuuaaaaaacauaaaacuguaaauacacucaagaguaacugcuauuaaacaguucugaacaggcagaaagaguacuuuccuuuuacagaaaacguuaagucuguaauagcagcauaauuuauauauagaaaaaagcuggcuuugaaaccccagacuuuuguauacauaaaacauuucccuccuuuuucuauacaacacagcaaugcuuuccgggaaggcuucuucacguuaugguccaucccacgguuggcaguuccccagcaucagugggcuccagcccagccgucaguccaacaccagggccgacagggcauucaggucuuucauguacggaugagcugccaggaucuggucgaucuucagcuuuugcucagagucagggaagaucuuuagcagcgccucccucagcucgcuggucucugcagaagaucucugugcuggcagggguggguucugcugcauacugggaaggguggccagagcugugaagugggacugcuggggaagccaagggcuugaagaggucuggauccgggguggaggcugguggcuguuguuggcuaccugcgugcugggacuccggaagccagggucaaaugugcccacacuuggcagggcauugaguagcggcugcaugugucuguggaugaagugagagggacaguaagaaacccuuucaaagcgccuauggcuaacacugaaggccuagaugcuaguuccaugguuucugaaggccugaggagaaagcuaugggguggugaaaucagcccccuaagaguggccuauagggcaucugguaccauuuccagaaccauaagggaucgagcaucccuggauuugacaaugccuuaccagucuuuugucuuagggcuggucacacucguuggguuguaugcagggccagcuuacagagcugaggagaggcaccucucccugggcacagagauaaguccaacaggcucauggacuuccugucuucaacgagcucucaaugcacaugcacauggcguaauaugugcauacaggggacaucuguccugcucaucaacucccaucgagucuagcugcagcugagagcugggacaaacagugcugucaauuccagaagcucaacagccuacaaaagcuacauuaacuuuaauggcauccccucaugaaggagugauggcgacuggccaccaagcacuuugaaaacgacaauagaugggacugaaaaugaccagaagggcugauccucucaccaggcuacugcaggagugaagaggcagccaagaaugcgccucuagcuugaccugggccuuggcucaguauggggcccacacagagccuuaaacacaggacgugaggucuaaaaugcaaugaggauuuccaauauaagacauggaguagaggggaagggagugagagcacggcaggcuguuaucuccucagugugggccgaugacccugucugggcuuaacaccucaacugugauaaaacccaaaggcucagggagaaaugaucacauuaggaaacugaacauaugauggucuccaugauagacuauccacuauuucuccuucuaugaaaaucaacccacguccgugcaccaucaaguuccacuagauggucccccaaaggcacaaacaacagacuagcagccuugcaagcugggagagugugugccuucuccuuuuaggcacccagcccaacucuaugcaaaaaucugcuagaggauccacagaaauacagguuauuuugguuuuaaagcagagaaaagaucugccacuaguuagcaugaaagaagcugugguuaacaaggucgcccgagaauucugcacacaggaauauagaaccuucacuugucaggcagugacagacaaauacgcaagacaggcuucuccauucagugauggugaacuauagcugucugcugucuagcagugauuucugagcagaacaugaguucacaucccagcacugcacacucaacuccaccaaguucacagaaaagcaucccacaaaagcaaucagacagcaccgaccgaagcuaucaccaacaugaaaaucugcuacucagagaccuucaagaaaaucuguguugucuuagacuaaaaugagaaggagccucacacagggcaggccuggagccccaggacucaggaggcagaagcagaaggaucagaguucaaguucagcugacacagaaauggucuaaaacaggcaggcaggcaaaagaaaacugaaaagcacauacugaagauuaaccuuggagugucugcuugauuggguuccacauuggucacauaucaugaaucuaauuaaggcuuuaaaaaauauggcauuucuaguuauuaaggacaguaucugcucugaaguguaacauucgauugaaauaauaaaccuugacauacagggaaggcaaauaaauaccuaagaaaggccuccuuucgaagaaauucuucuagccgagguccguuucuucccagagggucaucaggaaccauaaauaugucccccacgaacguguacugaagcagucuacaacauagaaggucacagugcugacaaaugguacccuccacuaguguaggaaaugggacaugucuuaaaguagccuccccaucuuggggcaaugaucagucuaagagugaugacugcuaacugaccugacauacucaggugaaaucagugucacuuggguaggggacuuuucucagcuggcuguguacccagccaggcaucuucuacuagaggagaaacaugguuaaagacugucugcuugggacccagcaggugugccacaaaggucuaguuuaagugaaacuggaaacaaauguguuucuaggcaaaccucuggaaacaagguccuagaagagaaccccaggggcgagcauguguuacucaucaaggacagguuggaaccagagccugcucggcaggaaagccuggccugguacaaccggggccauggguucuaacaccuuacaaaaaguaaaaaguaaaaaauuagcugggcauggugaucugugcucuuaaccccagcacuccaaagcagaggcaggugagguggagcccaccagagcuacauaggagauccugucucagacaaaugaauaaauaagaguaaaaaaaauccuauugugugaugucuaccauccaccuuuuuguuucugaguugcuucucugacgucuagguuguuuugagacccacugcaauuaaagcauccuugugugcacacacagcagugcccaagcaguuuaacagcuuacucaucaacugugcccaccaggucagagaccaacucuccuccacccagcaccaagaauuuguagcaacacagaaggcagaauguagacagcacuucccuuuuaucccacaauuccugaccaagcucucucuuucuguuaaguuucaaguuacacuguuuacgugucugugugcgugucuguggagguuagagggaaccgcucuucccgagugugguuccaggcucgggucucagguccucgggcuuugacacugcucaucagcccaagccaaacuuuuucaaaacuccucuuaggauguggcaagcuauaaggauggauguaucugacaaagaacaacugcgaaaccccaagagaaacgaaugcagucacauucacuccaugguucguauuugcggugugggcaugucugguuuuuuccuggagccacagcauggcucuccugugugaagcagcugcucaggcacgcaggucuccuuggggcccgggaacucaguguucacugcucugcaguagcucagccacugaacacauccaaguaucagcaagaaagccugcaggcuaaacucauggaaaacaccagacacuggaacuaaaacuugacucaccccuguacccucaguuagugcccccuuugcucagcaaaaugugucccauacucuugcugugucacaguacuccaggugacaccagauacucuuagcagguccacccugaccuuuaccggggccaccacccuggaaagcagaaaugcaaacagcaaacuucugaucaaaacaaagaagaaaagauuaccuuuugguaauaauuucucuccaggacaccgacucggucacaaacucucugaaguuaucguuuguuacaauuauacccccagucuuguccgcuaagugcaguagaaaccuacgguaacaagaggguucaaaaugagcaaagaccaggccuggcuggagccgcugggucaaggacaugaaaggguuucucaaucuccagcugaagccaggauggagaguuaggccccugucaacugaaaauguucaagugaugaguaucucugcaauuauuaaugugauuauaaaacaacuuuucaugcaauuuaauucuacaaaaaugauuuuaacuaugaguccuacauuuccuagaaaaguuccugcaauaaacugugguaagagugcacgaaggcuugagcgaguuaaagguaacagacaggccugugaaaucucucauuuuucagcugcuuggcugccugaguuuaguucaguguuaguuacuugauggccagcugugcaguuuuaaaagcaauccauuuucugcuuugccuuaagaagacaucagucagacacccuucaguuuggcuuaaauacagacagacucauucaguuauaacagggcccaggguggugaaaagguuugcauuuuaaaaacaguuccuacagugcuggcgaucaaacugagggccugacaugcuagguaagugaggcgcaguagagaaacuaccagggugaccgcucaguggcuggggaggagggggacagccagaggcauuugguagaguccagagaagagaaaagaugcauacgugcauagggcuggcucgcucucucucucucucucucucuuucucucugucugucucucucucucugucucugucucucucucucugucucucucucucucugugagugugugugggggugcuugcugccuucgagcuagcauaguggggggggaggggagaaagaauagccauguuucuagggacuggaggaaccuggcacuuacuuagcuucgggcuuuuguaacuacaaaggcaagggaaguggcccucucuggcaggcagggaugcugugugagugagcuuuucuaucuuccacagcagucuuucuaaggucagacuugagcugagccaagacugucaggagaacggagauccuuuuggaccuaucuaucacucacucccagccgcgugcgcgcgugcgcgcgugcgugcguguguguguguguguguguguguguguguguguguguguuaaaucucccagguuggccuugaacuaaguaacccaaggaugacucuaaccuuccauuuggaccuaucuaucacucacucccagccgugcguguguguguguguguguguguguguguguguauguguguguguguguguguguguguguguguguguguguguguguguguguuaaaucucccagguuggccuugaacuaaguaacccaaggaugacucuaaccuuccaauccucuccccucuaccuuguggugcuggauggcaggugugugccaucauuccugguuuauagggugcuagggauagaacuagggccuuaugcugaaagagguaagagugaaauaauaaagaauagugucguacuguggaagguuacuccuguccaaacccucucaaaaucucugugaguagccaggcacaguagugcacaccuccaagcucagcacuugugggacagaggcagaguuaaccugugaaguccaggacauccaagacuacacagggagaaccuagcuaaacacaacacaacacagcagaacugaaaccucuggaguugauagaaauguuauuucuugaaugagaacaaagauaaugaaacaaaagagagaccacuggccgcaaagguaugauggccauccaucuuagcagucucuaaguaugaaugacugcucuucuuagucaucucuaagugggacucaaacaacucaacaguuuccaagaucucaggagccuuagaaaauguucuguuuuuguuauacuccaucccacccgccucaucuaggcucucacauauuccaggcuagcuuaggauccauuguagcucaggaugacuuugaauuccuaagccuucugcuucuaccucucaagugcugagaucauggguuugaaccaccacgauuggcugacuuccuuauuuaugaacaauauacauuauaguuuauuuuaaagagcauaaauuucaaugcugcuaucugcccaaaugucaauaaaaguagauaggaaggcuucucucauauccacugggauacacacccauguucucugauacccagcgggcuguguaagucaagcaaagccuccgcuguaugucugggccugggucugaguccccggcugugagaagaaagcugagguggucgucaggaccugaaggcuuccugccugaccacuccagggcuccugagccugugacaggguccacaaagaguccuucaggacagauucccagggcugcuccuaacccuguccauccccuguucagcuccaaccacacugcucucugaaggcaccuuggauccacccuaccuaacacagucucuuuccugucagugagugaaugucuacuguggcccuaacucaccucucucccauuuaaccauauaccagcuuggauaacaaagcacugccuucccugggaggaauguggaaaugggcagaauaacgcuaagaagggacagucagccugagggucccagaugccaugcuuauuccuccagacacgacagcacgagaacagaguuguaaaguacacaccacagggaaggguggaaucaaaauccuuccuuuugggggugaggauuucaccacguaacccuggcuggccugaaacacaacagaucugcuuggaucuuugaucuacagagugaguucugggccagggcugcaugguaagaucuaaucuccaaaaagaaaaucagccaacuacacauaccugccuuuucucaucucagacaugcuuuaccaaaauaacaaacucaaagcaaaccaccgaaguuucuuuugugccauuccuaaacuuacagaguaucucaguggucuuggugaugagucugaaacugaauuaagcaguucccuucagaguacagaccuaugcaguggacagguagcaggcuccuuaccaccccacucccaccuugggaagaaaaacagcccuucauaccugucaucaugagaagcaauucuuucuccaaagaccauccgggcaggaguuaaagauaauauuccaagcuccuggagcuggguuaagaagugcuguucuguucauggaagaaguugauauguauucagcaaagacuaucuucccagauguguaaauaaaugaaugcaaacccaaauauuucacuuggggacuuguagaaagacucuuuuucccacuuccucaacuuuacuaacucaccaaaagaagaaaaaucacucacacuaaggcaagcccagcuuaugaacugaugagguagauuuuaaagaagcuaacaaaauguuaaacucaacugccucuaaaugacaacuaaaccagaagcccccaagaacuuucccaaaaggauauacuguaaguagagcauaaaaagagaaaugacaagagucacccaaagugggggaaggggagggggagagcagucuuaaauaggggguugcgggagugaacugccauuguuccagauaagaaaggcugcucguuuuccagccuggcugcagcuuccucucuugcucucagcugucuguauaagcauuuacuggauuucacaggcuugaguagugacagaauggaaggccaguggaaaagcagucacaggcaagagaagcugagagcuggagccuaaggucccugugucugcaucucuuaccaaagcggcugccagugcccugcccugcccaauggagggcucccugccucagagcugcaugcuguguaagccgcauugacacuuagaaaagaaaggaguggaucugccuccuuucuugucgaucuucucccaaauaaaggaagcuggaacagucuggaacagccaucucccuugugucuaaguuucacuucuuguuccugugcuagacaaaucuauaaaacacacccaccuuguuuuaccuuuccuuucuaggugccuggcauagccuuuucaccuaagacaaaaacaaccuuaaguuucucuggaauauuucgcaauuuauauucaauuugaaucuuuuguguggggccuguagguuagccacaaaguacuauauggcaaacagaaaugauucauaguaagccaccagacuacugaaaagacauauuugaagguucucaucuuccaagcaaccacuuaaaaacuauuauuuaaauucucagaagcacacacuaguggagggcauccucucuagcggaugugcuaggucuccgcccuucccaacuucuuauacuguaacacuucucaacugaggugugucuacaccaggccugcuaaaaguccuacuuuguagccaacgaugacccugaucuuccugaccucugcccuucccgcuccaucucccgagcacugacaccacaggugugcgcaaccauacagacuuuucgauugcuauuuuaccggacacaacuaauuuagaauucugucauucaaguuguggcccaugugcacgauucuauucuaagcaccauauguugaaauuugaagcauuaaauaucuagccagaaauauggaaagaucacugggccucaccugugauauuaggaucccgucuuguucuccacugugggacaaacacagugauguuccuguugccgagcuuccaaaaauacucaacugcaauugcuauuccacggcaacuaaagaacuuuuucagaccguggcuggaaagaaggacaauuucuuucagguuaaaguguaaagaaaaaucuagguuuuaccacagaaaagagcaacuauacauagcaaaaacaacacaaacacacuuuuacuuuuguuguacaguuugccaaguuagaccugcugaccaagccguuccugcagcuuagucagagcugaaggucuuuucccucuacgugacaggcugaguauacagcuuugguggagaguggcaggcuugcugaauaccuguuuacuaucaugggucuuaaauguacucugcuggggaaauauccuguuccuaagcucugucuaaucaccggccucucagaacuuuaacuucuuuuuugagacacggucuuuauaugucauugaagcugacucaaauuugugauccuccugccucagucuucugaggucugagauuacuaauguuaccuccauggagugacuacacuggugguggugguguuuuacugugugguggaucaagccuaaguccucacacgcuguuagcacucugccaccaaucuccacugccgguguacaucuuagaauuucuuaugaauuugucccucaagcaaaaacagcucaguagcugugacaaugcccgugcucugccuuccugugguugaggacaggaauaaagaugugacucugccaauaccacauacccaauguugcugcugucucugauggguguuagguacaccacccacuuuccagggaacugagaaguuuccaaguucaaagcuuauaaagaacaauuugaaaacaagaaucaaaugacuagggccacggggacuguacugaaugaagcaaaaagcagagaaacaagcuggaaccuuccaucuguaaaggucaccaaucaacccugccauagcaaugugacaacagccacagacagcuguagaugacaaauauggcugaguuucugcucguaaaacagaaagaggcugcacucagcccagugugugaccuccugcuacugaaguaaaaaaaauugcacccucaaaucuggcaguucauuucaaaauacaaacacagaagcuagaaagauggcuccuuggguaagagcacuugcugagcuuacaaagggcauggauuucauucugagcacccacauggcagcucacaaccaucuguaacuccagucccaggcaaucagaaacucucuucugaccaggcauguacacgguacguauauacacaugcaggcaaaacacucaugcacauuaaaaccgcagguacaaggcucccuccgaguacggcacgggcagcauggugcacgccacauguuuucucaaauaaguuaaguaaaugaaugcagugaagguaaacaaacaaaacgccuucauuuugucucaggcaguuaaauaaagguggaggagagaaguccuuuccacacacauccccugccaggguggcguccagguccuccaaccucugacggacggacggggucagagagagccagcaaaggcaaaugcuccagaguacaugcgccaggcgcguucgcccauccucuggcugcuuaagccuccaccuucccuccagcccgcugaaggcucagccuugugggaagcaauccuucagaagacccuuucugaccuuucaccucccagcuuucgucuauugugagugcaagacagaauggccugucucgagcauguggcuagcuggaaaguggugugcuggggcagacucaaaacuuccccacuccuggccaaggcccucaugcuauacuauagaauucugccaaccccauuugcauuccugacccuugagagcuauauacaagguugcaaugaauagcucacaguuccuucucucuguuagaggauuaaaguccacucauuuuuccagagacccauaaagaagaaacugggaucagaucuuauuuaacaccaaagacaggccuggaguuaagucaaccaguucuaacaugaagauuccaaaucaagagccucgugcuuuuuuaggaaaaccuguuuaguucuccaaaaccuugaaaagggucuccacguuauucaaaacagauacacauacacgcacacacgcuacccuggccuucugaggcggcgacaaaguuucuggaagcacuaaugcugccccaguuuucaguguucucugugguaagaucacaacauuuuuuuuaccuugaaagucucuagcauuaaaaacagugguucaaaguuuggguaagugaguagauagauuuaucuagaaaagcacauaaaaaaguaaaugggaugaagcauuggggguguggucugaguuuaagccucagccccagggacgaaaaaaaaaauccaaucaggugaagccaaacaguuguccuaacaguaacuaguccuaacaguaacuaguccuaacaguaacuaguccuauaguccaguaagaguucucugucuaagccuccucccacuccaccggcuggguaagugugcuugguccuugcugcuucugccuuugcaacagagaggcugguggacaggaagugcagaccagcggucuacccugaccuagagagcauacauccaagguguacagaauacaauaccuucuacuuugggggccaaagugugacgcucccagcuccacaugcaggagaguagguguaucagcucuccagagagaaggaauuccuguucaugccucuggaaacaaaugaccuggcuguuuuucacaccauagcagccagucaacaugucuaaggcagaggagagcuagguaacacuagcuagagcagugaucaucaccccaggcagggcaguggcggggaauaguggaaagcccuuuccgaguuaacccggacagcaugacuuccuucuggcuuccacuuaguaaaaacuaguuguggaacugcuauagaaagaccagcaacgcugggcgugguggcgcaugccuuuaaucugagcacucaggaggcagaagcagaggcaggcugauuucugaguucaaggccagccuggucuacaaagugaguuccaggacagccaggacuauacagagaaacccugucucgaaaaaaaaaaaaaaaaaaaaaaagacagaccagcaagaaaguggacagaauguacaguucugacaagugaacgggcaaaccccaucuacacggaaaaucaccaaagcaacaagucaggugcucucaggcugggguuucagacgccucugugaugucgagccagacaccgcaaacauguccacugacucacgacugacucauucauggugacaagggggaaaugaaccaaaaaccuacagagucagcagcauaaggcagguguuuuggaauuucucaucauauacaugagcugcagacaucaugucagacaaagaaacagcaacccagggcagacaggggaguucccaccaggauacccugcuccugguggccucagauuuccuucucaauuaagacagcaaaugggugagggucccucugaagcaguuaugcauccaauguugauaaggucugaacauucuaauuuuaacuucuggcaggccaggugcugaggaaagacuuuauggcccccaagucuaggugugacucugggaaggucauggaagugauaccaaauuuuugcuccaaaaaacuuguaugaagauuccaucacacacacauuaauaauaauaguaauaaauaauaauaauaaugaugaugaugaugcacaaggcugagaaugaaguuuuagaagcagaauauuugccuaguaugucuaagaaucaaaguucaauucucacacagcagugccaaaaaacuuaauuuaaaaaacaucugaaccccgucucgaaaaaccaaaaaacaaaaacaaaaacaaaaaaacaucuggucucaguuaaaaugaucagaaugacaaucaugucaucaacauggcaggauauguuccauacuaaauccuccccagacacuggaacaccccaaacaccacagauuuucuaacacuuggauauagugcugcucuuuuugaaaaacaaugauuaucacuuaaaucaaacauguauuaacauacauguuuaguauuauuuguuugcuuguuucugucugugucuguguaugccauguguaguaacagacaguugugugugaacaaucagacguggaugcuaggaacucagguccucuggaagaaucacacauguucuuaacugcugagaugaauuguuauuaccaucccuauuauuuuuuuaagccugccugguugacauuagcaggccagcaaggguuacacaguaagauccugccucaaaaccaacagggcagguguaauggcacaugucuauaauccgagcacuuagaaggcaggcuagaucuuuuuugaguuaagguuagcuuagucuuuacagcaaguucuagaccggcaauacauggugagaccauguuucaaaacaaaaaacuacauaccaaaagcuacaagacagauguaugaaucuuggcuguacaggcuuauaaggccggaugaaggaugacaaacaagcuuuguaccaaaaggaucaaacugggccuggcccacuuguggaccacacugcugccagcagccaugaauucugugcuacccuacagcuaugcuaccaugagcaugccaggaacaguugcugcuggaggccccucaccaagcacaccaaguucaaaggggacaggaccuaagaaguguguggcuuugcuccccaucagcagugagcucuguccugcugccaaggacaaacaggucccagaguucaucaagaaaaggauacacccacacugaaagaaggggagagauacugagcgagaguccuuaccaccaugaggaaggcagcugcuaagucacaaaguccccuuuguccucugaguaagaaauaauuuccagaaaacaacauggacuguaccugagacacauucugaaguauuuacagaugaaauacuuaucugagauuuccuuacaagcacccaaagggcuagagggggcucagcagcagaaugcuguccuaacgagcagaaagccugccuuccauccccaauaccacagguaaaauaaacagaauaaaacacaaaauaaguaagacagaugguuuaaagugguagguaagaguacagaugaaacaagauuggucaugaacuagcaauuguugaguaaacccaugaagagucuugcuuuauauuuguuuguaaaaauuuuaaugaaaaaaaaaaaaagaaaaacaaaaaaaguaguacuagagauacugcucaggggucaagagcucugcucuuucagaggggcugaguucaguucccacaccaacagagggaggcucacagcugccuguagcucugacuccagagcaggcagugcauuuuucuggccucuuuggacaccagcacacauguggcaugcauucauauaaacacgcaugcauacgcaugaagaagaagaggaggaagagaacaacaacaacaauaauaauaaaguagguggcuggagagauaucucagcaucaaagaaaacuugcuacuccugcagaagacuugggcuugguucccaguacccacacaguggcucaaaagguaacugaaguccuaaggaacccaacacccuuuucuagucuccguggauaccagguaugcacucaauggauauauaaacaugcaggcaaaacucucauacacauaaaacaaaauaaacacaugccaauaauuaacuuuucaucccuguaauagaaguacuaggggagauaggccaggaggauuggucagcuagccugggcaacuuaggaacagcaccucaaaaugaaagauggagcauuugggagacagugggggggggggggggggcuugccucacucaugccugaacaugaauaccagaagaagaaaaaaaugccauagguauuccuaacacuacaagacaugaguugaucuuuuaggauuccuagaaagaggccauacacacauucagcagcacagaauauuauucuuaggauucaaugccuguaggagcuggggaugauggcucagccaugaagaaagacuugaauuccagcacccacaucagguugcucaguccaccuagaaccccagcaacagggaucggagacacuuuucuagccccuaugugcacuguauuccuguguacaaaucaacuuucagacacacagacacacuuaacuaaaaauaaaaauauuuuugaaagcuguuuuugagggagccgaggcaagaaggacuacaaucagcagacagccuagcuccacgacugucucacaauggaaggcagcuccacuucuguacuggggauuuaacaguaacauagauuucaaagucuaauucauuuacagcuguauccuaugugcaauggagcaauguguaaugugaaaauauauugucucuaccgucucuuacccacaggaauaggguaaagagaaaguucagaagggaaagaccaacuguaguggguuuggccuaaugcugcuuguagcuaauguuaauuucagucccaagaauuguuuacagggagagucugaacauccucacguaagacagugagggacccuaccccaguugguucugacugguaaaaggaugcugggcagccagugucugggcaggacaggcagaggcaggacuuugacugggaggaggagaaggaggaaggagaucugccgggacggaagagugugaaggggaggagaggaagagacccgagaccccugccugagaagagcgcaggacggagaggcauggcugucaugugaaggagccgggagagcacggcccagcugggcagcccuccgggucccgagcagccaagauaguuugguaaguaauaccucgggaauauuggcgggaggugaauuaaccgcauggacguuaggaaguggcccagcuacugugcugacuaaggcauauuaaaauauaaaggcgguaugugacucauuugggaacauaaaccuuguugggguggguaucaaugagccugcugccuggauuuauuuuguaaacaauuauuucaaaaccaaaugcaaaacuuuacaagcagcuggucuucccccaagaaaggaugcagauucacuggaacacaaaggacaguccacacacacacacacacacacacacacacacacacacacccucagacacugcuuagaaaacuguguaagggugaucugcagagugacuuacguaauugcaacauuacuuccaucuauaacaauaugcuucaaaucugcucguccugguucguuuuuuaauuccagcuuguaugguauuuuuaagguaucucgaaaucuuugaaccccuguaacugaggaaucgauauggucagaggacccucccaaucgagccucaguaacugaagguagcagcuggggcagcggcagugguggagaaagugggggauaauuuggcuuaggcugaggagagcuacaggagccagaacgcuuuucacaggcaggcuucguauuauuuggaagcaaagguucuguuugcuguugaaaaccauuuucaggaaaagcuggguuucucuguuggugcccugaagcuccccuugaaacaaaacugaugucuuuagggcuggcagaggcggcagaggccgaguggccaucaguuuccaggucgacaguacaacuugaguucugcuuugaaccccagauuuccuguuuuuguccuacuggcacuguucugaaagaauuaacuuugcaauuugagguacaguguuuagagucuuugaacgguaacugcgagaaucucuccaccauacuuugcucugugugacucugugcuuucuuuggcguggagucugcugugagcucauuuguggugcucccaaccccugcauuucugcucugacuggcaucuggauacacaguacaagguggaaagucucggucuucuuggagccuuuuauuuucuuuuucaauuuccucuaagagcaguaacgguucuguagaaggcccauacucccuaaugaccuuuucaacaaucucuugggaauagcccaugguuuuaaagaaguuaacaaggauauuguauuccauuucuucuguagugucuuuuccaucggggcuuagauuuguagaguuugaagcaggaucagacaggucaauaacuucauuuccagcugaccccuuaccaucuggcaaaagcuccccuucuggaacauucuccaaggaaaacugcuucuuggugugccuuucuuccguaucagaagaucuccucuugugacaaacucugucuuuggaaagagcaucuucgucuggacuuaggccauucaccggaacaaaaagcacaucuggugaacuagagaagacuguguccauguguuuuguaagcucagaaacagggguccuagcuuuauuucuagaaucuuccuguacaacaacuucaucucuagcacuacucgguccuguggcagcacucuguguguacucugguggccguacaucuccaacaguaaugacaucaucaucuguuucaaacagacucucuuccccuugugugagacucaguaguuccuucuucaaggaaguaggcagaaucaacagguccauuguauaacugucugcgugggcuucaacaaacugucugaauucccguuugauuuccgacucucucugauuacuggggagguucucguugcucucaaagagcuucacaaacugcugaaugugacuccuggccaugaccacagcuucagcgcuuccucggaugccaagaagcccaguaucuaaaacacagaggucagcacacguauccugaauuaagcucuucaaaaagaggcuuugugccccgacaaaaaugcagugcauggccuugggguagcacucuuucuccuccagcuccggcucgcagauccccuugauauacuccugugaagagaagacaaaguuagaccaauucaccaguuccccaggacaugacugucaacagccaggcugaauuuuuuuuuuuuaaccacuacacauaucuauaauuuggagcaacauacuuugauuucaaugagaauaaaguacagaucugaacucugugagugugugugugaggcuauuugucuguuucacucugaacuauuuaaucaacuuuagaggaacugaaacuuuguauaauuuacagagugggaauguauaaccuuuucacugugucuugcauugugaucuuaggggcuugccuagcuacacaguggauaaucccaaggcuggauucauuuacugaguuaggagagaauaaaggccuuugguuucuggaauuaacaaaaaugacuguccugcuuccaaguuucuugaagacauuuagaaacaauaagguugaaguauacagaacacuaauaggacugccccuggcugaugcugcuacugaagaaggcuuuaguaugguuuagaaagggaacuaggucuggugagauggcuuagcagugaaagaacuugcugcuaagucugauggugaccugugggauacacgagguagaaagagaaucaacuccugcaaaucacccucuggccuccacacccaaguguggcggcacacacccaugcguguacaccccuacccacacauguacacacauacccaauaaauaaauggaauaaaagaaaacuuuaagggaacuaguuucuuuagcaaguccacugcuguuggagacaaaaaacaagucaagcaauuaaguguauacaacacacacacacagucacacacacagugauacacauuuauuaauaugcccaccaacuuuggcucugaaauguacuggucucaaauuccagaaauacuuguggugcagucuugcucaaguuaucuaaccgaagcccagauucuucauagcagaggugagaacagccacgucaugcacagcuagagggacuaacguccuuacaagggcaccuaggcacauggucagacuacuucuucgaugaucagggaaacuucuagaucacuugugagaaaugagaucuaaccuauaccuucaacuaaaauagaaacaccauggcccaagccaucacuauucaaaagcuuggccugcgaagcaccggucacagguuuuugagcuugaacuuaauaugcacuugcugcugacagccacaccccuuaaagaaggauucauauuccuauacaugcacaaacgcacacacauacacacacacacacucauacaaacacacacaccuaccccaaccucugugcauauauucagaaccacuaaaucugaguaaaucaaacaguaaaaggaagaaaccccuaucagagaguaugguacgcacccaggcugucacugcucuggaauccuaucugaaccgggauuuguagucuugaugaugaaacagagucgucuugucuuuuuaauaaacauaaucgucuacuuuuguuaacaugaaaauuuaguuaaaccaaauaaugaauugucuccucucccugaauauccaagcaguguuaaaacugaugccagcagccuuagaccuccaagugggaucuggggacauggcucaguugggagaaugcuugcuaaguacacaacagggcccgaguucaaaucuguuaccauguaaaucaggcauggugguauaugucuacaaacccaguaauuaggagguuggagcaaaaggaacagaaguuuaaaaucaaccuuagcugcacagaggcaaggccaaccucagcuacuugagaccccgacacacacaaauggaucucucuccaaauggguaacauuugacuacaacuuguuugaacuuaugcuauauuuacauauugguuuuaaauuacuuuuauaggggcuggagagauggcucagcaguuaagaacacuuccuacccuuucugaagucacaaguuugguucacagcacucaggcagcucacaacagccuguaauuccaauucuugaggauguggacaucugcacauagauuugcacauucccaucuuccuaccacaugcgcauaaauuaacaaauucuuuaaaaggaaaaaguauuuuauaauaauaauauuuuuaaaauauucuauaauguuugugaaaggcaguauauagacucuguacaauccauguaucuccccccaucacucuaccuauauaucaugagaaccagaacaucuacauugcauguaugagaccacagaucuagacuaguucaucacacgguuuuauaaaaccaccacccugugucagugcuuagaauccuuccauuaccacagauuuccuuuaucuuuuuauggucacaccuacuuuaccuucaaucuccugguaguuuagcgacauuauuauuaugaaaauggcauuaugauuuaacuguaaacauuuaggcacacauauaaagugguuugcaugacuuucccugcacagccucacugcacuugacuuguaucugcccaucauuuccuuucuauagcuguccaccucugcccuuguugcucuuccacccuacuggucuggucccuucugcuuucaucucucucucucucucgcucucucucucucucucucucucucucaugcacaauuaaauccagguucuacauaagaauacaugauauuuguuuucuccagcuccaucuuccucucuacccugcccacuuaggauccuuacucucuuaccauagcccucaguccuuccuacugucuaucuuaaggcugaauggcagguguaccacaucuccuuccccgucugucugcugacagcaucuaggccugcuccacgcuuagcaauuaugaacagugcuaccacgugcaugggugugaguguagcgguggguggggacuuucuucccuguucagcuagaagaggcucauacaagaggcugcagcagaagggagacuaagcaagauuguuuugaguuugaggucagccuuggcuauacaguaagaccuugucuuaagcaaacuaaacaagacaccauaaagaaaagugaaacugcuaugaaggaucauguucagauuuuuaugugaguuuucaguucucugggaucaaugcugagggcacagaugcucgcucacaugggaaacauguaguaguuuuccuagaagcuacucaacucauuuucacauggcuauacaauuuacaggaccccaaaaugcaugaaauggcauucaagaaugagugugguauaccuuagcuccuauugccuucuggcugaccaguggcccugaucaucuugucucacgauguccucuccagcaaaauguccugcucuugucugucucaaacuguaauggucuuuaaucacugaguuuugagacuaccuuaaauauuccaguuuuuuuuuuuuuuuuaaauaggaaaugcgguuugcaucuauuuuauauacacugguauugagacagggucucauguagccuaguuggucucuaccacacuuggucuacgugguaaucuaugugaaaucaaaccugugauuucagacauguuaggagaaacucuacuaaaauuaagccacaccuacagacccuuccuuccauuaucuauggacuaacaggguguuuugugguggcagaagucuuaaauuuuaagaaagcuguuuauuuuuuuccuucauuaagcugacuccuuacauaucgccuaugucauccuuauacauguuuuauacugaagagucgaggcuuuugcucagcugcaggaugacgccaaggcaagcacaaggcccugacuuugguucucaacauugguugaggggggaaaagauuuuuuuccuuucaagacccaaaaagggggagugguggugcuggggagcuggugccacaguucaacagcauuggcugcucuucagagaacccagggucaacuuuccagcacccacauggcggcucacaacccccaucaagcagcuauauucccaguaggucuuuagagaacacuucacccaacagucaaaauagguucugcucaagagcccacagagcuaucaagauaaacauuaugcugaccgugaaacaaaucucaacaaauuuaaaagaacugaaauuauguugaaugaucugaccacaaaauaaucaaacaaaucacuuacagauaagaagaaucuccuaaugauuggaaaguagaaacugaacagcacacuuuuuuuuuuuuuuuuuuuuuuuuuuugguuuuuugagacaggguuucucuguagcccuggcuguccuggaacucacuuuguagaccaggcuggccuugaacucagaaauccgccugccucugccuccggugugcugggauuaaaggcugggauuaaaggcgugcgccaccuccccaggcugaacagcacucuucuaaguaacucauaggucaagggaauuuuccuuuuucuguuccuuucuuuggaaggccauggaucuuccagacacgugaguucuuuuucacagugcugggaugaacccagggccuuggccuugcuaaguaaguuaaguguuccgcugcugagcugcaccacagccccccaggggaaguuucuuaggaaugcauugaauuaaauaaaaagaacaugaacuaucaaggcagacaggagcagcccugaaagggauguuuauguuacucucacuggucuuuccaacagucucaacacagucaacugaccuaguacaauccacuaagaagaucaccaggugagccuuagcuuggugauccuuccaccucugccuccccuaugccgggaucacacacauagacaaacaugccuagcuugaaaaggaaauuuauacgacacaaaugcacauacuagaaaacaauaaaaaauggguacggcaacucacaccugcaaucugccuuaaucccagcucuuaggaggaagugcuggagguggacaugaacucaagggcagcugggcuaugguguggaacccagccucugccuccugcguacucacuggguuacagguggucucugugccugcccaccuuauacguggguuguggggauucaaacuacagguucccagcuuaugcaacucgugcuuuauccacugagccaccuucccauuccccacucguaaacauuuaagauacaggaucaaggcucuuguuuugcuuucuuccugugcugggaaccaaagggugaaacuuguaugcauucuaccacugaacuacauucacagaccuaaguuuauucuuggauccuuucuccucccaccuuuuaacauagcugugccauauuccauacacagaaguuaaacacagcauacagugcauacuuuuuguuuuuagcaaucaaaucaaguugaagcacucuggaagagcagauguggaaguauaauuaaucccaguccugaagaggcugaagcaggagaauucugaguuuaacagaccgcucuacuaggcuacacagugacacuuuacaucaaaaccgaauaaacaaaacaucacaaaagggaaaaguaaccagcugcauuuacgcagacauuugcuacuuccauggaaacuguagcaauuuagagcuuuagcaauucuuucaaacaauuguuacuuucaacuaugggacggggaggauacaccccagaguaggugccuacagcggccagggcaucagauuccuuggagcuggcagaggugucgggagccauugacacaggugcuggcaaaugaacuuggguccuugcucuuaaaacugccgaccuaccuaucucuccagcccucaacaucuuagguagaugacuguuagcaaugguuuuccuucacuuuccuuuuuaaagggagagugcuccuuuuacucuuaaaugacaauuuccuuuaaaagggaauguuccauaaagguucuugcugugugugaugacacuaaacuucaacccuaaccucaggggagcgaggcaggucagaagugugagcuucaggccagccagggcugcagagugagacacagccucaugaacagcacgcuggaguggcgggguacacaaugcugauuucagcaacaaacuucauaaaacauuccuuucuccuucagaagauuagcuaagggagacuauuuuauauucuuugugaccauggcccacauuugcuuuguaagacaggucuucugugguccaggcuggccuugaacugacucaugaguucucagcuuccacaguccaaaugcugcuguuaaaguuuguguccccauggcuaguuugauauacugcuuuuuuaauguguuguucggggcuggagagaugcuucagugguuaagagcauuggcugcuuuuccagauggcagauugguggcuuacaacccucuguaacuuuuaguuccagaggauacccuuuucuggccuucaagggcacugcaugcaugugcuacacaggcauauaugcagguaaaauacucauauauguuaaaaaaaaaaaaucaucccuaaauaaaauagaaacagggugaaaugccauuuugucaaacugcagguaaaaggucauuuuaagguccauuuccauugacaugucaccaguaaauaucauuuagauacacaagagauaucaacuuuucuucaaauugcuuauuguuagauguuuugucaaagaaaaucuaaguguccucugcuccaugagcaauuuagaugggaaaguucucaccccuccagagaagugaauacuuugugaccgauggaaucacgauuaagauccagcaccaguacccuugcccauggccacaccaguuacuuaagaguggacuacccaauucacggauacagcaacaauacagaaugugaaaauuuuguauuggguucauuuugcucauuuuauaaaaacccagauuuuaguccuggcaagauggucaagcaggucaagugccugcugacaaagccuggcggcccgaguuuggucccugggaccuacuugauggagagagaacaaaacucuugcaagaugugagacugggguaggaggagagcuccggagccaacgcuacacugugaguuccagucagccuaggcugaugggcuagagaucuugcuaccaacaguaacaauggaggaugcccaacuucugagguuuaaauugcuauuuugcuccaaucuugcggguugguucuuuuuacaguucuuugcugaaacuuuugguuuugauaauuaccuacuggggauuuuuuuguuuuguuuugaagcaggauuucacggucucaaaauguaguccuggaacaaagauucaccuaucccugccuacugagucugggauuaaagguguguaccaccacgaucuacaacuggggaauuuuuuuuuuuuuuuuuuuuuuuuuuguuuuuuuuuugagacaggguuucucuguguagcccuggcuguccuggaacucacucuguagaccaggcuggccucgaacucagaaauccgccugccucugccucccgagugcugggauuaaaggcgugcgccaccacgcccggcaucuggggaauuuuuauaacagggguuuuagcuuuuaucagaugauuccaacaccuauguguccucagcaguaauauuugcacccuuuccugcaauaauuaagauuucccaauaacucauaugccaagucacuuguuauccauacugaaugcuaggguaugcgaugcuaaacucuguuucaguucuaagaaguuggcauguuuaagagauaacagaucugucuuaugaguugugguuuccacgccauacaguuuuggaauaucccugugcaggauggcaccaugcuguugcuguuauguucaguucugaaaagccucuuguuuuuguuuguuugugacaggguuucucuauuauguagcccuggcuauguagaccaagcugccugggcuggguuggcacaugucuuuaacucuagcacuggggagcagaggcaggcgggugaaucucugaguucaaggccaaucugggcuaacaaggagguggucagcaaaugguucaguggauaaagguuccuacugacaaaacugacaacuuaaguuccauuuccaggacucacacaguagaacaagagauuggaccccugcaaacuucugugcauacccuuauacccccacucuacuuugauaaagaauaaauaaaucaauaauuguaguaauaaagccaaccaaacuuggcaggggcaguaaacucacuaccaauggcuuauaaguccucuaaauuuaggucucucccaguuuaucuguuccuguuuccaagccuaaauaaaauggcucccccaggcccucuguccagcuaugacagcaguauguauaguacucucagggugcuuaaccugccauccgaggacugggaaucaccuuacacccauccguuaguguaagggaagcugucuguccaaguaaggagcuaugugguuguauucacugguaucaaaucgaguuaugcagaggacguccuacagccacuuggauaagggaggguugauuagaucuccucagucggcugccagcagcaacuggcaacugguaagguaaagggaagaaaucucuuuucuagauaaaggaaccccaaacacucucuuuaaaggacuauuuccugauugauccacaguaaagcccccaaugaacauauccugcccagauccaaaucuccaaacuggccuuuaaaaggauuuuccaugaaacacauaaagauaccugcgugugaaagaaggcauggcuaugagacaaacacaauaaaacagcauaaaaaccaagaaagugggaggggcaauccugggcaauucauaguucuuaagacaauuucagaacugcagauggugcccagagaaagagcauuuggcagcaugaggcuggaguuucaauacuguuuugauuucaguuucaguugcuaugauaaaauacacuuacagaaagcaacccuuggggggaagggcuucuuuagcucacaguuacaggcgacagucuauccuagcagaaaagucaagguggcaggaccacagcacagcuggugacaaggugucuccaaggaauucacgcucacucccacucagcuugcuuucucuuuucacaguacaggacccaacccaggaaacugcuaccuaccacacaguucuaggcuggauuuucuuacaccaacaaaugaaauuaagucagcuuccccacagaccaaccugaugcacacgaugccucacugggcuucucuuaccaacugauucuagacugugucaacgcugacaaugaaaacgauccaccacaaauccuuccucgguacagaaaaaaaaauucacauuuucuaacacauauaaaaugauacuaaauccaugcaacaggaaucaggaugucaaaagaaaggaaauaaaggaaaucagagugaagagugcuaguaagauaagaauaugaagcgaagcauggugcccuaaggcuagaauuucaccacuaagaagacuggagcaggaggaauggccuaaguuuaaggccagccucagguacagaaugagauccagucucaaaaaacaccaaaucaauuuuuuaaaaaaaggagaaguggaagugaaggagggcuggagagauggcucagugguuaagagcauguccugcucuugcagaaggcccaggguugguucccagcacccaugcugagagacucacaaccaccaucuuaauuccaguuccagggguccggacaccaggguuaaaggcaaauagcugacaugcccagccucuccuaauuauuuuaaguuucaaauauacuuuauuuacauaaaucaaagaaucagaaacgcaucucaagaacaauuaacaaguugggcauagugaggcuggccuuuaguuccagcacucgggaggcacaggcaguggagcucagacccagccuggucuacacagcaagugucaagccagccagggcuacagugagagccugucucaaaaaggaaaaaaaggcaauaaaaaagaugaagacaagggucuuuuauagguagauuuccucaccaugaucagcaaacaaauuuaacauauuccagaaaaaaagaauuuggagaaacaugcagaaacaguccagauuauauuaacuguaauuuugcuuaaagcaugaaagaacuugcuuuguucauucacuuguucauccacuguacauugaggcaccaagcaugugccgggaacuagugaagcaaaaggugaaaguggguuccuguuuuucuagagaccaugucuuagcaaagugggucaagugguaagaacacagaaaugggccaacuucagcccuucucugaggaaaacggaagcaggguguguaaggcuuagguaaucccaaguugccagauuuugcuuccuccugaggagaugggaacaacuguacguuguauggagagugagaaauguuggagcacucaauccuaaaugugcucgcagucuccaucaaaccccuucccuggcggcucgggaacuccguggaagaggaacugggaagaauguaggagccagugaggauggaggacaccaaggaaacaaggccuucccaacgcagcaggacugauggccuaugagcucagagacuggcacaagaacagagcccgcacaggucuaggccagauggaucccgguggggagagaaguggacagacaugaauacccccucccccaaccuagaggcuauuuccaauugcuaaacgcucagaggaaaaaacuaguuuucuucaaugguauacaauccacaucuaagggcaggcuccaugcccagcaguagaugaccaacacauaacaguauuucuggagguauuuucucauaaugauuuggacacuuuuuacuuuaaccccaugggucuuuugcuuauauaucauaauuucugguuuugucuuuaugggguuucuaugugcaaaugugcaugucucagcaucucuauguuuuucuguuuguuuuguccuacucagguuuauuuggucuuguuuuucuaauuuuuuucuucuucagaugccugcuugcuuucuaaugagagagagagagcaagaaaggguguggauuugguaguaucugggagagcugggggaggggaaacaguaaucagaauauauuguaugaaaaaaaguauuugcaauuggaaaaaaaucccuucuuagucuuaagcucauuacacucaagugucuguguauucucagugcugugcagccaaaaggaaugugaaacugacuagaugcugacccuagucuccucccacccuccuuccccuuucuacuaugguacccucggcacugagccaacauuccccuuguuggggcugcucucccagguugaacuggcuggccuggaacuuacaauccucuuucaucagccucugcaaugcuggcaucacaagugugugccgucacaucccauccaacuucucagcucuuagaaaagcauccuagaccagagaaaugcuccugccaacuggagccuuucaggaaggaguuccaaccagagaggggcaauacagcaauucaagagcaggcaggacucgccaggggcaagcuuuuccuaugguacuauucaccauuacagccucuuccugaaagcaugcagcuaaggagcuuugaggacaaacagccugcaaagcauaaggaacugagugacaacugagagcagucugaaagcaaccaccagugugugcagaacucggcuaacuaccaaaagcaucaugguacagacuacagaaugcuccagucuaccauccaucacugagaagcuauguaggcaaggaagcucuuaagaggucaaccugagcaucguguagaauaccugucaucccagcacuucagccuuccugguuauaugauacccugucucaaaaacaaaacagaaagaaagaaauguucuacauuaucucuagaaaaguaaguuuuuuacccuugugcacuggcaugcaucuaacaucgggucuacacagugaguuucagaacagccagagcuacacacagacccugucucaaaacaacaugcauucagguuucucuguaagcucacaauugagugugcaggugccuguggaggccagaaaagggcaucagaucccuccaaggaauacagauuggaguugaaggcagcugugagccaccuaauuuggauccugggaauugaacucggguccccuguaauaacagcaaaugcucuuaaccacuaagccaucucuccagcccaggcccucucuaccccuccugucacugucuauaaacaugccugggguaccugauaaggucacccccauggcagcccuucuuccaccuucacaaucuacgaaaagaguaucuugugccccauuuuacagucaaccccuugaaagcuggguccuguuccuauugaaauguaauuacuugaauuuugacaaugacaacuacacaaaacauucuaacuugaguuacagagcacaccccucucaaacacucugccuuugguaaguacuucccucuucacaguuguacauacacgcuauguauggauacagccugacaugggugcagccaucuugagucauaauuaucacaaaggcucccaggaacccuaguuggauuuucuuucacuuuuccaacaaauaagcaaaccaccagucagucacacguugggccuuacagucagacccuggcucuggggacaugcucauugcuuagaugguaguuucagagaagccagguacauuccagcacagaugaagucacugucuuaaacacgaugccucuuugcuaugcacacugugaaaacacaacuggucuugcugccccuccccaaccucccuucuguuggcaagcccccagcaaacugaacccugagcaaccaaaucugccugccucucuggccucacaggacuaaaaacuacuccucacagaggaaaaauggguuuguccaggggauacuacugaguugucuucuccugacuaugccccaaguccuuugcucucauuuucuauugcuagauguguauaguucucaaaauuauccccagguaguuuccucucaacuccacuccuacccucgccaagcuccaauccuaauuuuuaucguccuagcgauaacuucaaauucugccucuagcuucaacacuguuagagagcaagguugcuuaugccccagccuuuccauccaccacucuauuccaaaagugccucaaauuuucaucugacuugcagcugacagcucccuaaaacccagcuuugaucccaaguucucuucuaaucaacaguggcuuagacucaacacaaacaccacaaucaacuacaaauauaaaccucuuucuacccaccaacuuuauuaugccuuugcuacaauaacuugucuaccuccuuguuacaguauaagagguauuucugagaguacguuuuagaaagguuccugcugggcaagacuaauuucaagcucugaggggcucugcucaaggucucugguuggauuaccauguccgcuuuuuugcuacuuacuuuaacauuuccuuccuugacucaucugaaaacaucaucugagaaaacaggagguacauacacuaaucucugccuuauaaacacaagugucuuauuaaauuguaauguauaucacaaauccaguaaauugcacauucuagauagugggaacuacucuuagcuaucaaauucaguuacucccaagcagauguaauucucuagacaucuggcaacaucaggaaacauaccuggcuuuuauagcuugagaagauguucuuggcaucuccagcaucuagaggguggaagacagacgcugcuaaucauccuacagauauaguacacuucuccccauacacccaaauuauaugacccaaaucacauugcugcugagaaacccugagcaaacaaugucuaacuaauaucuguaggugguuagaaacaugggccaacauccugcaacaaugaugugguuaaacacgaaagaauggcugggccagguagauaucugugaguuuaaggucagcuuggucuacagaguuaguuccaggacagccagguuuacacagagaaacccugucuugaaaaaccaaaaucaaaaccaaaaaaaaaaaaaccaaaaaacaaaaaagucaacagcauucuucauaacauagaauuccaggucagccuuggauacauagaccccuguuuugaaaauuaaucaaucaauuaauugaaaugcagaguuucgacaaccaagaugauaacucuuggaguugguagaagagauagcccuaaagaguaaaauuucuuugcucugugagauauuagguagccaauuuauucucuaauucacuggcuucauuccaacauucuuuguuuuguuugagagagggucuuacucuguagcuccagguggacugaagaacacuauauagaauaggcuuggccucaaacucaagagaucagccagcuuguacuuccugagugcugggauuaaaguagugguucucaaccuuccuaauguuucaacccuuuaaccccgauucucauguuguggugauccacaaccauaaaauuuucacugcuauuuuauaacugauuuugcuacuauuauggaucuuauuguugaagcaucugugcuuucugauggucuuaggguuaagguugaaaaccacuggauuaaaggcacaggccaccacgccuauguuuaggcuagcuagcucugguucaugaguuaccugccugucugaaagucugcuugugacuuuaaaagggguuuuacccuuucggaguuuguaggccccacuaagaugcccaagcacauaccuauuagacugguuaccuguuuaaauacaagcuugucauauuuuaggucccagaaugaguccucaauagcaggaauccuucacuucucugccucucuguugccuucuugucuucuucugcugucugcuggugucucucacuccuggcccuucccuucagauggcucacuggacucaaagggcccuccugcugcagcuuccugagugcuggcaaccacagcaguacuucgcuguacccagcuccaccugcccccuugccagguccaaggaccauuuugccagucucaaaugugucucucuaugcaugaauguguucuaagcaccucugccagcaaccugaccuuugugguaagaucaugugguuaucugucuagcagauaauuaggaccugcuuucagaugagauuaagaaacucugguuuauggcugggacgaagcucagugucacagugcuugcugguaugaacuagguagggccugcauuccauccccaaaaucacaaaaagaaaaaaaaaaaaaagggccagguaugguggugcagacuggucgguaccugcuggcaccaccagcaucggcagugcagcggcggcagcagcagcagcagcaucaucaucaucaccaucaccaucaccaucaccaucaccaucaccaucaccaccugucuauauuucuuaacacagagcccugauagcuggagcauaagucacucugugaucaggagggaccagcuccuaaccacugagacuugcuuaucuuuuagacuuuucuuuuccccuuuguguuacucaggauuaaacacaaaguuuucuuggacaugcuaggcagguccuccaccggcuacuucacaauuaauuccuuccuuccuuccuuccucccuuccuuucuaccucccucccuccuucuuuccuuucauuguugaggacggagcucaguaagauggucuuacuugggagacccaggauggucuucaagucacuacacaacccaaguagaucucaaauuugcaaugccucugccucagccucugaguaguuagcugacauuaugguguacaucaccaaugcuuggccaucuuuagauuucuuaguggaaaaaauacuaaguuccuauuuuucuagaacaaagcagcuccuuaauuacuacagagauuuauccuccuauaacuucacuugaaauuuaaggaugcuaauuuuaacaauuauauuaauuuaguaaaauguuagcaaaaacaaaaacaaagacacaagauauugaaccuugauuuaauuaaaauccuacauaagaggggcagagagauggcucagcaguuaagagcacuugcugcucuuacaaaagaccugggucuggcuccugucacccacaagacagcuuacaacuaccaguaacaccaguuucagaggaucuaauguccucuucugaccuccacugguguuuggaauguguguggugcauagacacacacaauggcaaagcacucauacacaugaaaucuuugagagauaaauacaucuuuuaaaaaaauccuaaagcugggcgugguggcgcacgccuuuaaucccagcacuugggaggcagaggcaggcggauuucugaauuugaggccagcguggucuacaaagugaguuccaggacagccagggcuauacagagacaggucuugaaaaacaaaacaaaacaaaacaaaacaaaacaaaaaaauccuacacucagcaaguagagucaccugccaccaagccugaugaccggaguucaaucccugggaccuacacgguggaaggagaaccaauuuugacaagcugaccucggauccccaugcaggauaugguauaaacagcuccgacaaaauaaguaaguaaauauaaucuuaaaaugaauccuacaacacuggcugggaaaggaacggggaaggggaagcuaaggcauuagcagugagcauccccuauuucaacauucuggaauaacccccaaguauuagccauaacagacacugagccaaucgcuguuucuuaagaugauuuucacaacuguaaaaaaagcaucauucuaggaaauggaaaaaagccaccacauuccuuucugguaaaaccaacacaaaagcuucaugauaugacccagugguacacuucuaacuuauuuccucuaugaacgaguccccugucuacucaugagccaggcaucacucuucuaagacccugcagaacucucagggagcgcugcuggcaugugucuagccuagagucucaccucagagccuuucugccucccuguccuuacucagacaaacuccagggcuccauucugcauugcucaacugcacuuagauucacaccuaggaaacaucacccaccaguuuuaagguccagcgacacuguaaguucaggcuccugacucccucaggucccuacccaguccacagaagucccuucugguugcuucuuuaccaccaguuguucacugagacagagcugugggccaccagcucuucugcugcucucuucuccaauaggggaaggaagugcauuaacucacaagaccugucucccacuuucuuucuuucuuucuuuuuuuuuuggggggggggguugguuuuuuuguuuuguuuucugagacaggguuucucuguauagcccuggcuguccuggaacucacuuuguggaccaggcuggcuucgaacucagaaauccaccugccucugccucccgagugcugggauuaaaggcaugcgccaccacgcccagcugucucccacuuucuaauguaggcuuuaaaagggcagcucgaaagcuccaccuggaccacugacauauuuucuucaacauguaugauuggauuuuaucacaacuuuuuuguaaauugaaguugucagguccucugcccccagcccggggacagggugcaugcugaagauuugacauccacugguugugucaagcuugaguuuaaagagucaacacuauggauucagggaaaauuauguucaccaguaucugaucuaauaacuacagguaaagcuuuugggguguauuaauuaagcaggacacuagcuuucaucaaaccaaaagcucacuaucaagaaggucucuggcaccuguuguagccuagccaccucaaguccccagcaagguaucugcaaacuuccuugccucucucucuuucugucugucggucugucuuccuuccugauacugucuugguagaucgcucuggcugagacggaccuuaccaggucgcuguuaugaauccacagugacccuccuugccucugccucaggagucccgggacuguggguguuugcuaccagguccagaugguuuaugacugucuuuuguucugacugugacaguucauguaacugcuuccauguuaagauauguuauucagcgguacacaccuuugauuccagcacuugggaggccgagucaggcaaaucacuuaguucaaggcaagccugguucaggauggccagggcuacacagagaaauccugucuucaaaaacaaacaaacaaacaaacaaacaaacaaacaaacaugcucuucagggcaguuagaaugugugcuuccaggccacagccauucuauaucugucacaaaguaaaucucuuguucccuuuuuuuuuuuuuucgguuuuuucgagacaggguuucucuguguagcucuggcuguccuggaacucacucuguagaccaggcuggccucaaacucagaaauccaccugccucugccucccaagugcugggauuaaaggcgugugccaccacgcccggcuucuuguucccuuugacugcaguauuuuuaugcuacauagaacauacauggaauuaaaaauauaaauuugcucccccacccauccaauggguuaaguucuccaggucuccuaucuucucacacugucuuaguuugggcuaauauuguuaugaugaaaccucaugaccaaaagcagucugggaaaaaagggcucacuuggcuuacauacacugaaucacaguccaccgagagaagcuaacacaggaauucaaaccaggcgggaaccuggaggcaggagcugaugcagaggccauggagggugcugcuuacugguuugcucagccugcuuucuuauggaacccaggaucaccagcccagggaugacaccacccacagaaggcuggguccuccccaucaaucacuaauuaagaauaugaccaacaagcuuaccuauagcccaaucuugcauuuucucaauggcgguucccuccucucaggugacuuuagcuagugucaaguugacauaaaaguagccaaggacacugcuuaccucugaagcucgaguaaaaucaaaucauauggacacagcucacaguaucuguacuguaucacucacguucuaaauuuccuaccccucccccacaggccccagacacccucuccaccucucaagauuccuccaugcucucuuucagccaaggaacugcaggaagcggcaggcuccacacacccgugguucugcgcaggcucucccucccuuggaaaugccccuuuccuucaccccuuagaaccucgcugauuagaagccuuuccucuuucucauuacugcgaugcuuuggacgcacagcaacugcugcaugaaucacacuguccuguuuccuuggaagucucucuacuaaguuauaggaaccuugagguuaagggaacaaccacauacugacgcccucuuggguaagcuuuuccuuaguugcugaccacuagcugaccacgguccacguccauaccucccagcacugaggagcagaggcagccaagacacagcaagucuuucccuuuaaaaaauaaauacaauuuguaaaaguugccugccuggcagcuccaccaacagaucacagacuacgaaccacacccuccagguuuaaacuaccuuaaaucgccacuuccacucagguccaagcccaccccauaugucaaacccagccuuaagacaaagcauuccuucacuacuggcucucucucugccuucaaauuacccauucaggaguuucaaacaauuuuuccccuggccgaacccuaaauacucccucccgacuauccaaggucuugagucaagccagcauguuucccaaccauuguaucucacaagggaccuugacauguucuggucuugauaucccuccucagacacgguuuucuggccucuacuuaguaaugagguaccuagaagucuuccaggcuuuucaaaguccaccuacugcacugccuccuccagcacauaacacugggcggucggugccucucuccaaccuccgcaggcauuaucgcucucacaguagcucccacugccucccucugauuacuggaggcuuggcugauucacaggccauucucacagcuguaacagaaaacuggauucugagagccagggcaguuaccccaccagcagcagcacacacucccguuuucuuuuuuggcaccaggauugaaguuucaaagcacucuaccacugagcugggcccucguucccuuauuuuaugagagguuaaagaggcaagcgcaacaugugccgggcugggggugcagcuccacagaagcgucuaccuagcagguacaaggcucuggccuugguccccugcacuuccaagaagaaaaacuuuggcuugugaggcuggguuccucugugucgccuaggcuggccucacaccaccaccuucaugccuuggccuccagaguucugggacuaugguaaguuccaccaugaccaccuggcuaaacuuuucuuugcuguauuuucccuucagugacauuucuacuuacaccaaguuaauaguuuucuuuuccucaaaaaaaaaaaaaaaaaaaaaaaaguaaaaaguaaaaaguaaaacaaacugccggugaguguugcagucaacuccuaccauaaaucucaagggaaaggaaaagggauuucuuuuaggcgggaagguuacauuaugaguaauacauguuaagauuaagauaagcuggcaggugacauuacuauuaccaauacaccauacgucacacccuucccaucagcugugucaagcuuuguggcacugacagacagagagaaccgggguggaaggacugguggaggcauggcuuuccuguaaaccgagggaagcaucuuccaccucugggguguccucaaaaaaagcggcagcaggaaggguccaaaacacagccaggacaggagagaguagccugcugugaaagucuaagagagcggcuaccagagccauuauaaacaagaugccuguaaccuaggggcagaaggaccagugauccaaggccagccagucaccacagcaagcuugucucacacaguuccgagaguucagacugacaggaagucccuaccagguuccagggugcaagaaggaguuuuugaagaaggcugacuuugaauagagagugaaccaggagcccagaggcagggaaugagaagcagccaagcuggaagggacuccagcagaagcaaaggucuuaaccaaggcgaaggccagggagaggagaggggugagugccugguggacacuuaaaagugacaagccucaggcauguuuuagcucuggguaguaagagagugggcggcgcaaggagcuaagcacaggggaaccaacuugguccaacaccaacagguucaacccccacacugucaagaaucacacaaauaagcaccuuacagccuacacaugguaaacauuucuuuuuuuaaauuaaaucgacaccuggagcuacaaccucuuaaagaguaaugugaaauuugugauguaggauagaaaaagaaagucuccccagagcugaacuguuuaacaagcaucgcuggggcuggagagauggcucagcgguuuaaagcacugacugcucuuccagagauccugaguucaauucccagcacccauaugguggcucacaaccaucuauaaaggcaucugacaacuucaucuggugugucugaagacagcuacaguguacucacauacauaaauaaauaaaucuuuaaaaaaacaaaaacaaaacaucgcccaugugguuucuagaaacaaauucuggugccugauagguggaagaguuugggaaaagguggguagaagauguucaggaagcuccaaacagggggcuuuaagacauuggugacuucaaaccaagaggggcagagaggggcauucuccuaaguucccagaucugacccucgaaacaccaaagaggaaacaauaccuuauuccucaacuuccuacuccuccccgggagcuuaagaugcuauacaauacaccuucagccuucucccacccacggcuuggaggacucucuugcauagaagcaauuaaauugcccguucuccuggcaaccugucgacuaaccuggcuauuucacugacucaaugagauuuuagaggcauaagcgccuccgcggucaaauuuugcuguuuucugacaagggggaggggcugauggcggugcugaaucugaaauacugauuauacacaaggugagucaccgcuuaguuucaguuucuccaguuguucauuuaauagaaggaacaagcccuaucaaaacguauucgccggauuuuuaaagccugcguauuccuuuugugguacucggcggaaugucagaaguguaacaaccaucauuuaaucguagaacaccaacacuacaggaauaauauuuuuaacgcagcuaccaaauauucuaccucugaagcgucuggucauuacaugcguucccuuccugauuuccuagagguucaggccuaagauucccaaaggguuuagaagcccuggaguggcggccuggagggugaagaccaaccaggagcaucgagccuugcgcacauccaagggaccagcggacggagggagcgcgagcccgcucagcgcgcgugcuccggggccugauggcucugcguucugcgcacuucgcgagggaccagucagggagaugcuuucgcagcgcccuuuacaaacagggaccccgaggcucccaggacggacccgcuccgagcgccccgcgcgcggcccgugcgagccaggccggacucaccuuggcgcugugcaccgccuccugcgcgccgcggaguugcagccagauacgcgcgggcagcggcuccuccgccccgagggcgccgagcacggccaagcccaccccgaacagagccucgaugcgcccgcggcuccgcuccagcagcgccgccuucuccgcgggcgccgugaacucauccagcaccacccgggccgccauggcgggcgcggccucccggggcgccgggggccagcggcggcgacgcccccucagcgugccgccgcugcaccgagccgcucaggaggcgugggccgugccggccuccucgcccgcccgcaggccccgcuacaccaucacgacacggccgccgcagcuuagcaacugcgggcagagacuccccgccaccccgcugccccgcugccccgcugccccgccacggccgccgccgccgccgccacagccgccacgcaugcgcucagcccgccgccguuguggaaacucgccgccccgucgcgaagggugcguugguaggcugagggcaacggaagucgacgccacacgcugucaccauguugaccgugggcaagcgucggcaggcgaggccugggcggccauauuugauaagggccugaugccuuugggcaucuaguagaaggauuuuacauugauaggcaaauggugauucuuuuccuucuuuuuacuuccuuccuuuccccuuuuuacuuacuucagaaaaaaaagaaaaaucguaacaggaaaagaaaaugggacaaccaguaaagaauuaaaaggccaaauugcuggucuagugucaauuacugucaucccacuggggugggagaaugagguaggcagauagucauuugcugaaggcaagccugagcuacauaauuccaaaccaguuugagcuauaaagugaaaccuugucucaaaaaccaaacaagagcuguuucgguggagugcuuauuggguaucauaaggacugggaguuugauuuggcuaucaucacuccaggaaagagaacagaucuucaaccccagcuccagcugagaccugagggcuugcuggcuugcagcuuagcuaacaaaaggcaaaaggggagccacagauccagggagaaacucaaucuuaaaggaguagaugacauuguagaggagaucacccaaaggccccucuggccucugcuuagagagagaggugcuuaccaucacacacuuaugcccauacauuccacacaaguauaugcauaacucuaaaauaaaucuauuuuuuaaaaaguugggcauggugucauaagccuaaaauugugguagcacuuagauaguugagaccagagucaaucaaacaaaaaaccaaauaccuucuucuaauggcguggccaagugagcaguuucuuuacuguaccucuggcauacaggaaaggggaaaggcaauuucaguagaguuauguguguuaugugaggggcaaaaauaauagggaucauacugugggacuagggcaaauaaaccaaacccuucuucuggccuguguuucuguuaagucaaaggcaucacuugauuccaaugcuucccagauguaagcuuucuucuucuuuuuaauuauuuauucacuuuauguauaugaguacacuguagcugucuuuggacacaccagaagagggcauugaaucccacuacagaugguugugagccaccgugugguugcugggaguugaacucaggaccucuggaagagcagucaaugcuuuauaaaccaccaaacuaucucuccagccugacauaaguuuucuugaauccuuaaaaacaaauugugaaagauaaaguauugguuucuguagcugguuuuugcuacuuuauggguucuucuuucucccacacuuuaucccccuaccccaguuucacucccuaucacgagguaggagagaaagaaggguagaggagagagagggagagagauuucugaaccuaauuucuucccuuuuguuccuucuuugagaaugacuacuaagaaacaguaaccaacccuaccuauuggggcuccagcacuuauauacccucuggaaaguucccagaaguccaaacaguugcagaaacuaucugcagcuggcaaagccaugccucuauuagagcacgaggcaaaucauagucagcugcugcagacggucuuaagcagccccauaucccacaccugggauuaaaacagaaacacauucuuagaauauuucuguguuuuagaagaaacuaaaauuccagauucucacuacagguuuccuuccucugggcuaaguaucuuggauguaguaaauaggacuaauggggauauugcuuagcuucuuuguauuguaauucuucacugauacaguaaacgaugguaagcaguaguucuauugugucagcauaauuccaacacaguaaaugcucauuaaauacuagcuauuauguaagaucuaguucuuuaucaaaauuaaccagaaaaaaauuacuccaccagccaagaauuguaauguauccaaacccagguaauggggggagggggaggagagcuaucaguuugucaacccugccugagaugucccagcugagccgaauuaagcuucagcuuccauccacuuugauaguacucuagucaauucucuaaaguuccagcuuuuuguucauauucccaaagacugguuuccuggaagcugccuagugcaucaugggaaugaugcaguauuaacagcauccagcuuuuucucuuuuaccuuuuggauuuuugagauagggccuuucuacauagcccuggcuguuauggaacuguguagaugagguggccuagaccuuacagagauccaccuggcuguaccuuccgaaugcugagcuuaaaggcagguaccaccaugcuuggcuaagcuuccauucuugaccaaugaaaaccuucuggggaugggggaugcaaacuagcuauugcugccgaauugggaaacuuuuaaaguuucagauuccauggcaacccuguguagguuuauuccagccacacugaacugugggccugggaaccuguaccacuugugugccuccucuuagagggaggaagggaaggaucuaaguccauuagaguuaggaauggcgauggggagaggugacgagagggauuaccccagauaaaaucuaucagggguccaggcugcugggcuuuuccauguuucagaaacucaggcagguguucuccuggugccuuaccaaaagaugacucaguacagggaagagaaacacugggcucgcagacucgcugcuuccucuucccucugggcuuuuccccugguguccacacaaucuugcuccaucaagucgguugugggauuggcugagacagaacaggugguaagugugaccuugcugguauaccgcacccagagcccaguguuaucaacacagccuguuauuuccuuuguuguacucaauggaauugcuauuguucaucaguugggcggggcugcccccccccccaacaccuuccuguguguuuccaguaacuucucugccagaguuucuuucauugcuuaguuuuaagggguggggacagagucuagucuucaaaagcacagaacagcgcccaccuugcuggacucuaaaacugcagaaagagaguagccaggcucgaugguacacaggcauacaccagaaauuccagcauuugugaggcuugagggucaaaguucaaggcaagguuacacaauacugaaguauauucaaagagucacugaguuggaacaucgcugaauacaccguuuuuuugguauuuuucuccucauuagaauucuuugugguuuguauuuguucagcauuccccuuugagaaccccuuuugcuuugcugagugugaagaacaagaagggagggagggagggagagagagagagagaauguuaaagcaacucccuugcuuuauugcuucaugaagcuuccaaaccacaacuuccucaguugacuggcugugccugccugacuggccuugccagcccaggacagcaauggugggaugagaucuuuuggagucugcauuccagacucuacuguguuuuguucuaaacucugcauguaauaccauggcagaaaucaucuucucuguuaagaagggcaaguaguuucccucgccguuccuuagacagguagcaucuggaagaacauagcucucucagcuuccuccacuugucaaucauccugccccagagcaggaggaaggucucugggauggugacuuucugggaugcucaaugcugugucagacauugaucacuaggaaagaguaaguauacuguugauagcugccugugguugcccacaugccggugacugguaaaguguuucuacgucaaccauacccucuaauaucauuuuuaucaguaauaaauguuaaaucuuaaaaaaaaauuggggcuggagagauggcucggaggcuaggagcacugacugcucugcaagagguccugaauucaauuuccagcaaccacgugguggcucacaaccgucuguaaugggaucuugaugcccucuucugugucugaagacagcuacaguguacucauauaaauaaaagauaaauaucauaaacaaugcuguagaggcuggagagacggcucagacaguaacagcacuggcucuugaagaggacccgguuugauucccaguuauccacaugcccugcucauguguaugcuuugaguuccaggggaucugaugccuuccuuggggaccacaccuggugcacauacauacauucaggcaaagcacccauacacauaaaaguagcuaaguuaaaacuuuaucuuaaauuauguuauaugugcaugugaggguagguaaucuuggagguaaucagagaugcuagauccccugagcuggauuacagccaguuagcaacuuuugaacaugcaugcugggaaccaaacuuggaucccaaacaguacacacuccaagcuaucuagaacugcugcugcugcugcuguugguaguguggauuaaguguagacagggacucaacccaagcucucaccacaccagguaaguauuuuaccacugagcuacaucucuggcuucugcccauuugcuuuuaauucuuagcuuguaaguuagaagcaucagaauggauguucauuguucacugaccucuugaacuucccuuaaagauaaagauggagaagacaucaacugucuuucuacacuugagcuagcacaagcaagaagagaugauguaggauggaaagauggcucggcauguaagugcagugugcaguucuaacagaggaccugaguuccguuccuagcacccaugccugguagcucacuuggauauaacuucagguugugggguguccaagacuucuggucucugugagcaccuguaucaugugugggcacacaccaguacacauacuuaaaaauaaugaaaguaaaucuaaauuaaaaaaaaaggaaaagauaauguacuaucauggacaaaucucucauucuugggcuguauuugccuuggauguuuucaaaauagaacugcacuugggaugucgcuccccugccaaucaaucuaauuuauaaugcuaaacagacugaagaugcugcuggccagcagugugucuuccuggacucuggguuuccccuguaacuacaggaauguggaguaggcaucaagacuacaguugugauucaacuacacaauguauuaaccagcuuguuuggugcucagaaaacuguauucgaagcuauagccuauggcagguauguuggagacuuuagaucagacuuucucaacuucugacuugugacuccuuuaggggucauacaauccuuucacaggcaggucacauaucagauaucccgacuaucagauauuuacauugugauugauaucgugcaaauugauacaucgacagcagcaaaauuacaguuaugauguagcaacaaaaauaauuguauguuugggggucaccacagcaugaagaacuguauuuaaguggccaaguauuaggaaggcugagaaccacugcucuaaaucaaggucucucugcucauucuccuccugucucagagaagcccuuucucugaaguuugucugccuaaggauaaacuucaaacaaggaacucaguggcccuguguccugucuccaggaaaacucaucuacuagggaaggucaagccauucgcuggaaaggucuaagguggcagauguuaucucuucugcugaugggcugcucuuuggcaaauuuuauuacccaagaaccucucugcuuaacaagacauucuggccccagugauauagcucacugaaggacuguuugcccagcuuacacuaauuuuguuaccaguaacugaagaacuugaucuaggacuaagucccuucuggucagcaucuguaaugguuugguagacacucuccuuucagagaagccaugcccucaaaacuuuuuuuuuuuuuuuuuuuuugguuuuucgagacaggguuucucuguauagcccuggcuguccuggugcuugccuaguauguaucaggccuuggacucaauccucagcacgacuacaaagcacagugacgucccgaucccuaacacacacacauacacacacucacuccaaguccuccuuuagggaauagguaggguuugcuuggucggucaguugguugguuuauugguugguugguuguuccuuugguuaguugguugcuucuuugguugguugguugauuguuucuuugguuaguugguuguuucuuugguugauugguuguuucuuugguugguugguugguugguacagacuuggggacacuggggaagucaaaagaaaguguauuguuggcaugggaacagcuaugucaagaacccagugccucagccccauaggaguggcaaagaauuucccagggugaggcaccaagagacgguggcaaagccuuccucugcucugagugagaauguugacagugagugcagaaacugccaaccacagcuuccuccucagggaugacugcagccugagacugcuuuccaaagagaccuuuuacugagaugagcuaaaccuugcugcauguucagcauauuccauaaaccugucuccuccuucagccauguacaacacaucugccucuuugauuugagugguaaaacacguugagccaggcaugguggcacaugccuuuaaucccagcacuugggaggcagaggcaggcggauuucugauuucaaggucagccuggucuacaaagugaguuccaggacagccagggcgacacagagaaauccugucucaaaaaacaaaaaacaaaacaaaacaccaaaaaaaccucccccccccaaaaaaaaaagcacauugaguuucugaguugcuguuguugugucuccaucaaagagcacggcccacaggaucccagcuuuucaauacauauguccgugugucuguccuuucuucauuccuucacugccccacaauugcugaagcagugcaggacacagcauaagccagaggagaauuuagucccuuuggggcaggguuuucucacugagcauggagcucauaauuuuuccaacagagcaacauccuccugucugucuucucuuccccagugcuggggcuauaggacucuggaacauacccaccaguccuucugcagcagggcagacacuaaacuccaacuacugccaucuccccagccucagcccagccucagcccucagguuuagguuuaaauagaaagcaaggagcuggaacgauggcucagugauuaagaacucuguucugccagagagcccaguuuaauugccagcacccauauggugggccccaacuguaacucuaguuccagagaauccgacaccucauaauggccucccaguguccugggcacacaaguggugcaagaacacagugcagacaaaacacccagaucagaaaauacaauaauaauaaaaaaaaaaaccacacacacacacacgagguauguauaaauaagcaguccuguugaggugcggucccacacauuagcauugucucaacuccggccucuccuguaaggucugacaguuuccuggggaaaguccagugucuuguugccuauugucucaguggucuauagccaaagggcacagacacaagugucucuguuaaaacacaaaaggcucuuauuuuuuuccuuagcucaaaaaaaucuuaauauguuugcugcuucuuuucucucucucucaccccucucucccuccuucucucucucucuuucucuuucucuuucucuuucucuuucucucucucucucucucucucucucucucucucucucucacacacacacacacacacacacacacacacacuuguuuuccucuugcagugcgagggauugagagcaucaaugagagcaggggacugaagccaguuaggaaggaggccugggaaggggcccuaagagcagcaguucugauguccuugguucuccagacagaaaugccagggaguucucuucaaugagcagcccugccuggggugugugaccaugggacuggagcuccagucuagacacuaauccuuucuagagaacaaauuugaaacagaccuuuaaauauucauggugaaauggcuuccacccacugcccaguuucagcccauuccugaaaugaauuuagaguuaacucuggagaggggagaauguugugauagcauuggagguccaucaaaaguauuuccucuggucuagagaagggagacgguugacccuggguggaguccuaacauggcaagcaaccccagacauaagaguccagcuaggccaggcaguugccuagcaaaggagauucaccaauaccaugguaaggagaaagaaggaacaauucugucuucgugagguagugaucccuugacugagauggcauaccuucuucugcagaagucccuggcgcagucacuuaugggcagaaaacugugugauucagcuaaggccaccugcuuucaugaaucacuuuuccuuuuuuuuucuucuuuguccuucuuuggaauacuugccaaagcuuggucauccucuuccggacacucugaccuacucuuucucuaugaaguuauucccgcccccuucugcauuguggcuguuacaaacauccaagcuuccucucuuccucuucuccaucuuccucuucugggaagcugccaagauuuacagcucaccaaacuucaggguuuuuuuuuuuuuuuuuuuuuuuuaaaaaaacuccaguaaaaucaucccucccuuucuuuuaagucuauucuuaaauucuuucauuaacaagacuaaaccccgcaaagagacccugauuucccaguagcaugugguaccccgggugaggcucugggccuugagcaugcugaguaggcacauauucacuguuuuauaccccuaggccucuuuggcauuuuuauuaaccauaucguugaagcuacaacuuuccaugaucgacaggaaugacuuauaaaaacaauaccagcacaguucacucagagcaaacaaugacuuuauuaggcuguuuugcaggagcaguggauggagagucacaggcagaagcguaggugaccucaccacaaccacgcuggaaggucugcacccagcaaggaagugaccuauaggaagugaugguauuguuauauucaaccuaggcaaggaagcagauacugggacagguaucccacagagauugccugccagcuucuagaucccucuaauagcaguauuccagcauucucuccagcaguuucucuacuguagcacuguucaauugaacccauuaauacucuguugugugcgugccccacccugugaaauguaggguguuuuguuacagccuugcucugcucuaccagauuuaagcaacagccagccccccugugugacacaugaaaaagguccccagaucaugccugauggauggacuaucugcuaagccaaagcaucgcuaucuucaggaguccaacuaagaacguuugccaauggucaucacugccuggcuuguuggcuguuugaccuuccuuuuuaggagggggcaggaauguuaaugggacucuccccugaguauccaaccaucccucucaguaaguaauaugcacuucugcuuaaacuggauguggccucaguauaucuggaagggccuagaauauauacaaagggccgcaugaggggaggagacucccucuauguagcuguggggaagccaucguccuugcugggugcagaccuuccagugugguuguggugaggucaccuaugcuucugccugugacucuccauccacugcuccuguaaaacagccuaauaaagucauuguuugcccugagugaauugugcugguauuguuccuuggucuguuacgagacauuaaauggaucuaccccaggaaggaauuuuagcaacauuuccugauguuggaauuuucccuaguugggauuuuucuggccuauagaguuaguucaaggaaagagacauugcugggaucaagcuagugauaacugagaaucuuucuucagcauccucagacauagagaaagacacgaacaggcauagaaacacacacacacacacacacacacacacacacacacacacacacgaugcaugaugcaucaccucuaauuaauuguaagcauccuggaagaaaugaauauauucuaaagagacaucugugccccucuucugacuaucaaacuauuaaaacgaugggcccuaagaaacuagaugucuguggugguuugaguaagaauguucucccuaggcucaaaugcuuagucacuggggaguggcacuauuugaaaggguuagcaggguuaggaggcguggccuuguuggaggaagugugucacugaggguaaacuuugauguuucaaaagcccaugccaggccuagguucucucugucucccuauggagcaggaugcaucucuuagcuacggcuccagcaccugccugcaugcaaccaugcuucccaccaucaugacacaggacuaaacccuucaucagaguugccuugaucaugguuucucuucacaguaacagaacaguaaauaagacagcuucucgccgggcgugguggcgcacgcuuuuaaucccagcacucgggaggcagaggcagguggauuucugaguccgaggccagccuggucuacaaagugagguccaggauagccagggcuauacagagaaacccugucucaaaaaaccaaaaaaaaaaaaaagacagcuucucuucucugcuuuaaaggauuauguuuucaaagaugaaacacagaacuuuuauugaccaaagaaauuaagcaaggaaagaguauaagagauaaagacauauacaggcuacaaagaaggucacucaccuauuggagaaaaccccaacacauacacacgcacacgcaugugaacacgcacauguacacucacacgaacacgcacacacaggagaggcaaagaguguaagagcccagagugaaagagucuugagccaaagccuugguacugauggcugauaguugguucuggcuucuaguugggaguuuugguaggggggagcugucaacugugggucuuggucuccuuccacaugguugcucaggcuuucuuuugguguaugguagaguaauuuauuagcccuugggucaucuuguaguagagaguacuuugaccaaguauccauggcgacuaauugaauaaaauaguaauguucacuaggucugcgauaauacucaaguugauaacacucccuaguagcguaacagaauggcuggcagaaugaauauauucuaaagagacacuuguaugccacuaggcaaggccuuaggucaccauuaacugauuccucccucugucucuguguuuaccuuuggcacccaggauucagagaccgucuaacugcgagcaggucuagggacucaucaacuucacggcacagaaaccgcacccucuccugcagccuguaagaggaggucgcacgcugccucaugggccucaucuccucugccaggcugccuuuuccugguguuaauaacucuucuaaaaucucuuauccaaaagguuaacccgagucaguguuccuguuggagccuuaaaccgagaccuguuagggaauaaacccagccacaugggcaaccgagguccgacgugguuuggucacacgugagcugguccugcuccccuauccagcaucuccgugacuccuuuuaugaaugcuggguagcacaggucacacgcuaaaccugcugcucccuuaugguauaggacacccccugcucuuuuccuuguaaaccuacagaagaguaaggucuucuguagucuggugggccgauaacucuccgagcucauauccuugcuguguguggccagcauccuuaaagaucuuuggcuugaaaaugacaaaacaaaaccaaaaccaaaaaccaaaacccaaaaauccuuaacccaaauauauaacacuuugagagacugguacaauccucagacggguaucuacuugguaaagguagaggguguaacuagaggcuuugugaaucagagagagaaaugacaggcacguaugcauacccuucaccuaccucuuuucccagagcccuucugggcaagucgaaugccccuuccaugagcagaggauagauuuuaugugcagguaagcugguuucccacaggaaggaggcuaagucugccauccuaagugacuuaguagcguuuggggggagcccacccauagaaaucuaagucuucccaggagaggagggugugucaggagaggagaggggccacuaaaggcuugcuaacugcugucccccacaggaacuauggggaccugagagaaaggcuacuucucacaguaggaagugcucagucagucaguacugcugagaucacacuggacccucccuccucccuguguacucauuuuauauuauguucaaacagugaguuuucaggcugggccuugcccauuugacaaguaaaccuuuaacuccauuuugagggcggccccacaaacaguguugucuggcaccacucacacagcauagacugauaaaugacuugugagcagagaggguaccaccucuacaguuaucagggugagcuaagauugcagggggacaugggcacaaaucaagucucguuagggaagccaagcccgugaacuuaucagacaccagccagggcgguguaacucucacccgaacccuguacaguaucuaguguuaggacgacagcagccccacaaaucugucaucugacaacagauguacaucaaggacugacaggcagaaaacugucacuggggccucaccuuagcuuggucccuacuguuguuguggccuucugcaauugucaccugaccaacuaccugcuuggucauuuggacccagagcugggguuccuacugcagcucagguaugcccuuugucccugcagcugaagcugucuuuacugccaagccugcuucuccugcugccuggauccacagcaacagcuucuuccuucuggcuuguuugcauuggcuggccuaucaauacacacucuguuugcguuucuaucagcuuacuucugaaacuguugaauucugcaguccacacucugccauugcccccaggagaacuuuggguguggggguggggguggggaauccucaacuuuagggaucguguguguguguguguguguguguguguguguguguguguguguauaauuuucauucauucuccaaaccacauaaacacauagaaagacaaauagauguauuugcugugugcugugugcaaugaaagcuaauauugggaauuaagcauucacuuagacggauuacuaaaguagguggaagugucugccauuuaagccacugcuccuuguaaauuuacaguuauuuaguaaagucugacuuuaugugcucaccuguuucuggucccuuuucuuguucaggaaagggaccuuccugguagacaggauggacaucuggagaggacugugaggcagaggaggcaagauuuugauggcuccacugggucugaagagaagcuagaggucuguaccugcagcugggccugggaggaaggagagcaagggguauugagaggugggcagagaccagagcugcaugccuggaugcuguccggggguggacgcagucacugauaaaguuuucuccaaaucauaggucugcaagggccuguguccuuguagacacucuucuuguuuggaaggugcuagccaugagaaaccuuucuuuguuucuuccuuuguuucuuccuuuguuucuuccuuuguuucuuucuuuguuacuuucuuuguuuuucuuugguuuacagucuggcucccaucaauagaacgagacagucaccaacccuggcaggaauaaaaaauguagccauuuuagugagagaguguacuagccuagcuggaguucuagcgcaaccuauuuugcaaaaagagaaauugccuuguuaaaauugguuucauuugcuccuguguuccucuguaugacaccaagaugaccgaucuucaacacugaugacaaaaugacagauagcacuguaguuuacaacauucguguuuugcucccuuuuguuuguuuugauuuaguggguuuuuuuuguuugagauagggucucacuguauagcucuagcuggcuugugaacuugcuauguagaccagacugacuucagacucaguaauccaccugccucugacccuugagugguggaauuaaaggugugcaccaucaugucugguuuaaagauuuguuuuugaaacagaguuucucucuguaauucaaacuagucugguacucacuacauagcucaggcuaauaugaaacucaugacaagccuccugcuuuagcuucuuaaacacuggcauuacaugcuaucaaguccacuugauaaauuuuacuuugcagaggaaggcaugucugagaugaggacaaagagaugcugucacauggaggaggcuucuggagugaugcauuagaaccguagucaggcccaacaccucgcuggucacagaugguuuuagaacucaauagccaagcugaaggaagcauugucucagucgaaguucccucuucccacuggccugaguuaaguugugcaaacaaacaaacaaacaaacaaaaucaaucucucucgggggcgagaagacauuugugacuuugguguaggcuacugaauuagucaggguucccuagaggaacugaugugauagaaugaaucucucuauagaaaaaagggaccuagaauggcuuaaggcugugcuccagcuaauucaaagauggcuggcauccaacagaaagucuaagaauccaguagcuguucaguccgggauccugaugucuccacugguccucagcgugcacuggaauccugaagagggcucuaaugccagggaagggcuggacuuacaggcaagaacaagcaggcaaugaucaaaagguuucucuucccaugucuuuuacauagucugccagcagaaggguuggcccagauuuaaaaugggccuucccuccuuagauaauaaauaaaaucaaauaaaaucuggauuuaggaugggucuucccacugcaauugauuuaauuaagaaaaauaucccucaccggugugcccagccacuuggauuuuuaguuaauuccagauguggucaaccaagaauagccaucccaguuaccucacauggcagacuucacaugcagccugugaucuagguacugacacuggcugaacacaucuuccuggaaggggagcagaaagaaagcgaugucuguaauauagggcagaaaacuccauagucccuuggaagaugugaagagcuuuucugaugugggacuuuugcuggguagacagugcacauaugucuucucgcccccgagagggaucgauuuuguuuguuuguuuguuuguuuguuuacacaacuuaacucaggccagugggaagagggaacuucaacugagacaaugcuuccuucagcuuggccuguaggcaagucuguggguuguuuucuugauuggugauugacaugagagaggcuguuuuguuuuauuuuggaauguaggccauggcaucacugagcaggugguccugggguguccgagaaagcaggucaagcaaccacaaggagugcuguaguaaacagaccuccauggucuccacuucaguucuuaccguccguuugcuuucagcuccugcccugacuuuucucagugauggaguaggaccugggguuuuaaggguucuaaggugagauaaguaauuuccuucccaauuugcuuuuagauuuauuuauuuauuuauuuauuuauuuauuuauuuaauguaugaguauucuauuugcauguacaccucaugccagaagaggcaucagaucacacuauagauggugugagccaccaugugguugcuggggauugaacucaggaccucugaauaagcagacagugcucuuaaccccuaagccaucucuucagccucccaauuuacuuuuagucauagccuuuaucacaguaauagaaaguaaacuagaacagaagaugcauaaaauuuguucccugagcacagacauacaaguuuuuuuuuuccccuagauaccucugcauaagaggagcugccugggguaggggcuggaguauaugcuaguacccagaauacuguuguacaguuucaacuuuaucugagugagcucacauggccccaacaacuuuuagaaggugggguuguacccaucuuacagacaaagaaauagaggcuuauagcaaugaaguaccucacuuggaacccucacaacuaggaagugacaguaagaacaggcacggcauauugugcuauucaggacuucccuguggaccugaggagacagagguuccuugguuccuuaggacugagaccugugaccuguaggauaagggacucuacaguccuucucuaucccugggucauaggagacagguaacaaaccccaacuguuguuaaaagagacuaggugcugagguaaagcucugaagcaucucccggcagcaguaccgggucuggggcugugaggagccugcaguaggauuugcugcagaauuucauuggaccccucuuugucugagaaaccaagaugggagugaagugugcuuucccgaggccgaaccuugauuggccagggcuccucaagcacauaggcucccgaggugguuuaguaaagggucacuagcaccuccuugucccuucccauugucuuguuccugcuccugccacaggucaccuccacuacagcaagggaagaggugggagccuguggaagaggcaaucaaccagcuggggugggguggggugguaaggaacgcggcuccucaaguugcuagaauacuuggccuaagacaccagggucaggcagucucacaggaagcugggucuccgcccuuccccuugagcuuccuaguaaaaauaacugauguuuccugaagcguucacauguggcaggaaggcugagcucggagcugccaggucaccaccaagauuccuuuuguuuugcaauggauaggauagaaagaaugucucucucucucucucucugccucaccuccucuuccuccucaucacuucugccuucuuuuuauuuagaauuccuaaauuccucuuacggaagagcuaagcuccucuuugcccuacaguguggaaacaacaucacugauaaugucagguaauuaauucaauggcaaacagacugaaacaaauuguaacuccagugcauuuaguuuuuguucuuuucuguuuugagaagaguuauuauggcaagaaacaguuucccuugcaauuauacucaacuuaaaaaaaaaaaaacagaacaaaacaacaagacuaagaacaccuuagguguucaggguucauguggcuauuuccagagucaugaagagggauggauauaaaugacuuaaauguggaaacaagcaucgcggcuggugauucucgaccuugugcgauaugagcucuugggcuaauugugcaaccuuugaaaaagccacacuuaguuuaaggguugguucugcacccugcacuggucaaacaaaaccuuugcauaauaaaaggcuuggcuuugccuaucccguaguugguugggucuuugguugggucagaccaagccaggccccucguuucuguuucuuuuggggguggggucggaugggggguguuuuguuuguuuguuuuuuuguuuuagacaagguuuucuucuguagcccaggcuggccuggaacucgcuagguugcuaggguugggguuuugaaccuacagaaauccucagaguacaggcacaaacuccuguuuauccgauaguuuccucaaggaggauauuucaguucucuuccucuuuuucccuccugccaauguggugcucagacuuggagcuagaggauaaagagaacaucucagagguuuuugcaccucauaacuugucaguuacugacuagcaacugaaggaaacgcuucugcuuugaaucgccuacgcccuuggcgccaccugcuggucgcauc

SEQ ID NO: 4616 - RNA, 554 nt, Mus musculus
gugucugagauuuuuuuuuuuuuuuuuuacucaaagugauuuuauugcuugugcacacaacagcauuuaugccacuagagcagaggcuguggacgacucauauuuccaauugggugggagcacccgcuuagucuuauaguaucgagccaaucggugaauucugcucucuaucagaaucaggcggaauuuagcauccuuauccuuucuguuccucucaaggugcuuucggacagcaacagcuuucuuaaucaaaugguagagauccucggggaggucaggggcaaggccuuuggacuugaggauucucaagauuuuauuuccagucacaaaacggaccugggccaccccgugugagucccucaggauuacaccuaucugggagggagucaggccuuucuuggccaauuuguaaaucuguuccuucacgucgucagacgucaacuucagccacguggggacgcuacggcgguagggcagcgccgacugggacaggcccuucccgggagcgugcaugcgacccaugauggcggaggucuggcagcaaagaguguguc

SEQ ID NO: 4617 - RNA, 4207 nt, Mus musculus
ggaaaagaauucgcuuuuuuauuaaauuucccauaaggccccucucccggugagacugaaaagagaaaagaagggaacgguggggcuggaagagacugacauucgacugcaucucacuucagaaaccccccuuuuguccccuacaguccccugggccccuagcccugggaagggcguggcugccagaagcacuuuaagcuaagaaagagccggagaugggggugggggcagaagacagaaaugccagaaauuuugcccgcgguacuguuaagcccugcuucccccaccccucacucaaaaaacauugaaacuugaaacugaaccucagcccaugaaaacccuggagaagggcucaggaccaccagcgcccacccgggcugcguaucucggucuuggacccuccgcuuccucccgcuucuggcguugcgucacccgcguucaacacagggucagcguuccagacuuaaaacgaagucguuuauuucaauuuugcuuugcacauuauguuucgguacaaucaaaacuucuggacgaaccccuugaaaguccugcgaaugagcgcaaucgcgaguccggccgcccggguuuguuuggcggguggaccucggguucagaggcgcugguacaaagugucaggugcuucgggcgccgcggagcggauagagcuggagacauccaaggaaaguaggcgugaagacagucacgcggggcaggcggguucgaguacuaggauugggaauaauuccugaugcauuuggaauugagggugagcaagaaacugcuuccaggcccucggucacgccuagcaggauuuaggucuuauaucucacuuuccaccaaagcaggggacacaggaaaggcaaagggagccugcugcgggagacagcgcagaaauggcucugcgaagaaggccuugugcccuggccucuccuugcagcuuccaagucucuugcuucuccgcccgccucaaccucgcaacccggaaaaggcgaaguuuagaaagcuguuucagaaaaauaaaagucccacuuugacuuuauuggauuaaagcaaaauuaaaauuuggcuauucacacguauguuacagaggaagaagaagcgucccgaagaaccuccuuggcgguugguggagccacagaacacggggcauugacaagcaucagagaacaaacaccaagcagccuuagauuucacgaucacuccgaacaggacagaaauacggaauacagccagcguccaccuggaagaguucuucguguacaaaugauacauauacauauuuauguauagucaaaccagucaccacgaaggugagucuuuccuucgcuaacaagcggggacgaauucucuccagcuuaacuggcgcgguguuugaagagcaaaaucuguuauuaaaacuaccugccccauucggaaacagaaacaaaaaaacaaucugacccccucuucaaacuggggcaggggggcauacuaaguuucaguaaguggcaggguucagaggggggucgggucgggagaaacauuucacauuacuucguuaauuguuagggacauggacguggguaaggaaccauaaugacaaggcaagucucuuccucgauuacugcgacuggcuuggggaaggcgagauuaauuuuggaaacgggagugugcagagcuaagcgaaauuuacuucucuuaguaagggagcggacgaaguuggaccgccggcggcgcgcaccuugguacccaguguagcuacgaacacguaggaaguuuccgguggcgccgcuuccucgcccugguaauuuucggccucuuucucacuccccuccugccucucuccugccuccauucccgauacgugccagucagaggggaaacacgaggaauccagagaagguugaguacuuccagccccccaucaaguucccccgcuccagcuugagguaugcucggucgccuuucuccaucuggaugaggacgccguugcuggcggccucgcgugucacgucuuggucaccggcgaaggcugaaaucaccggccacccguucaacaugaggcucaccuaagaaagaaagcgaccuauaucagaagcgccaucuaagaguacccaagcggcggcgagccaaccuaggugcuuggcuggcagccacgaaggccugaugaggcacgaggugugcggggcgaaggagggcuuggcugcucacuguggaggcucuaacagggacccacgccguaucuagguaguggaagggucugccucuccagaacgggcggucaggcuccuuucuguuucucaaacgagcgggccaagcgaaucccgauuggacacgauccaauuuagugaacccgcagguggcuguagagucccgagaccuuuggccucucgccagcuuaccaggagcaacucugcuccaggagcgcccugaauuacuaaacaaauaccuucaccccgggccucucccggggucuguggucaggacagauuagaagcagccaggaguggcuguccgcacuuccgagauccgcgaaacugcacuagugcuucguucccaagucacccucucaauucuugccccagauccugccgcgcccgccaucgccuguuugugcccuugcagugccagcgucggccuagggccaggcgcccuguccccagucgcguuuucggccucugcgggugcucuaaggaaacgcagacaucuuuggggaccuggcuagcgggugggugcuggcucugaaguggcuggcccgggagggcguagcaccaccucucccacccccaccucaaccccuuuucucuguccacccuacgagauucaaguuuaaaaacaagucugcaaaggaaggaugugggguuagugaacgcgauucuguccgcggugggggaagaaaaaaacaaaaaacaaaaaaaggaaaaagcaggcagaaaggcuuugggcuggagccugauuguugagccuagaaagcgagaaggugagcguggaggagaccuuacagaggccuuagcugucugugaagcuaacaguccuuaugagaagucccuaaagucccuaagggaaacccagggaucuuuacaaaaugguucagaaggagaaggcaggaaacugucucugcggaugcucucacaggaaccuuggacaguuuaaggggcagugcaagccaaagagcaauguaugaggcccugcuaccacguucccggagcagugggagcuuaugccacugauuucugacgcuugcuuccacagagcccuacugccagggacccccucuacugcgacccuggcccccagguggcagcugaccuggauggucugucuguuguagacuuucaccacguggaaguuaaaacuguagaugccuuugcgcggggcgaugaaagugcugcguucugagucaaaguuguucccgauguucacuaguaccuacaagaagacaggaacgaaaagggguagaccggaguccgcccgagcguggccucgcgcuucugcagagucccuggagaguauaucccacauccgccuuccaagcucucccugucacccccucaccaauccauucugggugcugcaaaagaauggggaacucaccuggucgaaguagaugaucauggugcgauuacucaucucggacggcucaugguuggugcuccugauggcagagaaagccaccuuggcgcugccggagcgcacagagaugcccagagcagugcccguagggucagacgugggguuggagucacacaccaccaggcacuugcccuccaguacgaugggcucugucucauucugcccgcgggcugggccugccagccacgcaguccccaacagcagcagcuccacgacgcccagcaucgcgccuccggcgcccaccccgccccccaccccgggggcugccagcgccagccgccccccuccccagcccugcuccgaagcccccuccucagcucugugcgcagcucugccgacgccucccgggccacuacgccucucccucgcacuccagaacaaauguccccgcgugccgugugcccgaagccccgcccgggccucaggggugccgcggccgcccagccgcacuuggaugcauagccucugcugccugguccccgcuguugccgccgccuccuguccgcacucgccgcugcugcugccgccgccgcucugaauuauugaugcagcgggcgcugcagccggagcgggcggagagcgcgcgccgggcaca

SEQ ID NO: 4618 - RNA, 4207 nt, Mus musculus
ugugcccggcgcgcgcucuccgcccgcuccggcugcagcgcccgcugcaucaauaauucagagcggcggcggcagcagcagcggcgagugcggacaggaggcggcggcaacagcggggaccaggcagcagaggcuaugcauccaagugcggcugggcggccgcggcaccccugaggcccgggcggggcuucgggcacacggcacgcggggacauuuguucuggagugcgagggagaggcguaguggcccgggaggcgucggcagagcugcgcacagagcugaggagggggcuucggagcagggcuggggaggggggcggcuggcgcuggcagcccccgggguggggggcggggugggcgccggaggcgcgaugcugggcgucguggagcugcugcuguuggggacugcguggcuggcaggcccagcccgcgggcagaaugagacagagcccaucguacuggagggcaagugccugguggugugugacuccaaccccacgucugacccuacgggcacugcucugggcaucucugugcgcuccggcagcgccaagguggcuuucucugccaucaggagcaccaaccaugagccguccgagaugaguaaucgcaccaugaucaucuacuucgaccaggugaguuccccauucuuuugcagcacccagaauggauuggugagggggugacagggagagcuuggaaggcggaugugggauauacucuccagggacucugcagaagcgcgaggccacgcucgggcggacuccggucuaccccuuuucguuccugucuucuuguagguacuagugaacaucgggaacaacuuugacucagaacgcagcacuuucaucgccccgcgcaaaggcaucuacaguuuuaacuuccacguggugaaagucuacaacagacagaccauccaggucagcugccaccugggggccagggucgcaguagagggggucccuggcaguagggcucuguggaagcaagcgucagaaaucaguggcauaagcucccacugcuccgggaacgugguagcagggccucauacauugcucuuuggcuugcacugccccuuaaacuguccaagguuccugugagagcauccgcagagacaguuuccugccuucuccuucugaaccauuuuguaaagaucccuggguuucccuuagggacuuuagggacuucucauaaggacuguuagcuucacagacagcuaaggccucuguaaggucuccuccacgcucaccuucucgcuuucuaggcucaacaaucaggcuccagcccaaagccuuucugccugcuuuuuccuuuuuuuguuuuuuguuuuuuucuucccccaccgcggacagaaucgcguucacuaaccccacauccuuccuuugcagacuuguuuuuaaacuugaaucucguaggguggacagagaaaagggguugaggugggggugggagagguggugcuacgcccucccgggccagccacuucagagccagcacccacccgcuagccagguccccaaagaugucugcguuuccuuagagcacccgcagaggccgaaaacgcgacuggggacagggcgccuggcccuaggccgacgcuggcacugcaagggcacaaacaggcgauggcgggcgcggcaggaucuggggcaagaauugagagggugacuugggaacgaagcacuagugcaguuucgcggaucucggaagugcggacagccacuccuggcugcuucuaaucuguccugaccacagaccccgggagaggcccggggugaagguauuuguuuaguaauucagggcgcuccuggagcagaguugcuccugguaagcuggcgagaggccaaaggucucgggacucuacagccaccugcggguucacuaaauuggaucguguccaaucgggauucgcuuggcccgcucguuugagaaacagaaaggagccugaccgcccguucuggagaggcagacccuuccacuaccuagauacggcgugggucccuguuagagccuccacagugagcagccaagcccuccuucgccccgcacaccucgugccucaucaggccuucguggcugccagccaagcaccuagguuggcucgccgccgcuuggguacucuuagauggcgcuucugauauaggucgcuuucuuucuuaggugagccucauguugaacggguggccggugauuucagccuucgccggugaccaagacgugacacgcgaggccgccagcaacggcguccucauccagauggagaaaggcgaccgagcauaccucaagcuggagcgggggaacuugauggggggcuggaaguacucaaccuucucuggauuccucguguuuccccucugacuggcacguaucgggaauggaggcaggagagaggcaggaggggagugagaaagaggccgaaaauuaccagggcgaggaagcggcgccaccggaaacuuccuacguguucguagcuacacuggguaccaaggugcgcgccgccggcgguccaacuucguccgcucccuuacuaagagaaguaaauuucgcuuagcucugcacacucccguuuccaaaauuaaucucgccuuccccaagccagucgcaguaaucgaggaagagacuugccuugucauuaugguuccuuacccacguccaugucccuaacaauuaacgaaguaaugugaaauguuucucccgacccgaccccccucugaacccugccacuuacugaaacuuaguaugccccccugccccaguuugaagagggggucagauuguuuuuuuguuucuguuuccgaauggggcagguaguuuuaauaacagauuuugcucuucaaacaccgcgccaguuaagcuggagagaauucguccccgcuuguuagcgaaggaaagacucaccuucguggugacugguuugacuauacauaaauauguauauguaucauuuguacacgaagaacucuuccagguggacgcuggcuguauuccguauuucuguccuguucggagugaucgugaaaucuaaggcugcuugguguuuguucucugaugcuugucaaugccccguguucuguggcuccaccaaccgccaaggagguucuucgggacgcuucuucuuccucuguaacauacgugugaauagccaaauuuuaauuuugcuuuaauccaauaaagucaaagugggacuuuuauuuuucugaaacagcuuucuaaacuucgccuuuuccggguugcgagguugaggcgggcggagaagcaagagacuuggaagcugcaaggagaggccagggcacaaggccuucuucgcagagccauuucugcgcugucucccgcagcaggcucccuuugccuuuccuguguccccugcuuugguggaaagugagauauaagaccuaaauccugcuaggcgugaccgagggccuggaagcaguuucuugcucacccucaauuccaaaugcaucaggaauuauucccaauccuaguacucgaacccgccugccccgcgugacugucuucacgccuacuuuccuuggaugucuccagcucuauccgcuccgcggcgcccgaagcaccugacacuuuguaccagcgccucugaacccgagguccacccgccaaacaaacccgggcggccggacucgcgauugcgcucauucgcaggacuuucaagggguucguccagaaguuuugauuguaccgaaacauaaugugcaaagcaaaauugaaauaaacgacuucguuuuaagucuggaacgcugacccuguguugaacgcgggugacgcaacgccagaagcgggaggaagcggaggguccaagaccgagauacgcagcccgggugggcgcuggugguccugagcccuucuccaggguuuucaugggcugagguucaguuucaaguuucaauguuuuuugagugaggggugggggaagcagggcuuaacaguaccgcgggcaaaauuucuggcauuucugucuucugcccccacccccaucuccggcucuuucuuagcuuaaagugcuucuggcagccacgcccuucccagggcuaggggcccaggggacuguaggggacaaaagggggguuucugaagugagaugcagucgaaugucagucucuuccagccccaccguucccuucuuuucucuuuucagucucaccgggagaggggccuuaugggaaauuuaauaaaaaagcgaauucuuuucc

SEQ ID NO: 4619 - RNA, 52753 nt, Mus musculus
cggggcagcggggcugggcuccggccgggagucagacgagggagcgcgcgcgcgcucccggacaguucuccgcagccgcucgcccgagccuucuacuuggccaacacagcugccucuaccaccucgcgugcccgguucgugggcuuucagguaggaggcggcgcgcggcgggucgggagugcagcaucgcgccgaccgaggggcgcggcguggauguggggggcgggcaggagcgcccccccguggacacgagcgcgcggggcagcgacagcggcgggcugguuaagggcacguacgugcggggcggggccugcguggggcucggggcgcacgugucgcgggaaauggaguggacaccgggggcuucaggggaagacauccaaacgaccgggagucacgcguggacucuuucgcgcgaggguaggugugcagaccggccaggcgagccucgcguccggcaucgcaagcgccggcaguuuccuucuugguucuugggaugguguuuugcuucugcgcccgcgcugguaggagcuaugcgcccuacccgccuaccucgugcacuuguccacgguagauuuaaaccacacacgaauucgaaaaacaaagugaaacuacauccacgcccagugggagaugaggugaggagcugcgggggugggccggucccgcaccucacggcaggaacgcagacagguaggccgaggccgcuugcauggaauccagaccaagcgggcagggucgaugugcuggagcucaucagaggccacccgcugcgggagccucucucgcugcagcgaugcaggccaugggcucucggugccgagguggccuccgggguaaggcaggcagcuuuucccuggcgggccuccgaaucucgagacagccucaccuagccgccccacccccaccccacccccagccucuucuguuucugagaggugguuuuuuaguagcaauuuaaagaacuaccguaggaaacccaacagcagacgucugccucuuuucugaagccugccugugagugccgcaggagcuagagcaagcagcaguucacagcuccucuauugagaaauccccagaaaccagcuguaguugcaccugauguucucauacucaugcgcuggcaugaaauaaggggugagaacuggauaaugaagcuacagcuuuaacccugaaaggccugggaaacacccacugagcccuaaccuagccucacaguauccuagccacuagugacauugucagccacucugauguccccuagcaccugcugagugaugcucggucaggugcaacugagaacaagacaaguggggguggagggugcaacugagaaggagacuuggggguggggcaaagggggaauucucuuuucauagaggacaugucuagggaagauugccuccacccagguggucgccaaccuguucauccuguccucugaugagguuuuuggugagcagugcccacugcuggacugucaaccugauggcaggaauuccuuggcuucugauagcaaaucccuucucucugguuuacagcuguucuucucggccugcaaggccuucuuugcauguacauucugcaaaugugauuaacuaacccauccuuuguuuucuacccugcuuuugaaacucggcccuucuuuuccugucccagcgaguauacuuaaauucgcuugguggcagaaccucccacauggaaccaguuuccaucccugugucccgcuugaaccauuuucagacaguuguacuuuggcucagaucgcuagccugggucacucgcaggagcccggugguguacuauucccaaaucauugaaucgcuuccagccuuugccuuuacccucuuuaugccuucauuuugaugagugucugugaaggcuuccacuucccuccaugauuucaagucccauuaugccccuagcucccucaccucuuuccuguguaccauguuuaaaacaauaaaugaaugcuaauguaaugcuuauacguccaugcuuuccugaauugugauaacuaaugaauaccaucuaauugagacaggaaagucauuacaaaucucaaacuccaucacucuuuuagacuaaggauucuucuaggggcaggugacaccaccaguucaaacugccauaaaauguuuacuuggucauugcaaaaugccuagagugucuugccguuuaagguacagcagcuggaccugucacuaggacacuagccucucuuuucaacuucuggcuucguauucagacuguuuuuauaugauaccaaucuuuagaaggcacuguuaccuuuguccuuguaagaaacaggcccccuuugucaauacuugcagcucaaauuucagaauuguucuuacacgagacaguuugagucacaugucaguuguccaugauaauuuuuuugagauuucuagcuuuagagcuaaaaugcaccucacaugguaaaaccaaauaaauaacaauaauucauugccacacucuaucuuuucaaaaacuguuggaaucaguuuuuauuuuuucaauuuuuauuauuccagaaagguggauagauaccuuggauuccuuaacauucaucaagugauaagaacaaaugaaauacugacuuggagcaauaaaaugaaucauuucuggaaugaacagccaugugcuuaacuuguuucggccuucuguuacuaaaacacuguuaagggacuaaaaagcugcuuugguaauccuugucaaucaacaugguagaaagauuucgugaacuacagauuacccauaaugaauuugaacuuuuguuauccuuaguauuagcuuuaaguauggccucuuauuuuggugaacucaaaggcaguuuccugggcugugcucugaauucccauccuccgugagcuuugagaggaguuaacaccagccuccccagcugucaugcuccaggcagccagccuguuggccuugccuuugccccagggagaacagccugggaaugagcggcagguccaggaaaggcaguauucucucacaggauucauucccuuuguuauaucaaaaugcauucuccacaccaaacaggauuucaucucuguagcauuggcucaaagagccagucagugcugaucccuggaaucugguucauuucuccuuaaaguaaaagggaagguucuuuauucagaagagcguacaucuaggguacuaaaggccauuuccaaucagcuccugagagguagguauccuccauuggucuguuccugaauuacuccgaaguaagagucuuuucagcucucuuccuguugccuguucagacacaaaucagaugcaacauuguucuuucccugaccaaggauuagcuuucaaaauuaacuuuguaacuagacaucaggucuucuguuugguaaaggccagguuuguaacauuuuuuaucuuguuauuaauuuuuuauuuaaaaagaauacuugugauuugcucuuggcucucauguuaauaucagguucuacauuuucuuagucugaguucugaaagaaacacuguuuucuuaauuuaaaaauugcaacacaauuuucagaaugauuaccuuagguauucuguagcaugugaagguaggaauuucauaugaaaauuuucuucaaauaaaugagauuuccuuuaaggucacagggaaagauauaaugugauccuacagaccugcucuggaaagaaagaaaaaauacacauauaugaaugaaaccuaaaacaccagaugcuucccccaccccaaagaaauaaugagcuguucuucauaguugauuauggagacaaaccaagguuuagccaacugagcaggcacccagggagugccagcaguuugugaaaucaggccuccgugcugcagucagcagugugcaccguuucucacuuuugccuccagugagaagacugcuaagcaggcuucuugaaaaguguggcaccggcucuucuuucugcauguuuaccuuuauccuaugaucagaagguagaugaacccuauacguacccugcacacacauaauuaauaaaugagagaacuucaaacggaugauuugaguguauauuucagauuuaauguguuagagagcuguuugguauugucauuguggguggcuggauuacaguuuuggaagagcuaucuuguuuuauuagcugggggcuuuggcacauuccuucacuguguauucauuuacaugaauaugaagacuuuccauggcucagaaggcucuccacuaggucuuugagauggcugcuaaccagagagauuguugaaccuuccaucccucaaaagagaaaugaaagaaaaaaaaaccugaguggaccuuuaaggauggagaaugcagaaacaugagaauagagacuauguuuuuaaaacucuguuuagaaaggaauauuuccaaauuaagucaggggcacaugcauaguccuuccaccccacgccaggccucagugacagaugcagaagccaaugagcuccccauguguguaccccccccccuccacugagccagccuuccuucccuugcucuugcccuggcagccaaccucaugacuuuuugguugguucugcccaguggaagacagcagcaagaggucauaggugggugggaaagaggcugagguaucugccucuacucuucuagugcagccagggggagucggggaagugacccuggaagauccuggcugugcugucucccuuuaauaaucagcuccuaccuaggggcccugucuccuccccugagugcuagugugcucugggaacacuuucaucuucugcccuaggccaggaggucugucagucugcggguucucaacaucugcuaaugaguucuaagccugccaacaccugauugguaaaaauccauuucgccuacguuucauuccuuucuuccugugaucucacaaauuugccucaguauauaaaauguuguguccugacaaccaauacauuuaauauacuucauucuuaauguaggagcauuaauuguauaguuauuuuuccaguggguauggauuaaaugcuuacuuacugcaaguuuaggucagcugcgugacauaccaaagcuauacacuucaaaugaacaaauuaagauuauguaguuuuuacgaauauuaaaguaaaaauauuaggaauaauuuaaguauuagccaauguugaauccauuaauaaagcuuguguguccccaccacauagacagguauuaaugucgugggaagucauaaagcucucuuguguauuugaaauauggagacuuugccaaauaucuucauuguuggaaaagcaugacaauucuugcuguugguuuuuaagcuuguaaaguuuuaucugugccuacuuuaaacaaauaggauuuuauugucauuacauaaaauaggugaugauuuagauuuuuaaaguaagagcuuugaagcaagccacaauaucauauauaucaauauuuagauauuuaugagugaauucuuuucaucagccauuuaacuuaauuguguauuuuauaacugcugcuuacaucgcuugagcuucuugccaaaacagagagugcaaagcaauuaaaaaguaaccuuugacaaauaagcuaucugcaugcaguagcaaaagccagaaucaauucagugacgucacuacucaggacuagcacucacaggcaaggagaacaagcuggcugagcuccuaauauucucuuguaaugacucuguaaauaagcguggauguaucacaguuuaucugauuuucaugccauauuagaagauuuccugaauguuugucuaaucuacucaguuacuaugaaacuggugccagucugaaaugaugccuauucaggguguuagggauguguugagauaagguuucuguagccuuuucagguaagaccuaaacuuuugagcgccuuaguucuuaccgagucaucugccugcauuuuacagauggcucuggaguguaaguccucagagugcaccacacauggcuucucuguagugauuccaggagcagaaugugagagaauggagucucuuuccugcgcuugcuagacuggcaucugaucaguugucaccucucuucgagaaguaacacuugucuacccuaagagcuugucugugaagauggaaugagagaguucacgcuguuggcuaggcauagcugagaguggucccccaacaccuaacccagguucaucuccacugccccgugcuugcugcauaccucccgaagccagaugaguugaguucacucuuagcauaugaacguccagacaaugucuuccuuuaguauuaauauaaagucuuugaccuucaaauuuaaaacaaagacuaccuguguacuuaguaacaguguguacauaacugacaguuuugcaaacuccaaauccuuuuuuucuguauuuauucaagaaauguguauugacugccuuccacagaacaucuaauuuacugggaggacugaacauuuguuagugaacaaaccuagagcacgaggaaauaucugguuuuguuacagccauguuuucuccuugugaugucccugcacaaauagugaauagguccucaucuugcaggucagacugaccaccugauccagccugcgacacaauuaugacagccauacauuuguuuucagccgaagcauccuuaaagagauacuuuacaagccaagauuuggcuguuuuguagaugacauuuaauuuuuuuuuuuuuuugccauuucuaacuagggauuuaauuggaaaaucagcauuauaaauuuuauguuguuguuucuauuuuuaaguuucaaggauuguggcucugcugccugcaaauuaaagauggagauagcugggaauguugcucuuguacauucugccuuuuagagugguuuccugggcuuuugucuguggcaaauaucauuuuaauaaauuuaauguggccuuuaaauauuacuuuuuaaaaaaaccuucuauuuaaaaugugcucugagaagggaagaugauaccuacguuuaaggucaggagcaggaugcacggagauggcugcacugguucagcuuuccucgucucugacuacauucagucagagaaccugccucucugagcucucagcaucccugugagaccucgugcucauuauguguguaugugaucguccaugucccauagcuguggcacugcgugaucuucuucucccuuuguauagagggacccucuuagccucacccccucaccccaugagugacagggaagcuuggacauaaacauagagcucacucaugugucuccuguuucuccauaaaugacuuuuuggauuaugcuggaagaguaguucuuuaaauagaauguccucccauggaaauugcccacagugcugaguauaccuugugaaaggugaggcuggaauacagggugcacccucagcagugcccagaagccuggugcagucucuggagucuccaaaccaaauuuauagcaguucauuaguguaugggaucaugaaauccgcacauugccaucaucacggaggagaacaaagaccucagacaagacucggaagauggagcccuguggaggguucucccuugcucuauagaaacucacgugccuguuuugagcccaguuuucuuuugagcauaugucuugcugagcaaccaaaaggauguuuauauccuagucacuuggcaaaagucuaacauugcuucagagagauucauuucaaaccuaaaggauggagcuuaaaaaacagaugagguucaguagucacaagaacuggccccaccuuaguuuucucuuucguugcuaaauggaaccacccuuuuuuuucuuuccuagaacauaaauagguaggccugaaaucaguuugauuauucccaccccauucuaaaugaaaacaggcuugguguuguccacagagaugagaagcauuugaaacuccaugauauagcuauugccugaagaauuauuucuauuauaucaaauuguccuauguugcugagacaauuuccaaaucacugcucauuaaaaagucuacuugauacuaaccaggaucaugaugcauuuaaaggaagcacaggauuucugucagcuauuucugaaagaaugcugguagaguagauagcagcacgaugaucauuguccuaggcuaagauuguguccuuuagccucuuuugugauucuggugucuccacuccacacagcaagugugucuucauacuguuuucuuagaugccuaagucauaggguuuccuuuuaauauguuaacauucacauaaugcccgcuggugcuacccgggcauuugcccaugguuuucaccuugcgaaccacaccugaggauacucauggaagugccucccaaacccugauucaccacggaaucauucacaauuagaagcggaaacccauucuucccaucacaaacacaucucuuugaaaagcaguucucuuguggacgguguuuaacgucugagaaacuaggauaaccuuauuuaugagcacugcucgaaccaaagcaauuugugugugugugggggggggggacggacggacggacucaagguuccauguuuuaagaaaagcaucagggguuaauuccacugggaagaccaucuuauccauaaacuguuaacacacuaaagagacaccuucagagccagcacagguccauguuugccugaauagaauuaauaauuuauaggauuaauugagagugcuuuuugaugccagagucuggguguguaggguugauauggcagaggcagcacuugcccuagucuuucagcuugcagaggugggaggguuuucugccucagcccugcaaagucuguucacuucucuuacagcacugucccucaagacaguggcccuggcucaggcccaaguccuggcuggcucucacuuaccauuaaacaugauauacccuuuucuuguaagcaguguugcugaauuugaaauucuuuuguuguuguuguuguuugggggggucucacuuacguagcucuggcugucccaggauuccuuguguagaacaggauguucuugaacucacagagauccaccuaccucugccucccgagugcugggauuagaguaugugccacuauacucggucuaaucugaaaauucuuaaagauuauaaaucccuguuuucauuugucuuuuuuacaaucuccacucucaucuauugucaaacaaaugacaucauuuuguuccuaucucgguauaaugccuuuuccuuagcauucaucuguggagggaaaucaaaacugauucugucacuuggugguuugggauaaugauuccuuaauugugauacccaaguaucucagugaaauauugacucagcguccauugaucguucugggcuauaugguaacuauuuuugaagaacauccauguauauuucuauaguagcuaauugacauuccuaucaauacuugugugaaagggucauaaaaaaaauaaaauaaaauaaaucccuguuuucuucucauucguuccuaaaugguaugagagaugaaagaugagaggugagaggugagagauagagagagagagagagagagagagagagagagagagagagagauugggauuauuggcuugcccauaccuuccauucauuucuacagcugcagcauaaaaacuguauuucugaucuuaggaaugguugcuggcagggagcuggggagcugcucaguuggcucauuucucaagcaaaaggagcugaguuccauccccaaaucaccggcuaaagauuuuaaaagaagaggaggaggaagaggaggagaaaaccaacaggcuuggugguauacauggaggaaguggagacaguugggucccugggacuugcuggccagccaaccuagaauaguuggaaaguuccaggcuaguaagaggcccucuauaaaugaaugaauguggcaguacuauaguguaccaguugaaguuaucgucugccacccuacacacauacgcacacacuugcagggaugcuuagaaaaaagaggaagccagaggaauaaacuaaaagcaguuagcugacccuuuugccguuugccauuuugguggcaggggcgggggugauguguuacuaauccugcacuacuguuuaauauuucagcuuuaaccucuuucugcucgaagacugaauccagaagcuuuaaucuggccaccacuuaaugagagggcauuugcuuuucuuguaguucuggaguucacacacaggaaaucucugggcuuuguaccaggcuagaugguagugccuagugaugauauguguguguguguguguguguguguguauguauguauguauauauacacuaauauauccuuuuguaaggcauauuaguaacaaaaugagaagugacuucauuaaauugaaauguuugaugucucaguaugcaaagugaguuugaauguauacaucgcacacauugcucuucccaauuggggauuucacagcauuugaggauuaagguugugggucauuucauuuuccugccauuuuaaagacauaccauuuccaacuguuaaguucccuuuuguugaaaugugcccguuuuuuguuuuguuuuguuuuccuauaacuuagcggaaagcucuccauuaugccucuucauccgccauuacugcuuugccuuuugguaucuuuuuuuuuuuaauuagguauucuccucguuuacauuuucaaugcuaucccaaaagucccccauacccaccccccuagucccuuacccacccacugccccuuuuuggcccugggguuccccuguacuggggcauauaaaguuugcaaguccaaugggccucucuuugcagugauggccgacuaggccaucuuuugauacauaugcagcuagagacaagagcuccgggguacugguuaguucauauuguuguuccaccuauaggguugcaguucccuuuagcuccuuggguaauuucucuagcuccuccauugggcacccugugauccauccauuagcugacugugagcauccacuucuguguuugcuaggccccggcauagucucacaagagacagcuacaucuggguccuuucgauaaaaucuugcuaguguaugcaauggugucagcauuuggaagcugauuaugggauggaucccugcauauugcaaucacuagauggucuauccuuucgucacagcuccaaauuuugucucuguaacuccuuccauggguguuuuguucccauuucuaagaaggggcaaaguguccacacuuuggucuucauucuucuugaauuucaugcguuuagcaaauuguaucuuauaucuuggguauccuaaguuucugggcuaauauccaccuaucagugaguacauauugugugaguuccuuugugauuggguuaccucacucaggaugaugcccuccagguccauccauuugccuaggaauuucauaaauucauuuuuuuaaauagcugaguaguacuccaauguguaaauguaccacauuuucuguauccauuccucuguugaggggcaucuggguucuuuccagcuucuggcuauuauaaauaaggcugcuaugaacuuaguggagcauguguccuucuuacugguugggacaucuucuggauauaugcccaggagagguauugcuggauccuccgguaguacuauguccaauuuucugaggaaccgccagacugauuuccagagugguuguacaagcuugcaaucccaccaacaauggagaaguguuccucuuucuccacauccucgacagcaucugcugucaccugaauuuuugaucuuagccauucugacuggagugaaguggaaucucaggguuguuuugauuugcauuucccugaugauuaaggauguugaacauuuuuucaggugcuucucagccauucgguauuccucaggugagaauucuuuguucagcucugagccccauuuuuuaaugggguuauuugauuuucuggaguccaccuucuugaguucuuuauauauauauuggauauuaguccccuauccgauuugggauagguaaagauccuuucccaaucuguugguggccuuuuugucuuauugacggugucuuuugcuuugcagaagcuuugcaauuuuaugaggucccauuuaucgauucucgaucuuacagcacaagccauugcuguucuauuuaggaaauuuuucccuguacccauaucuucgaggcuuuucccuacuuucuccucuauaaguuucagugucucugguuuuauguggaguuccuuaauccacuuagauuugaccuuaguacaaggagauagaaauggaucaauucgcauucuucuacaugauaaccaccaguugugccagcaccauuuguugaaaaugcugucuuuuuuccacuggaugguuuuagcucccuugucaaagaucaagugaccauagguguguggguucaucucugggucuucaauucuguuccauuggucuacuugucugucacuauaccaguaccaugcaguuuuuaucacaauugcucuguaguacagcuuuaggucaggcauggugauuccaccagagguucuuuuauccuugagaagaguuuuugcuauccuagguuuguuguuauuccagaugaaucugccgaucgcccuuuuuaauucguugaagauuugaguuggaauuuugauggggauugcauugaaucuguagauugcuuuuggcaagauagccauuuuuacuauauugauccugccaaugcaugagcaugggagaucuuuccaucuucugagaucuucuuuaauuucuuucuucagagacuugaaguucuuaucauacagaucuuucacuuucuuaguuagagucacgccaagguauuuuauauuauuugugacuauugagaaggguguuguuucccuaauuucuuucucagccuguuuauccuuuauguacagaaaggccauugacuuguuugaguuaauuuuauauccagcuacuucauugaagcuguuuaucaggcuuaggaguucucugguagaauuuuuagugcaaaguucuaucagaccuucaaagaagaccuaauuccaguucuucacaaacuauuccacaaaauagaaauggaagguacucuacccaacucauucuaugaagccacaauuacucugauaccuaaaccacaagaagacccaacaaagauagagagcuucagaccaauuucccuuaugaauaucgaugcaaaaauccucaauaaaguucuugcuaaccgaauccaagaacacaucaaaacaaucauccauccugaccaaguagguuucaucccagggaugcagggaugguucaauauacggaaauccaucaacguaauccaguauauaaacaaacucaaagacaaaaaccacaugaucaucucguuagaugcugagaaagcauuugacaaaauccaacacccauucaugauaaaagucuuggaaagaucaggaauucaaggcccauaccuaaacaugauaaaagcaaucuacagcaaaccaguagccaacaucaaaguaaauggugagaagcuggaagcaaucucacuaaaaucagggacuagacaaggcuguccacucuugcccuaccuauucaacauuguacuugaaguccuagcuagagcaauuagacaacaaaaggagaucaaggggauacaaauuggaaaggaagaagucaaaauaucacuuuuugcagaugauaugauaguauauauaagugagccuuuugguaucuuuucuucagcaacaaaguaguggacuugacuugcccucccgcagagaacuguguaucauaaauuccaaccugagcuuccuaaaggcauuuuaagaaugguaguuccccuugugcaguguucaaaauuggcaucuuaaaaaaguguacugugaccauuggcauuacacauagacgugaacgauacacaagauacuuacaagauggcuuuagguauguuuuguucaucuuguuuuguuuugaaaaugcaucugcuagcuagguauguugauuuaugcccacagccccagugcuuggaagacugaggcaggaagaugacaaguuugaggccagcuugagcuacacagacacuaucucaagaacacaagagcugagauguagcucagugguagcgcucuggucuagcauguagaaggccuugggguuugaucaccagcauagccaucaaagcagacaaaauacaucugucccauuuucauguguuggcggcgggcacgcuagcuuggaagaaccauaguagggauacuuuuccccuguguguguguguguguguguguguguguguguguguguguguguguauguguaugggucuuugcauguguguggacauguuuguggagacccaagguugacauugcaaaucuuucuucauuguuugccaucuuauucauugaggcagaaucucacuugaaaccacagcucaccaggguggcuggucugacuagucagcuugcucuggagagcccaccucugucuucugggagcuggacuuacaggugagccaucacauccacguccaccuggcauuuacguggguucuggagaucugaacuccaacccuugcacuugagggcuuuaaguuccgagagggugcuuuuaagcaaugguuacugccaucacuuucaugucuguguaauuucuaguuuacauuuuuacuuuugaugugucuguaucaggccacuagguagugagccaauagugugaggagaagaaaaugacaaacgugucucuguauacuuaaaccacaugauaugaaaaugaaaccuaacauaaugcuggauacuuuucucucauucaguguauuuuugcccuacagaauucucugaacucuguaccaacaaacacaacacuauagagacucuuaguuuuaauauaccuugaaaguguauaucuguucugcagcuagcauaccaguuuuagcuucuuuaugacauauuuaaaaaaaaaacuuugucaacuaacacaaucuggaaucuggugauuuaggugccauuagaaccaaauaauugagaguugcaccuagauguuaggccuuguggcagcucaccauucacuaagcaagggguccuaaugaggcuaaguacucucuauaugagcaaaaagaagcagccauguuuacauugauaaaauuggacuauagcuuucaaaagggcuccagacuccugcagccagcagagguuaucuucagugugcugaauacccauacaaugcgcuauauuuuacauacagcuuuugguagccaaugcaauaaauaccaugcuuaauucucuaugugcguuguuucaauuaaucguaggaauaaucucaugaacuagguacaucuaucucauuuugcaggagaggaaaugaaaaacaaauaaaaugucuuacaucccaugggauguguugaguagacauuccagcauguuccaacucuagagacugcguucauggcuagucacaacacacaagcccagcuguguccacaugccucccucccccaccuacuucacaaugcaaauagauggcuuauauuaucucuguugcaaaugacaaagcuaaacacuaaaggcuuccagagacacacccaaaguugaaggcgcuggggucaucuguggucuugacagucaucuguggucuugaccccuugauaaaggggguccuucaucccugaucgcuaccaccacucuuuucuuauggccuggaguaucuaacuauguuagcuacaguucugucucugcuuuagagugagcacucuguggaucucauugaucguugucuucucuccaccaugcaccacugcagaaggggugagaguaugccuccuccacauguggccugucuuucuucccauccccauuacaauagggagaucuggcaaggcggagaacaaaggcuuugucuuggucaccguuagcuucccuucucugacuguacaagcacaugcuuuccagcccuuuugguucauuaguaccuuguguucuaaagcaccuccccaccguaaaaauagaaggccugugagucauuuacacuuuagguugaaugugcuuucgugacuuucccaaggcuaucugugcuucacuccuuucuuccgauugcagagugaaggucucugggcuauccuggcuccuuggacaggaagaaggagcuaggagucguuggccugaacaucggaccacuggagacccacugccuguaaacgcuugcacugcagcugaugcuuaccuggcauccacagcagccuuugcucagcaucggacucugagccugugcucacucucucccucucugcucagcaucggacucucagccugugcucacucucucccucucugcuuaagucagguggauuccugcucuccucuucuugccaguuuuuucugagaacauuuuucaucuuuguaguaaucacaucuuggauuuuuccuguguccugcagcauggugacccagcuguccccaggaacagauacaggcuuaaaguauaccccuucugcugucugcaaccaccugguacccagagaacccagauaugacuggcuagcgcucucacuuaggcucauuuugugugugugugugugugugugugugugugugugugugugugguguucacauauaccaugcauguggagcaggaagcaccuguaagauauacauuagcuuucucaguugcuggaacaaaaugucugacauaaauaaccuaaaaggggaaaauauuuguuuagcuccugguuucaaagguuucaguccaccacacacugaaagcacagcggugcaaucacaucauggaggacaagaggcagagagaggcagagacaaagauggaccccuagugaccuacuucuucuaaacccugucccuguccucccaccucccaauagugacaucagcuggaaccaggcaacuaacacgugccugugggagaccucagauucaaacuguagccuaguaaaugucugagaaaugcccaggaaaccucugagaccuucaguucaucuguaaaguaccgucaacaccuagcuuauguugauccccagaaaccaaaagaagcaaggauccgagagcacaguccauuugagagaugaugccaugagaugcuggugaacgagagagacauuaagcagaaaacucuuggaggaguuuggaagguaggcagccuucaggcucccugggagucugagaugcagguuggaugaggcuguuaaccacaagcucccagccuuugguaaugguuauuuccucucagucccagcgcuuacagugagucauccaagcuuccuuugcuuucauaaaagucuuucagaugaaauugagagagagagagagagagugugugugucauugcaggagccuguggaguagcaagggcugaaggcuguggacggcucccauguacugucucccaggguggagguggugggagcagagcagauguuauugggagaccauccucaguaaggguaucugugcaacacgcugggaagaauuagauuaucugugucuccugagcagcucauuaucucaggcuuuguuguagcagggaacaacgagcagcuaagaagaggauaaaaaaacugccaaacaguucauuuggcuaaacacaggaguccugcacucaguggugugaaccacuuauuauuaaugcugauuacaaugcugucuaauaaugauuacgcaugccauuaaguaugcaccagauuaacuuugucaugaaauuuacaacaguaggcuugauucauacaugcagucuucauaauuuauugcucauguagcaugguuaugacuucaaaacaaucuccaagacagcauugguuugaugaguguguugcucuccauagguacaguugcucugugaaugagaaaugccugcuacacgugucaguggucaucagcucucccuccacugacaagacgguuucccuugucuaaucaggaagcucagaaaugccccaccuuugugacugcacuugccacaggucauugacugaugcaaguggcuuugauuugaaccagucauauagcuugcacuaugcugaguugaaccugauucugagugguguggauuuagauguggguuugaaacugauucugcccuugcagcucauggucuagcaaagacuuacacuaacuuuauagaagauuacugaagaaugaaguaaacauaagccauuaaguauguaguagugcaugccucuuuucccagcaucucacagcuucagagucuaaggcaagaagaguuugaggccagccugugcauauguaguaagaaacuaucucaaucaaucaaucaaucaaucaaucgguagcagacugaagcaaaaguaagggacuuacuucaucucgcuuaccucguuguggaggaacaaaacuguuguuacuugguuuccagaaaaaugucuguaaagcaacagucauuuuguuuucagaaaugaguagcaccacuggcuguuugcugcacggucuuagccuuugugcugagaauguccuaaagucauuuacugguaaagucuaagggcuuccuuuugcuaagugguagcacuuugugaauccagguuuaaaaugucaucagcuaugccacagaaagcuaacuagaagaacuucacugcuacaacaaaggcaaauucucuccgagucaggcuuagcauucucacagacugagccacauguguuccugaaguuuacaauuucacaugaaaagaaugcuccgggaagccaugguugggcacaucucucagaauugagcauugaaagcuggaguuauagcagggccgauguucgucaucaggaagagaggagaaugaagcuuggcagaaaaagucaaggccaugaauaggacagagcuagucaaaggcagacugagggaaaggcuagugagauccagggacaggaaccugagucucuggggagaccaaguguggguaggguagauaagcccaaccaggucacacugagaccuucccagaaaaagauuuguguggggaucauuuaaagagcccauguaccaucauuccuagcugccuaccuaggaacaugcuagguggccauguaguuucaggcuguaauaaacccuugcacauaaaguggcccaugaauagcaggcaugguuuaaagggacuuaauccuugauucuggguagagcaauggucagagacaaacaccaacuucaacaaaugagugccuauuauuagacaggaccaggguaucccugaagucaucacccuuucccuccuauccaaacugcugggguauucuuuauauguguuucugacauuauuccacccacacuucaugcuggaccuucagagaaccuugggaccaggucaucacuuuaccaucaacauggcuccacccucucccccaucucagaccuggacguugcaucucaguccugaagccucuauugugacuauagcccuucagaaaacccagcaggcuucuuaacuguacuucaaagucuguucucugaaccuaguggacaguacccuuggcacauucucccugccucccaaggcccuccauuuuccugucucuccaaaggcaccaucauucuugugauauacuggcacaaucccaucaacauuucucaucugugccuucccucugccuagaucugaaacaucccaagccauuccuacaggacauacuugugccugaacuccaaaugccaagagccaucaggauauucauccugucgguuuuagcuuuugauuuaucauccugcauagcuuuguagcacuuagugcagugacugaagguacaagagaggcucaaacaauggacuuguuuuaacugcagugauuugggauauuggacacugggcucagucuuuauccauuguucuuagcuucgagcuguauaacagcuguggcuuauuugagcuggaaaaggaaagaggcuuugauaucacagaaggaggagccaggcaagaaaucuuuucagaggaccaacuuugcccacuucugggucugauucugucacucacucaugagccugacucuugacucugucacucccucuggacgcuuuccuuugcuaccguguugucagcaaaccccacucgacaugggauccuugucugccuaaaauuaugccaagacucaggccaucugaugguugagccuggaucacaucuaagcccaagcugcaauaaagcugggagagugagccucuggcuucugugugauuggaaauccuuaucauguucaaauuaauccuaaauaaagguaacauuagcaaaggaugggcaggccauggaagacaauaagggacaggccuucagagugaccacuauagagccucuaaccacaagccucaagagacaggaggacauucuggcucccuaaucuggacaugggaugcagggguguggaaggggcuguuuuaagggacacgguccccagucaucccccuggaguaaggacaagagaaguggauaugcuggauccccuccauuuccugacccugcugaggaccccaccccuccuggaggcucagaggccaguaagcccaugcuugcugcccuacugacccacacugaaguaccaagcaugcugaccaagggaaagccaccaggagaaacaaaugcaagacagacaugcugcccuugagucuugcugggauuccacaggcacuguucuuuucuuuuguccagugucuccgcucagggugucacuuugcacuuugaguaccccagaccccaagacagcauucuucaaguguucuggugcugcauguuaagggugugcuauucuuaccccuuguuugaaacuuagaacguucuuuuguauaccucagcagccugcaccauuaaaggugagcaaaggucagccaggccuauguuuucuuucccaggauugugagacaagagugaacuguguggccugugcagacacgaugucaggaaucuuguuaaaccuuguugcagaaaucccuucuccaucugguccuacccauguggucucuuguugucagcccacugcucuguauuagugucuagccuucuaaagugguagauauaaggacugccauugcaguaagccccgugucacuaacagaaguuauaaggcccacaaaggacucagcgacuguaacuccgaguccagugaagaaugcuugggccugguucaccaccuucuucagaggcauauuguguucuucacagagaauggaagccagcuauagucccauagacuaguagaauuaaguaucacgugagaaaucuagauaaaagagcuuuugauuuuccuacuuaaaaugacauuaauauaauucuuauuuuaaaacagcaggugauaaaaacaagugcaaagagcaggagugugcccucuuccaccccugccucacaacgacauuugcagugcgguagaaaaagaugcaauccgugugauuacguguugugaugcuguguccuuguggggcugagguguucucucuccccucucccucuccaaguguguguguguguguguguguguguguguguguaugacagggucuugcuauguaccacaggcuguccuucaacuugcuauucuuuuguaagacccuugagugcuggcauuucaggugugugccaccuugacuaucugcugcacacacacacacacacacacacacacacacacacacauacacauacacauacauauacauauacaaauacaaagagagagagagacagacagcucacugugcugcccaggcuggccuagaauucaccaccuuccuaucucccaccucagccccccacuuaacuagcacaaccaccacacccacauuaagacaguuugaacucugcugcucuugcaaaguccaggccagcagcugguggagcagaggcugugucucacugaaaacaaacauuucaaaguacucugggcucuguccgauggcagccaccuccaaggaccuuauucccgagcagcuuccgccccuuacguguuaauuauacgcaugcggcucuccugccaacguaggaauuugguuuauuauauuaggaaacauuuggaugaaagaaucugcuggugcugaauacuuagaauuccuucuguggcuucugucauagcauuuguagacaucaguugcccguuuauuuuuguuagaagggggaguccaagaaaagagugcgauugguacuuaccgcaaacauaagagucacagguuuccaguaccaucccggacauaugaagagucccacauggguuugccaaaccucagcggcuacuccugugcuucacccugcgguagggccagcuugggccauguuagucucuucacaugauguugcugccccuccuuguggccuaaucauggaucaccgugugguagagaagugagcucuggaccaucaggcucagaagggucacugcaagcaagcaagagaauuguucugcaaagaugcagguaagcacuggcugaguccguagccuuacaagauccuaacccucugauucuaucgggcugagcccuuagcucuccuuacuuacgugagccuaaccuuccuccucacuaugagaaagugugaguucuuccaaccguccucacuuaguaaaagcuucugccacuguucucagugagcuuuccccaagggcgugucuguggaucacucugacuuacgccucuccucaggacugcuauaguuagcaccugaaccuuuguuuguguugagcuugccuaaugucugucuucccuaccggacugugagacucaugagggcaggaaccagacccguuauauuuagaacuguuauagucaccacgcugucagcacuuaacaaauaucguaugauaaauauuuguuuuaaaugcagggucagaauuaguuaaaaggcaguuugagcugcucuuaaauuuauucuagugcuucagcauuuacugccuguguuaaugacuuuucucccugcucugacuaaauaucugacaaaggcaauuuaaggaaaacuauuaucuggcuuagguuugaagguacaauuuaucaccaaggggagucguggcagcagcacccugaggcaacuggucacauugcauccaaagucaagaaucagagagaagaauccuaguggccaugcuuucucccuucugucuggaacucaagacuauggaauaauggugggucugccuugcucaguuaaaccuuucuggaaacauccucacagacacccacagggguauuuuuaugguuuugcugaguucaguccaucugacaaugaagauuagccaucacacuauguaagauuguuucuccuuucuguuuuguuguaaaauuugcugaauccuaccuguaaguacaauuuauacauaaaugugaauuucugucagguauaugcccuuguucagccucccucaaaugcccagcuuccauuuacacaccucagccugcauuuaacaguggcuaauucaaauaugcaugguccuuuccccauugcacacucugcccccauuuuuuauuucauuuguaaauauucuaguguuuagcuuucuaggaaaauaacccauaauuaaauaauaccaauauuaauagcacuacuacuaauaauaaacuaacaggcaucauggcacagaccuauaauucuagcugcccaaaaagcugaggcaggaggaugcaaguucaagauuuacuugggcuauagagaaauuucaaaaucacccaacuugcaacuuaguagcuuagcaagacccugucucaaaaaggaaauuagucaaagacuagagacuagcucaguuguggucaaagacuagagacuagcucaguuguagucaaagacuagagacuagcucaguuguggucaaagacuagagacuagcucaguuguggguguucaccuagcaugcaagaggcccugggcacaaccucagaaacccagaaagcagaaacaauuaucuugccaucacuccuuaagcauccuuugggaaagcaugacucagcauccuaagacucugagucaguguuuccauccuccggaucggcuugcgaugucuuacagugucuauuuucauguaauacggucacuuauuuauuaggaguuguaaaaaugcucauacgcccuugugaguuuucucuaacuaucguguucugucagguaaagucacacgagagaggacaagucugcuuuuuauuucccuuuacaaagugguuucaaaguaaugaguuguucucugguacaguucaaaaaugaugaaggaaugaaugaacaugcuugcuuuuauucuauuguuagucuuaccaguacuauguuuuaauauuuuuaugcauuggcaacauuuauuucuguuuaaauugugucucugccuauuggaagucgaaacacaucaacuugagugcauuuuccaggaccauaauucucucugaaagcugccuuacugaagauguagacaguugguagagugcuugcuuagcauguauaggcccuggguuucaucuuuaguaccacauaaaucccugggggacugugccacaugcccaugcgaaggagccaggagaauccuagguucgggaucauccgaggcugcauaucaaguugaaggccagccugggauccaugagacccucucaccacacaaaagucccuuucucuaaggcaagguucaccgugaacauauucugccucagaccucacauuugguggccagaugagggcauuggauccccuggagcuaggguuucagguggcugugagcugccuaacaugggugcugggaauagaacacuggcccucuauaauaacagcaagaguacuuaacugcugagcccccucuccagccccagaccucccucacagccuuuagugggaauuuuagucaucgcagucuugguagacagggacugguuauuauuuacagugaacaaagauagaaaguguauagugguguuuuuuuuuuuuaaagagaaaaaugaauccauucugcaacuaacuggcguuagggauaguggugguuuuaccuggcuucacagaccuuacauccucuccuauaagggaaacccuggguccaaguccugccaaggcauucccaguuggcuguccuuggcacugcucagagccuccgguuaaucgcauccagauguggucagcagugagccuacugaucuguuugccgucuccuuuguuugucaggcaucaccuacagcagacugucuguagccagaccaccgaccguuuauacagugagguccaguccuuucauuuuccuuugcaguuuuaguaauucuuuuucucaauuuuguaauucuucauaaauacaaaagugucuacaugauugccaagucaaaucuauaaagcaaggaaucuauauagcugaggucuggcaucuccccauucucuuuuugcaugaaaaaaaucauuuuaaaguauaaucuauucuuuuucuucuugugccguuauggugguacacacuaggaguguagugucacuggugcuuguaaucccagcacucagaaggcagaggcaggaggaucaagaguuccaggccagccugggcuacauagagagaccuggcucaaaaaccaaaacaaacgaauguaauaaaaugaagccugcugguuucucccaccuccccuggggugagcucucacacacacucuguccccuggguaaugaccaugccgccuccuggccugccugccugccaccugcccuugaccucauuagccuguucucagcuccacagcuacuaccacugccaugucacucccccccucaaaaggccccacaagaucccaucucauaaagugagggcccauguccuuuccacugcaugggucucuccccucuuguuccucacucccauaucucuaagcccucucaaaccuucuuccucuccucacuguauucuagcccaugguuuccuggcugcucaccucagggccuucacacugccuaccaugagcagaauuccuucugauaauucucagcucccacuugccucccucaaguccuggcucauuggcaccuugucucagagccuucccuuuccuaugucuacuguuucauccaccuguugccuuagccuccauaccucccaccaugcucugggaaacuuacucuagguacacugguguucuccacuaagaggggacuuccauaaagguauggacccuuaccacucuuguccccacagccuguacagaauaggugcuccuuagguauugagugaaugaaugaagacuuugugaacuucaacugaaaaaaauuacugaaucaugagccagagucacauaaucaucuagagccucgcugagugcaugauuucaggagaacaagucucucuuuccauuuaccagagcauggcuucuuccucucccaugucugguggcucuggaaguaauaaugcugauaucagucugacaacccaaagguaauaguaauggcucauggcauaguuguucucuauguuaauaugagcucuacaggaacucauuaaaucauaucaaugcaacaacccagcaaggguggcaugauguccccguuauagaaauaaaccaacaaagcauaaacaguuuauuuuuaauugccuguggaaauauuucauaagugacacagcuggagccagagucucgguggaguucguggacccaggccuugagccagugcucugcaugacuaggaagacgauggguuuaccccaugugugugguauccaacuuaguacucucuaccaguggugacuuaucacuugacauauggcugguugcccucaaucccacuuuaauugugucuagucuuaaccacuuuacauuuaaacaagagcacacugaugcuguguuggaccacucuacugcagagcuuuguaaacaggccuggcagaguggcaaagugccauucaagucgucacacaguuguccuguaagcccaaagggacaaccuguuuccaggauuccaagaaauggcucagacccuccagcagugucauccacgacuuggauuggacugcucuaaucuccaacaacaacacaccagaagacagcugccuacauacguuuguuccuuuuugucagaagaaaugcuugaaggugcaauucugcaaagccagcuugcaaaguagagguaggaauguuggaaguuuauaaaucauccuuagcugcuuacaaguucaggaccaaccugggcuaagggagaccagucucagauagauagauagauagauagauagauagauagauagauagauagauagaugaauaauuaaaugaugauaucuuuacuguguguaugaaugucaacacuauuuuuauaauguuaccacucguuacuucugagcuccauacauguugauacauaagucaugaaacaucaguuuuacauaauauaccauguuuaauuaaccacuccuuggcugaugaauauuuuuagggugugcccaguuucucauacuucuaauugugacgagggacuguauacuccagugcaucuauuuggaugcuccucagaaaagauaacuugagggugcaggaugugaucaucgucugugaagcugguacucccaguaucccgcaugcuccagcgugccauucagacgcccaccacugaguuuacggagccuucauccugccuuccaucaacaucggcucccacuggccaacuaaaaguggcugagcugagauagguggcugugauuuccguuugugucgccaggguucuuagugagguucauugcuccuuauugagcagcaggacaccugagcuuucauauuuggugaaauucuuggaugcuccuuugugugcugaguggucugugugauugauuugugggguucaauauaauccagucagcacucuuguucgccaacucuguggcaaauguuuacccccccccauuugcagcagacuuuuaaccauuuugugguuuauuuugucuugaugaagguuuagaauuucaugguggcuucugagacaucucucauuuuuuguugaacugauuacaagucuuauggagucuucuagaagagauagggcugacuugugguguccugauuuaucgguugauuacuauuucugaaagaauaaaaacuucccuugugcauauuuauagcauuuuccguaaggaacaaaguucauuuuuaugucaucgugaaaugccgugcuauagagguaaugauuuugugauaucgaauaauaaaacguugauggugguaaagccuuauaaucgauuuuaaagcaggaguugauuugccucucguuucuugcucuuugcaguuguuuguucauggugcugcuuccuggaggauuuuuaauauaaguuauugggaucugauaucuauaauuacacuaagaaugaauuucauauguuuaaaaguauuuuaaauaccaucucucuucagucugagauuacaacagacuagagucacuucaccaaccuugaaccccagcucuccuccugccugccccaugggaacgugcaagccacuuuaacuuacuaguugguuuccuuaucuguaagaugggcuaccugcuguaaccgugcagaccuccuggggcugcucuggcaguuaacggaacucugccucaucagagcacccuaagcagcaccccaguauggaagcaacacaccacagaggccaugguguucgcccaucugguggcuucagagucucauaagugagaacaagcuuggugcccucuggaagguggcuuuaguuaaggugcagccaccaucacugauugcccuucugugccaucagugaaugaggaaagucagccugucggggacacagcacugcuggguguggcugucuucccagagagacccauugcacucuugcagccacccaagcucagugcuuuccaacacaguaaauggaaaaugaaggaaacccuggcaagauaucugugggguggugugugugugagugugcgcguacgugcgugcgugcgugcgugcgugcgugugcgugcgugcguguguguguguguguguguguguguguguguguguguacaagcacagagagagagugugugugaucucaaaauaaaguccuucacacaugugacuguguuguauagcuggcugaguaagauguguuuggcuucauuucuuccacuagucgacaagcucuguguaaccccaggcaguauuuagcaucagguuggcggcuauucuuuucuuccuuucuuuucccauauauuuguuuguuuauucauuuuacaucccaaucucagccucuccucccuccucucuucccagcucuacccuuacacaccccucccccuccucuucacccucuccuucucagagaaggggaagccccccaucuuuuuguuguuaacugacagcuaauaauuguauaucuuaguuuauuugugauaaagcgugacaauauuuucugaauugcugauaauuaaaucacaguaacaaauguauuaccuccuguguuuauuuuuuauggauuaaaacgauuuuagaucuacuuuuuaucagcuuuuuuguuuguuuauuuguuuauuggcuuuuaaauacacucugccuuagcauuuccguccucacucugcaggaacacauuccaccuugcugaaagcuuguagcuuuugcucuauacuuuguuuccccucugcucugacucuggauccugcacuucuggucuacuccugagcuugcuauuuuucaguuucaugugaacaagaugagacaguacuugcuuuucugcgccuuguuuaucucacuuaauacgcuauccucuagguucauccacccugccacacaugacaggauuuccucccuuuaaaggcugagucuagucuaccgucuguguguacauuuucuucauucaccuauugauggauacagguugcuuccacaucuuggcucuugugaucaaugcuguagugggcauggauagcaaauaucucuucaauauacucauuuccauuccuugggaaagcagcuguguugggggauuguucaggguuauuuuccacaauggcuguccugauucacauucauagucuagcacugggcaaagguuucuuuuccuacaaccucacuaacagcugugaucuuccuugguauaguaaccauucugauagagaaaggggccccacugcuguuagcaaacaucuugucauuuguuuugcacaguuccuggcugaaggguacccuggagccuuguaggaggcuucccuucugccagcucagucaggcacgggacucagggugagaagccaaaugucagaaucagggaacccuccucccaacuuccgcuucuauuucuucagcucugaggaagaaaccaccauucaaguuggagugcgguuaacaucaaaaggagaacggugagaauggagucuccccaaaauuacucugagcaucacagcugcguuagaacaacggucagcaugcauacaaaaggaccuaaaccacauucuccucgucccggccggccgucacccuagagcaagcacaguucuuccuucagcuccucuccugcucaccauggcucagcugaaaucauugccuaugagauaaccacucacgguuucccaucaccacaguguucucauggccugccaaacgagaacuugcaggccuagcauguaaagggaccagggaaggaggcagaguggggccugcuguugaggcuggcugcuucuguguucucugccugugccaggcugcguauggucuucacuugccgucuuugaacugagagaaccucagcuguaaguguguuggugugcgggaugcuuccccagagggauucgcucugcucugacaacacuuugucaaucucggguaaaaugagaccuuucucuuaaagagaagguuacagcuaauuuucuguaagagcaguaaaguuaagaagaccuucccugaggguagaaaaaccacaaaacccaggagcagggacugucuucuuucuuacaguauuuacuauccccacccccaccccugcugccuugccauaccaggcaugaaggaacuagucacuuaagcaagaaaacuguacuccagaucuuaagaaccucaauucucacccuuaucagugucuuuuuaaaugaauaauaccgugaccuucagcuuuguccuccauuaugggagguugcuucgcagagaccgcuccacuuuccuaaauuaaggcggcugcugucuguauuccgcucagcucuaguguuaguauugucccaagugugacauuuaugcucuuucgcuucuuccuuauaaauaaauaucaaaggaggaagaccagugugaacuccacaaggaauaauaaacuacaauaauacgccauugauuuugugcaggaugucuaaguguguuuuuaugauuguguauguuuauagcuuuuucacacaagugacaugaauucugggcaauuaaaaaggacguggauuucaaaacauuuaggaaggaaaucugcucucuaacggcugugcguuauagcaaguuggagcuccuggugaaaacuagguuucagaccuccaccuuaagaaaccagaguuauugccauuuuguauuguuuugcaauaugauuacccugagacuacauuuggggacuuuauuuuggcugcuacguggauguaaccauuuaaucaggagcugauaaagagucuuuugcccacaguguaucguccugugagcucccaccuacugcgauuccuagacugcagccugaguccugugaguuggagcucaaccuucuccuguggagagaggagagcacacccccucccugcccccagaggcagaggauaccugugagcccuacagaguugccuaggacugggggaggggguguuccaugccagcagccuuccaaagaugguuuugggacagucauuguuguuaggaauucagugaggugauagacccugcaucucugggcaccucuuuccccucuuucugcccuucuuagagcguucccacgguucccuucgacuuccuggugugugguuuaaauuacucaauaaugcauaaauaccaaagccuugaaaaauaacuaaagcauuacagagaacuuagucacuuagacuccucccaagacagaucgcuauuccaucuccucugucacuccuuccccuuccgagaucagugucugcacuuccauacauccaagcacagugugaaggcaauagcacugggcagcuagauagaucuguucuuuaaagguccuguccccucuaccaguacugucugugugucuuucugcaaccagccuuuuacauccuucccaugaucguuaaucugccggauccacuugguucccauucauucucacggcaugccugggcuguaguuugcagagcucuucucccaccccaggccacuggcucucccggauuucugcuguuagaaaccucugacaucugugauuucucuagcugugcgccugccggugggauugcuggguccuagaauaugcagagcucaccauauaagaaagugaugucaacagcaaaccgcuccaaaauggagguuuccgucuguauucccaccuguuucccugcauccucaccaacucuuaauauuauuuagacacugaaaugucgcuaccuuccauaguugccaggcagcaugauuugcuuccguguauacuucucuuauuacugaagagaccgagccacuuuucauguuuaucagcuauugauauuuccuaccuaugauguacccacucgaacacuuugcccauuugcuguugggauguuuauccuacuuauccguggaaguuaugcagaguaaguguaugugugagugugugugugugugugugugugugugugugguauagcauauguggggugugugugugugguguagugguguaguauauguggggugugugguagagugugggguguuaguauuuguggagggguguauccugcauuaugaucccaugucagcuaggcaaguccuaaccucuucccagaucacaucuccuguuuuagauucauuuaugcuaucucuuguccccauugaucuugaccuuggcugucucuucccguucuuauucuuuuacccaaacugccuuaugaacccauauggcaggaugauccuacgugggugaugccuccaaauggcugugcucauuugaagcuuggagcugcgacugcagugaugggugcuggaagcacuuccugcagauacgggaugcaucugucgccagcacccauuuucccagcccaguggcagaacagccgggcauuguguuagacuuucccugugcugacauauaaacaacugaaaggggaaggguuccuuuccucaugauuugcauggauucaaugcaccguccuuggcuccuuugguucugggccuguagugaggcagaauauggcguccacaggagcaugcagaggagagcagccugugacugaggaagcuaccuucaaaggugucccccccaccuguggccuauuuccuccuguuagaccuccaucuccuaacauuuccagacuuuucucaaacaccagcaguagcuggagaccaaguguucagcauguaauucucaagaggacaucucacauucaagccgccagaaguggcagaugccucccauaccugugucugagucgcaggcuggaggucuguaggaaggguguguggaaaugaugcaugcauucauuauacacgggagucuuugugugcgugcgugugugugcaugugcgugugcgugugcgugugugugugugugugugugugugugugugugugugugugugugauugggaaggaaaaaccuagcucagcaauuuccuugcugccugcuuuucagaaacuguuccacacucccagagcuauauuccagguuuuuauugugcacuuuaaauugggauauaucucaacaguugcauuuaauugggugauuauuaaaaaccacgagcaaguucagcggcucagccagaaaaugcucugguguccagcuugaagacuugaguaagaccaaccuccucucggguucacuguccugcugggaccugcacaguaagggggaguaaagauaggccuauagguagacauguccucacaugggguuuggaaauuaccuuagcaaggccugcccuaaugacagcccccacccaugucauuaaauuaccuacuucuaaucauaaaugaacugaaaaaguucaacccuuauuacagucaccgcagaaagcuauuuauugucauauauaaauacacaguggacagagugcacacaguuaggaggguacucucauacucugaggcagggaucuuguuuuggaggcacgcagaguaacaaaagguaauguuauauaacaggaguuccugggagaacggaaagaggaauccccugcuuccugacagacucagcugcagggucaaaagccagucugggaaugcacucucccacacuugggagcacacggcacaggcaguggcuggaacgucuguggaaucccaaguccgugguuuuggaguaagugcgugcauaucccacugacgggcaaauucugacaucagggcguagcuucccuagucagcuucccaucaaucauccuguggugaggaaggaaggcugacuuuagcuuccagagacuccagucuguggucagcucacuccaccgcccucugcccugagcugaggugucacagcagggcacaugugcgcagcucauugaccaucucauggcauuaggagacauuuuggaguucuuucagacaggucgugugaguagguuuuuaguuauuggcuuauacacaggcccaucuucuccccugguuacacucccaaaggcaggcaguuguaacccagucuaugugcagaccugcuggguuuuauugauuuauauguaaaauaaaaugcucacacuuuuacuuaguaguuuucuaccuuuaaaugucuagaaacauuuccccugggucaggugggagcuuauacaauaccaucaccccuuccguuucuucuucuucacuaugguuuuccuauggagacaucugucugaggccacugucguccuccgcccacuguaggugacucgauuguuucuggggggugugggauuugggauccucuuuguauuucuaugacucagaaauugcagugauauaaaauugcacaccucacuuguuuggguguuuuaaaaaaaaauccccuucaguaagaagcuacuugguaucuguugugugcuguaagggguagggagaagacgggccacugucuucucauggcuguuauuucugccuggaaagcagcauuauguuuaccguacagauuggcaauagcauacccugcuggaacuugcuguguauccauugcaauucaucaaucugugguuuuauuauuugguuacaauuggaauuugaggauccucauuuuuaaaccuuagggaguucccucagagccuaugcugcucucugauuuauaaaauccuucucgcuuguguuucauggcuaauguuuucuauaggcaaucuacauguucacguucacugaugcuucccucucgaaucuccaguguguguguguguguguguguguguguguguuuguguaauaugaauuugaagugugugugcacgugcguguguguguguguguguguguguguguuuguguaauaugaauuugaagugugugugcgcgugcguguguguguguguguguguguguguguguguguguuuguguaauaugaauuugaagugugugugcgcgugcguguguguguguguguguguguguguguguuuguguaauaugaauuugaagugugugugcgcgugcgugcgugcguguguguguguguguguguguguuuguguaauaugaauuugaagugugugugcacacgugcgugcgugugcgugugcgugugugugugcgcgcgcgcguguguauguguguguguucuuaacauucugagcaugccuuugggugcucacugggaugauuugguccauuugauucauuucuccuccugugcauccucucuucuccuuuccucacuucgcaugguguuuuuuguuuuguuuuguuuuguuuuguuuuguuuuuaguaggggcugaagacucuugcccauuucuuaaagacaccaaugcucauggaagcacugguaauguuuagcucagaacuguaauugguuauccaaacucauauccucuaaguggacuucuuguggaguaggaagugcaucuuguuaauuggaggcucacuggagugcuggagacauuugccgagugagugggugaggggugcugcuuuauugggaaucaagacuacaggugacaguauuucuugauguguucacagggaaaggcagcuuacccuacaggacaucucucuuucaggcugcagcucuuugggagcuguuaacauuagcaccugcccugcugcuguggcggggagcacuuucacacgaaugcugucaugccucauucuguuaggaucagucugaaugucacuugggggaauuuauccuuggugauguguccuaguccucuucuaaucugaucucagugugaaauuaucauggaauuauguaaaaaaaaugucucuccaacugucuaucuuuuuguuucauuuuugggcaauuuaauucucaaaaggauacauaagguccaauguguaauuauauauauguauacacauauauacauguauacauauguacacauauauacauauauauguacauacauauauauaauuuuauacauuuggccuuaagggucaguguauauacauauauuguacaauguauaauucucuuaagguccaauguauaauuuaugaagacaguaggugcauuuuaaggcugaguuuucucacuauuuuuccuuucccagagcauuagaacuguuucauauguugacuuaaucuuuugaauguucagaaccugagaaauuagaguaagaaagucagaccaugccccaccccuugcuugaaaggcaguaucacacagugaauucaggucccauggagccuggucgcugggagugcagcuuugcuccugcuagccguguggucuuaggcaagaaaccccagcucgccaggccucagguguucuaucuacaaagugcugucaucacagugucucuucgagccguuaagaugauaaaacugacuguuacgaaacaccaugaauuacccucuuccauggugagugcagugagcguuggugugaguucagaaagccaucagacaaaauaaaaauaagguuuguuccauccgucagcauuuuauccagucuacccuuuccaaggaggaaagaccccuucuauaagcauuacuauauuacuauguauuguuaaugacaguguuagcacgcugugauuuuggaaagcaguugaguagugaggaaagagaagccuuccuggcugccuccuggcccucaggacagcagccgugacacugcccccaugcugaucucccugggucaccaucaccuaaagucuacaccgguacuagaaucucauuucagacaaaaucuacaguuuuucuccauucagcuuuaaauucugccuccaaacuguccucuucccagcccacagggcugcuagagagcuugcaaagccacagucaucuugugccggagcuguuuacugggacacuuccacaccauuagcgacgcuugcaaccuuauucuagcccuuccuaacucaguaccccuguguucuguaguauuccagcuucacaaacaucuguggcauauagaauauuuccaaguuguuagggacagacuccugauuuaccauuucuguuccauuuuucagucuguuuuauuaguguuuggaaauucuucccuuuagcaucaucugccuggguugucaccaucgucacaugccaugguucuguuauuaagacuauaagccauugaaaagguuuaaucagaguguuuuguagcugugacuuggcuaaugggcuuuugaaauuuauguuaacuuacuguuuaauuuagucauucuccuggcuaauuuaugucaucuugauacguugguaaguuggaaucaucugggaagagagaaccuccguugagauagcaucccuaacaaacugaccugugggcaagccuuuggugcauuuuauugauggauaauugauguaggagggcccaaguaacagugcgucaccccuaagcagguuguucacaguuguguaagaaugcaagcuauuauaagaaagcaagcuaaguaagccaugggaagaaagacaguaagcggagucucucuguuuucugcuuugguuccugucuccaccuuccuaccuuucuugcuuuucuucaagguagacuguaauuaggacaugaaaacuaaaauaagccccuuucccccaagaguugccuuugguugcgguauuuuaucacagcaauagaaacacuaaguaccauagucaucuugggcuagauaauguuguccaugggagacuucugugcacauugucacaaccuaaucuuauaucuacaaggguuugucaaccucacaaguaaaugaggcacaugagucuaaaaucaaaauuuccccauuaccauuagauugucaauauagaccaggccugggccacaccagauauggcaaccgucaaaagagugucaaagaugcacucaccccaccucccacucuggaguaucagugcccugcaggcauccaugacaguggcucugugggugucugaggaugugguuucaguugggcaggccacacuccaccaaacagcagccugaguaaucaaaaugacuuguuguaaaagugaagauuaaguagggguacauugugaccggucacaauuucuaaacaaaucuuccugacugauugaggccugacacugccaaagcugcugcuauuacugagcaugugggaaaaacaagacaagacaagacaagacaaugggguucuugagugccugccuuagcguugcuggaucucucuagagugugauggacgcaggcagggaugcugcucuuaagaugcgcccuaccauguaaccaacagcugcugcugugcucagaccccaccgguucucuaguguuuagcaaaacagagagggucuuuuauccguguugagugguggguuucgcuggcucuccagacauuaucuuucauaagugcuuagcugugguaagugggaaaagaauguuucuuuuaaauuuagcaaagagcauuucugugcauaugugcucugccacagccacacuuaggugguaauagaaauaccauggaaaagcaaacccuaggcuuucagcaucgcuguggaggccggaggcuuccuucucucaucccuccuggggagaugguuaggagaaugagagguuucuccggucugaguugauaagcuugcuugcuguaaaaugucaauucuuuuuuaggcuccggaucacacuauaauaaaugugaauguaagcaagugugcgagugcuuucuaagcaguccucgcaucuacaaucacaugcauucuuuuaucuaguaaaugccagugaaagcuggggaggaggcagugccauuugcaugauguacacuacccaguguggaguccagccacugagcaggcuugcauagagagucaaauucagucuccuggagcccacugugaccuucccuggauuacaagaccggaugucuuugagauagauguaagaugagauuucuacagccuugcuaggacagucugggcaugcuggggaugucggugucuuugcuacuugaauaggcucuuguucuaggauguuauuccuguguuguccugguugaccaaugaccaaaucaaugaagacacauucaaccaauuauggcaggauuuaugcuuuucaaaacauuugauuaucgagucagguaauagggcacagggaagaaagaugauauagagauauaaaauguguauggggccugaggaagccuugagugagggugugcuauugacaugagugcagccauaucaagggccugaugccucagacccaugggagcaaacaaagcugucccuagggugaggcucagagaaacccuuccucuggucugaguucgaaugucagcaguaugugcagaagcucucaaccauagcauccuccuccuaagugacugcauccugagccuguccaacugagacuagcuaaccccgcccacugugcugcacacgugucugcuguagaguuggugcugcuccagcagagcuuggcccaccugaucccagcuugucucugcgccugugcgccugugugccugugugccugugcuuucuucacucccucauccccagacaaauuuccuggaccacagcaugcaggacacagcugguagggucugcucaccugggcucaaacccagcuccacuuuucuaguggcaccaggcgaguacucaaccccucccugccucagcucccucuugugugaacagggacaccaagaccuucccacaggcuuguuaagugaauucaugcauauaaaaacaacuuguacuuagcaggaaguaaugccaacuuguggaguuuuuauuuuaagcauuaagaaaaauauuuuuacaauugaaauaucaaaagagguggagacacuggggaauucuuuggcuuuagaaggugaaucccaggauagaauguguccgagcugacagucagauaccaucugacauuaggacgcuucuauccaggcaugugcacaucugcuucaccugggggagaugcuuaaagguaccaagaguuuggguguuguuuuuuuuuuuaauuauaauaaauuaaauucucaucccuuccuuccugucuugguaugcugcuuucucuuaugcuguggucuguaaauguauuucucuuccuaauuugacucuguuuuuagaucuagcugugaauucuuuauucucucacauagacauaugacagugggggaggagagcaugcauauuuccuaaauuuucacaagaaaucugucuugcuaucuccaaagaguggaaauuuagggaggagcauccaguagucucagcuuccuccaaaucguacucaguagcauguccaauaugccacauacaucagucagacauuuguccugagcacagugaaggcuucagaggagugaaauggggcgggcuuguguggacagaggggauuccacauccucggguaacucugggagccaucuuaguugauacuucacccacauccaccguguuuugucuuauaggcuucuggaauccauuuuguccguagaguggauagaagccccugaaucguauuucuggaggcagcccuacccagccacugccaggaaaguauguauccagcaauucuggaacaugugguuugagguugaccagugcucccucugugauccggcagcagccaccaccugucccugucucuucucccugaguuuccccagcaccugccacccucaaccaaccacucacuucaaagugcuccauucuagaucucuuuucgggcuuccauccuaagacuguacacuucccacaacaaaagucuuaaguuugguuuugccaaauucacuguggacccuaaguugccaagacacauuuuugccaaacuccuagacaaacauucggagcuaagcucaugugcucacuucggcagcacauauacuaaaauuggaacagagcuaagcucaucaugaguacauaccuauuaauaugcagcccucagugggaguggccuugggucacagcuaccugaucccucccugacucguccuccugcaauuugggauauccaguuuguguucgaggaggagaggagaggagcuuggccuggugugcucagcacugugagugugugcuuucugagcauggcuaggccccagugucuaccccuaccuacuuuaucuccucugggugggugggcacgugaguacuuggugggucugguuugguuucuugagacagggacucgcucuguaguccagaugggucuggaagucaguauagagcucagauagauuucaagcucacagaaguccuccuuucccaaaccaccugagugcugagauuagaagugggggagccaccaugccgagccaucucuaccauucaggccuaacuaacacaagucugaggcugagaaaacccuugccuccccacagcucccacuaauagguaaaucagguacguuuacuuuaaauuaccuuaagaaauaaggguacuccuugcaaccuguuucaggauaccaccuugucccuuggcguuccaaggcccuaguacacguccagccagguccccuccuuucuccuccauuguugcacuuuaugcucacacacagaacagugcaccagcaaaggaugugacuagaucagagcagauuagcaccagggaaaaaugcaauccucguagaagacaauacguuugauuccacacaaguguccuuuagccuuugcuuguaaggcgguuccuugaaguggcuuguuuuugcuuuugagacucacacugucuuugggcugcuuggaagucugugcucagccacaagcacucagacaaagaagccacggccauguucuuguuuacagagguugccgucugagaaauuaaugucugcuuuuacucuguaauuagggaaauuuagggcccuacugcuccaaaauccugcauuugagguuguauguuaucuggguuuucaugaucauuuguuggauuucugucauuaauaacaggcauaaacccagcaagcagcagggugugcguuacauuuaaucaauuugcuaucuguauucaugaugcacguccuccauuuugagucaugaaaaauugagaggccauugcaaacagaaagagcaccauggauuacaaaugauguaacaagagcagaagcacuauuaauuggucaauugugcuugucagcccauuuaaagugauuaaggcaggaagauuagaaaggacaugagcgugcuugggaacgagagcccaggaacacuggggauccauucaguccucagugcccagaagaaugcaacagaaccgaaugcuguuuauuccaauuuuacucaacaaauaauggaugagcacacuccaugugccuuagacugugguggacacagcagaaagcauugcagaggccuuccgugaccucaggaugacauuccaguguguucagggcagauggcuguauagugugauccccuuaguauacagccacaaaacccagcaggaggcugcaggugcauacgugacagcuugggagaagcugucaacaucugaagggaaguuagaaugaagaucuaaggaugcaaagcuuuggguccagcaccccagucuccacccaccacugaagaagaaagagaauuccuuuguagauagcaccugaugacggaugguuuuacuugggaaugucagauuuuacacaggugagggagggaagcaugugguagaaaguccuuugguuuaaucuuuucuccagcugguggaaggccccgcccucccucaugaugcuagacaguagcagcggcccacagucagccacauaaucaugagggcacaugcauguucggagcauuuuagauauaagcacuccacaaauccuauaagauauuaagcacuuuuguuaaaaauaggcuuuguguuggagaucucggcccagcauuaggcuaaggaaagcucucugucauuaagaugugagccaggaguccuauagauuaagaguauuaaaggcauuccuaagguaucccuaacuugguuuauugggauguaaccccuacauaaauuggcguaugaggguuugguuugguuuuaguuaauuauggcuuaggugaaacucaacccacugggaugacuucccaggaccagaaagcccacccugucacuuaucuuguauagacccuucugucauagcuuuuugguuuaaguaaacacacggccucauuugccacugucaccacauccuucacacucaaccagggcacacagaugagaugagacgagacuggccucugcuucugggacacacuacccuuucccagcuuucaucucaccucaggucaucugaccuuaccccgaaucucugcugucugugauccuuagaaaugcaguccucagugccccagacaccuucucagagagccccugccuccagggaucucagcguugcuuugcuuugcucugcuucgaugacaugcuaucugcuaacuugguucucaggaucgucugcacugcguucugagugcugugaaccccagcauguguugcucaaggucagcuuuguguccacaugccuacaacauaccugccccgugaagggccuaaggaagcuggaacggaucagugaagaaucugaagaggaaggcugggagcucugcuguugugugcuauuuaaauguuuuccagggacccacauagaagaaaaggauauucauucugaccagguggcauuaauauuugugcuguuuggcuucacccaguacaaucuauuggcauacauuucuaaacccuauaugaggucuucucaacacauugacuugcuucaacugacuaaagugcuguggcacugucuuuacaagaugagaccaacccagaugaggcacugcaauugaguaacacugcuguaugggcuugacagucuaggacuugcuuugugcagagcaucugagcaguuuggcgaaggaggcgcuggggugggaugguacaagauuccaaguacuuugugcauauaacucacaguggacucaugagucugucuuguuccuggccccauagcaggugccagagaagccaaauggagaaagccaugcugcucagcugcuggcaagagcuggcagucuuugggaguuguuccuguccccacccguauguuagaaucauuggaaccaaagucccauuuuaggucagcugagucaggaucucugggacagggauuucacaucuguccagaauguuuuaaguucuaagcucugcuuaugaacagccagguugagacccacaggccugucggaagaauggcugcagaagaccaagaccacaaaccaaccaaagaauugcugucgauggcuggcauguuucuuugguguguaacuguacacagaaaacaggguuuguaguauaccaaggcuagucacacagcagauaaguggcccacuucccuauugucuaccuccaaagaacugauuuuaaaauugcacauagcauucaucaaacaauuauuuuccuucuauggggcuaaguugaguggccauggcuuucuuuuaagccaaguauuaaauguuggacacuucaucaaauaaagaauuuuuauuaagacagagacuuuccuaauuauggaagcaaguaggcccaaaguguggguaggugauagcugaauuuauguucuucaguuggccaugaguuuugaagaugaagaugacugugggccucugugauaguccagcauagugauaaacugugauguuugugaacacugucugcaauccaauauguucuucacaaaagcaaaguagcaugugcuaagaaguuccauacacaggagguauagcccuccucagccaaugcuuccaucuuuugaauucacagugucaccugugacaucaaggggagcggugcuggauugccagcuauucaucccacuggucaccuugaaagccacagguaucaaguggcaggaaccauaauuuuagagaaaccucagauguaaauuauuaaagaacacagcauuuuaccaaauacaaagaugacccaggagggccauaggaggaaugccauguguauauugcagccccuuguugggaguggaagcagccaucaagcuagggucacaggaagacaaccucaguacaugugauccugaggaagaccugacaguugguggcucucgaggccaugcuccucccuaugagguacaguucugaguauucagcugucuguauggugcagucacacaggagcuuaaaaccugccuguaccgaagaugcuugggcagaaagugggaugaagauggggcugaguauaugugugcuuuuggaagaacucuggagugaaucucauguauaacagggcuaggaagugcugauguauuccagguaaaugacugaaauagauaacaagggauaucaccugggacacacacucgacgaauccuaguaucacaaagggcaaggacccuuaguggacuucaggggacaagauggacccaggcccaagcaaacaucccaucccuuuguugacuucuugaucccuagcccugcaggaauuacacaaagcaggaccagguaguuguggagugaggacuuuauguuucugcacacacuuggcucccugguccuuccugagucagaagcuaaacaugugcagcucaaucgcaaguucaccugcaggggagcuugagagcuuccagguuucaugugcuguggucugggcucacugcaacguuccuucacgugcuguggucugggaucauugcaacauuccaugaagcuuuguguguaucccaaaccacuugugugauaucauagcuccaucuucuccagagcucugaaacagauccauaagggaggauggagcagccaugaggagaacugggaccacacuccagggcuuguccugaccugggguagcuauagcuauggagcagauaucccacccaagcugggaaggaagaauagagggacauauuuguguuccauguggguuagcgucucacaaccuugggcuccgggaccagugccccgaggagcugccuguaggcaguaacacaccacacacaggcugagaguaaguacagagcagaucaagggcaccacggucugcuaggacagacuaugucugcucuaaaagccaaacaugccuccaaaacccaucagcuagcaucuggauuuccaugaacacaguacaccgugggcuucuaccuccucucccaugaggccaugguccugucaaggcccuccuccacuucagugucauuuccuuuuuuccucugauuuuuacuucucauuaccaccagaggggaagucuagaacgugagggggagaaagauauggugaaggaaaugaaacaagaaggcccucuuuguccuuaacugcaaggggagaugcuggugguggucagagacaagacagucuccuagccucggggccucagaaugggagguggccucaagggugcucuuguauggcugugccugcccauugacuuuccuucugucuacuguggaggccauugauacugaagcagcccugacauauccuuaggugcucguguuggaaagucacaaggacauaaucucuaugacuuuacggacaaaguuuccaagaccaacuugucuuaacuuugcagcaaaggagggaguugcccaugaugugacaccuuccuacuuagcugucgaggagcugggggacuggauguguucucugucggccagccccuguuagaggagguccuucuccagcuaguccucucccucucccuagccugcugccagcuccagacacaugaaggcuggcauuauggagcuuauccuugcccuugcucuugguagucguuacuuuuuuaucacuguagaacagguuucucuuggguccugguuucagggguaucaguacauuauggugaggggcuaugguggaaguuugcauaguggugggccagaaacuggaaagagggcauucaggaaggacucaggugacauauaguccugaacccauuccccagugacaugcuuccuguauccaggccccacuuccuacuugccaccacgucccgguaacagcaucauguugggacacaugguguucuaaucaucucuggaaauuccucucauacaugcagucaugcuccacuaguccuccaggcaucucuucacccagucagcuagacaagaucagccaucaucaaaccugaggaaguggcucacuugauaaaauaccacacaagcaugagggcuugaguuuaauccccagaacccaggagaagcagcagcugaagaggcaaggaggaaggggaggagaaaggaaagaagcagcagcucuauguaccuguaguccuggggcuaaggacgcagaggcagaggcagaggagcagagaggcagagaggcagagaggcagaggcagcucuguguaccuguaguccuggggcuaaggaggcagaggcagaggcaacucuguguaccuguaguccuugggcuaaggaggcagaggcaggaggaucucuggggcuuccuguccugacagucuucaaacauccguggguuucaggcucagagagaaaacauguuuauaaaguagaguagucgaauaauaaaccugacaugaacacauacauauauacugcacauucacucgaacacacacacacacacacacacagggagagggggaggcagcugucauuuacucagacuauagacugaguucagguuuuaaagaggaagaagacagaugugggguaugaucuaguucgguuucuguugcugugaucaacccacaacagaaucacaaagaaacuuggaaagggaaggauuuuuugagcucacagcucaggucacucuccauccccgaguaaagguggggacagaaacagaggccauggaaaaaugcgccuaguccucauggcuugcucagccugauugcuugccuuuuugaaggugauuuauuuuuauuuucuguguaugcguuugcccaacauggaugugugcgcaucauaugcauguagugcccaaagaggccaagaggaaacauuagcuucuucccuguaaucgacuugcaggacuugcaggugguugugagauaccaucuggguucugggaacugaaccugagucuucagagacagcagcugagccagcucuccagucccuuggccugcuucuuuauacaacccaggaccaccugcccacgguggacugggccuucccacaucagucaugacucaaggaaaugcucccugggccugccuacagaccagugugauggcagugguuuuuaaauggaggucccauaugacucuaccuuaugucaagaugacaaacucuagcuguccagaaaaaaaaaaaaaaacaacaacaaaaggcuacuuacuaccucucucuaagagaggaaccuacagaaggccccugccucucucuaagaagugcugcuuguucgaacccauuugaacauuuuuuuuuugucuuuuacuccuacauaguuaccaagcauguccugaagaugaagauacucucagccuaacgucuccaagcaaauauugauucagcaguauccccagguaggugcuuuugcuuaaaaggggcuuuccuguuagcccuuggcauuuauugugcuuauaagcugacaagacacauagaucuaaacccacaggagccuucagagcaacuguugguaccgcccucugcuaggcaggaaagaaggagccagagaggauaacugauccaccaaggucacccugccagugagcaucaaaggcaauucuaguccacauaguuaccaugacauuacaggauguuugucuagaacuuaagccccaaauacuaugcuuaaguucuagaccacacacaugugugcacacacacaagcacacgcgugcacacauacaaacacaauguucauuucuccggaaauccugaacacuuuucuaacuucaaaggguagcaaccuagacgugcugauaacccaccuuggccucugccgugggauucugccaagcagcccacuuggacgucacccuuaauuuaagccagcgugauggauuguggugcggucuuucuuaacuguauuauuacuccugcuucauucccugagcacagaaugagggauucucucuacugcgccugggaugcauccuccuugcuggguauaacuggccuauuugcucaguaaaagcaguggggaaacaaguguccuugaagcccagacauaacagaauuccuagcugcccuccaccccugagucugcagauccaggucccccagaccugcucacuuuacucuuauacccugcuaugcugcaguguaaacugccuuccugucucaacugcagaagcccuccucuggccguauguggcacagugucuuuugccaaggccugugcuccacccagaccccuggaaucuaguugcagggcauucaccauguuuauuggcauccuaggugugugugggcucugcagcuugccuucaaccaguccccagcugcucuuuuucuccucucauaugaugcuccccacccucaagggccaaccuggcuagcuguguuuacuucaggugagccuggcuccccuauguggcuuccgguccugcccauccuccaccuguauccccuuucuacacagguuaggcccauauaccccugaaaauggcuuagagugcaggcucugugucuagcauuagagccuuguguuugcccgauaccuguccuuuaauggcaugcagccccagugccuucauauaauuguugcucacaaugcuguccaguggcuguguccagaguaaacaguaagagagcaaggaacuugcuggguuaggaucagauccaaacaggggcugaggcuuucuaucccaagcugcugcccucaccgggguccucaccccugcuauccucaaggaacacugagaagaugaccaacccaccccagccuucucugcaucuguaccacaguacacagauccaugcaugcuuucacucagcuucaacaucuccuuauccgccagaucuuuacugagcauaaguauccccacagcaacacagaguggaacagacaagaggcugcccucugguuacaggaagcugaccacaucaaaucacagacaagcuauguagccagagguuagaggugcaggggacagagcuccccaucagcuacaacaaccauuucccuuccuagcagaguaccaguggcauuaagauaucaccagcuuggcuaccccuaaaccuacaagaugguauauauaccccuacccauagguccuaggcaggcuucacagaacaaaggguccuuacagugcccaccccacccccacagugccucaagaggaaaugugguacuuucucaagccaaugaggcaaagguaaacugcuagagaguaaaagcauuucuagggauaguaucugagauuuaaagagaaagccauaagaaaggcuggucucugggugugguggcgcacgccuuuaauccuagcacucgggaggcagaggcagguggauuucugaguucgaggccagccuggucuacaaagugaguucuaggacagccagggcuauacagagaaauccugucucggaaaaaaaaaaaaaaaaacaaacaaacaaaggaaggaaggaaggaaggagagagagagagagagagagacagaaaaagaaaaagaaaaagaaaaaagaaaaagaaaaaagaaaaagaaaggcuggucucaacgcacagugguggugcacgccuuuaaucccagcacuugggaggcaaaggcaggaggauuucugaguucaaggccagacuagucuacagaguaaguuccaagacagccagggcuacacagagaaacccugucuugggggaaaaaaaaaggaaggaaggaaggaaggagggagggagggagggagggagggagggagggagggaggaaggaaggaaggaaggaaggaaggaaggaaggaaggaaggaaggaaggaaggaaggaaggaaggaagagaaaggcuggucucuccuuccucaguuuugucucuucuaaaagugauaucuagagcauuguaacccacaggcaaagccacaccauauaucagugaacagagaaacaacugcccuucuccgggccccugucugagaagcuggagcaucagcccuggagcucuccggagcaguuuccuugcucacuguccccagcugaacacagguuggucagaucuacucccguucccacucugcccccaucucuccccucugugcuugccaagcaguaaguagacugcucauauuuguggaaugaguaguguguugguguccccaguagcagaccuggcaaugagacuucaugugccauaugaagggaguguuccaggggacaaaaauaagggaauagagauaggacaagggugggugagggggcagagcacuggaguugggcugucccccucaccuccacuccuaaacgucagacugcaggguucuucaaggaacacagaaacucaggcaugugugccgaagcaauggcaggaagcaaugaggaccuggguggggugccugugucugucaguacaacugucuggcuuucuacugcugugaugaaauacugugaccaaaagccacuuggguaggaaagagguuauuuuacauuacagcuucuaaguccaccacugugggaaagccagggcagaaaccuagagcagaaaccaaggaaacacugccuacuggccuguucucaugguuugcccauccuguuuucuuauaccaucuaggaccacuuacccaugggugccacugcccacagugagauggacccucccacaucaauuaucagucaagaaaaugucccacagaccaauucuguggagggacauuuuuuuucaguugauggucucuucccaacugauucuagcuguguugagaugacauaaauaguagccagcauaccauccaaacagacagcaaagccaaggcagccuucaggccugcugucacuucauccuguccuuccuaggaccagaggggauacugccugcucaggaaagccaagaggagccugcuucuccugaaauguaaaaaguacacugugcauauggaaagcauuauuguguuucacugugcaucgccagauucuucuugcaaaacauugaagcuuagcucauaauuuggugauaaaauauugauuauuuauccacagccgcaugcagagguccaaagcacguaaacaggauacccacccugcauuaucuuauauuuuaagucaauaugaagauggacauucuaccccugagaccaauuucgaucaaauacuuuugucaauaaaaagauacuaauguccgagugugu

SEQ ID NO: 4620 - RNA, 19102 nt, Mus musculus
accuuagguauucuguagcaugugaagguaggaauuucauaugaaaauuuucuucaaauaaaugagauuuccuuuaaggucacagggaaagauauaaugugauccuacagaccugcucuggaaagaaagaaaaaauacacauauaugaaugaaaccuaaaacaccagaugcuucccccaccccaaagaaauaaugagcuguucuucauaguugauuauggagacaaaccaagguuuagccaacugagcaggcacccagggagugccagcaguuugugaaaucaggccuccgugcugcagucagcagugugcaccguuucucacuuuugccuccagugagaagacugcuaagcaggcuucuugaaaaguguggcaccggcucuucuuucugcauguuuaccuuuauccuaugaucagaagguagaugaacccuauacguacccugcacacacauaauuaauaaaugagagaacuucaaacggaugauuugaguguauauuucagauuuaauguguuagagagcuguuugguauugucauuguggguggcuggauuacaguuuuggaagagcuaucuuguuuuauuagcugggggcuuuggcacauuccuucacuguguauucauuuacaugaauaugaagacuuuccauggcucagaaggcucuccacuaggucuuugagauggcugcuaaccagagagauuguugaaccuuccaucccucaaaagagaaaugaaagaaaaaaaaaccugaguggaccuuuaaggauggagaaugcagaaacaugagaauagagacuauguuuuuaaaacucuguuuagaaaggaauauuuccaaauuaagucaggggcacaugcauaguccuuccaccccacgccaggccucagugacagaugcagaagccaaugagcuccccauguguguaccccccccccuccacugagccagccuuccuucccuugcucuugcccuggcagccaaccucaugacuuuuugguugguucugcccaguggaagacagcagcaagaggucauaggugggugggaaagaggcugagguaucugccucuacucuucuagugcagccagggggagucggggaagugacccuggaagauccuggcugugcugucucccuuuaauaaucagcuccuaccuaggggcccugucuccuccccugagugcuagugugcucugggaacacuuucaucuucugcccuaggccaggaggucugucagucugcggguucucaacaucugcuaaugaguucuaagccugccaacaccugauugguaaaaauccauuucgccuacguuucauuccuuucuuccugugaucucacaaauuugccucaguauauaaaauguuguguccugacaaccaauacauuuaauauacuucauucuuaauguaggagcauuaauuguauaguuauuuuuccaguggguauggauuaaaugcuuacuuacugcaaguuuaggucagcugcgugacauaccaaagcuauacacuucaaaugaacaaauuaagauuauguaguuuuuacgaauauuaaaguaaaaauauuaggaauaauuuaaguauuagccaauguugaauccauuaauaaagcuuguguguccccaccacauagacagguauuaaugucgugggaagucauaaagcucucuuguguauuugaaauauggagacuuugccaaauaucuucauuguuggaaaagcaugacaauucuugcuguugguuuuuaagcuuguaaaguuuuaucugugccuacuuuaaacaaauaggauuuuauugucauuacauaaaauaggugaugauuuagauuuuuaaaguaagagcuuugaagcaagccacaauaucauauauaucaauauuuagauauuuaugagugaauucuuuucaucagccauuuaacuuaauuguguauuuuauaacugcugcuuacaucgcuugagcuucuugccaaaacagagagugcaaagcaauuaaaaaguaaccuuugacaaauaagcuaucugcaugcaguagcaaaagccagaaucaauucagugacgucacuacucaggacuagcacucacaggcaaggagaacaagcuggcugagcuccuaauauucucuuguaaugacucuguaaauaagcguggauguaucacaguuuaucugauuuucaugccauauuagaagauuuccugaauguuugucuaaucuacucaguuacuaugaaacuggugccagucugaaaugaugccuauucaggguguuagggauguguugagauaagguuucuguagccuuuucagguaagaccuaaacuuuugagcgccuuaguucuuaccgagucaucugccugcauuuuacagauggcucuggaguguaaguccucagagugcaccacacauggcuucucuguagugauuccaggagcagaaugugagagaauggagucucuuuccugcgcuugcuagacuggcaucugaucaguugucaccucucuucgagaaguaacacuugucuacccuaagagcuugucugugaagauggaaugagagaguucacgcuguuggcuaggcauagcugagaguggucccccaacaccuaacccagguucaucuccacugccccgugcuugcugcauaccucccgaagccagaugaguugaguucacucuuagcauaugaacguccagacaaugucuuccuuuaguauuaauauaaagucuuugaccuucaaauuuaaaacaaagacuaccuguguacuuaguaacaguguguacauaacugacaguuuugcaaacuccaaauccuuuuuuucuguauuuauucaagaaauguguauugacugccuuccacagaacaucuaauuuacugggaggacugaacauuuguuagugaacaaaccuagagcacgaggaaauaucugguuuuguuacagccauguuuucuccuugugaugucccugcacaaauagugaauagguccucaucuugcaggucagacugaccaccugauccagccugcgacacaauuaugacagccauacauuuguuuucagccgaagcauccuuaaagagauacuuuacaagccaagauuuggcuguuuuguagaugacauuuaauuuuuuuuuuuuuuugccauuucuaacuagggauuuaauuggaaaaucagcauuauaaauuuuauguuguuguuucuauuuuuaaguuucaaggauuguggcucugcugccugcaaauuaaagauggagauagcugggaauguugcucuuguacauucugccuuuuagagugguuuccugggcuuuugucuguggcaaauaucauuuuaauaaauuuaauguggccuuuaaauauuacuuuuuaaaaaaaccuucuauuuaaaaugugcucugagaagggaagaugauaccuacguuuaaggucaggagcaggaugcacggagauggcugcacugguucagcuuuccucgucucugacuacauucagucagagaaccugccucucugagcucucagcaucccugugagaccucgugcucauuauguguguaugugaucguccaugucccauagcuguggcacugcgugaucuucuucucccuuuguauagagggacccucuuagccucacccccucaccccaugagugacagggaagcuuggacauaaacauagagcucacucaugugucuccuguuucuccauaaaugacuuuuuggauuaugcuggaagaguaguucuuuaaauagaauguccucccauggaaauugcccacagugcugaguauaccuugugaaaggugaggcuggaauacagggugcacccucagcagugcccagaagccuggugcagucucuggagucuccaaaccaaauuuauagcaguucauuaguguaugggaucaugaaauccgcacauugccaucaucacggaggagaacaaagaccucagacaagacucggaagauggagcccuguggaggguucucccuugcucuauagaaacucacgugccuguuuugagcccaguuuucuuuugagcauaugucuugcugagcaaccaaaaggauguuuauauccuagucacuuggcaaaagucuaacauugcuucagagagauucauuucaaaccuaaaggauggagcuuaaaaaacagaugagguucaguagucacaagaacuggccccaccuuaguuuucucuuucguugcuaaauggaaccacccuuuuuuuucuuuccuagaacauaaauagguaggccugaaaucaguuugauuauucccaccccauucuaaaugaaaacaggcuugguguuguccacagagaugagaagcauuugaaacuccaugauauagcuauugccugaagaauuauuucuauuauaucaaauuguccuauguugcugagacaauuuccaaaucacugcucauuaaaaagucuacuugauacuaaccaggaucaugaugcauuuaaaggaagcacaggauuucugucagcuauuucugaaagaaugcugguagaguagauagcagcacgaugaucauuguccuaggcuaagauuguguccuuuagccucuuuugugauucuggugucuccacuccacacagcaagugugucuucauacuguuuucuuagaugccuaagucauaggguuuccuuuuaauauguuaacauucacauaaugcccgcuggugcuacccgggcauuugcccaugguuuucaccuugcgaaccacaccugaggauacucauggaagugccucccaaacccugauucaccacggaaucauucacaauuagaagcggaaacccauucuucccaucacaaacacaucucuuugaaaagcaguucucuuguggacgguguuuaacgucugagaaacuaggauaaccuuauuuaugagcacugcucgaaccaaagcaauuugugugugugugggggggggggacggacggacggacucaagguuccauguuuuaagaaaagcaucagggguuaauuccacugggaagaccaucuuauccauaaacuguuaacacacuaaagagacaccuucagagccagcacagguccauguuugccugaauagaauuaauaauuuauaggauuaauugagagugcuuuuugaugccagagucuggguguguaggguugauauggcagaggcagcacuugcccuagucuuucagcuugcagaggugggaggguuuucugccucagcccugcaaagucuguucacuucucuuacagcacugucccucaagacaguggcccuggcucaggcccaaguccuggcuggcucucacuuaccauuaaacaugauauacccuuuucuuguaagcaguguugcugaauuugaaauucuuuuguuguuguuguuguuugggggggucucacuuacguagcucuggcugucccaggauuccuuguguagaacaggauguucuugaacucacagagauccaccuaccucugccucccgagugcugggauuagaguaugugccacuauacucggucuaaucugaaaauucuuaaagauuauaaaucccuguuuucauuugucuuuuuuacaaucuccacucucaucuauugucaaacaaaugacaucauuuuguuccuaucucgguauaaugccuuuuccuuagcauucaucuguggagggaaaucaaaacugauucugucacuuggugguuugggauaaugauuccuuaauugugauacccaaguaucucagugaaauauugacucagcguccauugaucguucugggcuauaugguaacuauuuuugaagaacauccauguauauuucuauaguagcuaauugacauuccuaucaauacuugugugaaagggucauaaaaaaaauaaaauaaaauaaaucccuguuuucuucucauucguuccuaaaugguaugagagaugaaagaugagaggugagaggugagagauagagagagagagagagagagagagagagagagagagagagagauugggauuauuggcuugcccauaccuuccauucauuucuacagcugcagcauaaaaacuguauuucugaucuuaggaaugguugcuggcagggagcuggggagcugcucaguuggcucauuucucaagcaaaaggagcugaguuccauccccaaaucaccggcuaaagauuuuaaaagaagaggaggaggaagaggaggagaaaaccaacaggcuuggugguauacauggaggaaguggagacaguugggucccugggacuugcuggccagccaaccuagaauaguuggaaaguuccaggcuaguaagaggcccucuauaaaugaaugaauguggcaguacuauaguguaccaguugaaguuaucgucugccacccuacacacauacgcacacacuugcagggaugcuuagaaaaaagaggaagccagaggaauaaacuaaaagcaguuagcugacccuuuugccguuugccauuuugguggcaggggcgggggugauguguuacuaauccugcacuacuguuuaauauuucagcuuuaaccucuuucugcucgaagacugaauccagaagcuuuaaucuggccaccacuuaaugagagggcauuugcuuuucuuguaguucuggaguucacacacaggaaaucucugggcuuuguaccaggcuagaugguagugccuagugaugauauguguguguguguguguguguguguguauguauguauguauauauacacuaauauauccuuuuguaaggcauauuaguaacaaaaugagaagugacuucauuaaauugaaauguuugaugucucaguaugcaaagugaguuugaauguauacaucgcacacauugcucuucccaauuggggauuucacagcauuugaggauuaagguugugggucauuucauuuuccugccauuuuaaagacauaccauuuccaacuguuaaguucccuuuuguugaaaugugcccguuuuuuguuuuguuuuguuuuccuauaacuuagcggaaagcucuccauuaugccucuucauccgccauuacugcuuugccuuuugguaucuuuuuuuuuuuaauuagguauucuccucguuuacauuuucaaugcuaucccaaaagucccccauacccaccccccuagucccuuacccacccacugccccuuuuuggcccugggguuccccuguacuggggcauauaaaguuugcaaguccaaugggccucucuuugcagugauggccgacuaggccaucuuuugauacauaugcagcuagagacaagagcuccgggguacugguuaguucauauuguuguuccaccuauaggguugcaguucccuuuagcuccuuggguaauuucucuagcuccuccauugggcacccugugauccauccauuagcugacugugagcauccacuucuguguuugcuaggccccggcauagucucacaagagacagcuacaucuggguccuuucgauaaaaucuugcuaguguaugcaauggugucagcauuuggaagcugauuaugggauggaucccugcauauugcaaucacuagauggucuauccuuucgucacagcuccaaauuuugucucuguaacuccuuccauggguguuuuguucccauuucuaagaaggggcaaaguguccacacuuuggucuucauucuucuugaauuucaugcguuuagcaaauuguaucuuauaucuuggguauccuaaguuucugggcuaauauccaccuaucagugaguacauauugugugaguuccuuugugauuggguuaccucacucaggaugaugcccuccagguccauccauuugccuaggaauuucauaaauucauuuuuuuaaauagcugaguaguacuccaauguguaaauguaccacauuuucuguauccauuccucuguugaggggcaucuggguucuuuccagcuucuggcuauuauaaauaaggcugcuaugaacuuaguggagcauguguccuucuuacugguugggacaucuucuggauauaugcccaggagagguauugcuggauccuccgguaguacuauguccaauuuucugaggaaccgccagacugauuuccagagugguuguacaagcuugcaaucccaccaacaauggagaaguguuccucuuucuccacauccucgacagcaucugcugucaccugaauuuuugaucuuagccauucugacuggagugaaguggaaucucaggguuguuuugauuugcauuucccugaugauuaaggauguugaacauuuuuucaggugcuucucagccauucgguauuccucaggugagaauucuuuguucagcucugagccccauuuuuuaaugggguuauuugauuuucuggaguccaccuucuugaguucuuuauauauauauuggauauuaguccccuauccgauuugggauagguaaagauccuuucccaaucuguugguggccuuuuugucuuauugacggugucuuuugcuuugcagaagcuuugcaauuuuaugaggucccauuuaucgauucucgaucuuacagcacaagccauugcuguucuauuuaggaaauuuuucccuguacccauaucuucgaggcuuuucccuacuuucuccucuauaaguuucagugucucugguuuuauguggaguuccuuaauccacuuagauuugaccuuaguacaaggagauagaaauggaucaauucgcauucuucuacaugauaaccaccaguugugccagcaccauuuguugaaaaugcugucuuuuuuccacuggaugguuuuagcucccuugucaaagaucaagugaccauagguguguggguucaucucugggucuucaauucuguuccauuggucuacuugucugucacuauaccaguaccaugcaguuuuuaucacaauugcucuguaguacagcuuuaggucaggcauggugauuccaccagagguucuuuuauccuugagaagaguuuuugcuauccuagguuuguuguuauuccagaugaaucugccgaucgcccuuuuuaauucguugaagauuugaguuggaauuuugauggggauugcauugaaucuguagauugcuuuuggcaagauagccauuuuuacuauauugauccugccaaugcaugagcaugggagaucuuuccaucuucugagaucuucuuuaauuucuuucuucagagacuugaaguucuuaucauacagaucuuucacuuucuuaguuagagucacgccaagguauuuuauauuauuugugacuauugagaaggguguuguuucccuaauuucuuucucagccuguuuauccuuuauguacagaaaggccauugacuuguuugaguuaauuuuauauccagcuacuucauugaagcuguuuaucaggcuuaggaguucucugguagaauuuuuagugcaaaguucuaucagaccuucaaagaagaccuaauuccaguucuucacaaacuauuccacaaaauagaaauggaagguacucuacccaacucauucuaugaagccacaauuacucugauaccuaaaccacaagaagacccaacaaagauagagagcuucagaccaauuucccuuaugaauaucgaugcaaaaauccucaauaaaguucuugcuaaccgaauccaagaacacaucaaaacaaucauccauccugaccaaguagguuucaucccagggaugcagggaugguucaauauacggaaauccaucaacguaauccaguauauaaacaaacucaaagacaaaaaccacaugaucaucucguuagaugcugagaaagcauuugacaaaauccaacacccauucaugauaaaagucuuggaaagaucaggaauucaaggcccauaccuaaacaugauaaaagcaaucuacagcaaaccaguagccaacaucaaaguaaauggugagaagcuggaagcaaucucacuaaaaucagggacuagacaaggcuguccacucuugcccuaccuauucaacauuguacuugaaguccuagcuagagcaauuagacaacaaaaggagaucaaggggauacaaauuggaaaggaagaagucaaaauaucacuuuuugcagaugauaugauaguauauauaagugagccuuuugguaucuuuucuucagcaacaaaguaguggacuugacuugcccucccgcagagaacuguguaucauaaauuccaaccugagcuuccuaaaggcauuuuaagaaugguaguuccccuugugcaguguucaaaauuggcaucuuaaaaaaguguacugugaccauuggcauuacacauagacgugaacgauacacaagauacuuacaagauggcuuuagguauguuuuguucaucuuguuuuguuuugaaaaugcaucugcuagcuagguauguugauuuaugcccacagccccagugcuuggaagacugaggcaggaagaugacaaguuugaggccagcuugagcuacacagacacuaucucaagaacacaagagcugagauguagcucagugguagcgcucuggucuagcauguagaaggccuugggguuugaucaccagcauagccaucaaagcagacaaaauacaucugucccauuuucauguguuggcggcgggcacgcuagcuuggaagaaccauaguagggauacuuuuccccuguguguguguguguguguguguguguguguguguguguguguguguauguguaugggucuuugcauguguguggacauguuuguggagacccaagguugacauugcaaaucuuucuucauuguuugccaucuuauucauugaggcagaaucucacuugaaaccacagcucaccaggguggcuggucugacuagucagcuugcucuggagagcccaccucugucuucugggagcuggacuuacaggugagccaucacauccacguccaccuggcauuuacguggguucuggagaucugaacuccaacccuugcacuugagggcuuuaaguuccgagagggugcuuuuaagcaaugguuacugccaucacuuucaugucuguguaauuucuaguuuacauuuuuacuuuugaugugucuguaucaggccacuagguagugagccaauagugugaggagaagaaaaugacaaacgugucucuguauacuuaaaccacaugauaugaaaaugaaaccuaacauaaugcuggauacuuuucucucauucaguguauuuuugcccuacagaauucucugaacucuguaccaacaaacacaacacuauagagacucuuaguuuuaauauaccuugaaaguguauaucuguucugcagcuagcauaccaguuuuagcuucuuuaugacauauuuaaaaaaaaaacuuugucaacuaacacaaucuggaaucuggugauuuaggugccauuagaaccaaauaauugagaguugcaccuagauguuaggccuuguggcagcucaccauucacuaagcaagggguccuaaugaggcuaaguacucucuauaugagcaaaaagaagcagccauguuuacauugauaaaauuggacuauagcuuucaaaagggcuccagacuccugcagccagcagagguuaucuucagugugcugaauacccauacaaugcgcuauauuuuacauacagcuuuugguagccaaugcaauaaauaccaugcuuaauucucuaugugcguuguuucaauuaaucguaggaauaaucucaugaacuagguacaucuaucucauuuugcaggagaggaaaugaaaaacaaauaaaaugucuuacaucccaugggauguguugaguagacauuccagcauguuccaacucuagagacugcguucauggcuagucacaacacacaagcccagcuguguccacaugccucccucccccaccuacuucacaaugcaaauagauggcuuauauuaucucuguugcaaaugacaaagcuaaacacuaaaggcuuccagagacacacccaaaguugaaggcgcuggggucaucuguggucuugacagucaucuguggucuugaccccuugauaaaggggguccuucaucccugaucgcuaccaccacucuuuucuuauggccuggaguaucuaacuauguuagcuacaguucugucucugcuuuagagugagcacucuguggaucucauugaucguugucuucucuccaccaugcaccacugcagaaggggugagaguaugccuccuccacauguggccugucuuucuucccauccccauuacaauagggagaucuggcaaggcggagaacaaaggcuuugucuuggucaccguuagcuucccuucucugacuguacaagcacaugcuuuccagcccuuuugguucauuaguaccuuguguucuaaagcaccuccccaccguaaaaauagaaggccugugagucauuuacacuuuagguugaaugugcuuucgugacuuucccaaggcuaucugugcuucacuccuuucuuccgauugcagagugaaggucucugggcuauccuggcuccuuggacaggaagaaggagcuaggagucguuggccugaacaucggaccacuggagacccacugccuguaaacgcuugcacugcagcugaugcuuaccuggcauccacagcagccuuugcucagcaucggacucugagccugugcucacucucucccucucugcucagcaucggacucucagccugugcucacucucucccucucugcuuaagucagguggauuccugcucuccucuucuugccaguuuuuucugagaacauuuuucaucuuuguaguaaucacaucuuggauuuuuccuguguccugcagcauggugacccagcuguccccaggaacagauacaggcuuaaaguauaccccuucugcugucugcaaccaccugguacccagagaacccagauaugacuggcuagcgcucucacuuaggcucauuuugugugugugugugugugugugugugugugugugugugugugguguucacauauaccaugcauguggagcaggaagcaccuguaagauauacauuagcuuucucaguugcuggaacaaaaugucugacauaaauaaccuaaaaggggaaaauauuuguuuagcuccugguuucaaagguuucaguccaccacacacugaaagcacagcggugcaaucacaucauggaggacaagaggcagagagaggcagagacaaagauggaccccuagugaccuacuucuucuaaacccugucccuguccucccaccucccaauagugacaucagcuggaaccaggcaacuaacacgugccugugggagaccucagauucaaacuguagccuaguaaaugucugagaaaugcccaggaaaccucugagaccuucaguucaucuguaaaguaccgucaacaccuagcuuauguugauccccagaaaccaaaagaagcaaggauccgagagcacaguccauuugagagaugaugccaugagaugcuggugaacgagagagacauuaagcagaaaacucuuggaggaguuuggaagguaggcagccuucaggcucccugggagucugagaugcagguuggaugaggcuguuaaccacaagcucccagccuuugguaaugguuauuuccucucagucccagcgcuuacagugagucauccaagcuuccuuugcuuucauaaaagucuuucagaugaaauugagagagagagagagagagugugugugucauugcaggagccuguggaguagcaagggcugaaggcuguggacggcucccauguacugucucccaggguggagguggugggagcagagcagauguuauugggagaccauccucaguaaggguaucugugcaacacgcugggaagaauuagauuaucugugucuccugagcagcucauuaucucaggcuuuguuguagcagggaacaacgagcagcuaagaagaggauaaaaaaacugccaaacaguucauuuggcuaaacacaggaguccugcacucaguggugugaaccacuuauuauuaaugcugauuacaaugcugucuaauaaugauuacgcaugccauuaaguaugcaccagauuaacuuugucaugaaauuuacaacaguaggcuugauucauacaugcagucuucauaauuuauugcucauguagcaugguuaugacuucaaaacaaucuccaagacagcauugguuugaugaguguguugcucuccauagguacaguugcucugugaaugagaaaugccugcuacacgugucaguggucaucagcucucccuccacugacaagacgguuucccuugucuaaucaggaagcucagaaaugccccaccuuugugacugcacuugccacaggucauugacugaugcaaguggcuuugauuugaaccagucauauagcuugcacuaugcugaguugaaccugauucugagugguguggauuuagauguggguuugaaacugauucugcccuugcagcucauggucuagcaaagacuuacacuaacuuuauagaagauuacugaagaaugaaguaaacauaagccauuaaguauguaguagugcaugccucuuuucccagcaucucacagcuucagagucuaaggcaagaagaguuugaggccagccugugcauauguaguaagaaacuaucucaaucaaucaaucaaucaaucaaucgguagcagacugaagcaaaaguaagggacuuacuucaucucgcuuaccucguuguggaggaacaaaacuguuguuacuugguuuccagaaaaaugucuguaaagcaacagucauuuuguuuucagaaaugaguagcaccacuggcuguuugcugcacggucuuagccuuugugcugagaauguccuaaagucauuuacugguaaagucuaagggcuuccuuuugcuaagugguagcacuuugugaauccagguuuaaaaugucaucagcuaugccacagaaagcuaacuagaagaacuucacugcuacaacaaaggcaaauucucuccgagucaggcuuagcauucucacagacugagccacauguguuccugaaguuuacaauuucacaugaaaagaaugcuccgggaagccaugguugggcacaucucucagaauugagcauugaaagcuggaguuauagcagggccgauguucgucaucaggaagagaggagaaugaagcuuggcagaaaaagucaaggccaugaauaggacagagcuagucaaaggcagacugagggaaaggcuagugagauccagggacaggaaccugagucucuggggagaccaaguguggguaggguagauaagcccaaccaggucacacugagaccuucccagaaaaagauuuguguggggaucauuuaaagagcccauguaccaucauuccuagcugccuaccuaggaacaugcuagguggccauguaguuucaggcuguaauaaacccuugcacauaaaguggcccaugaauagcaggcaugguuuaaagggacuuaauccuugauucuggguagagcaauggucagagacaaacaccaacuucaacaaaugagugccuauuauuagacaggaccaggguaucccugaagucaucacccuuucccuccuauccaaacugcugggguauucuuuauauguguuucugacauuauuccacccacacuucaugcuggaccuucagagaaccuugggaccaggucaucacuuuaccaucaacauggcuccacccucucccccaucucagaccuggacguugcaucucaguccugaagccucuauugugacuauagcccuucagaaaacccagcaggcuucuuaacuguacuucaaagucuguucucugaaccuaguggacaguacccuuggcacauucucccugccucccaaggcccuccauuuuccugucucuccaaaggcaccaucauucuugugauauacuggcacaaucccaucaacauuucucaucugugccuucccucugccuagaucugaaacaucccaagccauuccuacaggacauacuugugccugaacuccaaaugccaagagccaucaggauauucauccugucgguuuuagcuuuugauuuaucauccugcauagcuuuguagcacuuagugcagugacugaagguacaagagaggcucaaacaauggacuuguuuuaacugcagugauuugggauauuggacacugggcucagucuuuauccauuguucuuagcuucgagcuguauaacagcuguggcuuauuugagcuggaaaaggaaagaggcuuugauaucacagaaggaggagccaggcaagaaaucuuuucagaggaccaacuuugcccacuucugggucugauucugucacucacucaugagccugacucuugacucugucacucccucuggacgcuuuccuuugcuaccguguugucagcaaaccccacucgacaugggauccuugucugccuaaaauuaugccaagacucaggccaucugaugguugagccuggaucacaucuaagcccaagcugcaauaaagcugggagagugagccucuggcuucugugugauuggaaauccuuaucauguucaaauuaauccuaaauaaagguaacauuagcaaaggaugggcaggccauggaagacaauaagggacaggccuucagagugaccacuauagagccucuaaccacaagccucaagagacaggaggacauucuggcucccuaaucuggacaugggaugcagggguguggaaggggcuguuuuaagggacacgguccccagucaucccccuggaguaaggacaagagaaguggauaugcuggauccccuccauuuccugacccugcugaggaccccaccccuccuggaggcucagaggccaguaagcccaugcuugcugcccuacugacccacacugaaguaccaagcaugcugaccaagggaaagccaccaggagaaacaaaugcaagacagacaugcugcccuugagucuugcugggauuccacaggcacuguucuuuucuuuuguccagugucuccgcucagggugucacuuugcacuuugaguaccccagaccccaagacagcauucuucaaguguucuggugcugcauguuaagggugugcuauucuuaccccuuguuugaaacuuagaacguucuuuuguauaccucagcagccugcaccauuaaaggugagcaaaggucagccaggccuauguuuucuuucccaggauugugagacaagagugaacuguguggccugugcagacacgaugucaggaaucuuguuaaaccuuguugcagaaaucccuucuccaucugguccuacccauguggucucuuguugucagcccacugcucuguauuagugucuagccuucuaaagugguagauauaaggacugccauugcaguaagccccgugucacuaacagaaguuauaaggcccacaaaggacucagcgacuguaacuccgaguccagugaagaaugcuugggccugguucaccaccuucuucagaggcauauuguguucuucacagagaauggaagccagcuauagucccauagacuaguagaauuaaguaucacgugagaaaucuagauaaaagagcuuuugauuuuccuacuuaaaaugacauuaauauaauucuuauuuuaaaacagcaggugauaaaaacaagugcaaagagcaggagugugcccucuuccaccccugccucacaacgacauuugcagugcgguagaaaaagaugcaauccgugugauuacguguugugaugcuguguccuuguggggcugagguguucucucuccccucucccucuccaaguguguguguguguguguguguguguguguguguaugacagggucuugcuauguaccacaggcuguccuucaacuugcuauucuuuuguaagacccuugagugcuggcauuucaggugugugccaccuugacuaucugcugcacacacacacacacacacacacacacacacacacacauacacauacacauacauauacauauacaaauacaaagagagagagagacagacagcucacugugcugcccaggcuggccuagaauucaccaccuuccuaucucccaccucagccccccacuuaacuagcacaaccaccacacccacauuaagacaguuugaacucugcugcucuugcaaaguccaggccagcagcugguggagcagaggcugugucucacugaaaacaaacauuucaaaguacucugggcucuguccgauggcagccaccuccaaggaccuuauucccgagcagcuuccgccccuuacguguuaauuauacgcaugcggcucuccugccaacguaggaauuugguuuauuauauuaggaaacauuuggaugaaagaaucugcuggugcugaauacuuagaauuccuucuguggcuucugucauagcauuuguagacaucaguugcccguuuauuuuuguuagaagggggaguccaagaaaagagugcgauugguacuuaccgcaaacauaagagucacagguuuccaguaccaucccggacauaugaagagucccacauggguuugccaaaccucagcggcuacuccugugcuucacccugcgguagggccagcuugggccauguuagucucuucacaugauguugcugccccuccuuguggccuaaucauggaucaccgugugguagagaagugagcucuggaccaucaggcucagaagggucacugcaagcaagcaagagaauuguucugcaaagaugcagguaagcacuggcugaguccguagccuuacaagauccuaacccucugauucuaucgggcugagcccuuagcucuccuuacuuacgugagccuaaccuuccuccucacuaugagaaagugugaguucuuccaaccguccucacuuaguaaaagcuucugccacuguucucagugagcuuuccccaagggcgugucuguggaucacucugacuuacgccucuccucaggacugcuauaguuagcaccugaaccuuuguuuguguugagcuugccuaaugucugucuucccuaccggacugugagacuca

SEQ ID NO: 4621 - RNA, 1185 nt, Mus musculus
ccagagcagccccaggaggucugcacgguuacagcagguagcccaucuuacagauaaggaaaccaacuaguaaguuaaaguggcuugcacguucccauggggcaggcaggaggagagcugggguucaagguuggugaagugacucuagucuguuguaaucucagacugaagagagaugguauuuaaaauacuuuuaaacauaugaaauucauucuuaguguaauuauagauaucagaucccaauaacuuauauuaaaaauccuccaggaagcagcaccaugaacaaacaacugcaaagagcaagaaacgagaggcaaaucaacuccugcuuuaaaaucgauuauaaggcuuuaccaccaucaacguuuuauuauucgauaucacaaaaucauuaccucuauagcacggcauuucacgaugacauaaaaaugaacuuuguuccuuacggaaaaugcuauaaauaugcacaagggaaguuuuuauucuuucagaaauaguaaucaaccgauaaaucaggacaccacaagucagcccuaucucuucuagaagacuccauaagacuuguaaucaguucaacaaaaaaugagagaugucucagaagccaccaugaaauucuaaaccuucaucaagacaaaauaaaccacaaaaugguuaaaagucugcugcaaauggggggggguaaacauuugccacagaguuggcgaacaagagugcugacuggauuauauugaaccccacaaaucaaucacacagaccacucagcacacaaaggagcauccaagaauuucaccaaauaugaaagcucagguguccugcugcucaauaaggagcaaugaaccucacuaagaacccuggcgacacaaacggaaaucacagccaccuaucucagcucagccacuuuuaguuggccagugggagccgauguugauggaaggcaggaugaaggcuccguaaacucaguggugggcgucugaauggcacgcuggagcaugcgggauacugggaguaccagcuucacagacgaugaucacauccugcacccucaaguuaucuuuucugaggagcauccaaauagaugcacuggaguauacagucccucgucacaauuagaaguaugagaaacugggcacacccuaaaaauauucaucagccaaggagugguuaauuaaacaugguauauuaugu

SEQ ID NO: 4622 - RNA, 34282 nt, Mus musculus
agauggguguguuaacauucccagggacauccagggcuccacccauugucagggauggccccgcccacaucacauuacacgcacgcgcagucccugcucccgcccucugcgcaggcgugcugcuuuuccaugugugcucaggccgucacauuggacccgcugaggggagacgccaaguaacgucgagccuggaagucgccacgggcccggugggccccaacgacggcugcugcagucguccucuucuggucugucacugcagccuccgucgccauggguaagagucggacgaagcgcuucaagcgaccucaguucuccccuaucgagagcugucaggccgaggcggcggccgcgucgaacgggacuggggacgaggaggacgaugggcccgcggcggagcuucuggagaaggugggacgagggcauggccaggcucgggcggcgggcggccgggggcccgggggcccgggagcgaggugcugcagcgcgcgugcucacuacgcgacucugacgucucgguucccgcagcuccagcacccgagcgccgagguccgcgagugcgccugcgcgggacuggcccggcuagugcagcagcggcccgcacuaccagacuuagcccgucgggaugcugugcgccggcucgggccgcugcugcuggacucgagucuggcgguaagggagacggcggccggagcucugaggugagcccgagagggcccgaggcagugucccugcgagcaaacaaaccugggacacccucgcccgaugcauucucuacuucugggggaauaauaacaugccaguuagcucagguuugcaguggauggagaugugaauucaugcaccgaaggaccccggggcucacacacuuuuuguuguauccaccuggcgcuucaccaaccaucaaaccucaugcacauuuaccccaucucaaaacccaccauagagucccugauaggauagucuuucagucugggcuccaaguacagcugacauuucagcauguaagaucucuuugcaggcgcuccacugagagggugucuggaaacugucaaaaagacugggcugaauuucaguaaaauuuagaccuucuagcaugguggcacagaccuuuaauucccgcacuagggaggcagaggcaggcagaucucugaguuugaggccagccuggucuacagagugaguuccaggacauccagggucacccagagaaauccuaucucaaaaaggccaaaaagcaaaagccacucuaaugaacuguagagaggacagaaaguuaguauuugugcucuuacagauuugccuguguguauuguuucagucuaauaaauauuggauggagcaccugugugccagccacuggacgaggccaguucaaggccaccuugaacuacuuagugaguuccaggacagccagggcuguuacacauagaagcccugucuugaaaaaaucaaccaaccaaccagauaaauaaacaaaucuuaagucuauugaguaagauuaguguuaagaauauauugauuauuauuaaccaaauaauuacuauauguauaaauacaacuaguaguaauugcagagacuacuauuagggguaugaugguuugaauaagaaugucccucauaggcuuauguauuugaccacuuaguauugaguucuccuauuugagaaagaauaggagguguggccuugcuggaguacgcguggguuuguuagaggaaguaugucacugagggugggauuugagguuucagaaagcccacaccaggcccaacaucuuugucuaugaucaagauacagcucucaacuacugcuccagugccaugcaugucaccaugcuccacgaugacaauggacuaaggcucugagacuacaaacaagccuccaguaaaugcuuccuuuauaaggguugcccuggucauguugccucuugaaagcaacacaacaguguaagacaaugaauuauuugaugugcugaggaccaggacaguugaaaaucuguaggcuugcucucuagcauauaacaaauacaguuuuguuuuguuuuuuccuguggaaaaccuuaacugugguuagacauacagggcuuagcagcauuuugugagaugugacuugaaaguaaaauguguuuacauuucuuauguagaaaccucagugcuuguggagguuuugacguuugugaugacaugguggcaaaggacaucaugacgccccugguggcacuacugagagagguauguggcauuuaacauagccugagugaugacuucugugugguuuuuaggagacagguuuaggagguuuuuugucuguuuguuuuuuauuuuucaauacuuuggugucgucuuaugugucccuuuaaauacccugugacaauuuuauuuuuuccccuggaaacucgguacaaaggccccaguaauaccaaucucuauuauuugugucucugccaccuuuaugauuagaagagcccuuucuaaagauaugcacacuuacccccuuagaacucaagcccguucccugacugcucacuccugugugccugucauuuaaucuucacagugguccuaugggacaagucuuuuuucccuuucuuuuuuguggugcuggaaauggaacucagaucuuugugccucccaccaggcaggugcuuuagcaccacccaucuguauccaaauccaaggcagguguucuuauacuaguucauacugugcugaugggcccaaggacagacguuaugaacuuacaaagacuauguuagacucauuguuacguguuacauguacauucauguuacaugcuguagcucauuggcuaaggacacuggacucuuguauuccucucagucugccaugccuuuuguccguuuuacacugaugcuaugagaccuuggucagugcucccuuacaagcagugcugcugcgcugcagguggcugugccauggggacacccaguuggguagagaucagggaugcuguagaacuuccuuccuugcagagggcauucucccauuagacgucuaagacucagaagaccuuuuagagagugcccuguucugugcuaggaagcagcccugcacagaggucggggcuccaguuggaggcuagaaugucugcagcuagagcccagcuuuaccauacacucagcugugucuucaggagccucuuuuaucuuauuuucauacgaauauugggagguuaagguuaauaguugagcugcuucaaguuuguugugaggauuaacuaguaaauauauguaaaaugcucagaauaguacuuaggggauguuguacagauauuaacuauuguauuccuuugucauucuguuucuuuuaauauaaauuaauuauucuuuuauauauauauauauauauuuauuuauucgcuuuaaaucagcacccucugucauucugacuuuuacuauauuaggggaaauacguuguauuggucuuauacuuucauguaaagugugggacaaauaacaucauuccuugacaaccuuucuuaucuguguuucuugccaaagggauguauuauuuuuuuaaguuuuuauuguuuuuauuuauguaugucuguguggagugaaugcuguguguaugcagguaccuucagaggcuaucagauagcguggagcuguaguuacaagugguuguguaccaauugauguggauacugaaaacuuagccuagguuuccugcaagagcagugcaaaaccuuccucuggacagacagagugcucuuaaccacugagucaucuccaugcccaagggauggaccauguagagaacuguaccuguaaccauugauguaauuguuaacuaaccccuaucauuucugggguuuuuaagguuauaauucuuuacuauuacuaucuuuuuugcuuaauuauucuuuugaaccuaggugcuaauuaugauguuugguugcagugucucucuggacuggauucaaaugagaugucuccacaggagaaagcugauaagagaaauccuguagagagcauagccaaugaggcugugaaugugcuguggaaugugugguaagugcuuucugaggucagucuccuguugugucacugcccagccuguggugcucucuguuaaacuguaggccccgcccacagaugcuugcuacuuuaguugauggggcaaucugaugacuugagauucauccuaaucagcauaguguacaccugcuuugguaucuggaaugaaaagggaccacgaacauuggcugauguuguuguccacuguucuaauagugacuguuugaacgggaaguaaauucccaagaggaacucucuucgaaugaagaggaacaaggcugcuucucuucccugucgcuggcacugguuagguuagaguggaccaugccuaggaaugaaacagagcuuagaagcacuucuuaagcuugguuuuaugcccauaauuauagcaguguuaucguuucuuguuuuuuuguuuuuuuuuuuuuuuugguuuuucgagacaggguuucucuguguagcccuugcugucccggaacucacuuuauagaucaggcuggccucgaacucagaaauccgccugccucugccucccgagugcugggauuaaaggcaugcgccaccaccgcccggcaguguuaucguuucuuauauucaguugggaacaauuaaaauagugaccugaaagcagugucucuuagacuuuaauauugagguagaucuugaaaagcugccuacauaccagucugagucugcuuauaauuucaucuuaaaccaguaauacuggcaaagauuugagaaaauggcuuuuuccccuuuuauuuuuaguuuuucuuuuucuuuuuuuguuuguuccuuccuuccuuccuuccuuccuucucucccugccuccccuuuagccccaggaucuuacuguguaauuuuggcugaucuugaauucauguuccucuguccuuggccuucugacugcugggauugcaaacuggcuauaagaaauggcacaugagcaacugauagguguuuuucugugcgccauaaaucuuuuacuuucuauaauuuuguuguuuggagcccugggccucauggcugcuagcacuaaacauguuuagcauugugcuuuuucuccuguugcuagaagaucacugagcuugaaauuugauugauugauugguugguuuuuugguuuuucgagacaggguuucucuguauaacccuggcuguccuggaacucacucuguagaccagacuggcuuugaacucagaaaccugccugccucugccucccgagugcugggauuaaaggagugcgccaccaugcccggcugaacuugaaucuuuaaauuuucuuuaaguuacauauauguguguggguacauacauaugagugcugggcccuuccagggcagagaccuggaguuggcugugaaccaucugaugauggugcuggcuaucaaacuugggucuuuacagaaacaacacuuagucuuggcugcugaggcaucuuuccagcuuuuauuuuauuuuuugagacaggaguaggccggguuagccuagggcuugccauguagcaaaggauggccuugaauuccucucuccuguuuuuauucccacguccuggccuuacaggugugggcuaccacauguggcuugaacugggaguuuuaagaauauuuucuuugaagagagccuaauacagugguucuugaucuuccuaaugcugugacccuuuaauacaguuccucguguuguggacccacaaccauaaaauuguucugcuacuauuuuauaacuguaauuuugcugcuguuaugaaucauuauguaaauaucugaucugcaggauaccugacaugugaccccugaaggggucaugaugcacagguugagaaccacuggccugauauuucuaucuccaaaguaaccuuacugucuugaguccucugaguccagucuuuaccaccuacaguugucaucacucugagaauuuuguuucacucuuuacauuucuuuacugauaaaugcuuugucuucuggcuauaguuuagugcugaaauaacuaaagggauaacuaacagaaaauaauauuuuugauugcaugagucaccuguuaucucuguuaguauauauauuauguguauguuuacauugagauuauauucuggaaacaugaggaaacaucauucuuuuaaccuguacuugguguauauguuuauuaguaauauugauaacuuuguuuaaggaauuucuaugauaucauaauuaauacuuagaguacuuucucuaaagauugaaaauucuuguugaaauuauaauugccgucuaggaguacauaaaauguguuuuuuuuuucaauuaaaaauguuacuuuucaugugauagaggccuuuguccuuauuugaaugcauuauuaucaagugguaguggaaaaagaucauucuauauacacaaggaaccgaggccugggcagggugucgccacacccagaauacggggcugcagacagauggccuuaccugggagggacuuggcuucucucaagucuguaaaaugggaaguuggaugagagauugugucugagguuucacacagcucuaaccuucuguauggagagauggacugagagaucccagugugaagggaaugaaucccugauagcuugucauguacaauaaauacgaguggguauuuugacugcugaucuuugguuuuauaaagcauaauuauuuuuuucauugacuucugugguuaauuucuuaauguuaaaauauggauaguaaaacuuauuuuuccccuucacuguagugaaugcaguggcagagcagugucuauauucaacaaagaaggguguuuggagauuguguuacaguacuuacguagguuccccaccaguauugaccuggcugucuccguagguaagugaagaaaguguucguuugcuauuccugcguuuccaugggcgggugcagugugucugcuaacagcccgacuguuacuagcuguaaauguccagggaacuuugguuuguuuggaaugucuuuaaaucuguggcuaauacuuuacuuauauaauuaauucugcaagguuuguuuuguuuuguuuuguuuuguuuuguuuuugagacaggaucuuacugcuuaacucuggcuguucuggaacuugcgguauauauaaaccaggcuaaccuuuuuuuguuugguugguugguuuuuuuguuuuguuuuuuuucgagacaggguuucucuguguagcccuggcuguccuggaacucacuuuguagaccaggcuggccuugaacucagaaauccgccugucucugccucccgaguucugggugggauuaaaggcgugcgccaccacugacuggcuuacugucuuauuccuuauaauaagccuuuauucuugaaguuuucaucucuauuuacuaagaaacaaagccccauauuucccaggccuuuaugccaaacuuuagcauuuuauaucacuuucucugaucucugaagaaaacuacuaaagcaaggcucauguauaauacggugaacucauagagcucuguucuguccagaauaauuuuuuugaaauuauguuuacaguagcauucauaaguuaucuugccuuuuguugguguuugcuguauuguacugggggguccauccaagagcuuugcucaugcuggacgagcacucagucauggagccaucaccccagcccuucauuuucucuucugcuaaagugacgaguguuagucccuaguaacacaguacauauagaaguaaauauauguauugauguguaacauagcuguaucauggguugcauuuuuuauuuuagauuuauuuaguuuauauguaugaguguguuuguacauaugcgugccuguugcccuuggagguuagaagagagaguuggaucuccuaaaacuagaguuacaaaugauuguauguaaggaaaacgaacccagguccuuuguaagaacaguaaguacuuuuaacugcuaagccauuucuccagccccacuaccauauguuuugauuuauuuggauagauacaaucucauuuggaauuucagaauuaaauuuuuuggaaaaaauaccucaaaggaaacuaauuuugcuuuauuuuccuuuuuguacuucagaggucuuuuuuugucaaaaccuuuugugugaucucaguuuuguuuugggcuauuguuguuuuguuuuguuuaauuuuuuguguguguuuuguuuguuuuugaguuuuugagacaggauuucucugggcagcccuggcuauccuggaacucaaucuauagagcaggcuggccuagaacucagggauucaccugucagucacuccggauugaagcuguauaccacaaacuuuguccugauuugauuauuugguuugguuuuuuugauacaggguuucuuuguguaaccuuggcuguccucaauaaguaggccaugcugaccaggcuggccuugaacucauggagaucuaccuacuucuccagagugcugggaugaaaggugugugucaccacugaucagcaccucaguuguuuuuaugcuuucaguuaauuucuagaaugaauguuguaaucuauuaucuugguuuuguuuuauuuugguugggauuuugguuuuuuguuugguuugguuugguuuaguuugguuuuugguuuuuuugagacagauuuuuuccuaugguagcccuagauguccuggaacuauguaaaccaagcuagccucaaacucacagacauccuucuaaaugcugggauuaaagaguacuacuguugggcuggagagauagcucagcaguuaagagcacugauugcucuuccagaggcccuaaguucaauucucagcaacuacauguugguucacaaccaucuguaaugggauccaaugccuuuuucugguaugucugaagaaagugacaguguacucauauacauaaaauaaauaaaucuuacaaacaagcaaaagaguacuguguuaaaggcaauguacuaccacacucagcuacuuuucuuaaauaacacuaauguaugggucagguuuguccuuggcaacaugguacaugaacuaguacuuggucagaaacuucuugcuacugaccuaugauaaguguauagauugaggauaaacuguagauacauugcuacaauuacuacuuaaacuuaaguuauaguuuaugaaaguauaguuuuauuuuuauuuauuuuuuuuaagauuuauuuauuauuauauguaaguauacuguagcugucuucagacacaccagaagagggagucagaucucguuagggaugguugugagccaccaugugguugcugggauuugaacucaggaucuucggaagagcagucgggugcucuuacccacugagccaucucaccagcccgaaaguauaguuuuauaaagagugaaaaauuuagcuggugauggugacacacaccuuuaauuccaguacugcagaggcagguggaucucugaguccuaggcuaucauuguuuauagaaugaguuccaggacagccugggcuacacagagaaacccuguuuucaggggcagggcggggguguggggggggguguggggggcuuccuggaaggaagaagaaaaagaauuagaaauuaaagaagagagauugagggagaucucuagcacugaggucucuuuugccuguaucauccuggaagugaagccucuauaccuguugaaguugaagugucuaaaaguuguaaaaaugcagauuuuugucugaguuauacaggugucaauuaucuuaaacaauucacagguuucuaauuguugguucuugucuuauagcguauuguuuacagacagugacggaagauaacccagagcuccugaaaucuuuugauggcacagcacuacgugugcuggagucugcuuugcuuuguccugucgccucuauggaauacauucuuuuaaagacacugguggcagguaagauuuauccgaaugaagucguaauuguaauagaagcagaggccaggauucagucuucccagcucuacaaugcucugucugaucggagaacaucuugguguuagagcaaagaccccuaacugauuguuaugaagccuccuagaauagauggauccauuuucuaaaaaaaaaauuucuuuccuuuuguuguuguuuguuugguguuucgagacaggguuucucuguggcuguggcugccuuggaacuaucuagcuuugcaaucuuuguagaccaggguggccuuaaacuuagaaaucugccugccucugccuccagagugcugggauuaaaggcacgcaccaccggguuaucuuuucuuuuugaguauauauguaugguugugugaauucauuccucauguaugaaggauccugaggauccgaagagggcauuagauccccuggaacuagaguuauagacaguuguuagcuuucuugugggugcugagaaaugaacacuggcccucugaaagaacagccaguacccuuaaccccugagccaucucuccagcccuauccaguuugacacacacuguuugucucauauagaaacgcuguaguuagacuuuacucucucucucucucuuuuuaaaugauuuauuuuuauuuuauguuuauuagugguuugcuugcauaugugucugugugaggguguuggcccccuagaacugaaguuauaauaguugugagcugcucugugggugcugggaauugaauugagguccuuuggaauugcagucagugcucuuaacugcugagccaucucugcagcccagcuuuccucuuuuucaagucccaucgaguucacaguucacuuagggcaacuaagacgugacccaccacuugcucuuccaugaguucuuagucccaccuuuuuuuuugccccagugucugaguacagaaaucugaagugaucuggugguuaguugaguagcauauacuuuauaauacucuucauccugaaaggugacuguauccacuaaaugagaacuuucccugacccuguuuuccccucccugucucuggacaccagcauucugcuuccuguuucuguggauuugacucugguaaaaaccuuacugaacuagaagcauuuaugcuugucccucuauggcuagcuuauuucccuuagccucagguuuucaaggcugccuacaucggggcaugcauuauacuauuucuuuguaguuuuugaaacagggccuucuguggcccagcuuggccucagauuuacugucuggucugaugacagcaagcuccuacaccuugagugcuuggaauaggagugugugucaccacaucuacuuucugcuauguuggggagcaaacccaggacuauaugcuaggcaagcacucuuccguucucuuuuagaaugcugaauaguauuccugggcauguguguuugcuacucuuuggguuuugguugguugguugguuuuggcuuuuugacacaggaucuucccugucuuggaagccauucuccauugucuauucaucaucagaugagcaccuggguuaauuuuuuugguauuguuaaucaugccacagugaucaugacuaaugucuucuacccucuguucucaguauuuuuaguuaugccuagguggcguuuucauuuuauuacgcuuuguuggagauggggucuuauauauauggccuaguuacacuuguauuauagcugaaauugaccuggaacuucugauccuccugccuccaccggcugaaugcuguucuuacugguauacagcaucaucccugauuuacaguccuuggauugaaccgagggcaagcauucuaacugagauacauccccagagccugccauucacuuuaaaaaauuauuuagauuucuuccuggaagcacuauuuuauuuuguuaggaaaaagccaagaaauuucugucugcauucucugugugauuuuggaggauuaaugcaucccacugcaccuguaauauaaagcuucggagaagaggagcuuagguggaaaugggaggaaacaaggcaccuccuggcauugucagagaaaauugaucagugucccaguguguaaguucuauaccaggaaaagugugugccaagauggaaugaacaaaggcauuuggguuaggauuuuugaaauuacaccauagccuaagcccuguggaaacugcuuuucccucacuguuauauguuguucaauuaguuauaauuaguaaauuaguugaauuaguuucagcuaguaaaaauuacuuguuuuuacuaucuaguauuuccuuuuauuauaccagaaucagucuguuuauuaccugguuggguuagaacccauuuuuaauaaagauuccauaggcaauuucuuugucuucauucuuauuuuuucccaggcaccaucuggaaccuaaaggacauuauuccaucuaagagucaggcagaaaucauuaaugccauccuaggugccuugucugaaguucuggguaugaauacuggcaacauggucauucagaugaaggaagcugaaacccagcggcuaaagacugccgcagagagugaggacauccuagcaaaugcuaacggugaugacuugguugaagaugaugaaauggaagaaaucccucauaaaagaaaacucagaaggaaaacauuuauuuccgauuuacuuccagugagucagauggauguucgaucugaauuaaugcauuuuauuuuuuauuuuaugugcauuguucuuugccuguauguaugucuguguuagaaugucagaucuuggaauuaaauacaguugugagcugccauaugggugcugggaauugaauguggcccucugaaagaaccaucagcccucuuaacuguuaagccaucucuccagccccucaacgugaguuaauacaucaguuuccuucagcaggcuuccuuagcauuacaaaaaaauauuaggcaauuuuucaauuagaguuguauuuuucuguugauucucauuguaacauucgaaauguacccauguagaagaaacgaaaaccagcaucucuuguccaaaauggaaaccuuucugugugggagcuuucagagcacuuagcaauagcauccugucuucuugacucugaauucaguuaccugucuccucagggagucuucacgcugaccuuccucugcuuccuuuuugauugaauucuuaucucuuuuauuuuaguaccucucuuuagcagagaccuaggccaagccuucagucccccacuguugcugagcagaagagguugggggagguguggugcuucaugcuagugugaugugcgaugugcagugagggugcacagcugccaguuacuugagcugagaaaguguagguggacccaugcuuugggaggaggugagaagauguggaaggacagacagacaagacccagcugggaagguacauccuuccugugcugcucauguguguucauguaccgguuacagaugagacuccucagucauguuuccgcauggggaaaucccucuuucuucaggaagacacacucguaagcccaugguuauauuagugcgaugcugcgaauggugguagaauugucaccaaaucuugaguuguuucuguaagccugguuggugcauaugaugaagaccagaugggagagcaaaggaggaggcugcuggagaugacacagggccaacugagcugucugaaauggggaaguagagaauugugaagagaauuuucauuuaaagggucacucagcuggauacugggagugugaaggcaugaagagcaggaggcugcaaaggaaaggugacaagcuuuggcuaggagcguacaguucacauucucucaugggccagggccagggguggcuuguucuuauucacguggaguuaauugaaaguaauugucuugagucaacaucuuacaguucugauuaguuuauaugacuuagaauucuuuaaauagaauauagcucaauguaaacauauuuucuuguagauuuuguuugcuugccuguuuguuuuagcugcccuaggagguggggcuaugaguguuuaccaccaggccuaaaucuuacauccuugaagacuuacaaaacaaaguuuugugguuuuuuuuuuaaauuauuagauuuuuauuuuauuggaagggauaaguuuaugccauagaacguguguggaggucaaagggcaacuugcaggcaucaguccucuuuugcuuccacguggggccugaagauuaaauucagauuaggcuuagcagcaggagcauuuagccacugagccaucucucuagcaugcauauaauuaauuuaaucuuagugcuuugaaggaaucaagcuuuuuauacaugugaacaacucaagccuuguguuaaguagggguauaugcagaagucaaaaggccaucuuauccuuaaguuuacuacagccagacagugccagccaggcuagccaaagcaguaggcuugugauucagugagagacccuguugcugcaugcagcauggcucuaaggacaaccugauuggaguacuaaaggaaugaaggaaagacagauacaaacaggaagcugggauccagugggcugggcucuuggcugaagaaacuguaccaccccagaauuucauguuuauuaauuauauagaguugaacagagaggugagguuauuacauacaguugagcaaggaguuuggguuauuacauacagauaaacaaggacacgaguuuagcuaaucuugguaggagcagucucugugacagagaagucuucaggccauaaauaucuugggccagaaagcuaugguggacauuuuccacagacacuaucaacacccauacaugggucagaggaaaggcuuugagguuucuccauggucugagguucuaagcuuggcauggcaguaaccaugucaacaaugcacauucacucaggacucucuccgcuuccuauacccugccucaaggcaaggagacaggcugugacagaggaagccugcuuuaccguguguaugcacgugugcacuccugugccuacacuacuuacauaggcaugcacacagaagggcuaagaguauuguccgugguagaauacaugcuaauuguguacaagaaacacagugaaagagaaagagggaaggagagaaauaaauucuugagcucauaaaauacaguguuuucucaaagcaaaaaacaaaaaaacaaacaagccuauuuuuauuuugguuuuugagacaggguuucuccagauagccuuggcuguccuggaacucuguaaacuaggcuggccacaauccaccugccucugccucuaccucugccucugccucccaaguacuaggauuaaaggugugcagcaccaugcucagcuccugcagaagcugcuuuuaaggucuuaacucauuacccuauauaauuaacauuauauaagucagcuagccagccaguguuuagguaccaguagagugcuagguaccauacaugggaggggagugcaaacucagaguaagcugagguccuccguacugcccaguugauuccacuuuaguccugucaacuuaaaacuuuaaauugcaccauuaaacuuaaggcauaacacaaauaugcagagaaaagagcagauuuuaacacaugcugaaauaagagcauuccuccuucgcuuccaggauacuaguuuauccagucuacugccuaauucuaucuaucccuccuccuccugauuacuuagacaccaugacagcucuggaccauucuuuaucaguuugauaacagucagaaguaggggaauguuguaaaggggauguugcaaaucucagaguucucuaacauggauauguauacauuucagguagagagaauccauugcaaaucuauuuagcuuagcuaaacucauacucacaaaccugaauagaaaugguuauuaugcauagugguaguagaaaauggacuacauauuccagggauugccauuagaguagucugugccuuccaucagucauccuucacuuuuguuagauaacacaggccaaaaguugaaguuuaauucuuagacaagggauuuguuggugagauuuuacuuguuugguuguuuguuucuuuguuuguuuguugggaacagugucacaauguaguucuggcugaccuggaacuugcugucuagacgaggcuggccucgagcucccagagaugcaucuguuucugcuuccuuagugcugggauuaaagggugugggggugugugcgcaccuugccuggcuuauuaguugcauuuuaaaugagcacaaacacucugguaaggaaaauguuaaugcauuauaagaccuauagguacauuuuuaacuuuggacccaggaggucugaggaaauaagauauuuaaauacauagucacagggaauuggcucuaacucagucccccaccccaccccagguuucaaaucuuaaguuguuaagucucucauacgaaaugguauauuauuuacagucacuuacacacuuccucucacaccuuuuagucagcuuuagauuaggauuuuuuugguuuuuguuuuguuuuaauacauggccucauguauccagguaguuucaaaguguguuguauagccagaguauaaccuguaauuucuaauccucugucuccacuucacaaguguggugauuauaggcgugucaccgagccuggguuguacaguguugaagaucaugcaugggcuuugugcaugauaggcaagcauucugccauuucuacgccuggcuccaucuuugaauucuuuuuuuuuuuuuucuuuuuaaagauuuauuuauuauuauauccaaguacacuguagcugucuucaggugcaccagaagagggcgucagaucucauuacagaugguugugagccaccaugugguugcugggauuugaacucgggaccuucggaagagcagucggugcucuuaaccacugagccaucucuccagcccccaucuuugaauucuuaacaacuguaguacaguguuggauaagaagggggugugguuugcuaacuuaauuguauuuagugcugaggaucagauccagggcuuugcacacacucuuggcaaacacuccaguacugaguuauauccccugcccucauaucacacacacacacacacacacacacacacacacucacacacacacauuacauaccgucaaggacagaugcaguuuucuccagguauuuguguucuugguuuauagugcugcucauagugguuuauaucuaugucccagauacuuaggcugagacuggaagguugagcccuguaauuugaguucuuccuuuccaugccacuacaauauaauaagagcuuuugccgggcgugguggcucacgccuuuaaucccagcacucgggaggcagaggcagacagauuucugaguucgaggccagccuggucuacagagugaguuccaggacagccagggcuacacagagaaaccaugucucgaaaaaccaaaaaaaaaaaaaaaaaaaaaaagaauuuaaguuuauauuguucauuuuaggaaauguuacuuguugaaauuaauaucuuuagagaaaaaugucuuuuucugucuuuuuuuaucacaaguuuuauuuguguguguuuaugugcaaauggguagggguagccauggaggucagaaaagaguauggauuuucucagagcugggguuacaggaggcaucaacuguaauguguacugggacccagacuguccucugcaggaagauagggguucucacacccaccucuauagccuuuuuuucccaaucuuuuuuguuguuauuuuuuuuuuuuuuuaugacugggucucuauauagaucuggcuguccuagaacucacucuguagaccaggcugaccuggaacucauagauaucugccucugccucccaggcgcuagaacuaaagaugugcaccaccgugcuccgcuuucuucccccccccccccaaucuugaaguuacuuuauauuuuauuuuucauagaaaaucaguaaucaaggcagucugauauuuguuaagcacuguuaguguaaggcuuguuaauacugugugugguauguuuacuuguuuuugagacaggaugucaauauauagcccaggcuagccugaaacuuacucuauagaccagacuggccucaaacuugagguaauuuuccugacuaccacuugagugcuggaauagauaugugcccccgugccuggccagaaguauauguugaaugugucuuucaaagaagaugucuaaaauauguguuuaagcaucaaaugucugaaauaagcuuuuguuuaaucuuaucaugcuaagcaacuuaacacauguggucaagauucaagguagguauuugguuuuguuuuuuuguuuuuuaagaauuacuuauuuuauuuauaugaguauacuguagcugucuucagacauaccagaagagggcaucagaucccauuacagaugguugugagccaccaugcgguugcugggaauugaacucaggaccucuggaagaauagucagugcuuuuaaccacugagccaucucuucagccccaagguaucuauucuuuaaagcuaugcagcucugugauagauggaacacaguuaacagagauuugcucuaguggaccaggaggaagucacagaacuuauucacauuucuguagcuuuucuucugccuguucuagccuccaucuacucuauuccaggugcagaaaucaaggaaacuuaauacaaaaaagacuugauuauuuauuuauuuauuuauuuauuuauagccuacugacaaggagcugcgagaggccauggcguugcugacagcucagcagacugcucuggaaguuauugucaacaugugcugcagugaaggucugcucccagcuuacauuggaugguuccccaccccagcucccacccccacaccaggagcggccccaugggaguuucuuugauaccccaguuacgucugguuuguccucuccucagaucccucggaugaugagugggaagaacugucuaguagugaugaaagugaagccuuuauggaaaacuccuucagugagugcagugggcaccugauguccccauugugccugucccacgagauucacucugcccuuaccaacugccucauuccagagaagguuaguaguuucauccuggucuccgguuaggcauggcugugugagcguggcuggugugagcuguucaccacaggggcuggaggcuuggguguaaagcagaauuaacacacaaauaauuuccuccugaccaccuuaacuuguaaauagcaagucugacuuuuauagagaaauccuguuuaaaaugaccucccuuuuauuuuuuuccuguuuuccuuucaaaccuagguuuuugagaaaacaucuucaccaaacaguguugcaguugacauauguucuaagaacccuacuuggaaaccuuugauuaggaaguaagaaacuuuggguuuucagacacauuuauuguuuugucauuaugugaaauugaauuauugaauagaaaaugcucccaagaccugccuugauauauacccugcagaagguuguguuccuucugugcugggauaguggugugagagugaauguucacagcaguaugggacauaguugccccaacuuggaaagaacuuugaugucugucauggucaaauguuuaagaaguugacauugagcaguaaagaggaucagaacuggaaccgcccacaacacagcagaacuuacugugaugagcugagugaauaagacauaaaacauguacacaaaccacacagcuaggcaacacuaaacuguuuagggacacauccaguggccgccuaaggaagcuauugaagaaagaaagccuggggugggagucuguaaccucaacugccuaaggcugcagugaagcaggacggucacaaguucaugcucugccugagcaaccuguggagcagagugggcugaguggguaguggggagcuugucuaucaugugugcuguaaugggaucaauacccagaacaucaaacuagaaauacagauaauaaaaguaaggaguuuccuguacagcgccaaguggagagagacucgggacucacaaaugaguuguacucagagcccuugagugcuuaggcacugauuggcagaugaucaggucacauuauucuuugugacugccucagaccuccuugaccuuauagguacucuuagacagaaucugaagcuuagauuaaaaaaugacacugagcugggcuugaagcuugugacucccauugcaguauucaagaggaucacaaauucaaagccagcauagauuucauagugagcuccaggcuagccuggaguauaaagcacgaggcugugccauaauaaacaucaacaguaccgcaaaucaguaggccauagagugccaggaugucaacguuagauuguuuccuuucuuuucagaaugaacacuauucaguguagagcccuuaugugucuccagagucuugugucucuccuggacauagaccaucucgguggagccccugcucuccagacucuugcucagcaccugucacagauucuuuuuucucagccagguaaguauuuagacaaguagugagagacuacuuggacuuagcagaacuuuaagaauggaacuugggcuguuauaucuguguuauaaauggaauguuauuauaucuaaccucagaaaccuuuccaagauacuaucagccacauauuaucauugccaaugacagucagggugugucaguagauagagggguguguguguguguuuaaauuaaugucauaaguaucaaauucucauuaggauaguugaaucuauucauuuuuuuuaauuugaggguuucauacaugaguauacuauauuugcauuguuucuaccuagcuccuccugucuuuccccuguaccuucuuuugaucccccuucuauauuuacuccuauuacaaauauacaugaacauagaccacaacccucuggaucaguuuggucauugcugccccaccugcauguacucagggcugaccagguaggauuaugguguugucucuggaaaaaaaacaaacaaaacagggaagaaaacugguucuccucccucagcagccauucugcugagaauucaaggcgcagcaucccuguccugcucaagagacuuucucuugacagugcucuugauccucaggcuuuuccaguuuuccuucucccuccucugauguucccugagccuucagugugggggcuguccuuuuggggcugagcacccaagggucacucaaggucuccgcugguuucugccuacuguagagagaagcuuggaagugagaggucugcacuuauuuaugcagauaaggauuuccaggcaguuggaaacuauugcuuugguaguauguuagugauaaggucaccuguggggccaugaccucuccagacauggcucuuggcagguuuacaguacuagcuaugacuucccuccaguugaugagacuugguuccccuaggaugcgugugccacuguugucuuauucaggagguuuuguuguuuuugagacagugucuuuguguauagccuugguuauccugcagcucacuguguggaccaggcacauggaaacuuuugaauaauaauaguaauaucuucacaucaauuguggagccucuguugcacaccaggcuuuagcagauaggggagaaacuguaguaagaccaucguuuagcuugugcuucucuuuauguuuuauuuauuuuauguauauaagugcucuaucuacauauagagucugcaugccaggagagggcaucagaucccaucacagauggcugugagccaccaugugguugcuggaauugaacuaggaccaaaaugaacuggcacagaucacauguugugcaggaguuuguccaaggugugucugaucccguacugugcuaauuacaggaacucccuucuuugguacauacaguaucuaaaaugaaaagcccagaagauaaaagaagaugaguugcaucuuuguacucuuagugcuugugaggcugagacaggagaauugauaguuugagaccagcauggacuauaggaagacccuguguuaagaaaauugugagccaggcaguuguggcacacaccuuuaaucccagcacuugggaggcagaggcaggaggaucucugaguuugaggccagccuggucuacagaguuccaggacagccagagacagagaaauccugucaaaaggaagggaggaagggaagagggagaaaggaaggaagaagggagggagggagggagggagggagggaaggaaggaaggaaggaaggaaggaaggaaggaaggaaggaaggaaagaaauugugggaagcugccugucucuuugccaggcaaccuaagagggagguauuagaaauaagacaauguuccaggaacaacaggacaauaagccaugguaucuggugcuauuuaucagcucucccacaaacuuuuaugacuaaagcaauaggugugauuaguguuacuuucagucucuugcuucucuggagccugagguggaaggaucucuuaagcccaugaauucuuuuuguuguuuuguuuuauuuuguuuuuucgaaacaggguuucucuguaucagucugaguaccacagugaucccugucuuaucguuguuauuuucaaagucucucuggguguggaauuuaggcagaauggugaaggugaucugucuauugcacaauaucuaggcagugauucuccauuaccgguaguugcuccucucccaggggacacuuggcaaugucugaagguauuccugugaguaugucuuggugguugcuccuggugugcagcagggauucuaggagacauccugcacaggagugcucuguaugcacacacaguagcaaguuaucugggcagggucacuggugcugagguagaaucuagacgacuagggucuccacuggaaaacuuaaaggccaugagccagaauuguuuacagugaacacuuggugcuagaaucaucccacagggcacuccuaugugacccgaaccuucucaaaacaauugacuggguucccagucugaggaaaacccacacaucuaugagucagcugcaagucacauugcuuguuauaaccuguucugucguggguaugguugaagaagacaaagucacacccguguuuaagaaaaggaaaucagggggcuggugagauggcucaguggguaagagcacccgacugcucuuccgaaggucaggaguucaaaucccagcaaccacaugguggcucacaaccauccguaacaagaucugacucccucuucuggagugucugaagacagcuacaguguacuuuacauguaauaaagagauaaauaaaaucuuuaaaaaaaaaaaagaaagaaaaggaaaucagacucugggagguaaaugcugaggggucaggugacacagacugggcauacuugcugugcaucuuuagaaaguaugacccuaauguuccaaauagaucacuuaccugggcggcccucauuugucccugcuggaacagucguuuauugcagcuguccuguuugucaguaggagaagagcaagacugaggcuaggagccaugggccuauauuaucagggacacuaguguagaagcugacuuucccucccacagucugccagcaccacaguggagaucccugagagaugagacucccccaaaaccagguuuauccugugccaaauguuaaucuaguuaaaacccagcaucguaagucaggaccacaguaggucucugccugucccuuccacagucuucuuucagacuuacuugaaaguguacagagacugugaaguaaacauuccgcuuaaauauagcaagauggcucaaguaguaagcauccaacugcucuuccacucacuaggagacucauagcccagcucauucuagugugucuaaugcccucuuguggccuccgugggcauugcauucauggugcacagacauacagaaggccaaacacucauccgccugagauaaaauaaaucugggagaaaaaaaaagcuuuuguuaauaacaguguaagcuaacauucgcaugcuuuguuuuaaaccuguuucuucuccuacaaaauaguuugucuucuagaagagaaaacuugcacuucaucuuuguguuuuuguggaaacauuuuguguuuuagauuuugcuaaacaugaugauuuucuagaagccauaaguagugcuuugagggcccuuuugcaaacaauggccuccaagaacauuccacagguaagauguuauaaacuucuugggagaagcuugaaaagauucuguguuuugcaagcaguuaaccaacaggguggggagccccugcuagaggagcuguggagauacagagcuuuguagaaagcaagggaagugcuggaaguggaaaaguggucccuccccagccugcagcuccacgaggggcugccuuuugugacgcuccuuaguuaguauuuaugcuguaaacauuuucucuagauguuguuguucuucgaauacuuuauucuagaaacucucaccuuuguguuccugaguccucucuuggcaagggacuuacaguuuuaucaagggauuccaagaggccaugucucugcucucacauccacuaccaugguuagcuuuuaucucuuaucuaccuauuuuauuuauuuauaagacaauauauuuuuaaaaaaauagaaggagcugacaagauggcucagugaguaaaugaaauucugcuaagccugcaucccugagcaccuauguaaaaaagggaggagagaccuaacuccacagaguuauuuccuaaucuccacacacaugugacuuggcacauuuccagguguauacaccauaauaagaauauaauuuuaaauguuaaguuauuuaagcaaguuugauauguuuuuuuaaacagcuuuauagagaugugguuuuauacacuauacauuuauccguuugaaguguacaguucaguaguuuuguauauuccuaucucauggcuccuaaucugucaugguuuccuuacccagcuucuucccuugcacgauucauucauggaagaagcuuauuuuguucucaacaaucagacuugaaugauauaucugauaguguuuuuaauacucuccaucuccugucuauauuaaggccuacaucuaauuagacucauauugcuguauguauuuuauacuuuaaaucacagauugugucuuaguauguuuacucaaagguuuuacagacguuggucauagcugccuagguccuuucaggaggcugcacaugagagaugcccagcuuugucuucuuugugcaguacugcaaauaagacaucaucucauuggucauuuaguaaauuuggcauaguucgugucaaaauuuuacagauauuauccaauaaauaaauaaauaaauaaauaaauaaauaaauaaagauggaaaggaauaccugauaaucuauuguauaaaaaaauugcuaacgaaguuuuuagauugugcccuuuggcuuuauuaaaacuauguauuaaauaaguacuugaaaagcugggcaugguggcgcacgccuuuaaucccagcacuuggggggcagaggcagacggauuucugaguucaaggccagccuggucugcagagugaguuccaggacagucagggcuacacagagaaacccugucuugaaaaaaaaaagaaagaaagaaaagcugagccucacuuucauuuagcuuuucuccugaugggcuuucuuaaaaguaaguuugacugagccuuuaucucaucagugaguagauaccccgcagucucuaaguaggacucacacugcucucucccucuccuuucccucccugcuccuuccuuuguuuaccuguguguugcugagacugaacccaugcuuccuucacacaugcuuucuuuuagacucauugugagcccagaguuuuauaccauuuauuuaucuugaaauaggguuccaucauauagcccaggcuggccuugaacugauccugcugccuauccuaagugcuggcauuguuuguagccuguggucuuaucuaccacagcagcugaguuauucuuucugauucaaaaauugauccauauuaguaggaacucuuucagguuggcuccuacucuuugacauggacccuauguaggagcccucaguucuucccuccccugugcugugcgaguccagaucuccggaauccauuuaaaugcugugugggugggugggugccugucuguaauucuagagcucugaagguggagaagggauaccuggagcaaauuagucacacuagcugcacuggcaagcucuugguucaacugaaagagcuggccucaaugaguaagaaaagaguauaauucaggucgggcgugguggcacacgccuuuaaucccagcacuugggaggcagaggcaggcggauuucugaguucaguuagaggccagccuggucuacagagugaguuccaggacagccagagcuauacagagaaacccugucucgaaaaacaaaacaaaaguauaauucaggaaggcuccaacaucagccuuggagcuccauacaggugcaugaacaccugcacagagaugcccacuguugugugacaaaacuuuuucugagaaguugcaacacacaagucugcucagcucagauacagauccgaugacaaaacaaauauauuuaccaacagucuaacuggugaaucaaugaauuuauugauuauucacaggaauaugagugagcgguugcuuacaggaguagaagacagugcaucaccaaagcccacccaacaccugguacacacugcacagucuacagcucaauagcuuggacaguguccuuuccaagugacucaguuggucuaaaccuccuccuggcagcucagcugguuccugcuucuuccgggcucuggacuaguccaagagucugugcagcuuuucucuucugagagggaugcucggcuuuuugcuuacucuggcagggaggggccuagugacugaucagauucagggacuuccugaagcuauuucaaguguuuaaaccuuccuguuuaaagagcuucccugcaagauggaauguuucaaucucagagaaaacuguuacacaacccacacacaugagcacucauacacacaugagauaaguaaauaaaugccugcaaauauuucuguucucucaacaguguaugaccccugagcagcugaugacgcugugcagagaaggcauucauagcaguagcauugggguucgagugaauguggucaguauuuuggggaucacugggagcguccuagccaaagacgacggcacacuugacacucugaagguaaacaguuuguuuauagccuaagugcucagggauuccugauaaggacagauuauaaagaaauugcuaaugaaguuaugaaagggugacccucauuuccauuuaacuuuucuccugaugugcuuucuucaaaguaaauuugucuucagcauuaguccaaauaugggauuuuugaaggugaguuugguuuuacugucagauaagauacauucugagaaacaccacagaggcaagccuuacaucacucuaucagcaagucuggcaugugagcacucuaggaaucccucagcauauuggcuguccuagcuaguuguaugucagcuugacagaagggacaacuaucugagggaagggauguauguaucaguuacaaauagggagggaaaguuucuucacguaacugccaucuuaugcauuguaucacuaauagucuaauaucuguuucauauucacuacuuucuagcugucugaaagaaaacccuuagaguuuguuuuugcaagugaggccccuaagcuauguauuacuugaucuucaucucccuuaccuuagcauccucugcucuuuuuuuuuuuuuuuuuuuuuuuuuaaagauuuauuuauuuauuauauguaaguacacuguagcugucuucagacacucagaagagggggucagaucuuguuacggaugguugugagccaccaugugguugcugggauucgaacucuggaccuucggaagagcagucgggugcucuaacccacugagccaucucaccagcccgcauccucugcucuuaugcuccuccucaaacagcugcauagacuguaucuuguugcuuaguucuguuccacuguccacugcuuuuccugcaaacaagaaguuaacuccaaugccuuugaguuuauccgguuguuuuuccuuuuuaauuuuuuggacauuugucuguguauacaaugcuugauuauacuccccuacauccucccuccagcugcacuugcccuuccccaugguccagcuuuuuaacauauguacuacuucauauaugagauguacgcuucauaguacacucuaggauauuaagccuaauacugucauagagguuaucuguauugcuuacauuaaaaggagaaaauuagagcccagagagguuaacugacuagcgugguacuggaccucauauugugagagucuccauccgcugcccccucaacagguuacaugucccacccccacagaacagccaaacuugaaucaggcuauucugaugaggccuuugcagauugggaaugugcucaucauaagcuaacuaauuguggagcgaaaagaaagaacauauguuagaagcacacacuagugggcuggguggcacuuuucuguauucucagcacauggggguaaaagcagaagcaucagaagucagggucgucccugacuguaaugaaucugaggccagccaggcuaagugacaugagaccauguggcaagaacaaaaaacagugaaguaaaauuagggugucacuuucaucuugugauuugcuggagguuuuuuguuuguuuguuuccuguuuuugacagagggucucgcuaugugauuguccuggaacucaguauguagaugaggcuagccucacagagcucugccugccucuccguccugaguacugggauggagggugguagugauuauugguacaaaugagaaacaagaaggaaaacuucaguaauuuccaaaaucaaauuuccauauccuuuauagcccuuacuucacuugauuugguaauauaaaccauagcauauuuagcucaccuugaucauauugugcuuggcacauucguagcuguguguaacaucuuuggaccuuucaaggcuuuccuucuucccuggugucuuuguaugaaguagacuacgggagcuguuggcacauuugucauccaucauuauggagacccaccgucauuauccucuguuugcuuuuuguagaccauugggugcuuucugcuggaagucgccaccaaagacccuucccuugugguaacaggcgaggcucuggaugcccucuucgauguuuuugcagauggcgaagcagcugaaaaggcuucaguucaaauuaaauuguuagcggcuuugaaagaauuccaaccagucuucaaaaugaagguuuguauugcuuucucuauaaauacccaggucaucaggcagugguggcacacuccuuuaaucccagcacucgggaggcagaggcagguggauuucugaguucgaggccagccuggucuacagagugaguuccaggacagccagggcucacagagaaacccugucucgaaaaaaccucgaagaaaaaaaaaaucacauaaaugcccaggucucagcagcucuggaaagaagggccaaacagcucggagggugugaggauaauuccuguuuaauucggugguuagcccagcaccuccauccauagcacccagugaagugcuuguuggccgucgugguucuucagaauggcccuggacuucaguaauugaauggaguggcaccuugacaaguucuucaugauguuaccagagcuguguuauguagaagugcuuugaaagcauuuuuguacacuuuuaaacuucuuuauaugcuauaaugugcuuuguauguuagcuuuguuguggguauuuuuaacuugggaaaagaagacaucuucgggaugcucuguccuggagaacauagcaacuguuguauuggcucaauaagagcagcugagagcuuugcuuuucuuucuuuauuuuuuggugcugggaauugaacacaguugugcugugcaugugcucugccccugaguuaugccaaugccuaggaaguuuaggaacaaacuugaaucuuuccauuuuagaggguugucugucugucugucuguuuguuuguuuguuuguuuuauuuuccuuucuucuauccaucugucuguccauccuuccuuuuaggagucacauauacaagguaaguacucuaccccagagcuacaucccuagcacccccaaaauaaaaaagaauuguuucccuuugagauauauuucuuuuuauauggacauuuuugccuguacauauguccguacagugucugugagugcccaugaaagccagagauggcgucaauuccucagcacugcagguacagguggcucugagcuaccaggucagugcugaaucaaacccaggaucucuggaagagaaaccggugugcuuuaaucucugagccaucucuacagccccauugaguuauguugcuuuaagcagagacaaauauaccuaggauuucuuccuuucuuauccaaaaaaaguagcauaacauuaccaaauuuucuuuuuguuuuugcuuaauacuaucuaagaccuauuuuuauaccagugugcagugucugcauuguucauaaaagccuuagauuucugcagaaggagccuuugagauaaggagaacgaagcuuaccccauuccuccacagcugccagcaaagcagauuaggcagagugaucaaacuugcagacggaugugguggugccagccucuaaucccagagcauggaggugaacacaauaagauccuaucucagaagauaaaaugaaugaggguuggaaauauggcucauaguagaguaugugucuagcauuuguaagacccgggcuuuaauccugagcaccgaacaguagagaaagagcaaaacucggaagaaggcggugcuuugaaagcuuuaugagaacucugagcugggaaagcaaccugaaccacuggaggcguugauggggcugguuuccuguugagcaugcauugcugcagugggaugcuucgcugcuggaguuugucuaugguagagagccauaguggccucucuuaguagccagaggccagucuacagcaugggauuugagacuuuuaucuugguuuugguuuauauuccuggaaauggaauccaggaccuuauagcuuggcaaguaaccauacaugaccuacaguuuuaaaacaaagcccauuuguguaaaauggagauacauuuacauuucuguaaaaaggaggcauuagaagcuucaaguuggacuggagaauuugucuaaagccacacuucucaagaguguccccuccccuacccuccccucccccagcaucaccuggugucuuguucagaauguggacucuucucguuuucuauuuuuuuuaauucugaguuaaucucauuuauuauaguauggcagaauguggauucuuagcccccagcuccuggccucuaagucagaaaccuaguugguuuuuguuuuguuuuguuuuuuaauauucuuaguugugcacaccuuauuuguuuauuuauuuacuguaugagugcucugcugcauguacauccgcccaccugaagagggcaucaguucccucuauggguggaugagccaccaugugauugcugggauuugaacucaggaccucuggaagagcagccagugcucuuaaccucugagccauuucacuagcccuagaucagaaacuuaguagagguaccaguaggggccccaccagcccauucuguaggaaaucuuaagaauuggugcuugggcuggagagauggcucaacgguuaagagcaccgucuccucuuucaaaggacuugggcucaauucucagcucucacauggcuacuuacaacuccaguuccaggggaucuggcacccucuucugaccuuuuugguuaguguggguauguagugcccagacaugcgugugagcaaaacauccauacacauaaaagaaagggccuggagauguuagaccuuuugcaaagguccugcuucaacucucaguauccacgugauggcucacaaccaucuuaacuucagucccaggggauccauuguccuauucagaccuccuuggacaccaggcauucaugugguaugcauauguacauauaaggaaaguguucaugcaaauaaaauuaaaucaguuuaauuaaagauaaauaaaaauaucuuuuuaaaaaaagacuaggggugaguuaugauuugauuuccauaaacuuugaucuuuuuauccaugguucuuauuucuguaacuuuucccuccuuuggucuuuuuccuucuuucuuucuuucuuucuuuuuuuuugaaauagggucucuguaugcaacccuggcuguccuggaacucaccauguagaucaggcuggcaucaaacucacaaagauucaucugccucaaucacugcuuccagaauauuggggucaaacgugugcaauuagcuuguaaccauaauucuaauguguguauacaaguuggagagguaguucagugguuagauuuaccaugcaagugugaaaagcaggaguuaagauuguaaauuuaccaccaaaaugcuaggaaucucagcuucagaagguagggacagcugggcagugguggcacacgccuuuaaucccagcacuugggaggcagaggcaggcggauuucugaguuccaggacagccuggucuacagagugaguuccaggacagccagggcuacacagagaaacccugucucggaaaaaaaaaaaaaaaaaaaaaaaaaaagaagguagagaacaagaacaagcuggcuagugagacuagccaaaucagcaagcucuggguuugauugagggauccugccucacugacaauggaaaagaaaaaaauggccacauucucauuuuccucuucuucauguucgauauucuauuuaaucuggaguaaaacuuugacuauauucuuugaaaugucuuguuuaauaguaagugaaugacuaguggauaacaaguuaggugauaauguucuccuucucucugaauuucucucaccagauacggaaagaagggaggggcaaguacaguccagaccagcuguguguucucgacaaugugaagaugaauuugagacgguuuauugcuuaccaggaaacuguugagaaaagacugacuucuuaaaccaucaagaggaccagagcuagggcuggcugagcaucugcgugccuagcuggcacaacagcccugggucuaucccuaguuccugaggaaaaaggaguaagagaagcugcuucuccugauggauuuagugcugagaauacugaaggguuucccuugaauauaugugcuuccaaagccuuuuuuucuuuuuugagacagguucucucuagguagccccuccuggccuggagcucacagaggucuaccugccucaguuuucugauugcugggcuuuaagguauucaacaccacaccugaccuccaaaagccuucuuucacugccucuguucuccguguuaguuugaaugugagaaccuguaggaaauguguguuacaucuccaacauauuuuagccacugaaaaugccccacauuucaggugcuagggucggcauucagggccuugcuccugugucgugagcucuaccacuaacuccaccccagcccucaggugguucuuaauggaagggcaguaaagagacuucaaacaaguacguccuuacauuuuuuuuuuuuaagaaaagaaauuaaaucauuguugggauguuuuuuuaaagccaauaaauaucauuuuauauuagcuaacuccuaacagaaauguaaagauaagcuuuauaaaauauuuuugucaugaaguacuauauaccaaugaugaaucuuuugugaaguaaaugacuugaauuugucacuguguagauagugagaugauugaauucuguauaggggucugagcaguuacucuggguaacagcauuuccugucuuaauuugauacagaaucagaaauuaguagaaaaugcuggacaugguggugcacaccuuuaaucccagaucuucagaggcagaggcaggaggaucucuugaguucaaggccaaccuggacuacagauggagcaccaggauagccagagagacccugucucaaaaaaaaaaagaaagaaagaaaagaaaagaaaagaaaagaaaaaauuaguagaaaauauuuuugaauaaauaacuuuuaacuggau

SEQ ID NO: 4623 - RNA, 1330 nt, Mus musculus
uaaaaaauaaaggauguauuuucguuuuucugugugagcuuuggcugguuucuguauguacugugcucaugcaaugcucaccgcggccagaagagggcaucagauccccuggaccuggagugacugcugugagccaucuaucuugaguuaggaauccagguccccuucaagagcuguaagcacucuuaaccgcugaggcaucucuucaaccccuagaaagaugucuuaauguuuaauguuaacaauaaaagagaaggaggagcugauuaaaagcugaaguggccucuugaaauggaauauccauuuucagaagauugaccacucaguuucagcuucguaccuccagcuugcacuuagggcgccaggaauguggcuuuucuugagcacucuucaaaggaccguaaggggguugcgccaggccucucagauuaaaauccacuucaacaccaagugcuuccaaguaccaggcuuaaccucguccccacaggcgaggagacaggaaagaccugucuggagugaggcagagagcaagggucuugggcccugccaagaaggugcaaaaaagcauauauuuggggagaaggggaagguguugugaugccaaggcauucugaaugucucccccaacuucuaggggagccacuuccaaaguggugagccacugccgccacuucucacguuuuagguuuugaaauuaaguguugacuucccaauacccuuaagucucuacgccggggccuccucugaguaauuuuccugagugcaguggucacagucgcuaugacuccaaauggcuguucuuaucagccauuugugcaauacagugaguggggcaggggacguggguguuguaccuggaaucgcaugcucugcggugagcuacacccucaguguuuuuauuuuuccagaagcguuaguuuagcaccugagccuaaacuccgugggugugugaaaccuugcaaaucagccagcugcaccagguguuuugucacagucgccgggucgccugaggcuucgggcaggugugcuugaagugcagguguuugcuugccugaacaucccccuccuccccugaagcuugccuucacuugugcacaccacagcucagcucaguuuccuggauuucccucuugguaaagucuuggcugggugucugcccaucucgcuuccugugcgcaggcuguaaaugucugaaagagcucugcguuuguguucaguuggaaguuuugcuggauauagaguucugacugggaaacgucucucagaagccgaaagcaucauuuucagugucuuuaagaaucccagauuggaagcagaggcaggcggauuu

SEQ ID NO: 4624 - RNA, 535 nt, Mus musculus
ugcaucucucagaccuugcaugggauaaucgagacuucaaacccuuucaacucaaagaaguggcugauuggaugguggcauuucagaaaagugagggccauagcuagagguuuccagagucccucccuugacaagcgucaggagcagaucuuccccuacuccagcaaucucuuggauggguucugcucuccuacacguugcuggggcugcacugaugccgagauuuggaguuucuagaccugcaggucugccgugaaguuggcucugcaucuggugcaugucuggcugggcggcugggacaucccucaguaucagcaggacaaauuuaagcugucuaggacagcuuccaccaggaucuagcuuccaccagagcagaagccaucuacaauaaaaagauggccuccuggucuuccugccccgcugacuuagaaucagauggucagcaguacucuccccugucccagccuccacccaugucccugucccacucccacaccuucauguccaggucgucauagcauugaccaucaaauca

SEQ ID NO: 4625 - RNA, 9576 nt, Mus musculus
ucacucagcccauuuccuguuuucaaaaggagaacucaggauugcggcagacauucagccaucuaguuggaccuugcaaaaagagaucggacuggggcaugugacucuccuggaccccgaacccacaaagccugaagaucccaggucagucaguguuugaccccaagcguagcuggcuucugcgcccugagacccagugauguccuugagaggcccucuaggaacucccuggguacugguuaggagggaccaaggguggugagaguaugggcuguccuuagaaacuggggccaaacccaccuccaaccucuaagccugacuccuuuugcaaugccaggcacugguccuguuccugggaacaaguccaggcuuguauuucucaaaggguggacccuguagccgaguaagaauccggagcccaccccagcucugucuggguguugugggguaggcagccugcuugccuuagagcuccuaacacuuccucuccccagucccaguggggauucugaugugcacacccaacugagagcgcuuccagcggcaagcuccacagagaagcacccaggggucccauggugcucagggcagguggagccuuggcuggcccuucaauggagaccugaggaggcugcccuacaaagaaaggagacuuaaacucaaacucccgcagccagggcugccgcucccuguccuuccuuuccuuccuuccuccuccucuuugaaugggugccucucaguucuucugucuuaugggcaagggcuuuuacuauauucuaccagauuuucauuagccaccccccacaaccuucccccugcccccgagaaagguggccucggcucuacaaguggcccuguguaugaaggaggaggacugaagagggcagggccccuugaaguggggaacaagagccaaggcucccggaaaaugaagauugucaugcacagaagauaguaagggguggaggggugggagccugcgacucugcucuguccucugggccaaguccagucccaacaucugcagugcuuuguucugauggcuagaaaucuuucccacugaggguguggagugauaaggcagcccucagaacccucuguccccaaggagcuuagcagcugggcguaguggcgcaggccuuugaucccagcacuugggaggcagaggcaggcagauuucugaguucgaggccagccuggucuacagagugaguuccaggacagccagggcuauacagagaaacucugucucaaaaaacuaaaaaaacaaaaaaccaaggagcuuagcaaaaggaucaauugcccacagggggaaacugaggcuuggauguguuugggaaacugucaacauaucaucuuuaucuacuugucuuuaaaugggucacucccagccuguccuguaagaggacaggaacagcuuugguuguggcuuugaguuuuauucuaagccucgguuucaugccaguuuuugaaugguuuaccagagcacgcagcacgggcacauuucugcggucuuccgaagccccauggaagaaguucccugcagaucuggaaaggccuggaccacuagggccaguuccacaagccaccacucacuucacagacaaaaucauagggagaguacagagugcccauaggaaacacuacaucuccauucgguaaaauaggcccccuuggcauaccuguagucccagcccuagggaggcaaagacaggaagauuaugacuuccgggcagcuugggcuacauagugaagcacuaucucaaaaaacaaaagcaagcaaacaaauaaaacccccuguuaaauaugacagccuauggacuaccuacuaucuugcuuuagcacuuagcacagugguucucaaccuauggguugugacccccccccauaggggucacagucagauauccuaaauaucagauauuuauauuagaauuccuaacaguagcaaaaugacaguugugaaguaacaucaaaauaauuuuaggguuggggagucaccacgacuugagguauuguaucaaagggucacagcauugggagguugagaacuuagcagaacaugagggacccaucccaucaacacuuaacagugugauaaggcuuauagccacccuucccaaaaaaggaaagggagagauggaaaacagaagauaauaaaugacgugcccaggggcugcaaucagucagaaugggggucaugccuccugacuccuccacgaggcugagagguuagcaggucacacaagcuauugaguacccaagcauauacagcacugguccagccgggacccuguucugugccucaguuuacccaccuccugucacugugaggccugauggaggguuucugaugauacuuaaugaaccgcugauuagaugccacucagaaaauagucccuuccaccugccauaugaagaacagccccugaggcacaggcuaaagccuccccuaggccagacuaacucaaagagaggaugugaugacaucauugcacuuccucuugguuccugugcuaugaugcuuaaucuugccaacuuaacuggacuuacaauacccugggagccgagagaagucgaccucugugugcgucugugcgcuguuuccgcagaugacuaaguuaaggggaagacccacccugaauguggauaguaccaugccaaaggcuuggaggaaagaggaaagugugguucagugagcuggcuuugcagguaaagccauuugccacugagccucaugaccugaguugcagccccgugaccugugugguagaaggaaggaauguacuccugcagcugucauaugaccuccauacucuucaugagcugagggacaugcacaggcaugagcgagcaugcaugcgugcacacacacacacacacacacacacacacacacacacacacacacacacacacacacacacguuaaaaacaagggaaacaagggaaaugccucuauaaaugcaggcauguucucuccggucccccuccucuucccuuccucuuuccucuuugcuuccccgccaccuggaggugagcugcugugcucugcccauguccuccccgccuccaugagcugaaaccugaaaaugaacauaauaaagccuucagcuguugaugccuggaauucugucagaaaaccuaacacaugugcccaagacaguguccagccguuuguuccucugagagaaugucuuauuucucgucuccuaaugugcagcuaucuguaaaaagcacacccuucuagaguuauuuauuucauuuguauuccucaaacaccuaaugcaugucagauccuaguaacagagaggacugugcagucccuguugugugaagagccccgaguccaagcuguaugggguaggccuaugguaauccucauaccagccugugaagguaauucugauauuguacccauuuuauaagacucugaggcacagaggaggguaaacugacaguuaucaaggcauccauuuacuucuguguacagacuggacuccagaagccugcuggccugcugccugccugcugcccgcuuccgaucagagcagauucuguagucggccaauuugggcuugugucccugccccaaccccagcccuggcuggcaggcagcucucaguuccuuaccacaaagugagaauagaaagagucccugcaggggaggguggucacauugggaacaugcaaagaggcaucccuggccugcacaucuuagacgcaguucucccuugcuccucuguaccaauggugagaccucaggcuagaccugcuuccuuaccuguuaucuggcaguaaugccaaaguuuuguggguguucuuuaaaaaaugaaguaugaggcgccagaugagaugaacugggcauauuaaauauuugcuuaaagguagauagauggagaggggugcacuguaauauaaagcugaguggugggacauuuaucuggacuagccaguacgcuucacccaggucaucucuaaugauggugcugucacuugacaguauuuccugugaaauccagagcaacuguauacugcauggagcacaaccauaacucaggaucugucuguccauuacaggagagggcuagguuugaucuggcuggguggguaacaggggacacagcaaggcaucauugucauuccucccugccugccagcauggaauccuuagcauuccugcaggagccccagugugagcuggcucucuucucucuuguagcucagguagccuuggagcauggcaaguccagagcauccugggagcccuggcuggagaggacccauaaaccaaugcagaacaaggaccagacaggaaguauugcccccaggcccagaccucccauguccaggaccagaagguaaacuggaggguuuguguucugugagggaggugggcauuagcagacauuugaagcacuucagugguuguacggagguagccaggcagcugucuuaacuggggucaccuuaaccuaagcacaaggauuuggugcaugcucauuacgugggagaugauccucggagacagagcagauugggaacaagagcagccuccuguauagggggugggugaucacaugacuaggguaggugacugugacucaggcuggaugggggcucaugggaaaguguaaagaacauaccugaguugugcauccaaggacaaagaagccaaagauuguccaacaucccuuucuuucugcaagugcuaagggagacaccuggccauguugcuguaguccuagaaaggcccuaggguccugaguuauaggugcuuuccuuagaagccaauggcauuuuccagaacaguggcugccaggggguguggccuggcacugacaguaucugcuauagugccaucuccuggaaucaucucucuuuacacucauuuaagauggaucugcugaagccuggggugugccaugcaugacaaguagacugaucacuuuccuggccuccaagcucagaagagagacauuggugaaaaagaauuguagaugugccaggaaaagucuacuggaacaaaaugggaagcacucacuccaguaucaaaauggggugaggcaggggagugacaugagugucaggugguacaagauaaggacguuccaggccugugccucuugcaauaagugaacaauccuuuaugcaauuguguuggaaaaaaaaaucuaaacagauucucagaaaggugugggacucaagugagguuuaggaaauacuguggggagcuggguggugguggugcacgccuuuaaucccaguacuagggaggcagaggcaggcggaucucugugaauuggaggccagcccggucuacagagaaaguucuaggacagcuaggcuaaacagagaaacccugucucaagacaaaacaagacaagacaagacaagacaagacaagacaagacaagacaagacaagacaagacaagacaagacaagacaagacaagacaagacaagacagaacagaacagaacagaacagaacaaaacaaaacaaaacaaaacaaaacaaaacaaaacaaaacaaaacaaaacaaaacaaaacaccacuguugguuuucagacaaggaaucaggaauucagagccgagaaaggcagcugcacccugagauaaaguguuuguguagucagagccucccaggcucaggcugaaauacgacuuccucagggcuuccccugcacacugaugugcccuaaggagcuccauggccccaagucagugcccuagggaguacaugggugugggcccugcuuggcaggagcacaugauuacaaaaugguccaucagcaggccggauguguacagacuggauccuaccccacagugcacuucauaauaauaagaagcagucggaguguuggauugaggucaauacacaagguaguuucacaggggucuagcugauguccccacagggaggguggcaggaagggauagauaaacucuuccagaacucugauauccauuccaucccacgccuccagucaucuccuuccaucccuggccugcagggcacuucagaauacagauucuuuaaaggcaaugucuuuccagaagcccaagauggccccagcucuaacuccagcaugaccacaagggaacuccaggaacacuggcagaaggagaagagccgcuggaaacaugucaggcugcucuuugagaucgccucagcccgcauagaggagaggaaagucuccaaguuugugguaagcagagcuuagaaugauggggcuccucccaucagucaccuccugcguggucggggaaggccuugggagaucacagcuuuccacuucuaauauggcacacuaacucacagucuuccagagaaagggagguugcacggucccacaugaagguagggugccacgaggacugugagucauguucccaugaugccaggugucagucaucugcaccccuucacaccccuucucugcugauucugaaaucuccuuuaauuguuaauauguuucuggcuuuuuauuugacuugcuuuuaaaauacaugucagggaaagaucaguuucacaggacauuaagaaaaaaaaaaaaacaauuacaaaaguaaacccaaaagaaagcugagcucuguuauuuaauucuagcugcuaguccugguuuguggggaguucccaaugggagugccgucugagugagauuggccuguucuaggaagauggacgaguaauaccaaguauucccaccucacugggaccugugaggucccacucaccacuccuccuuacugggaccaguacaguuaccauagcuaccagcuuguacuggguacagcucucccucgaaucaaugaguucacucagcuauuuaacccucgugcagaagacaggaacuauuccuauccuguuguguuguauaaaccggagguacagugcagcagcaggagggaggaccuccgugggcccauguucaggagucuccugaacaaucagcuguuugacaggccuaauacaaaagcaaguuuguugagggaaggggauauggaaaagggguagagguagggaaaggagggggacagagaaggacagaaagugagagagacugagagacauagagaaagacaaugaaaaagaggggggagagcaagggagcuggggugcaagaaaucuucuuauagccuggcugguaccuggcuugcagcccccacaagcuguuacuagguagcuguuuggacggagccuagaagaauugccaacacauccucaaguuaaagaugagacaacugaagcucaaggagguuaaauucccaaucuaagaccaaugcguuaugccugaaacaaaugcucagguguuccagaugggcccuuccugacuccagcccacgcuucccaauuuaggacacggagccccaguuuuugaugauaaaaagccaagagagacaccagccccaucagcaacucccggugccuuuucuuccaaggugcaucuaagcacugcuauucuagagccaacauuugccagggaccgccuuucuaccuuuacucauaguacagcaggagaguaggugugccugugugugcgcguaugugugugugugugcgcgugugugagagugugagaugaacuucaaaguaugcuauguguaugcgugaaaauggcagagggccagccagauggcucagccuguacaagcaccuacugccaagccuguccaccugacuuugacacccagaagccacaugcuggaaaaugagaaccaacucucacaaguuguccucugaucuacacaaaccacacacacacaccgcagacacauguaaaaauguuuuuuaaagaaaauguaaaagguaauauuauuacuucguacaaaaugugacuuuaaaaauggcacaggggcagguguguagagggagagggggaaaggagacacuguugccaagcagggcacgccuacaaccgcagaauuugcaagacuaaggcuggaauaucaggguccaucuguaaacuacaaggcuaguucauauuucaaaaacagauggccugggacaggggaggggaaaggauugugggagaggguacaaggagggggcggugagcgggauuuaaagugaguaauuaaaaaggaaaaaaaauuaaauuaaauuuaaaauaaccaaaugaccuggggcgaggcuguauagcucaauggcagaccacuugccagacuugugcacggucccuggguuccagccccagcaggguugagcgcgugcgcgugcacacagccgcgggggugcgggugcggcgcgcacucaggcuguccugaggcucauccucuccggucugccugcagauguaccaagucguggucauccagaccgggagcuucgacagcgacaaggcggugguggaacggcgcuacucggacuucgagaggcugcagaaggcccuccucaagcgcuucgggccggagcuggaggacguggcguucccgcggaagcgccugaccgggaaccugucggccgagaccaucugcgagcggcgccgggagcugcgcgaguaccugcggcugcuuuacgccgugcgcgccgugcgccgcucgcgcgaguuccucgacuuccucacgcggcccgagcugcgcgaggccuucggcugccugcgcgccggccaguacgcgcgcgcgcucgagcugcugggccgcgcgcugccgcugcaggagaagcugacggcgcacugcccgagcgccgccgugcccgcgcuuugcgccgcgcucgucugcuugcgcgaccucgagcggccggccgaggccuucgcagucggcgagcgcgcgcugcgaugccugcggacgcgcgagaaccaccgcuacuacgcgccacugcuggacgccauggugcgccuggccuacgcgcugggcaaggacuucgcggcgcugcagagccgccuggacgagaaccagcuccggaggcccacgcacagggacgccacccugaaggagcucacggugcgggaguaucuguccugaggcggcccgacaggugcccuggcauccaggcugcgcagacagugucgugggucgccaucgccugggggcuuugcuggacggcuuuggacaagccuggcuugaggggcuccugggaccucuggaagagccaucuugugacccuugagugccagguucucuaaauccuaagccgacaagcucagcuaucaaaacuuugcaaguacuauggaccuuacgugccaucucggaaugggaaggacuugccuaccgcacagaauguguucaaggccagccuaaaaaguuugcugagacuggcuccaaauaaagaggucugaggaugugacuuaauggcacagugcuugugagacuccauugcuucaaucuaaaguacuaccaaaaaagaaaaagaagcaccuauuuuuguagacagccagaggagaaauuuacacaaacaugcaaugcacuuccuuaaagacuacccccuccuauagccccagaucuucccuucgcuccuguaccccaccccccaaucaguugcaaguauuugcauccauuaacccacagaccuaguuccuccuuuuggugucacgcuuucaguaaaacaagcucuucaggggaagccugca

SEQ ID NO: 4626 - RNA, 54921 nt, Mus musculus
caguucggaggcggggcaggugggggcgggcccagguagcagguucggcugcgcgggggcccgcgcgccugagguaaauacuggggugguggguguggggcgcccggccggcccgggacgcugguucugaagcccggggcugcggcgcugagcggcggccgaggcgggugagugugcgcggccgcgcggcugacgcuagguccccaguguuccugcucugccucaggcgcccugaagcgcggaggcgaccgucgggccucagcgcccgcccguuagcugccccgggccgacgagcuucugacgucaaccgcgguugucaccuccagccugcccgagggcucccgacucgcgggacuccugcaccacagggcuuggguaggagcagugcaggacuccgucuuucucucuggcccgccgucguggacagauggggaaacugaggccgggacccugccuggcucccaacggcugcaggaggcagggagaaucucggguuaugguaccucacgucugugcuguuuugugggguguugguggcuccgcucccggaagagcagucuggccucgcuaauggcguguucugcuuuuucuuucaguuucucuggucuggagggaggggggaggagagaggaugguuuugcacaguuguguaguuggaaggugcauccuguugagacagguaccuuguuuuuccuuuuauuauuauggucagccuuggaggagaccgccaagucgcgaaugaucauggucuggaacugaguucaucugggucagcugccagguuauucauguccuuggcaucuuuuucuauuccaccccuuggcauuugcauguuuuagggguuugucauccucuagccaccaagccuugcaaucucccaacccccacuauccccgccaccuuccucuuuuugauuuucccuggaaaguugucuccuuagaggagcauucauucauaccuugcuguggugugugugugugugugugugugugugucugugugugucuguguuggggcuaaucagggauuccuaauaagauugcucauuuuuguaaucauuggcuccagagaagaaugcaggcaucaagagggcgugcauucaaacaucagucucuugcacacccccucauaccucaaguagguugaauggccccaagaauuuagccugcugcuccccgcuggguaguggguggauuugcacuagaacaguauugaaggaaagugauuugcuggaaauucuuagugaaguucauguaauuugaauguugacaguacccagaacauucucuaauguucugcugcaaaauuuuaagguauucuuuaaaaaaaaaaaaaaaagccuuguuuggacuggaaacuuuugagaugagcugauaagaccaggaacuuguuauguaaaaaugacauauuaaacagaagauaccuaaacugugguuaagugauuuaaggaagucuuuaauacaugaagaaagagcaguaauuauccugcccaucaaucuauacuuaguguuuugcuccugguguuuauacugucaucuuacauuuuuaguuucaaaugaagcuccaaacaaccugguuucauaauugugacauuucaccuuacuuguuucuacuuauauggauaguagcauaguauaaaauugauugugauuuuuuuccccagagaauuaaugauauuuuaggcaaacaucauguuucucuauuucuugacucuuauuuuuaacauaguagaaacuucuggucacuuaaauaggacaaggaaauagcauuuuggcuuccaccauuacaaucuaagcuaaucaaguuuucuggucuagucccuggaaagacaaggaguggggaagucacauuuuuagagcccagugguuagguuuaacucacaagagacagcauuguuccugucuuccugaugugacugcagaugcaagagccagacuuuuuuuuuuuuuccagacuuuuuuauuaaauaaaccuuuuaagucccacuugguuuugugacuguauccucgugucacaaauuauucuggucuugaaaucucuguauuucuauuuacuguuuaggcauguaaugacuuguucuuuuaguaagaguuguuuuuucuuaaguuagucauucuaacugacugaaagcauuuggagaagauguggcucuuuucuugcauauccaugccagccugcuuaccucuuuaccauuugugauuugagcaguauuuaguauuguaauuucuauugugauuuagaaagcuuucugugguguuuuagaacaaggaggcuaccucagaagagccagaugugauugaauuacaccugucuuugugagugucuuggggaugguacaucuugaucacuugagcauccagauguuuuagucuagaaaaauuacauuaucgcuuuuauguagcuggugaccauucauauugugauucuuaaaaccugguaauucugaucauuaauauuuguuguaggacuugcauccuguucaucuuaucauuucauucacuggaaauuguucaacauuuauuuuuuuaacccucauuuaguuuaauaauuuuuaucuuaacauaauggaacccuccuuuacucagcauucaggccgacaacuugcucauaagcagauagauucuuuuuuguucccucgucuccaguguccccaagaaaggccuccuuucaucuuugugucaugcugaacaguuugaggcuacauuguugugguccagcucuuugauacucuucuuucaguauuucaguaauuaaucaaaauauacacaauuacuguuacccagucagacaugggacaauguuuagaugaguuguuccugauauauucaccuucacaaugauuccauuugccaaguaacucgagaguauaguugaaaaucucccccuucauacucucucucuccucauuacugugaacuuguugucuaauagcagucaugaccugcacuuaaagcggaagcugaauggguggaaagcagacaucagcccuuaaaguguguaguuuucagggucuacugacuguaucagaauauugaacgugaucuggaaaaagcucacgaugugauuuugauguuucucuuuguagagucuugagacaguucuuauugcuugggguucuaaggcuuuauuuaacuacugugcagaucccagaggagugagaauguugguauuauauucauuacuacaggaagagaaaagaugguuaggauauuucuguugugaugcugauguuuugagaugauaaaugaucauuugguuuuucaucagguauguguguagaaagagacaaaguucucuauucuauuuuauuauuuguaauaaaggaaauuaauuuuaauguguuucaaacauacuuuuuucuuuuuauacauuuuauuuauucucguuuuuauaugcacuaguguuuuaccugcaugugugucugugugagggugucaaauccugggguuacagauaguugugagcuucaaugugggugcugggaauugaaucugaguccucuggaauuguagucagugcucuuaacugcugaaccaucucuccaacccccugaaucuuauucuugauauauuccuuuuaaaagcgggaagguucacacgucucuuucucuuuggauaauacuuuaaaaaauauuuuauaauguuuguuuugacuauuuuaguugucuguuguaccuauucuauuacugaauauaaacucagguucacuugugcaacaaguugcauucaucauucuuugucuaguucauuuaaaaaauauucuugaaaaguucuguuuauugccauagaccuuuuuacaaaccaagcaguuauauaauucuuaaaacuguguacuaucuuuugagaucaaauucauuuaaauauaauguccugaaacauauacaauuauuuuguuuugauaauguuucauuaacacuaauuuuuuuaaacuucaaauuguggcauuaguuguuaaguuagagagaguuaauagaauaggcagguaccaauuuaccaucuaaagauacccaguuuuagaaauuuuagaaauaaaaagaauuauuuuaaaaauaaaauagcuaugaaauguuuuuggucaaaaauuuugaaaugcauuuuaaagagaccccaaacaauaacuugcugcuuuuugacuaccugaaccugggagcagucuuaaaaccucuuuguaauaaggccuuguguaccuuuguguucaguaccucucuagaauuugucuauuccucuuuauuuguguugcuuugccuuuuucagacacacaaacauagcucaucaccucacuucuuagaacuguuuagaagcaguaaauuggaaagcaagaacaucacaaaaacagucacaggcugacugcaggaaaccacagaaaauggcugauuucaagagagacauuuaaguauauacugugauuucuauaaaacaggcaagagagccagagaacaggaugaaaagcuuuaugacaaaguaauaaacagcuuuuuauauugagacucacuaauaauaauuuauauuccuaaugauaccuaagugaucaagaaaaagguaauuuccuuaaugcugacauaauagcauuuuaguaaaaaagccaaacacuuuaucuugguuccucagaggcauagagacauauuaagggguuguguagcuucuuggguguccucuugagggauuuuguuuacauggggcuaagauugagguaucuacagguguguuauguaaguagcagauauaaauugauuccuuuucuguugaaguagacagugcccucaaguggaauuaaagagcacauuacaaaaggaagcaggaagaggagccgcuccugcugccgcugcugccuccagccucaccaagugugcaggugcuucagguggcagugguuuggaggagugccugccuuauccugucuugggugaccagagucucucauuugggcuugcaaaaggacagacuugugaaaaugaugggauacuucuaagagauauguuacucuuguguguggaacauagcaauguugcuuuauuauugagucaaauaauaccauuucugcuuuaguucuaagaguauuugauuuaaauugcaagaauuaaauggauacauaugauagcuuuauuaauuacuaccuuuagccacagggauggagauggauaccucugucucaaagaaggauaaaacaaccacauucuugugacagagauacauggaacuauucuuuucagaaagauaauuaauaaugaagcccuuaauuugaaaggauauaauuguguuuuuaaaaauuuguucucuagcagugagcuccuaugucauggauucugaacuggcuuauaauaucuggcauggauuccuuuuagcagagcaggccucaaauccgauagagcaugguugcuugaucccauugcagcccugccacuaguggcuccuggugaguuaguauuguacuucacaggguucaaauauguauguaauauguuuugguuacucuugccucaccuuauuuuccuuccacuccaucauacucccucccuacagguccccuuaccacauucaugucuuuuuucuuuuaugacccauuaagcuuaaugaaggccaccuguugagccuaguuggucucagugguggauacauaucuaaagacgaugauuuucucuuccccaggaucaccuaguagccaauaguuuagcaaggauguacccacgagccccuaccuaauccaugacuaguuauugacauguccagucuuacaugggcccaauaagcaaucacagcugcugugaguucaugauugcaguggcuguguuauggccagaagauaguguuuugcucuuauuuucccuaucuuccagguuuuauauucuccacccgagacuccaccccauucugcaacauugccugaaccuuagagggaguaguauaaguguucugcuuagagccgagcacucaagcuguuccccuuuucucagaaccuuggacacugcuguucauuguggggaaaaaaaaggccucucugauuaagacugauaauguggcuauaaccagagauguuuagaaggcaguuggacaccaugccaauuuagguaaacaacaguauuaaguuaaacccuaagccgugaguuucugaacuuguuuauaauaccuggcauugauuccuucuagccagagcaggccucaaauccaauagaguguggcugguugaucccaucacagucuugcuacuaguaggcauguuggguuaacuugcuugcuggguuacuguuguaguucugggguucacagcuggguaagacggcugauguccuacucuccccaguguacauagcaucuuucaacacugaaagcuaguuagcaggggggaaguaucugucucagcucuagcuugguuucucuauaucuuacagcuaaggaguauguugucuucagcaauagaaucucaccaucuaguucugauggcaaccaagaggauuggcaacaaucuguauugucuugggggccuuuaggaccugccugccugacaaggaggguaucccauaccugccacugggaauuuuguuuuaacaaccauggcuucugggaucagcagucuagcuaagcaggaaucuuccuucuaacucuaauuuucuuucaacuuuauauuuuuaaauuggcuuacaaaauaguggauuuuagacugucaggauggcuuaguagguaaagguauuugcugucaagccugacgaccugagcucgaucccuuagagcugacaugguagauggagagaaccaguuccuacauguugaccuuguaccuuucaugugcacugugguauucauguguaggauacuuugccaaacaaaggauaacuuugccuuguuccugauuuuaggagaauugcuuuagguuuuucuuuagcaugauguuggcuauagaccugucauauacagcauuugaaauuauauaguuuaaagucaucaauuagaguaggcuuuaaaaugaggcuacagaauuguguaauuauuuuuguaacaguuuuaaaugaaaaauugaagcuggaaaguaaucacuuguauauucuuuuuuaauacauaguuaaaacugugacacaaacuccacaauuuauugauauaaaaaucucuaauucaguauuauuauccuauagucauaugucauuauuacauaguccaaauuucgaggcuauaaaccauuuucaaauauuauuuauauacuuagguuauaauauucauguuuauuaauuguaagaaguuaaauaguaguuauaauuaauauaguuaacaucucccugucuaagcacaaaauauacaagauuaugguaaugaaagugaggaggccuaaagagauggguuagcaauuaagaguauauacugcucuuccagaguaccugaauucaguacucaugguagguagcucacaacuaccuaucaauucagcuccagaggauccaaccauccuuucuuauggcuuccuggaauaccuauacacacguggcauauaaucacacagauacagaauauacacauguaaauaaaauguauaaaaauaaaauugagucagauaaaacauaaaugaauuguagaugaagcuuccgaauguaauauugucauauuuuuauugauaaaagauguucaguacuauaauauguaacuuucuacuuaaguuacaugcuuagaaauaauagccuuuuuaauuaauaagauuaugcauguuuucucaaaacacuaugucuuaugcguucaaguaagacagaaaugcuacuuuauaguuuaaaaacaucucaacugggcaguaguggcccacacuuuuaaucucauuacucaggaggcagaggcagguggaucucuguguucaaggcuagccugguuuacagagcaaguucuaggacaguaagggcuauacagaaaaacccagucuuaaaaaacuaagaccaaagcaaccaaccaaacaaaaaacugaaaggaaaaaaaaaucucagagauugugauuuuauaauuuugaaauagucauuauuguuaaugucugcaaaugcuuugcuacuggcuuucuuaaaauccaguuauaguagacacagucacaugcuuuuagcucuuugagauauguauauguguguguguguguguguguguguguguauguguauaaaugugauuuaaaaaaucuuaagcuuuaauuuaagguuguauugaauggagucuaaaguuugcuuugcuuguuugccaggcacuuugaauugcugucuuuuuacaacauggaugccagguugcuaaaaucuugcuuugggacuuacagcgaguucauuuuuuuggauuuuaugacagauuuacuaguggcuccuuuuugccagucaauguucugaaaguuacugucacaaugaguucaggccuguggagccaagagaaaguuacuucacccuacugggaagaacggauuuuuuaucugcuucuucaagaaugcaguguaacagacaaacaaacucagaagcugcugaaaguacccaaagggaguauaggacaguacauccaagaccguucuguggggcauucaagaguuccuuccacaaaaggcaagaaaaaucagauuggauuaaaaaucuuggagcaaccgcaugcaguucuguuuguugaugaaaaggauguuguagaaauaaaugaaaaauucacagaguuacuguuggcaauuaccaacugugaggagaggcucagccuauuuagaaacagacuccgacuaaguaaaggccuccagguagacgugggcaguccugugaaaguacagcugcgaucuggggaagagaaauuuccaggaguuguacgcuucagaggaccuuuauuagcggagaggacggugucggggauuuucuuuggaguagaauuauugguaaguuugaaaagacauuuuaguguuuuugugaguguguguguguugugugagcacauacauauuucccccuuuuguaugcaguauauuuuuuauacucaugauccuuaggaucaaugguuuuuguuuguuuuugguguacuucucaggauagaccccaggacccucuaccacugaucuauaucucagccccaagguuuauuuaauaauaaacugagaggauauaaagucagugcuugaauuuuuaauuuuaacuuaaaauacuaauuuuaacuuaaaaauugucucuuaugauaggaauauauaagucauuauucuggauuuccauaucuaagaaguuuuaaauuaccuuauauuaaaaguuaacucuggggcuggagagauggcucagccguuaaagacuaggcucacaaccaaaaaguuaacucugccaauucuaauuaaauacuucaaaaauugugaaauaucuugugaugucugucauuuacaggguucucaguuccuuguguaugcuauuaaguauaacaguuuuaaggcaagaguuuugaaauauauuguagcaauuucaguuuuauuauacuucuuccugacuuuuauaaacugccuuggaauuuauuucuguuggaaacauaccaaaaauuuuuuuugaguauuuccaaacugaguauugguucucaucagugccacacucugacauucuugugaguagaagguuuuauuugcuucuugauugguuuuucagcagugagauaguuagguuuugacagccagguauggcuuauacuagcaggguugccaugcuacguaaccagccuauacccagcucuuugaaucugucuccccucugugaagugcuuauagcacaugacuuggggugugucuagggcacacucauacaguggauggcacacagcucuuuuucaguaaauggagcaaaugcugcuuuuugcuuaagguagaacgacaaaaauuaugguagaagucuacuguaaauuucagucuaacucuuucacaaaagaauuaugauuugaaacgaugagguaauuucacugucagauacagcuuuauuuguuaaauguccuaaacccaacugcaacuguuagucaugguauuucuuauuauguguauaauuuagaguuuucccaaaguaauuauccuguaaccacuuuaauggauaaucuuucuauauauuuuucuauaucucuuuaggaagaaggucguggucaagguuucacggaugggguauaucaagggaagcagcuuuuccagugugaugaggacuguggcguguuuguugcauuggacaaacuagaacuuauagaagaugaugacaauggauuggaaagugauuuugcaggcccaggagauacaaugcagguugaaccucccccuuuggaaauaaacuccagaguuucuuugaagguuggagaaaguacagaaucuggaacaguaauauucugugauguuuuaccaggaaaagagagucuaggauauuuuguugguguggacaugguaagaaaauuuuggauuguauuauugugaauauauguauuaguuucauugccaauuuagguuuaaauugaauauuuaaaaugaauuaagguacagcacuuuaaagaagacaguucaguuuaucuuugguccaggaacauugaaauaggacauaugagcagacacagaaugcaugugcuacauccuuuuccaguuuuaauaaauugggagaauguccucagucuuuaaauuuuccuuauuauaauugaccaguagacaaaaacaaaaaucaaaccaaagcaaacuaauaaaaggaacugacaguuuccugaccaagcccaaauguaugacacuguauuuuccuuuaauuuaaaaagauuuuuuguacaugcuuuguauauauuuaauaaaguuuuauugaucuuucugauaauaaugaaaguaaaaagucauuaauaaaaaguaccuagggaaaaaacugcacugcauuugaguagauggaguauucccauaugauuuguacuguuuaaaacuguuuucuuauuguggucagauauggcuaauagaagaauguguccaacuuaaguauaguuagagaacaguucaguggcauuugguauguucucauuaugccuuuuccauggucugucugcuggacuuuucuaucaucucacggggaacucuguucuuauuaaauacauucuggccagguuguccaugccuguuagcuacacucuuaguaccagucugcaggcaccucagugaggucauacacucaccuuuucuguucgagucacucauuuuuauuacugaauagucauacuuguuaauaauggauacauuccagccacauacugaauuaacuuguggcacuaagagagugagaagaaagagguugagaacguuuuuauuauagauugaaaauaugggcaaaaguucauuauggauagagauuucuuuauaauaucaacuccaggauguauuaggagagguuaugaacagugggcucauacaguggacuaguuuuaguaaucauuuuuauuuauucagaaauacuguaaagaaaugaaagucaggcaugguggcacacaccuuuaaucccagcacucgggaggcagaggcagguggauuucugaguucgaggccagccuggucuacaaagugaguuccaggacagccagggcuacacagagaaacccugucucgaaaaagcaaaaacaaaaacaaacaaacaaacaaacaaaaaagaaaugguagggcacaaauguuucuagcauguucuuguuacuuuguacuuagaaauuguguuggaugcucaccaguuagguauaaaauaaaaacuugcuagacucuuacuaugugagauuagagccagagugagaccuguggguuucucagaauugcuaauaauuaaaaccaguauucuuuaaaugugaguuuaguguuucagaggagaaauugugggcugggcagagagaagguugcagaaagcaggccaauaaucuuuggacucagucuccauauagauucuuuggcccagguuuucauugugacaggagcuguuuggauccucuccucccucgaugguagccuaggggaucaucuuguuuagcucacgcaggcugucuuaaggcuugccugccagguccacccauguuuuguccaucaccauuugacuuaugcaagagucacuuccaaacacugucauuaggcuuauugagaaguucuucaacugcaacuuuucucaugccuuuuuguuuccagggacacuuuacacaugcacuucugcucagagcaguuguuucacuggcucaucuguccguaccucuucaacaacccacguggcuggugucacaguagaauauaacuuagaaaaaucuccauuuuggggaaagucuuguauaccuacaaaugacaaaagaauucugagggcuggagagauggcucagcgguuaggagcacuggcugcacuugcagggguccugaguuccagagcaucuaugugguggcuuccagccaccuauaaaggaucuagugcccuuuucuagcauuuagguguauauguagcagagcacucauccauguaaagaauucuggaguaacuuaccauucugcuauagaaagucauacaguaauucagaugagcaaaguguccaaggauauaaaugugugauuaacuuuuaaggguagguuucugaguuaaauaaugcauuccuagugaauuuucauaugcaaacaaugucacuuuaaaccucaggugguguuauuaauacagauuaaaguaugaaaaauacuuuaaacuauuuuucuguguguuuucuauaacauuauuauuguuguuguuauuauaaaaccuaguuacuuuagcagcuauuucuaauauaaccuuucuuuugggcaaaguaguuaaagguucucaauguaaaauaauuuagaagauucuucuguaagaaauggagauguucauauuuacauuuaauugaggagggcuuaaaggcuuccuuuguaugucauuucuaggauaacccuauuggcaacugggauggaagguuugauggaguacagcucuguaguuuugcaaguguugaaaguacaauucuccugcacaucaaugacaucaucccagguaugucuccuuuauguauucagaagacaguuucuaacguguguuuuguuaugagaauggaaauauauucuuuaagauaggucuuuugaaauuggguuuuauaaggcagaauugucaauaaauagaauauccuuuauuuaccucaaacaaaagcaauaaagguuauuucuaaaaguaguauuucuaaaaguacugagugaaguuuauaaauuaucuguuacauuguugucuccuaggcauucuaauagagaaaaaaaaccccuuucuuauaauuggaagguucaaaaauacaaaaacugcugccuguuggagcaagaguugaaaguaggauccuguaaagagaaauugguuaccucaucuacacuccacaguagauucaggauucuuguuaaaugauggcugaaguucuuuuuguuuuaagauggcauuaugauggaucaugcuccaugacaguggucagaaacauuacauaauuuuauuauauauuauuauuauauauaucauuauagaaguaauaaucaggacgaacaagauaucucaguggguaaaggcaguuaacauuuauuucuggggauggaacccagagucuuacacgugugguacagguggaaacgcagucaaagucuuuaccucugagauaaagcacagccugugaaguuaacaccaaaugagaaagccaccaccaccaccaccaccaccaccaccaccaccaccaccaccaaaaaccucugcaaagcuucagaaucuuuaauuuuguuucaaguaagugucucccuuggcugcuaugagauaauuggcagugguagcaacaccagccccggcuguuagaauucccagugguaggcuaguucaguagagccaagagaggcaggcauucagagauggggacaauagugaauguuuuguaacuaugaauagcaggaaugugcuaggccuggaacuagaugguuuauaugcuuucuuuauguucuaaaccaauuuauaaaauaggucuugauaaauuuuuugcugauuuaaaauguaaaacagaacaaacagcaaaaguaacaaagcaaaacuguggcucaaaucagacuuggauugucugugaugaagugauguaaguggcagagcccaaguuucuguccaucccugucugucaugagcgcucuucagucuuccagcaaaccccuuaugcucagaguguucuugcauuaugaagaaaugcauaaaaagacauauuucuuaguguuacaugcuaggggauauuguuucuauggagauguauuuugucucugguucuauaaaagauaguuuuacuguagcaagaaucauaagugagcagcaaacuauuuuuuuucugcccaguguuuuuccauuauugguaauguuaacauaaaauguuuuugaguuuuuuucuauagcuuauuuucagucccgaauuucuuguuucagagaaaugggaaaugaaggcuccugggcugcacucuguccuuccugacucccuguuggugucaaggcauaaauacuuauuuuacaguuugaacauauuucccacauagcuuuuaguuuuguagcaagaggugugaaauucguguaacagcuuuauuucaauuuugcuauuaaaaaaaucugucauacuuuacuuuugauuucuuucgagauauauuuguuauuaauucuuugagaaauuucauauauauaauauauuuugauuauaacaccccccaucuaacuccucuugggucccccauucccaauuccuugcucaaccuuuuggaaacaaaugguguauauuuaggggaaagcauguauguguguucauauuuuauuuagugguauuuacuuugucaugcuuguuuuauagacaguauaguuuaggaaguuugugaguugaaauacuuuuuaauguuauagugagugcuuauuguuuuaaaaacagcaauauaaaauaccauucagauaguagcaagcccuuacauaggcuuuguuagauaugaauauuguaggaggcaaagcagguaagaauuauuggggcuggaguguagcucugauagaacacuugccuaacaugaguaaaucuguaaguucaagucccaguacugaagagacguaauuauuagggucaguaagauggcucagugggucagggcacuugccuucaagccaaccuaauuccuggaacucacaucguaaauguagagagcgacuucugcagauuguccucugaccucugaacacauauaugcaggaaugcacacacaugcaugcacucaggcauauacacauauuaaacaaauuuuaaaaauaauucuuauuccaaguuuucauuuuaaugaauggagauagacaaucugugaguauaucuaugaucaguuagaugguaccaggcuagagaaugauaaaacaagggguaggagauauggaguguggccugucacuuucauguauuccuguagaucucuccaugagacauuuaagcagacacagaagaaauaauugggccuccaauuuuaguagagcugaauugagaggcccugucuaaauacauuuggagagcuaugcugauuuuauaaugcuaacuugcuugauagcugagaaguccuugucauuuuuucuuucauuauuugugaauuuuuacaggggaacaaauucuagguauuacuucuuuuguacagucauauccucuagugaaauuucacuucaguuagcaaaaagauauguuuugggcauuuucuuuuuuaaggaauuuucccccuaggggggccauccaaugguguuuuugaaaccuuaaaacccaugacauuuuuugagugaauguaacugucauuuuuagcuaucuuaauugcauugcuuuugaguuuuguauuuuauagcugaaugaaauauguuauauaaaguugugggauuggggaaacaauuauguugguauuaccauuaaagaaggaagaagaucccugagcauaaagcucacauaugcagacguggcuguguuauuuucauucuccuguagaagaaaaagauuugaaauguuccacccucccccaacgcuucagcugcauuucuuuauuuaaacauauauauuauaugauuuguaugugaauaacauacauguauacauuucaccucuaaauuugcuugaaauguaaauugucuuagauucugcaguugcacauaagaaauggaaaggagaguagaaaaaaaaacauuuuuauuuucucuauguaggaauugggguuuauccuuacaaguaaaauuuauuuuuccuuuuuuauaguacuuauauuaaaaacauuuaaauuauauuuuauuuaaauacuaauauagaauuaaaguagcaaaaccaucaacaacaagagaaaaccacguacguuucaugauguaagagucccaugacagggaucuugaagauccuugcuuguuauuaacaucauugcugguuuagagcagucaugagaaaggaaaagaaugcuuuuucucuuucaaaacuauugauauucauaaaucuugaauagaagauaauuaagaaugauacugcuuuuauacacauaaauuauacuuauuugccaacaaaauaaagcuugcaaauagacuuuuaaaagguaaaguuguuuagaugaaaauuaauuuaauuugaauaagccuucaucuauaucuuuuguaucauuaacacuguuuucuugagggguaaaaagcaugaagagucucucuuuaguuccuuaguuuauuuauuuauuuucuugcucaauuaccucuauuugugggacagaauuaacauuuccagcacguaggaaagauuccuuuucagcagcugaauagauggugagauuuggaaagaauucuucccagugaacuguuucuuacuguuggugucucaauaccuuugcuucagccugcuauaaaaaugucccucuuugcccugcuguuucugauggcccaaagcauuaauuaacacaucugauaugauaccacauccagguuugugaaguggugaugacaucuuuuugugacacuccuaaaguaauacauuucugcuuguugagcucugucuccgucuuuuaguuguggagguuaagaguuuaauauaauuaaacaacucagacugcacaguuuaugcauagucacagaaauuuaaaaaggaaguuguuuagugggaaccuuuucuucugaggcugaucccaagcucaugauuucuuuuucauccuugugugugugugugugugugugugugugugugugugugugugguguugcaugucuucauaguucauguccuuuaaaaagcuaacaguuuuguugagcuacaaugcauguguaaccauagaacacuccauuucaccucucaucugggaagcuucuuagugcacuagaugaccacugacagagacccucaacuggucaggguacaaagaacaagagacaauggagcacucagccuuaagugggaacauacauccuguaccucccccaccaagacucagggaacuuuacagaggagagggcaggaagguuuuaagaaccagcaguagagguugacuucaagaaaacagaauuuucuggauacagcagggcaguuguauauauaaucucacaugaauugugucaacaugaacaagacccaugcagccucaagccagacaaaaucccagcauggaaggaggggauaguaggucugaaaucccaccacuagcugaaacacugaagcacuugguagcugcugggagagggaacaucugcaaacagcagucuguucuuuguuucuuuaaguugccauuucagaaaaguucuauguuagugaauuuguauaggacaugguuugggggauuucugauugacuuuuuauccaccauaauucucugaaaauguaaccaugcuguauaaguuuucuuuuccuuuuaauugcuaacauaguccuuguuuuugguguacuguucauuuaacgagugcccauugaaguacauuuaaguugggaucauaaugagcaaugcuuuaaugagcauuguaugagauuugaaaaaucuuaauuuuucuggcagaauauauguagaaauauguagaaaauguauauuuucuuuguguaguuuuagaucauguuauuuccauaguaaguuuuaaaaauguuuuuauuaguauuaauuauacauaguaauauuauaauaauacauuauaauauuuucauacaugugcaucauuuauuucaaccaugauuacccaguuaccuucuugaccccucucagcuccacuaaucguucuuuuccccauuaguuccacuuuaaugccucuguguguguguguguguguguguguguguguguguguguguguguguguguguguauguauguauguguguuagacuuaaugaguuucauuaggguugcuauagaagcauguauaauuuaccugacugguuaaaaaaaaacucuugcccuuuccuauaaaccauuaacaauguauaaauccuuagggagggagggaccccaugagucccuucccuuuccaugacaagcccaaucacauguacaucuuguuuaugguauuauagcugcuguaaguucaagagugcagcaaccuggaagcuagcacuccacaugcuucucugcuucuuccaucucuuauagaccuuccacccuugaaugcaguguuuccugagccuuggaaaggaugauauaguuguaacaauugcaguuggacauugaacaacuguuucuucucagcauuuugaccacugcaguaggaagcuucucugaccaaaaugacagacacccugugggcauaaacauaaguuauuuagaaggccacucuuguacuagugagcgcaucuggccggucauuguuguuguacacagggcaaauagcugacuaugacuugauaguucccccuagcagccugcauuacauuuucugcacuauaagggauagauagcacagaggaaggucccagccugagcacagcauaugauaucuucagcucaccaucuagaucugguaggcaacuaacagcaacaauuguuuuugcuguuuuagggacuuccaagaacauucuugaccagcaacucaaagggaaguagcucacacccuuagcacugggaggaccucaucuacccacacagaggaccacuauucuuuacaauaagcuuuuguaaaaacacugcuacacugucuuauagagugacuucuguauggugucacaugaccauuggaauuauguaaaugaucaagacuuucuacaucccccucaacauggcugcuuuucguguuagcuguucugagaaauguauggugauaguucauugcaguuuuguuuccuuaauagcucaggauacugaacaucuuuucauguuuuuauguccuauacuuauauucuucaguaaaauacauuuuuauuuguuuuggccaggcucuaauugaauuauuugcuuuuuuauuguugauuuauauaauuaaaaaaauguauucuagacaccaguccuuuguugaauaugauuuacaaguauuuucuccuagucuugucuucucauccucuucacaagguucguuuuuugggauuaaguccaacaaauuuuacuuaguucuguauuuggaaguuuuucuuaguuuuaaaacaugaaauguaauucauguaccacuacauuacucuacuaaaauauaauccaucaauauuaaguguauuuagaaugucauacaucuauugcuguuguguagcuccaggacuuuuuaucaucccagaaugaaacccuguuacucacucccaauagcagcuucucuccagaccuuggcaacuguguagcugcuuucuguuucuccaaguuugccuauucuguaauuucuucuauauaggggggacuuuuggccaugagagacaguuagagcccaaggaugguuugaagaaccagagcucagaaggcaauucugauguuaccuguaagguuccuuacagauacaguuauuauauacaguuaucuaaaauauuuugauuagucaucuaaacuuacagagauuuuuuuagauaauugcuguacauagcaugccugcacaugaggcuuuuauaauacccucauucauuuuuguuacauguuaaauccucauuuggguuugaauuguguaccaugauagaggauguugaacaauacaucauuuaaacaaccccucuuaauuuagugggcuauucaaauuuauagaccuucuguuugaguaauuuguucacucuuuuauuguuaggauuuuugcccaagaaucuccaaaaauacucuuuuuuuuuccuuacagaccaaaaagaguaaugauuaaauuccuaguuuuaucacuuugaaugcaguccugcuguguguauacuguguauacuugaggucuaguuucguuugcucagcaguguucuuguguguagcggugguuugcuccauuuuauuguuauguaguaguaagguguauuaguagaccacauuuuuagugaacucuaucuguuguuuucuuguggugcaggguugaacccagggcuuuggguauguuggcaagugaucuaccacagaccuuuaucuucaguucacaauuuuauauaccucaauguuuauuuguucuauagaauagauugguuuuagccauuaguuauuaugaauagggcuacugugugcauuuuggugugcuuuugaguggacuuauauccuugaauaucuuuaaucaugauaauuucaaucuuaagaaaauugucugcuaaauuuauuccucacccugucaaccauaucauauuuaaguuuucuucagauuuaagccauuaagccuaauauguauauauauguuggauuacaaacaucucuuuuuaauagaguuacauacuuuuaguuauaguugacagugggcauaguugucuuuagucaguuuauaugcuaugacuugggcauuucuccagugacaaagaguuauuuuuuccuauaaaaacucucauagaugauauuuacagauaccugaaugguaaugucauaaaggcacuuuuaguauuucuuuuauuauauuauuuguuaaaauuauggucauccaguauaauuuuuuaauugaaaugauauuccaguauuucauuugauuguauuuugagauguuuaagauauauauaauuuaauauauauuuaauaauauauuucccucuuccuccaaccauggaaaaagauaucaagcauuauuuauauuuacuuaauucagugugacucccuuuuucauuuuaaauguccuuuucuguauuuuaaauauaaaaaaauuuccuauuuuuccuuucuguccucaaaauuccacugugggugaucccguuuuuugcugauaacagcuuuaucagguauggcuccucagcauugugcugcacuucauggaugugcuguuggacuuccuaagggggaaccuuucaccuaacucccuuauguuuauuugguccguguuuauaagugucauaugaauucugacauuguuuuaagguuuagaaauaccuuugcaucuaaagaaguuugccaaaccuuuuugugucuguacuuuggaaugaaacuuagguugcuuucuuaaaaaaaaaaaaaaaaaauuacuauugugcgucucuggcuuucugcauuauugaucugugcauaaaucuguguuuuucuuguuuucauguguuuguauacacaucuguuauuuuuaauguguuuguguuaaaaguggaagcauauuuacuccucagagcauuccuaauccugaucugucuccuaaacagacuguuaucaagcuaucucugugaaauaaauuaaucugagauucucacuagaauggcacaaaagguuuuaucaaauacauuuagugccacaucauuuagagauucuuuaggcaugucggcguguaaagauucugauuuuugcaguaaauaaaugguccaucuuuaucucagcaccuuuuguaaaugcuugaguguaaaacacuguaauauggaggguugugcugggcuugcugaucuggaaaaugcagcaaaaacuaugaauaagguuuucuuuauguaagguuuucuuuauguaaaguuuucuuuauagcuuuuuuaaaaaucaaacagaaucgacuuccucugacuagcuuuucaaaaguuaaagcauuuggaaggauuuacaaaagaacagugcugauguucuuuuccgugagaaauuacuuugcaguguuuuugagucuuuaaagagaaucugcaugacuauaaagauuauucuuuuuuguuggaaaggauuguuuuguuuuguuuaugcucuugucauugauugcuaaacuauuucucuucuacaugaauuuauguuuauauuaaaaaguguguuugcuguuucagauagcgugacacaggaaaggaggccucccaaacuugccuuuaugucaagagguguaggugacaaagguucaucuagucauaauaaaccaaagguuacagguauggagcuauucuugauaguuuacaugauaucugauuuuccaaauguuaaauaaucuauauaguauuuguguguguguuguguguguguaacucaagcauuuuauguaaacuaaaguuuuauguacaugauugugagggugcaguaaagaaacuaaauggccaccccaugaauugucaggggagguuuuugcagcugaaagaguccagagcagaaagaaaaggaagcagacuggacaugaucagggccauuugcaagagaagcaagaauugugggggcaagggaaacucuugccuuuauauagggaacaaauggguggcugggaguagggaagcccaugagcuggagagaguuaggguagaggaggaggugagaggagcaugggcugugaaguguuucacagauacuuaggaugccgagggagccuggaggccagcaugcacucuggugugcuaauagacacuacagagaaccauuugucccuucuaccagugauuauggaaauggcuccuuugguagagaggaaccagcuucagaaguuccugaggaaugcuggcuuuuaucuaacuagcagaaauccuucuauagccuaggacagccuuuuggaguuugaggaauuauugucuccuuuugacagaacacuggggacauggagacaaggagauuccugagauuucuuagcuaucacuaucagcugccugccuauuuuaauuggcaacucucaggucaguggaggcauucuuuaaagaaaacaaaacacaauaagcucuugaggacuagcacacacaugcacacauaccuuuucauacacauaccuacaugucauacacacagaaaacacuccauaagaucaccuacucucaaacauaaaaaagcuauagguuucuuauuuggggaugagggccuugguaaguuuccuauguugaauuuaagcuucuggacucuggugauuccucuauccuagcuuuccaaguagcuggcuacagguguacugcaugaaguaugaguuaaacugugaagugcagagcuuuuuacuuuaaauugaaaagcaguuggcuucaguauagguugaggaauucgcacugaucaccaaugaggugugucuuuguauaucuaagacugaggcagggaagugucuuguaccuguuuguaaugcaggucuacuuucuucugauuuaaccaucacccuauaaaccagugguccucaaacuuccuaauacuaauacugugacacuuuaauacaguuccuuguguuauggagacccuaaaccauaaaauugcuuuguugcuacuuucaaacuguaauuuugcuauuguuaagaauuguaaugaauaucuaguauguaaucucccaaguugaaugaccacagguugagaaccauugcuauaaaccuaugagauauguggaagcuaauagaaaaagaguugugugaucucuacauguaacagaggaagauucugguagagaaauaaaauuuuacuuagcaguuuagaauuuaacuugcauuaaauagaguuuuuaagaccacauaauuaaucucuaguaugauuuguccuauaaucuaaagugugagaaauuauggugcuucauuuuuuucagacaugagaaaauuacgaaauuuuauuuauucauuuauauguuuauuacuaugaauggcaaguuuacuuuuuuucuuuaaaauugaaacucugggaauucagaauuaacauccuugccugugagcuucuuauccacagcagacaauguuguggcccuguguugcacauuguucugcuguucuuugucucaguggcccuuucugagccagcugcucauccagcuuuacacuaucuucuuacccauagucucaugugugaagaucaagcccucaaggauggcauagugcacugucaucagguugcagccucugggugccuucacuguguuuuuguacaguuuuuccuuguuggcuugggcagaguccucccccagcaaugcagacuacuugcuucccacugaaccuuuucuccauuucacaaaguagcuggacuuggauuuucuggaaggauuucagcugaggaacugguaaaaaaaaaaauuaauauagcuuuuggaccuccaacuucaauuuccuuggucauguugaguuccugcugcuaugucuugagaucugaguucaucuccagcuggagcagugccugagagauggaagauucaaacucacugggcuucuaccauugggcuucacagucuuggcauucaagcuuaacauggccuccaccugaggggaggaaggugccaccagucacucgggucacgggcaucacugcuaggaccaucuacuggcugccccagagguccuccaaaaguccuuccccugaaacuauaaaaaacaagaaauuuuacugguaaaauucuaagauguuuaaauaguaaauguaaaaaaaaauuaaguuauuauuuuuuguaauguuuguagucaaagucaacagagccuuauauguggugaggaaaguccuucaucacucaggcauagcuccagacacugaaguuauguuccuuuuguuuuguuuuauuuuguuuugauuuucuuuugggggaaaggugauccugggaucaagcuuagcaccuuacacaaacuaaaccaggacucuacuaccacacaccucgccuaaaccugaauuguuuuguuuuguuuuguuuuuuucaagacaggguuucucuguauagcccuggcuccuggaacucacucuguagaccaggcuggacuugaacucagaaauccgccugccucugccuccccagugcugggauuaaaggugugugccaccaugcccagcuaaauuuuuuuauucuuaauuucaguuugauuauagcauuugaagauuacaaagggaaauuauaaucacaugggaugcacucugagcaguacaucauuaggcaguuguguuuuucugugacucccagagaacgcacuuacacacaccuuuguaagagaacugugugcauauguaggcucuguaacacugcugcacauuuguucuuuuguagacugaaaugucuuuauaucacagcaguucucaccccauggguucugaucccuuugggggucaaauguccuuucacaggaauugccuuagaccauuagagagcacagacauuagauucauaacagcgaaaguacaguuauaaaguaggaacaaaacuaacuuuaugguuggggggucccgguauuaggaagauugagagucacuguuauaugguaugacuguaacagguuaaaugugugagucaguaguuugaucaaaugaaaugagaggagguaauuuuaacauugagaaauagacuacauggaaugauuuuuuuuuucuugacaugagacuucucuguguaguucuggggguccuggaacuuggucuguagaccaggcuggucuugaacucagaucccucuuccucucucucccuaaugcuaauuaaaggugugugccacuacugccuauggaaugauuagaguuuuaauauaaaaguaagcaggcuuuagcuuguucccauuugcuuguauugaccaauuaccaaacuucuaaagcugaagacaacaauaaaguacauuguauaugucuguuaucuguacagcagcugguacacaauauucauauuauaaaaaucucuuuuacaccauuuugaccuuuuuuuaaaaaggaauuuuucuuuuuccacaggaucuaccucagacccuggaaguagaaacagaucugaauuauuuuauaccuuaaaugggucaucuguugacucacaacaauccaaguccaaaaauccaugguacauugaugaagguaaucuauaacuuuaguacucuuuauaaugauccucucuguuuaguguguaagggaaaauggccuuuucaucaauauuuguaauuuuuggaaccagugaguagaccauugcugacaugcuaauauugcuaaacugaaauauuaaauguaguuugaacugcucugcuuugaggguuacaauccauuugaaauguguuaguagucuguucuuaucucuuaacucaugugcuuaggaucaaaguuuucuagaaaugaaaugacucauuuaacgacuguccuauuuuacuuccuuuaaaacauaccaccuucccuucuuaagacaucauuuucuuuauuuccuucaucuguucagcaaguaguuauugagacagucacagguuacuaugacaaagauauagcccuaacccuguuugaaguuguaguccauuuauuauuauagaaauccaucagacacaaauaauuggaauugcaauguugaugggagcugugacaggacuuggugcugugaggcugcuagagaggucacagggcaacccauguuuaccaggugucucagugcugugauaaaacacuuaccaaaggcaacagggggaggaaaaggguuaucucaucuuauguuuucagggaauaguucauuacugagggaagucagggcaggaacucaaagcaggaaccuagagguaggaacugaagcagaggccaugaaagaacgcuacuuacuagcuuguuucuaaugacuuguucugucugcuuucuuauacaacucaggacuauguguucuaggguggcacugaccacaguggacugggccuuccaaaauucaccauucaucauuaaucaagaaaagacccuauagacuuaaccuacaggcaaucuaauggagucauuuguucaacagagguuccucuucccgaauaacacugcuuguaucaagcugacagaaaacugacuugggcacuagagaaaugauucagagggaguaauaucacaaguuaggucauggaaauaguauauauaaagcccucugagaagaauagagccuagaagacuagaaagauccagaggagaaaagggaacagucaaugggaccaggucacacauaaucuccuagcuauacuucucugaaagaaaguggagaaacacugaaaaaauuuuaguaaagagugguacauccaaguuugucuuuugcaaacagcauugugguacaggacagacaguagacucaaagugaauguaguaaguagacaccauugaagguuuuuacaguaacugauuauaauuucugagauuagauuugggggagagauagaaguaauuugauauaaagggauauugagaguuggauugaagggagcuauagcuagauugaauauaagaguugaagaagaaaggcauaucagugguaaccccuaguuuucuggaucauguacuuagauggcaggaaguagguggugaauuugauuuugaauaugauucauuugagggguccuuuaagcuucccagagguaaauucuuaaacaggcuugguuggaugucuagguuuaaagcuuggacgagagauaagagcuagagaaauacauuuguaaguugucuucacacagggggauuaaaguucuuugauuaacagugaggagaaggggcagugauugaaauguugaagaacuuaauagcugggauggaaggaagaugagucuuaauggagucuaaggaaaagugaccguggagcuuuggguaaaaccaagagcccauuggucaggagugcguugaguaagugaauucucagagagagcacaugaagugagacccacauaaagcucauuugaugcugacucuggaagucauugauaaccccagucaguucugucaugggaagaagucaucugaggcucaacugggaugugcuagcauguagaguguaguaacugacauagggcaagaugcuuggguuucuuugugagugugugugugugcacacacgugugcguacacaugcauguguaugugugucucugucuguuuuucugucuaugucugccccacuuucuacccuuuugugcauaugauuaauugucuggacuaguuccuccaguuuaauggucuggcugacugcuauuuaccucuuaaacugaagcuuuuguuuguucagaagccuuccuuguucuugccuacucucuuagguuagguuaaaugucccguggauacucgccugucuuuucuguaaguuccuagugcuucuguagugcuuuauauucaguagguuugguaaacuaaaugaaaaugugaauuuauaguguuguaagucucuaugaugacuacauuaugcaucacaugguuucaguuauaagcuaaaacacacaguaaaaaucugcaauuguauaacauagguuacauauguacuuguacagaaagugacuugaguggguauucuccacaucugauuccugcacuggguggaguuugugaguguaggcagcaugaccugccucccucaagaacuccccuuugccuacaaggcaggacgugugucuaaaugguguuccuuuaagagggccugucuccugguggguuacuuuuguuaggacuuggucuguacuacaaauucuuacuuuucuaacuucuggagaguaccugguaggaacuuuuggccucuacaaauacuacuggucucuggaugugcauggagaccaauuaggaugacugaggaagccugaucaugcccugucauucccagcaggucacaaaugcucuccaaggugcugauugauuucuaagaaaaaggagcuaauggaaauagaggcuuucauaaucuagacaaugcugauucuuccaauuuaugcuacauaaaucuuuucaucuuuucauuaauauacauuuuguacuguacuaguaucuuauuuacuuuacuguucuguuacuaugaaagagacacuaggaccaaggcaauucuuauaaaauauuuaauugggggcuugcuuaugguuuuagaggguuacuccaugaucgucauggugggaaacagucauggcacuggaacaguagcugagagcuuuacucuugaucuguaggcagcagagaaaaagagacugggccuggccuggccuuuugaaaccucaaaagcccaccccuagugauacaucuccuccaguaaggccauaccucuuaaucucucuaauccuucucaaacccaggacucuguggugacuaagcauuuaagcauaugaaccugugggggccauucucauucaaacucccacagcugguauauucauaacuucuugagcuacuugaaccugauguaguguucaauagcuuuaugaaauaauauuggucguaaaaaacuuagaugaaaacuggauauggugauacauaucuauaauuuuagaauuugggagauagaggcaggaggauccggaguucaaggauagcuuugacuacacacaaacuuggaggauagccuggguuagagguacccugcuucaaaaauuaaaaaaauuuaaaaauuacaucauuuucuuaucuuccaguucuuucauucuuuccauucccucuuccgcaguauuccucgagcuuuagagaaguuguauaaguauccuguuuaaggcaaacacucaauaauuguacauucugagucucuauauucaccccugcuuacucuauaaagagucucuuaauuaaggauaagaauaguguguaagacccauagguuuuaaaugacaucuuguguugguuuguguuuucacuuaaccuguuuauuagugugggcaaagaucuucucacugguuuauuaguucuucugugaauuaccuuuucagaucuuucauuuauuuuuuuuucuugauccuauugauauucuuaccuucugagaaaaguagauuugcaaguauucucuccuuuagcucaaggccacucacaguuacaaccucuuuucaugaacaaguucuuaguuuuaaccagaugauaguugucaucuccccuuacaggcuuauaugcuuauauguaauugcucucuuccuugaagucauaaagagcguucuucuauguuguauucuagacauguguaguuugccagacacauuguuuuauacgcuaccuggaacugauguuugcagaguaugaauaagauccugguuuauugguuuuuuucauuguuuuguuuuuguuuugucaugccaggaaccgaacuuagagccuuacacaugccuggauugcaagcuaccaugugggugcuaggaaccaaaaccagguucucugaaagagccauaagcauucuuaaaugcugagccaucuuucuagccccagauguuuaaacauauguauuauugauuagcucaacaacauuaaaauggucauucuuuccuucugagaagcagugugugccugucagcuacauuagucacuuaaggaagcaacuuuuggguauuguuuuuaaucuuuaaguuuguuuucuugaguuacuucuuugggguucacuuuggcuuaagcuucuuuauucuuuuuuuucucuuucauuaauguuuuguuuucuguuuguuuugucuuucugaaaaaccaagucuauaugaguuaauuaauacuuagcuuuuuuguuuuuucuaaacuaagcugucaauaauuuuuaauaaacacuauauaucuguguuucacauauauuuuuuauucuuugguuucuuuuuccucucucucuuuuuuuaacuuuauuagaauacugaguucauuucacacguguauuuuuaucuuccuaccauuucuacaucugacuaccacuaugacuauguccuauccuacuuaaaccaaguaaaggguggaguucuauucuugaaaacuaaacaggcacguuagacaacacauucuuggcaauugaaccuggacagcauuuaucaaacacaguaggcaaaguucucacuuuacauuguaaaaagaacagccagauaucaacuguuaaagaaaugaaguaagacugacuauuucaaaugguuuaaaccacuuucuuaaagagacauccaccacugccagagaccucgagucccccaggcagucuuccagaagcaguucuuccccaugauuaaugagcuuggcuuccauuuugggaagaaaccaccuuuuucauacuugcugcaauugugccuuaauguuuucuauggaacgagguucuuuugguguuuuaggaucuuuuucccuauuguuugaagaaccugacccuuugaucuuaguguuuaugguuuuacgucccuuccauuuuuguuugauuuuugugcuuuuuuugcugggggauauuguacagauuuauucacuaguauuuuucuucaguuucuugcucaucaaaaucaucauugucaucauccuaagcaucuuuaucaaguuuugcuuuuuuucuguggaaccuuguuacaucucuagggucagauugcuuucuagacauauuuaagaguuuuauauccuccucauccucauguuugucuucugacuguauauuccucuacagcuacuaggugcuguucacuauugugcacaggcucugauacuucagcauuaagaccacaaguggugaaauuucaaagucccuaauggaaacuauugguuguacagacauuuucacaauugucaguguuacugaaacugccuucauguuaguucauugcuucugcccuuacaaaggcuuauaauucagcuuuugccccuguuucuaaacugaccauucuuaauaauaacugguacuuauuuucaucauuauccacuuuaaaaugaugaucuuugucagccuuuaguucacaacugaaagguaguucugaggccuaagggggcucauguccauguccaucgagucuucaauagauggaagacagaagaaacugugacacacaggacagaaucacagcagggcuuuuauuuuauuuuaucuuuaaaacuuaacuuauuuuuucuuugauccaugaguuauuuagaguugcuacuuaauuuuucuuuauauuuguucacacagauuucuagcuuagagaguauuaaccuaugugguacugaccagacauagaugaacaacuggugccaggugacugagacagaaaaguuuggagaugaagaagagaaacaaggacagacguuauuuagucaguagguuuguaguacugugagcauacuugcaaagggaucaugugcucaguuagacuagaucuuuuuauuguuuuuagagauacaagcauauuuaauguucuugaacaacuuuuucuaauuaagaacaauuuuucauaguugcagaagacccugcaaagucacuuacagagaugucuucggacuucggacauucaucuccuccaccgcagccuccuuccaugaacuccuugucuagcgagaacagauuccacuccuuacccuucagccugacaaagaugcccaauacuaauggcagcauggcucauaguccacucucucugucagugcagucugugaugggggagcugaacagcacaccuguccaggagaguccacccuugcccaucucuucugggaaugcacacgggcuagaggugggcucacuggcugaaguaaaagagaaccccccguucuaugggguuauccguuggauuggccagccaccagggcucagugacgugcuagcuggacuggaacugguaauuuaauuuggccaaaaaucuacaacucuuuuccugcaugagguuuugucuagauuucccccuauuagauaauuuccuagaaaaucaucauguguguguguguguguaugugugcgugcauguauguguauuuccaguaauagagaaaauauucuuacuguauggccuagcuucauucacccuuugccauuccuuaaacuucuggcucauuuuuuccucguguuucuuugucuguaaucaaggaguagaggaauuuuuaggcuagacuauuuagcuuccuuauauuaaguauaaugcaccuaacaaagcaauuaucaguuuuucuucuuacuccucagccuccucugauaugauuggcuuuacaauuaaucaucauguucagaggucuuugguagaagagguuuucccuuuggauauuagaaaagaauauagugugauauuucauaauuaugaaugaggaacuugaauaaacuuagcuuuuaccuuaaugugcuuuuugauuaauuuuuuucauuuguuaucuugauggugaggaacuagauaaauuaaucuaccuucccccgccccuugaucuuaauacuuuugaaauggcucagggcaaaucaguaagccaaggaaaugcaugaaguacuuccuggugggcuaaagaauugucuucuuaaaccacuaccucgucagcuagucagucccuuuucuugaugcucuucuauucagcacagauuugaugaaggaauucagacaaaguguuaaguucuuccccacuccuucugcaaggugcaguguaacacauaccgaagaagacuuucuuuuucaggaagaugaaugcgcaggcuguacagauggaacuuucaggggcacgcgguauuucacgugugcccugaagaaggcacuguuugugaaacugaagagcugcagaccggacucuagguuugcauccuugcagccuguuuccaaucaaauugaaagguguaacucuuuagguacuuggauacuuuuaauuuauuuacccagcuggaaugacugucucaugcugcuucucaguaucucaggauaacaguguuuaaaugauuuucuugccaaugcucaucaaguuucuaaguuguuaaagauuguaacauggugcauaagaaaguuguccuaagaggagauacauuaaaaaagugucuuuacagucaggaaaaguguuuaggaucuaaagaaggaaaagcaaugguuugguuuuuuucuucucuuguagugauuauagacauuuuauuuuuggcaauauggguaguagaaaugaaaauguggucucuuuaguauuaaugucccccucaccaucuuauuuaagcaccucauucaggguauucuaugaagaaaucugauacagucugaggacauaaucaguuugacagguggcggauggcucuugucaccacuugucuucagcuuucugacgcuggccuuucucaguucuggacaauagugagagucaagcagggguaaauagggaaaccaucuugaugaaaaacauuuuucuaaauguugaagaguaauuuugaaauuuuugauuucuuuucacacuugaaaauggaacauuuuggacaaguaacaaaguauuuauuugacaggugcuuaauugacuuaauuuucuaaguucuaucugaaggaagcaauguugaaagugaauaauagcauuuuuauaagcccagauaacuaacaguuaacuaaagguugaaaaaauuugcacaggaugucaaaauguauuuuaaaugaugacauauuuacauggagugcauaugaauauauacuaucaugguuuaaaauaauuauuuucauuuuuuaucuuuucagcauuugggggcuauuuaagugaaguaguagaagaaaauacuccaccuaaaauggaaaaggaagguuuagagauaaugauuggaaagaagaaaggcauccagggccauuacaauucuuguuacuuagacucaacuuuauucugguaaguacacauuuucugcaguaacuguagauagugccuuauugggacguguguguguguguguguguguguguguguguguguaucugaaaggaggugccuuugaguagagaaacugacugggaguuaagaaaggucauaagauuugguccuugacaguuaacaaauuuuauaucuuauuuauauagauuuuaaaagcuaguucgugaacagaugugaugaaggcaucugcuuccaauguaguagacugcacuugaaugaaccaaguaacuggcaguaaacuguuggcauuguauguguauacuuuaguauaucaaugugaucauggaaauucuuuauauuaaaaauuauuucccaugggaucacuguugccauccuuugugucgacuuuccuaaaguggagugaauaauacagggaacauuaaacucugaagauugaaccaugaaucuguggccuuaaggauugugcacugcaguuaaacuaagaggcucugccagcucugcucuguaaacugugcacaagagcgaggugguuagcagggaugguaggauuucaaaagcagagaacagaauaaaggcugggggucuuuuuguugguguaauacuuuugauuaaacaaaccuuguaguauugcuauaauauucuuuagauuuccugauaaaaaucuguuuaagccaaauguuauauucuuugauaccaguaaguuucugcugcuagucacucacaaguuauuuuauagaagcacaugucucaggagagcaagauguauuuguccuaacuaguggccuccaacuuuuuccccauguugucugugugugagagagagggggaaugagaggagggggagggagagagggaggaagugaagaaggggggagggaagaaggaaggacagagagggcgggcugauuuccaggcucuucuugacuauguaagcaagcuuuuuucaaaacauucucuugcaugucuuuacccuguguuuguggucuggaacuucagggucugugggcacacuaauggcugaacacaggccucugcugucuugacacaugaauucuuaugcauugcucuccuaugcauuguuccucuuucucuucugacuccuuuaagaauuuucucaaauaucaauauauuuuuagcauaaggaaaauauucuuuuuguuuuguagcuuauuugcuuuuaguucugcccuggacacuguguuacuuagacccaaagagaagaaugauauagaguauuacagugagacucaggagcuacugaggacagagauagucaauccucugagaauguaaguacaagauguguuugucuucaguuugcauucuguuugcuauuuucuuguguaguaauucuugcugugugcucauauaguaaaaaaagaugaauagaaauuucaugaaguauugacuuuuuaaaaccuuuagucuucugcuucuguuuauuucaguguauguaauaacuauagucuaugaaaugaugugaaucauuugguaucauguauuacaaguuaguaauaacacuguacuaaaagcagaugagguguauuauaguaauaugguguuuguuuaaaagaauauuuuuaugucuuccucuacuucuuuacuaaggugaguuguaaaugugcagaagaugggaagacuuugguaugugauguuggugauguguguuaacaucacaagauguuuaagugaugaagaguuaagucauacaaugaucaugaaacuaauaggucaggaagacagagaacaaacuacgcaauuuaaaggccaguuaugaucaauuugaauuuuguuauauacuuuucuuaacaauaaaaauaaagauuaauuuaauauauuuaaaaauaacaaaguauguaaauuaaaggaauauucuagauguccuacugugucacauaacuaagaaaguaaaagaauaaauuucucuauuuagauacuuguuuucccuaaauucuguaaucauuuuacccuuuaaaauaaauaugugcuuugauuuucacauuaauuauuuugucuuaugcaaauuuuaaccacucagauuuuucuuucacuauauaaaugguacuaccagcagaggucaaaucaauaacaagguguauuauuauagccuuccuucuuuuuaaaacacuguaagccuuucuguaauaggcuuaauauucuucgcaucauauuuguucaagcaguccggaauuguaguuagcauacuuugucacucacucuaugccaggagauugucagauggccugugaggucaggaugugucuugccgaacauggugguauaucauacaccuguaaucgcagcacuuacuggcucaagagacuaaggcaagaucaguugagcucagaaauuugagauauauuucuggugucugcaaacuuaacaccuguuguuuggacacagauuuugcuuuauugcaaguucccaaaagcagauuuuuuuguuggugguuuuugcuuguuuguuuguuugcuuaaucuuuuccuuuuguauucccaguggcaaacauuuuuacgugagucauagguauuuauuaacaagugagugacuaaaguguuagugacucuaaaaagcaaguacacgauuagugcucagcuggcucugacuugcuccauuaaguccauagucuccauaaucaaacaaagagaauuucuuaauuauguugacugguuugauugcagacuuuagauuuuuaguauaucaucaauuccccuuuuucauaucucuuauccuauauauuaaagugacuuuucuaaaauguggacauucuauuuuauaaaauaaguauuuuaauaauaagcaaauguuauugauuaaaaaccauucuccaagacuuuugaacuauuagaguuguauagugcguguuauuuuggaggugccacucuggaucucagucuuucacuuucuaaagcuuagcaagaagccugcaguugugcuuuaaaaacagcugccuagucuacugaugcgcuucccauguuaggauuguaugaaaguauuugauuacuaagauaugucauauaauucacuaugccagugucuguuaauucauuuuuaucgauauagauauggauaugugugugccacaaagauuaugaaacugaggaaaauacuugaaaaaguugaggcugcaucagguuuuaccucugaagaaaaaggugacuuuucuaauuuauuaauuuauguuacuaaacaauauguuaaauuauauccugaaguaugucuguuuuacuuaaaggguuaaucuuaaaauuauuugagagggcuauggauauauaucucagugguagaguaugcaagagacccuggguuugauuucuagcacugcaaaaauaaaugaaaaaaauuuuuuuucuaugugacaugcaaauuucuccugguauuggaagugauucuucucuuccaaagugacugugauguguaguaauuaagaaaguggcugacccuacaguagaugacuaacgucccugccgccagcagugguauuuggaguugccucuccuccuguggugagggcuguccugagccacucaacucccccaccugcgcuucuaguugaacagagcuguggaagagguggacagcguuucugucuacucacaacuggacaauuucucagauccaacuucugucuuugaguauguuaacaggguuaauauagucagcugugacauuuauacacgugauaauuacuuaaauagaaggaaaaauagggcuuauuuuaggugguagucuacugaaauccuucaaaagacauaaaaauguucucacuaugugugaaugaauauauucugcuaaaugggacaacaugacaacaaaauggaaaaguaacauuuuauuauaaccuguaaauaaaaguuuuucccuuacuaggaaaguuugaaaauacuaaacuuuuaauuaaaauaauuuugaaggaaugaauuaaguucaguguagaaauguuugucauaaagaauauaaugccuuuuaaauuuugccugugauuuauuugaauuuuuaauuuucuucuagauccugaagaauucuuaaauauccuguuucaugauauuuuaaggguugaaccauuguuaaaaauaagguaacuuucaagcugucuagaagcacugggcaguagaucuucuuuuccacugccaucccucaauaggaaugaaaucccugcugcuccucagcguuaucugaguguaguuaagcauuguaaggacagauguggguucccuuagcugccacccuuucccugggcuacacuugcagagcacaaggugaaccugcccuuugaauuagcccgagugaagaugugcccacaacuuauuuacuuaugcaauugaauaugaauauuuuuggaagcucaguuaauaagcuuuuaaagagaaucuuauucuaauugaauuaaagaagaaagaaagaaagaaagaaagaaagaacgaaagaaaggaagaaagaaaaaaaccaccugagaacauuguaguuuuuuuguuuuuuggguuuuuuuuuuuuuuguuuuuguuuuuugguuuuuuuacuuccccuuacuuacagagcucaguuagcuuuaaaauagcucucuaguucucuguuuaguaacuugaucucuucauucucuccauguugaaaauauuaccugaguuuacugugguauaguucuuaaugagauauucuaaaugucagcacuuuccaggucauuugagaggucgcagugguagaccccucucgauuucaaucuugguuucucuguugaaaauguuaggaauauuuguucugucuacuuccuuaagaucccaacacugccgaguuaguucucuuaccucugucucagugauguacuuugaaccaaugcuaaacugguuugugggaacaaggaaagugcacagugaaaguuugguacuucguaggagcuucuaacaaaugacauugaguguacauacuuaacagcaagucagagcugccauagcuuucuaugugccuagaaaaucaaagagaauuaacaaaagaguuuauaauccggccaaaaauuaaaaaguaaucauggaaaugucaguaacauuuuuuuauuccuucaagcauauagaaaauugaaaauuuuauguucuaggaaagaaaaauaggcagcaaucaaguuuuuaaaaauagaguuaaaaaaagauuuacacuaagcuaaaagguagauuugguuagugagaaagauuaaauaauuaaacauguuagguuuuuuuuuuuucaaaauaacuugcauuuugacagaauccaacuuauuguccuuucuuuggaacucaagaaaaugauuuuagaguuuucuacaaaaugaaguggguaaaaaugccgucagguuuuuuuuuuuuaaacuuucuauugauucuuugugaguuucacaucauacaccccaagccugcucauuuccccagccccuugcaaccucccccugccaaaauaaacaaaaaagaccauacgaacaaacaaagcaaaacaaagcguagaaaccaucucaucguggaagcuguugucugcgacagugugacccacaguguaccccucuguccucacaucuucacuugcaaauguucauugaagugagucacuggucugguucaugaacucuaggcuuccgugacaccaucaauauuggagcucauugggacuccuccugguugucccguuguugcuuuguuucccagagauccggcaacucuggaucaucaggacuggcccuuucaugugucccauuugcagaugacauagauuuugaggugggccaacucagagcccuggaucuagaccugggugguagcugagcucgucaacacacugccucucacuuauccacaccacugggaugagcucuccagcacugcccaggccaggccacccagugcagccuuuagcaggagggagggucagcucuccugcuccugcccucggggccugcucagccacacccacaccuccagagucagcuucuccuugaugcccagucagggggcugggcccacucugccaagugcugcagccugugaagcuuucacauccuaagggcuggcccaccagagcuuucaccaucaggguuagcucucuuccucucaugcccuuguggucagcucuccuacuacuguagauggugaggaguggaggaggccaucaccccugcacccucacuacucuacaauagaugagugguagggccagcuuuccuacacucuuggccucagggcuggcucacccaugcugcuucuccccaacccccaccacugaccagggucagcacuacugugcugaccaggggaggcauaggggccacacuccuaagugcugcaccagugaguggcagggccagcucgcuugcucucaugacuccagccagcucuccugcuaccauaggcguaggauucuuuuauuaaaaaaaaaaaggauuauaauuugugaaggaaaaacaauagacauuaaaauaguauauaauuggaaguauuuauuaauaaacuugaauaggaagguuagugguauugaaagaaaagaaauaugacauuggacaucugguagguaguuugggaagaaaacaucagguuuuuuuuuuuuuucaucuuuuaaguuuuguauuuguuuuacccugaaauguggccuuagaguaucuccauggcuagccuguaacaugcuguguagaccaggcuggucucaucugccugugcuuccugagugcuuauauuaaaugcauaugccaccauacugagacuccuuuaaaagguuuuucuagaacaaacauagauuuauuaaggaaaagcaagaaaauaauccugagaaagaagggacuucaagagaggaauaaccuguuugucuuuuagugaaauaaacugagaaugcuuaaaauuguuuuaaaauuuuuccccuuaaucuagccuuaucuaagagacaucagacuucccagguuuaauagaaguugaauacugcaguaauucucagaaguaagacagugucagauacuguucagagugugaaggccuuucuggaauugggaaaggcaccugagcaauucuuuauccucccccucacacuuccaagcaaccuguucauaauuccaccaacuccuuccuuaaagacuguaagauaguauuuugaguucuucuuauucucccaagugccauucuugucuuuauaagggaggccagcuaauagggggcugaauacugucuuaguuagggugucacugcuuugaaaggacaccaugaccagggcaacucucauaaggacaacauucaguuggggcuggcuuacaaugucagagguucagucaucauggugggagcauggcagcauccaggcagauggugcuggagaggaagcugagaguucuacaucuugauccguaggcaggcagccaggaggaggcucucuucuacaccuaauggaacuuaggcacuaggagcucucaaacccaacuacacagugguacauuccuccaacaaggccacaccuauucauuuaaaaauaauuuuaauuuuauuuuuaaauuauaugugugacugcaguguccagaggccagaagaagauguagggucaucugaagcaggaguuacaaacucccucuuguggguuuugggaacugagcucugggccucugaaagagcagugugcugcccuaacugcuccgacauuucuugccacuuuugguugugagccuuagauuuuuuuguuuuugauuuuuuuuuuuuuuuggucuuuuaaaggaugaacucuuucuccagcccaaacauacaauuuuaaagcuauuacuuuuuacuucucaucccuguaggcuuuuggccaucuuuaaugcaggauacauucauucuaacuucagaagucuucauaaucuuuaauaguuccaacacuguucaaauauuguucaaguguauggucuuuuuaacugugagccccugaaaaaaaaugaauaaacaaguuuccuaccucagcuuauagugaugcaggggaggcuucucauucccaaaagcaggaguugggggacagagcaagaaaaggucugacuaaagccagaagacaccaguacuauggccacuaaggcagggccauccaagcuccuuguagcaccagugaugacaucaugagccacgugcuccccauggagcugcaggaucuggguauucucagaugcgugaguacaggacuucaggacccaccuacuguggucugcaccacaaaggcaggcccaaaccacugcaauccaugaguuuuuauauuaauauuuguaaaauguagauguccauuuuuuaaaaguuaccaaauugauaucccugugcucuuggcuugucauaguggagaauguacaacccaacuagcaugguuugguacaauuucacagcuuuguuaugauucuguagguucuuucagacuucuaaaacucaagccauaaaguuacuuaauuuuuuuaucaguuucuaaaaauuucauaaaauuucauauuguauguuuaguaugcuuccccuauaccuccaucccuucccgucccuuuuugugucuucuuccugauaguccguuuguuccugagauaacuucauaauaaauuuguucaugucauauacaaauaaaugcuuuguacaaaucuauguaaaaucuaggaaccauaaaugagagaaaacauacaauguuucucucuauaguacugcucuaguuuguuuaauaugauuauuuccaguugcauucaauuuucuaugacugauauauuuuguucuuuaugguugagaagagcuccaguguguauuucuagcccagacacucuuguuuaaaaaaaaaaaagauaaauaguacugaaagauuaaaaauaaaaccucuuaguaguguuaguuuuaaggauuacuacuaagauuuuaagggaugggagauguuacaguguucauugugaugggaauuuguagacuuuuaugugguauuuaucaggucagugggugaccaucuaaagacuugguagcuacaaggcuagaggacaguugucagggucccugggcuuuacaccuugugcugcuuagcuugcuagaaaauuguccuucuguaccucuuagggccuuuauuuuaaggaguaaaaagaaguugaucuagaaaguauaagagucugucauugagccauuuaagcauuugcuuuaaucauuaaaagcagauuacugcuuucuagauuuggagagagaaaucgaacugauuauuguucacauaguguuucuugacugggauauuagucuacauuuuucuugugaucacagagagaacuugugaauaauuuaugaauaaggcagaaggaauaauuuaugaggucuucugcauaagugcauuuaauuaucucauccaaaucauugucuuuuaccuggcauuggaugaugcagagcugcacaucuguaucaugguauuauauucucagguccugccagguggcuugauauugugacucagucauuuagcuuauguggauagcuuaugugcauuucuuuuugauacucuuagaucagcaggucaaaaaguucaagacuguaacuucuaucaaauuuuuauggaaaaaaaugagaaaguuggaguacccacaauucagcaguuauuagaauggucuuuuaucaacagcaaccugaaauuugcagagguuagugauucugacuguuuucuugguuuuuuauuucuuagcaguggucagaagggggauguuaaacucagggcuuguacauacuacccugagugcugcccugcucaaccacacccagcucucacucacccuguuaagaaaacccacacaaaagauuguguuccaacuuuguucuuuuuuaagaaagcucuuuagcuuaaguugaaauguuuuggauuuaggugcaaaauggggaggaaaucuaguguuuaaccugaagaccuuuaaaggugcuuaauuccaaagauaugcauauacauauacauguuuauguuuuuaguugucauuuuacccaagcauauuaucuaaacauuuagaagguaaugaaugcuauuuuucucccuuuguuaaagauaaaaugccagugaaaucuucuguguggguuuguuaaugaauguaauagaagacuuucuuuuaccuggauggaugguuuccguagugcaugccguggucuguugcuggaacgcucgucucacuuacucugcugauguauagguagcaucuucugugaugaugucagacaggagagucaggagguccuguagcucacugcugcucuguguccacacugcacauucacaugugggccaacagcguagugcugaaacuacugcugggagugacagcugugacuacuucaguuucagagggaaacuuguuuuugcaguuuuuuccccuuagugcaggagacaagacucaaagcugugggcaugcuacuauucuaagcugaggaggccccagcccuguaggacugugauuucuaaaacgauguaucuguuguuguuguuguuaucaauaacacuauuauuuuuauuauuuguaggcaccaucaugcuugauuauccagaugccucgguuuggaaaagacuuuaaacuauuuaaaaaaauuuuuccuucccuggaauuaaauauaacagauuuacuugaagacaguaaguuacaguccuuaguuuguuuguuuuagaaauagucacauugguuguggauauaguacuuugacaugcagugcaguaccugaagagcuuggacauauuaagccaauaauuugagugcugagaauuuauucugaaaagagaagagguugaaaacaauuuaaaugcaaaaucacuuaucauuauacgauaagaaaguagagacaaguaaauguuagugagaggccagagguuaauaggacuauucuucauaacaauagagcuacuaccauuaaacacaggaguaugaggacaacacacauggaaaccauuguaaguggaaggaaagugcauugggagacugaaugggagacaugcgugaaaugcacaucacuggaugcacacagguauauagauaugcagacauacaaguguuagagaaaguuuauauaauggcaguguauuucucuugcugacuaagcucauaugugcuaucaguuuucuuuauacuuucuuuauaucucuuggguauuuuaugaccagagaaacagucuuagaauagguuugaaaaaaauccuaaaaauauuacaaacacaggaaauccaaaugaaauuuuaagaggaucagaagggggcuagcugcccccccagagcauuuuuagugacagaauaccuuuuuuuuccauuuuuucauuuaauuuauuuauucacuuuacaccccaauaucagccccccuccucccagcgccccuucacacacauagauccucccucucucucccugcucuccccuucuccucugagaagggagagcucguccucuccgagcaucacgccccaccuuaccccagcacaucuuauuuagucacuugacauuugccauccaucuugaaggacuguuucacugagcacagaaugcuauguucacaggauuugcugccuuucacacuaccccuggcuggcuggcauagucucuaaugagaaauucgcaguguuugggucauuguuugcagcuucauaauuuauuuuucucugccugcuuuguuuuuuaauuugauauucucuuuauuuacauuucaaauguuauccaguuuccugguuuccccuccgaaaacccccaaacccucccccugcucaccaacccacccacucccgcuuagugcagaguucuaucagaccuucaaagaagaccuaauucuaauucuccucaaacuauuccacaaaauagaaacagaaggcacucuacccaauucauucuaugaagccacaauuacucuuaauaccuaaaccacacaaagacccaacaaagaaagaaaacuucagaccaauuacucuaaugaauaucgaugcaaaaauacucaauaaaauucuugcaaaccgauuccaagaacacaucaagacaaucaaccaucaugaucaaagaggcuucaucccagggaugcaggaaugguucaauauaaggaaauccaucaauguaauccaccauauaaacaaacucaaagacaaaaacuauaugaucauuucauuagauauugagaaagcauuugacaaaauccaacacccuucaugauaaaagucuuggaaagaucaggaauucaaggcccauaccuaaacaugauaaaagcaaucuacagcaaaccaguagccaacaucaaacuaaauggugagaaacuugaaguaaucccguuaaaagcagggacuagacaaggcugcccacucucucccuaucuauucaauauaguacucgaaguccuagucagagcaauuagacaacaaaaggagaucaaggggauacaaauuggaaaggaagaagucagaauaucacuauuugcagaugauaugauaguauacuuaagugaccccaaaaauuccaccaaaaaacuccuaaaccugauaaacaacuucagugaaguagcuggauauacaauuagcucaaacaaaucaguggcuuuccucuacacaaagaauaaacagguugagaaagaaauuagggaaacaacacccuucacaauagucacaaauaauauaaaauaccuuggugugacucuuagcuaagcaagugaaagaucuguaugacaagaacuucaagucucugaagaaagaauucaaagaagaucucagaagauggaaagaucucccaugcuuauggauuggcaggauuaauauaguaaaaauggcuaucuugcuaaaagcaaucuacagauucaaugcaauccccaucgaaauuccaacucaguucuucacagaguuagagcaauuugcaaauucaucuggaauaacaaaacacauaagauagcgaaaacuauuaacaauaaaagaacuucugguggaaucaccguccuugaccucaagcuguacuacagagcaauugugauaaaaacuaugguauugauacagugacaggcagguagaauacuuuuuaaaagacuucuuccuccccuuucugcaaaugguagcucccaggcagugccgcaucuguggaggacuugcgauguacgagugcagggagugcuaugacgauccggacaucucagcugggaagaucaagcaguucuguaagaccugcagcacucagguaaucugugcuuaccugguggguaugcccuguagacgucacccacugacuguccacuacauuucuggacuugaaagccuuucagaaucaaaguacauucauaguaaauguucuugcucaucucucuucuguuggugugugugugugagagagaaauacuuggcugugauuauaagagcugggcucagugaaaguggcuagagucugcucccuugcaacaugguauuagcucaugugguguuuucuucauggucccuuuuagguucaccuucaucccaggagguugaaucauucuuaucauccaguaucacuucccaaagacuugccugacugggacuggagacacggcugcauccccugucagaagauggaguuauuugcuguucucugcauagaaacgagccacuauguugcuuuugugaaguaugggaaggaugacucugccuggcuuuucuuugacagcauggcggaucgagaugguauuaaacaccuuccucagcauccuguauuuagggguguagugcuuccuagugagaacaugugugugaaguaauaggguguguugugagaaaauccuuuaaggaauaguauggugcuauagacuuuaaucuucaaaguguauuaauaauucagcuacccagacuaaggaacaauguugugacaucuuggcacuuaaacagauuuguuaaagagugcugucuaagaucucagcacuugggagguagaggauugugaauuagaggccagugugugcuacauaaugagacucuuuuuccauuugccccaccucaaaaaaaauccuaagauucuucuuuuagagcugauuuuaccgucuauuuccuuucaguucuguauacacuguaguagccauuuauugagcaccuguaugccaagcucagugggaauacugcaguuguagaaauuaugccuguuuuucuguugucuuaguuaaaguuuaaaguggugaagauugcaugguuugcauuuaccucauucuuccugaucuccugcauuccguuuuaugaagaaaccuuuaucuaaugagcuguuccuaggaagcuuagucauuucuuaauacacaguucagugucaggaccucaaaaaguuuuggaaguaaaauacuugucacaguacacccaaccccccaaccccuauuucuacagguauucucccaagcucuaggcccuaaggucuucuggugugggucucuaauaaccagagaacccuaguagcaccuccuugaccagggacacaagaccagcaguucuccaucucuucccagcaguucaacgccugaggggcaugcccaccccuccuguucauaugcuucacccaguuagcauuagcagcauggcuuuugggaaagcacuugggagaauaaaaccaaacaggcuuucuguaauccagucaucaaagcacacaaaguaaucagugugcuuucugcugaucagugcauaaacagcgcauguagaggugugcaaguauguccuuaaaacauaggaaaacagcaaugggcauuacuagguguuucaaaaacugagcaaaauuuuuguggaaaagaaugucaggcuguuaguguaugggagggacuugcagguaugaggaaucaagacugugcacacaguggguagcagccugcaaaucaggccuaucuuaaauauguguucuuucaccaguuuuauucaccuuugccuguggaacccucucagaagccaaggagacuauaauucuagaaacuggaagucaaacaaagguuuucuuccaauucucagagucaguacucauuaaauucuaggauaguagaauuguucagguaggacaggaugccagaaggacuuagacauucacuucccuaaauagauuucacugccccuuucucuagguggucagaauggcuucaacauuccacaagugacgcccugcccagaagugggagaguacuugaagaugucucuggaggaccugcacucuuuggauuccagaaggauucaaggcugugcgcgcagacuucuuugcgaugcauacaugugcauguaccagaguccaaccaugagccuguacaaauaaccagguuauccgcagugggcagagacagcacaaaccuuagugcugugucuuccuccagcuugugguucuguccggcacccauugccggcaaugggugucucuuuugaugauggcccuucagcaaaggauuccuguguuuccaaacaaauugcuuuuguguuccugaaguauuuaauaagaagcauuuugcacucuaggaaguauguuuguguugauuuuuuaagaagucuaaauggauuuauuaauaucugacacuuuaaguuaacugcauugaugauacgauauuuuuggaagcauacaauuuuaauugugacgucuaaaaccucuuuuaguccauugaggauguaaauaaauauuucuucuuauggaccagggauaugaaaucauuuuccuuuuguagcuaaugauugccuugagaaagacauaauaugauuuuauuaagagucugccuuuacuccaauuguugaaggugugcugaguuuaauuguuaauuuuccuauauagugcugauuuccugcaugucuguacuuugcugaguuucuguguuccugcagcaguggucagaacaugcugaaauuccuuucaugguguuauuuuuuauuuguucuaguuuugagauaaaugagugacucugucauaaaauguccauuuuugauuuguucuugaagaauuaggguacaaaacaaguaucguagucauaguaacaacuguuacugaacaggucuucuguaggggcuccuaaguaugagacaacaugcagugguuucugaaaugacugagcgauaaguaaauuauauauucuuuuuuuaaaagauuuauuuuauuuauaugaguacacuguagcugucuucagacacaccagaagagggcaucagaucuuauuacagaugguugugagccaccaugugguugcugggaauugaacucaggaccuuuggaagggcagucagugcucuuaacugcugagcuaucucucuagccccaaauuauauauucuuauacagacccacaguccagagaaagugaagcuggcucagaguuagcaccaacauuucccugaaaaaauguguuagguguuuaaaaaucucaucguaaauaaauuauuuuauuuuuaguuuaagugaauuucucuuaauuuaaauaagacuaauauuuuuguuugacugaagacccuuguacucucuggugucaguuuggugucacuugaaacaaugacaaccacgucagcauguuacugcaaugucagugaugguuucaaaggagaaaauggaugucaucuuaggacugcuuguguguguauagaccgugguggaugcuguagagugcuuguugucugaguguuguuuugugguauggcugucucucugaauaaugucaaccuuacagaaagagaagguguuauauguguaacauauggcuuuauaaaagauuuaaugucaaaagagucuauaaauauugcuguuauuuuuaaaggcacuuuacuccuugguuuuauuauuccauuuugcuggcguguauuagcuuuauauaaaucacaacacacaaaacucguccaucuuguaaucuuuguacuuuugcaauggaaaaguguguauacugugcacagacuuuuauauagcugagugccuagacuggguggagaggccaugaguagauagcaguaaaguccuccagcuauaggcuagccuugucuucaucauccugggacaggugagaacggugagcacaggugagucugagcuugcacacugaccagaauucagucacccuguaauaaguauguauuuaaugagucuguuagugugguagugugauuuugaaagguuuaacuaaggaauggugaggucuuuguuuauaggcaagccuggcuuaacagugaaggggagggggcugagggaaagcuuuuuuuuuuuuuaauuucagaaauggaagcaaaauccaugugcaaagagacuagcuacuuggcuuucagagcagaggacucaaagcuuguuugcagugguucugaaguugggguggcacuuugugagugaggaggaccauguccacaggcaaucccuaagcaagaucgucucgaaauugcacuguguucuuuagcaguaguggcuggguaggggcacacagcggaacacccacuugcaguggcuggggaggccugagaagcacaggccagcgggagcucucucccaugccuucuugucccucuggacagccccuccucauuccuugucccagcagagccugguuugccccuggggcaauaggguuggacuguguggugcagauagcccucgugccuguggauuacuuuaauuuuguaaucuuagguuuucuguacgguuuucccauugccuuuuaaaauauuuugaguguccuucuccuuaucaagaugguaguguaguaggauuguuuuacucacaacaugguuuaggagccauagcuacaaauaggaaauauaagaauucuauuucucuacugugaggcaaaucuguauauauguauggagagucaggaggaugaacaagggagaggaaaggggcccaggcacauuuuuaauccaaaagcuacaaagugucgagcuccucagggccagcuucacagagaguccagcucaguucacaaaguauuuucuaaguuggggaaaugcauugagaaacagagcgagauaucuguguagugcagcugugggugguugcuaugcauuuuauccucagaguagccugggguuuuuauuuuauguuugccaagugcuuagguaaauggccgggcuccucuuaccucugacuucuggagcguguccauucucugguugacugaauguggcauuuucauaaaucuaggagcagcagcccucccaacugcaauuuaguaagcagguagauaagcuugcaucuguuugcaucuuccugcacugaguugggagugcaaaaccccguacuuggccuggugaguaacugccaacaaguauuuaugggucauuugcuagguggcuagcauacggcacggggcuaaugagaccuggggccugcucucauauagcuuacugcucaguuucuauaccagagcauccguuggugcuucuuagccuaggcaugggugacaggcaugucuggggaccacuuugggagacaaccuaguguaaccuuauugcaaaggacuaagagacaaaaauccuggguucuuucuccaucacuugcucuguagcugaaugaacaccaccucgauuucuugaguuucagugucuuguucugucugaugaaaggguuggauauguaguuggauaagcgguacaaauuguuaggguuccaggccaugccugauacaucugaguuuuugcuggagguaggaaauuucaacucagaagcucauccacagaaaacagugaccagcagcagguauggagccauaaggcuggaaggcuucaaagaccccuucuucuguuacuguuauccacggcaguuauucuguguaggugugaaggaguggcuacugacucuguguggaucagcguuuacauaugaccugaugggagugcaucugguauguguuccuccccccuguauugcuggagagauuggcaaucguagguauacacggaagugucgggauguucaguggcgcgcacuuggauguuucuuuucacuuuauuucuauagaaacagguuccaggagccagagaaguaggggaaaaaaucccugagcucaucucucucuacuacuuaauaaugcaaacauuuaaauucuugggaagauuuucccgccccacucccuacccccagucacaggucagaauaggauuuccuucuuagagaagguaggucauggggccugcgauuaaaaaaacaaaaacauaaaacaaacaaacaaacaagguggcuuuccuuggucuuugugauuccagcucuucaccagugaaggaauucuuuaguuccauagugcagccuggguggguggagaagaggcuguuauagugggagccagugagcaaagaggguuggaggaggcagaggacagggcucagggaaggcaagccuguggcucugggcauuggcccucuugucaaaggugucagagcauggcuuccugugaggggcuuucccuugcuccugugugagaaucugugcguugucuuacuggaugggggaccuggauggagauguuaggggagauagcuuagucuuguucuaaacucuagacuugcuaaaaaggguucucuugaguccaaaugcagugccagagggugagaagcagaauuggccaguagugaacagugguauugugggugauaagcccuuucugguggccuuaaauagcagugcuaguccuugagugccacaggguccccuaccuccguccuggcagugcugauggguuuguuucagcauauuuugguucucauucucauuuagggaaaagggcuguugaugaagggauuauccucccaggcaccaggggccucagcacaguucccugugcuuuuaaacacuguugacuuucauuaguuauucuaaagggauuuauauuggagauacaacucccuuugguuucauauuaugaaauagcuuuguacuguggaaugcuaacucuggaaagucucccucauaccagaaccaaacauucauuucuuuuauauauauauauauauuaucucccugguacucuccagggaggugguuauuaucaagcugacccaaaggagugcaguauguguucuaguuccuuuucugguaccuuguucaacauucuuuuuuccugaagaacauccuuuuguuuaugaaaacgugaauagcaucauguaaaacaaucccuugcuaucagaaugcuccaguuuggccuuaauuuuguaaaccuuggagaggaguggagcgcggcugugagaagagauguaccauguacucuuucuguaucauuaaagugcaguuuuuaugcuucuc

SEQ ID NO: 4627 - RNA, 16923 nt, Mus musculus
guuuuaucuguugcaaaaaaaauguauuugauuacuugaguaaaauuacaguaucucuguuguuaguaaguauuaaauguuaaagaaauuggaaccccccccuucaacuuuccaagaaagugcauguaacaguccauuuuuuuccuuccauaccuaauacaaaauaaaccaacacuauaccugcucuugaucaagaggcauuugcucuuguaaggaacauauguacauuuuaaugaaagugauauuucuuauuguauauagaagagcaucuacauuucuccacugaaggucguucaagaugcuaucguuagcagcauugugaaauuccagcacacguuuucuacugugaauauacccuacaaggccaaaaugcuacgucucaguuucaacuaccaaaacaacacuugugguuuuuuuuuccucuaaagaauucugcgugcuuauuacuguacagaaacguauuaacauugaagacgacucaaguaaaaagcacaauacaaauaguucaaaacggaaaugguuaacucucuaaaacaaaaccaaaaaaaaagcagguugaaguuuagaaucaaaaugaaaccaaaaccaaaacaaacaaacaaacaaacaacaacaacaacaaacccuaagccuuccaaauguucagccuguacuuaaaguccuucccuuaaaucuguuuggaaagauuagacaauguguucgcugauaaaauuuuccagcaggaucaaaguguacauuuauauacagacuuuauuagagaucuaacguaucacggaggcauugcaucaacaccagauucauauuaaacuggauauagaaaauaaguuaaugccggauuaagaccgccuagcagggcaacuugcgauugccauaaauguuacagcaagcuaggagcacucuaguccauuaguauuuaguccaaaauacagaagaccaaaguuaaugccugcacucuguuugcaaagcaagguuauagcacuaauaaauaagcuuucuuagaacucuagagguugaacaacauacaaaagaaugucuucauaguguaguucauagucccaggggccagaagguaaagggcggggggaggggcaggaggcaaccucgggcgacauucugagaggaagcacucuggcagcuuuagcuugugacgaucucuuugcuguccuccacgaagcgggugaaacggaaguugguuccguucucgcugcucgccauuuucuccaggccagccagaggagcacuggguuccgaauugcccaguuuuuccacguucccagucagcccacugauaggugagcugcucccacugcccaggcuuccaggaauuggagggaugccgccguucugaaugacagagaucucguuggccuucauggccagcccguuggacagugcugcuguauacugguuccaaaagcuggacggauccccacuuccugaccucgccgcuagauccuucuggaacauuucugggaacuugacaggauugccuccuagaaaugucauggggccauccacugagagccgccggccccggcgugcaggggugcuguuccacauaugggugcccauguggaccuguaauguggguuggggaagagagagaagaaacaagagagagagccaggagcuuaauagccgauucugucucaacucauaucccaacacucgacaaagcaagugacccgaaugucuauucuuauuacaggacagacaggggaaaagacaccaggaaccauccacucccauggucuaguaauaacguguuugcucucugcagugcuggguuggcucuccucuuccuggcuaacucgccuuacuuacucuguuuuuauuaccuguauuuagcuuauaauggccucaagcaagccaggcagucauagauagcuccucgcaggguuagaauuguuauguccacucucauugcagugguaaguauuguaucugacacucuuuacccuguagauguccuuuucagaugggaagaaaguaacccucacugauugcccauuggagggccuugcgcagagagaaaaacccagaaaguaauuauucaucccacauuacuggcagcaaccucccgaggaauacucugucaacagaaaaauguacacagcgagagugcucaacuguugcucuagaacgagcauauuugcuuuauuuccaacacauaucaguaggaaaugucguguaaucaauuaucauaauacccauuaggugaggagugacguuacuguugcuagaaaaauaaaccaugcuagacugggguuaugaaaaauagcugcauacgccgaagagagccguagagagcuguaauuauuaagugauaugggcagugugcaggccacacggaggucuuuaaucaauaccccauggcaacgccaggcugucugauuugguagguaaagcaauucauuugaugcacuuaagcuagacagcagaaagaggccugcugcuucgcuuagguaccaaauuauucaaggcguugggacaggcagcaagcuacaggcugcccuugucccugccaugauccugaccucacaaggcuccuccaugucuccccaccucagcuacguggagcagguccccuuuccagaaccuucucccuggcuacgcagcugagggcuccaggaccaugugcaaucaucaaccaagggcauggggaagggcugaggggcgguagggugcgggcagagcggguaccuucagauugccuuuuguugugaaugcucuuccacagauagugcaagcaaagggcuucucuccagugugaguucucucguggaucugcagggcacucgaagaagagaagguuuuaccacacguguuacaauagugcuguuugggaguucuccggggcagagcugggagcagaacuggggaugucgcagaggacgacagaggccccugagggacaugacuagugggggcguccuuacuguccugaggagaaacguguacaaagccguugaccucuguuuugaugagagaugacagcgaguuggcgggaaucacugcagaguucugauuggggccgagguuggaacugggcucaaagagcugcgauggcagaucucgcaucugaugugucaacaugugcugcuucaaauuacccuuuguggaaaagccacgauugcaaacugugcaaaugaacggucucucuuugguaugacuucuguagugaauguccaaggcacucugacaagcaaaggucuugccacaaaugucgcaagcaguguuuuuaaauuuaccccggucucugaaaggaaagaggauucccagagaaucuucuuugaugauuuucucugcaugacuagaagucaaguccaaagcaccuccguucacuggggugggagauagaccauuggcgaacucgccuggccccacucgcuguggcuuuuccuccaugccgggugacuuguggaauucuugggugcuguuggacggggacagagccugcauggaagagguagacucugagauggcugggcugccugcacucuggcucuccaugucgccacccacugaggaagagucguuggucagcacauccccuuccauggauccguucuccacagacuucaggcuggccugcagcugcuccgccaggccagcauugaucaucuucaucugauuuuccagagcagcgaugcucgacaucucgaggggcagaggcgaagaugacaggcuaucuugggaagcguccgcugacuugggugugucugggaugcugcccucaggacacucuuccauauucucaucugagaaguugucuaagucgucgaaauuuuucucaucaaaggagccugugucagacuccauggacucaggguaguugucagggacugggguguuggggaucuggccucccaugugcauacgaauaugcugcuggaggaccacugcguuugugaacuucuucugacagauggggcaggaaugcuggacucugaguggaggcauagcccgauggacgcuguagugggucuugagguucccuuucguggugaaagcccggccgcagaucuuacacuugaagggccucuccccaguguguguccgguagugcauuuucaaggcgcucugacagcugagaacccgguggcagaugauacacucauugggauccguggccuucuugucaauguuuucuaccaguugcugcagcuuggaugucucugaggccugggccgaaucuaagagucccccaaaaggaaacuuggccuugaacugcucagacaugaggggcaacagaggguuggugaagguggucccuccuggaccaccgucagccacuggggaguucagaguacuguugcccgcugucgggacggcggagcuugccauguuacucucuucacccuugccaccaaaggguggcacagcagacccuuccacuuccucagggacgccacuuggguuucuuguggccaaaucaggggccccggagucacuuuugacugagccuuggggacuggcagcagaauggcuaauagggaugggggcuggcucuuccgucuugaugaagggcgugaggcuugggagaguuggaggcaaugguaggccgacggaaguggucagagugggcaggacuggcuuggugucuagccagcugguaacuggcuucucuggagggauggacaugccguaggggaugccggugcucguggggacauuguccaagugcuccgguacaggguagggguucaucuggauguggggguacuucucuuuguggcgcuggaaguggacuuucagauugcccuuaguagagaaccuguucccacagauguugcacuugaauggccucucuccaguaugggagcgcaaguggaucugcaaggcacugucgcucccgaagaccuucgcacagaaccugcacuuguguuuaaagaacgccucgucugaaguacuuuucgcuucaaaggcagugacauuugguggcuugcuuuuucuuugcugggccaaggcagacagggaguucaaaucuucugcgguuguugcaauguuaggcaaagggguagggaaaacagcguuagcuggggucggcugagguagaaguggguuagaugcaggacucaacagacugcuuauugcgaaugcuggugaggacgaugcugagacggccggggagcugacaugggaggcaccagcauuggaagccacuuuuucugaggacggggugggcacugcagccgucacuaugcucauguugggagaagugccaccacugggcgggacgauggaggugccggagcugcucugagguagcuggacgugggggagcugcuucacaccgcugauguuggcagauuggcuagcaaggcucugugcuaauccagcugccaccgccagcuguugagacagaugggagcucaguguggucaagggguuggcagauguucguaaaguaccuugagacgggauagagggugcugccggcaggucugcgcucugagaggccagcagcaguauuuggugacguauuugcucuaugagcugcagcuggugaaucugcugcugcugcagagccaggaguuguuccaugaggguugagaugagcagcuugccuccggaggcccccccacaccucgccuccugggagaacugggccaccgcuaccuuggugcucuggagauucucaaugaugacguugcuguugaucaccgagaaguugcccagugucgucaggucccccaguugagguagagagguugugaucgcugagguacccguggaagagccgcuguggcagcucgggguggugauguuggugacaccgcucagagugcugccaccacucccgccgcugccgccaguggugguggugguggugguggcaacugggaccuccaccuccauggacucuucccugucaagccccuuggguucugaaaggucgcugcagucuucuuggucugcuuuauucgccgcgucuuucauuuggucgucgggaucauugagagacgggccaggagggaaggcuuuugcuggggaggcuggacuuucauugacaaucaaaacuaauugauucuuagugcagcucuuuuuauggagcagaaggucugauaauucaaagaauucagcgcagcaccggccacagacaugggcauccuugcucuuaguggggcgacuugguugacccuucucuguguccccuacaaacaucaaaaggugcaggguuaaaagugaagcgaggacagacugucaguaaugacuugaaauugauagaaagggccauaaauguuuucuaucugcuaaacuccaaaugugacccccccccccaaagccaggcuguauuuccugggaugccgaggaacuccugucuagcugguauuuuggauaguuaaggccuuuagauaauucaucaaaauauaaaauaccaugaaggguggacauugguacauaaugaaauuccauagcaaaauauugauuuccaauauuuuauacaccgauugucuacuugcugggagagggucccuccagcacacugaggacuuauuaggcucuugaguuucugucaaccuuauucauuuucaacugaugcaaagauaucugugacagucuguucugucacuaaacuaauuuguagucguucagguuccaaucaguuguugacaaggggggaaaaugcauaucacccagcugaggacugaugacuucagaaucaccucaagucccugccuggauccugagcucgggggcccaguggugacaaacacaguucaguccaaucaguaacagaccuguuucgacuucaaaccagaaagcaacacccucacaggcaaaaugaaaagaaugcaggaugguuaucccucacaggccugucugguaccuauguaucacccccgccccagacgugaauuuuucaaauucaggauugagcucugcugcucauucuccuagguaaagaauauaugccaccaugcuccacguggcuagguucuaaauaauuccucaaaaguggucuuucugucucuaaaaauugguguggcaucuacaguucugcuaaaugcuagcugaagaagaaggugcugagagguccucccuuccuuaagaaaucaugcccacccaggggagaguuuggcaauucuugucugaaugccuuuaaaaauacuuugccuuuugguguuaucgauugucuaacagauuguccugaauacauugcauauacauauacaucacacacacacccacacccacccacacacacacacacauccauccauccauccauccauccauccauccauccauccauccaucucccuauucauaucccuugauuguuuggcuuuacugguuugcucagaugucuucucacuaagauccauuuguaaauuaaacaucaaaaucuccaacuccaagcuaacauccuauucaaagacaggauggcguccccuuguuugcucagcauggggaacaccagcuccuguuguacgaaugguguguguggucaucuccaaaggcuguaaaaaaaaaacuguuuaauucaaggauugccuccccgcaugcuuuucuacagagcugaaucagauaauagguaguuuccaugacuuccaaauugaaucuucuagaaaacuugcaggaggaaaaaaaaaaguaauugcagauaugaauacauggaaaaucaaaaugcugccuaccccagaaaucccagucaacccagagcacauucagaagagccagagguuaucuuuuuggauuaagcaucuaaaaagcucggaagaguuuugcauuucagaaaauacaauuaacaccuaaacagucacuugugaaauuccuuaacucuaucugccuggagugaugaggaaguugauuagggccccugguaaagucugcuggccagaggagagaggggacgcgugcacucuccucacuggcauaguuuuaguggcugaguuauauuuaauaagccggcuuuccuaauccccaucuuuaaaucuacacgggguuauagugcaacaugcauuaacaacaccaaacaaaucgcaguuguagcagaaaauaccaauaaugauccaguuuuaauuuaauguuuaaucauccuaauuggcaccagauucccaugcucgcugaaggugcuguuuuaagcacuuucugucucuucuccugacuugaaauacuacaaacaaaauauuaaaugaaauuugcuaaaguuauccugccucacgcgggacaaaaaaaaaaugaugugacaaaaauucaguguaaagcuucguauuuugacaacugauuuuaaaugaugcccccauuucagaugcuuauuuuaaacuaggaaaugcaauuccuaauauauucaacagaaauguuauuucuuucucuuugcacauuuccauauguaauggcuauguuuccaucuacuuuuacagccaauuaugaaggaacaaaagcuauucuguuuguucacacauuuucaacaaaaugcauuaaaacuauuaugucagcauguucuauuaagcucugcauucaguggaaaauacuuuucaaccagcucacauuuaucaaaacauaaagccacuuuaaaacacaguuuugcuuggucagcugggcuuagacaaauaaugacagauucagaacuaaauaaccagcaagggaaaucagaaaacugacuucaucaauuguacacauuacaaugugguugcuucaaauauuuagcacaucugugcucacgguuaaagggcauuuuaauucuuuauaacuugcaaacaucugauauucucauaauauauagaaaaaaaaauaaaagcuagguuacuuucgaagguuacacugauuucuacuucccugcacugggguuuugcauucgugccgcuucaagacucacuugagagaauuuuuaaguuuuucuaccugaacauuuuuauauuuaggauuaugcuaauuagauggaaaauaaagacgcuuagaaauaaaugccugcuugcuucugagagagagagagagagagacccuuuauaaaaguuggccauauuugagcuucgauuuucacaauuuagcaagcugacauuugaucgcacuguaccaucagcuaauuuaauuuccugauguuuaugaacaaucugcucccucccaaauccuggcaucuauuuugauucggcucagaagcagguguugcuacacucuacagugccuaacuuuaaaccauucugcauggugaacagaauuccagggaaaccagcauggaucuuuagccccaguuacuaaaaggaaugacuaaaaguuacaauuagauaacgagcaggcagaaacacacacacacacacacacacacacacacacacacacacacacacacacacacacacacagagcccuguguucuuguaucucuuuaaauaaucuguuacacaggauggcaacuggugaccuccuuuuaguaacuacaguucccuuguuccuccuauuguagugaaaaucacauuccagauucuuuucuauggauuuugcauucacaaaucucguaauuccagccagauaggaacauuuacaaagcaagagcccuuuuuuccccucagcaacccccccaaaagaugcuuagaauuucuguucuuuuuuugaaggagauguugaaucauuaccaaauugucacuuaaauuccagauguuuaagcucuggcugaacuaucuagguacccaauucaaauuugucacuuuuuauccucuuaaccaaacacagcagaauuuggaagcaggaaaacgaagcguugcagccucucuacucagaaagcaaaaauauaaaaacuaugccucgcacagaaagguucagccagccaggagagaagaggaggaaaacaaaaacaaaacagaaaacaaagcaaagcaaaacaaaacaaaaaaguagaaaccaaccaccaggcucuaccagauuuaguuuucucuuugggagcgccucagaaagacacuuaacacuacuugccaguaccuuaagacuacauuagcauuucuuaauagaacucaaacaauaguggacuuggggccccuaauuuuaacaggcuguuccuucccacaggccugcuugcagaggcgaucaugaacauauuugauugagugaugcuuuaucuuuuuguuuuauuuuuuuaaagcaggauccgaauguccaacuuaagguuccagaaaaaaaaaagcuguaaauacaacauaugcugcgcauauuuucuguaaugucugaaguuccuuuuaugcagcauacaaccaaaugacaaaugaacugguccccuucaaguuuacagugccagcccugauuguguggaaggagacaagagaacccucuggaaaaaaaaauaacauggacaagauacuccauuuaaaguucugguccagacccaccuccggcucacaaugaaaggggaaaaugucuucccuauggaugaauuaaagugaacacuagauggggauccaacagcaaggguuuguucacaaacuacucuguggcuuuccuauuccagugacgcguaaaagagagacuccuuaaggcgagaucuaaacacugacuacacaaacauuggcaaagucacaagaaacuaaaucccuguuguuggagggugaagcugagccgugggaacuaccugucaaucuuccccuuugggggucuggcaucuggggguggcgggggaauaagguuaggaaaagaagccaagcugauaaggagaaacuaaaauaaacuaccaaguuccugcuaagugacuagcaagacucaaauugggggucaccgggaagacacugaaggacacauuaugaucuggaccuugucaccucugcaugggaggaggcuggcaaagguuaaaacagcucuacacguccagguuuucuaaagccuggcacaccaacuuuuuuuccuucuugggggaggagugucaagccucagguuaauauuaucuuucucuccucaaagaauauuuuagaacacagguuuucugcacuagggacuguguuggaaaaaaacacauuuaagcugcagaagaauuucgauuuuuuucugguuacuucacacugagugagcuuggcuaaguuuugaaacccggaaccugccugaauucccuccucccaucgcccuccagauucgcuaccagaaaaaugugggcuuuugccuucugaaggauauuguugguaaaaagacaacuagaagucuccaaccuuagagaaaagaaacgguuucccaaacagcacccuauaauuugguacuugugcccugagccauagcagaaauuggauguaaaauacaccaacaauugcucaaugccgaaaagcuaccuucccaguuuaucuccugccucagcaggcuuucccgggugcuuguuuuuuaacauuuagaaaguauuugcagccugaagcaaaucgcaacaaaacaaaacaagaccaaaaaacaguucacauuuucucaucuagaaucuucuauuaugccaaacuuaaaaauaggcuugaugaaacaugaauucuuuccaacugccuuaucuugcaggugucaggguucuuuucuuguuuuuuuuuuuuguuuauuuguuuguuuuuguuuuauaagagaauucauuauaguuuucucuaaccuuuugggcccagaaaucaauguguggccauuaagcugcuuacaaugaguaaauuacuuugguaaauaauagaauuucuuuauuaauaugaguaagaagggguuuucagguauuccuuaggagagucaaugcuuucucuguaauucccgauguucuaaguuucuuccaacauuauccuuuccuuuaaaaagcugagcagcaaaauuguuaaacgaauggagucggaauggggccuguuagaagcugcaggaaucuugaaaccaucaccaccaaauggagugaaccaacccaaccaaaaaacucaacacacacacagacacacacacagacacacacacacagacacacacacacagauacacacacacacacacacacaggcacgcaccuggaaauccaaacucaaagaaaaguaaccacaaauuaaaucauuagauuugcacauucccuuuuccaggauuuauccaucaugguaaauaauucuuccaaggcuacuuaucucucuacaaguaacuggagacuuguugaauaucuuuuaagagaugaacccuacucaccacaaucccaguuuucauaaggaacagaaaaauaccuuauaggaauacucaaguagaauaaacuaucaagguucuaagauuaacuucuaagaucaacuaaauaaucauuuuuuuuuaaauugaauggugguguugggacuggugcuuagcaaggcguagcuuucuuuguaaaacucaaacacgacacauacuacaggauggggccacagaacauagaauuagaguggcugcuucagggccacuguggcucugaaaacuuuucuaagguuuuccucuguguagaagucagacagucugggggacaacacgggagggagaagggucuaaacaagaucuacuuugguaaugccugauauuucauaugcuguguguaguaagacccucuugagacaagagaaaguguaaagcuggcaucugaguaagggguugccuuccaaaguaaaaaaaaacaaaaacaaaaacaaaaacaaaaacaaaaaaacccaccaaacgcccaacagcagcggcuccucaggcacauguucuguucuggguagggaaauggauggagauggcuggacucguugcagaagagucgacuuuuaaaagcaaacgugagcugugucaugcacuuuccucuguaugucucucacaacuauucccaaaugaaaagauucgggguauggcgggcccuccugacugucagcugcuggggagggcugcuuguguagaguacuauuacagcacacuaaauccuguaacccuauuacaaaaccugcccucuagucaacuucucccaaacuuauuguucagccauguaaaaacagucauaaccuaaaacuauuacuacugaagaaaaggagggaguaaggagcuggccugggagggguguuuccuaggguguucgggauaaucacugcuuuaaucacaaugaaccagcuuuuaggaagaaaaaaggagaaauuaagugaaaaaaaagaaggaaaagaaagaaaggaaacuugauucaguuccuuaauuaacuuaccucacagcucaaauaaacuaaaaaaaaaauuguacuaauaaauaauaauaguaagaggcagugaacuccuuuaaugcuaucgcuuuaugagaagccuuaacuauuaaaaauuccagcucuagacucaaagcgaagaacuagcaagggucuuuucuucccaagcucgagguggugguuguuaguuuugaaauucuuugcguggaaaauacaaacaaccaguauaaauuuaaaaaacaaaaaccaaaaaacaccucucuuuccccagguuguuuuucucccacccccacccccguaugcaaauuguuaaguuuuaacagcaucccggugcaaaggccucacuuuaggaaagauuguugugggggcggcagaaagccuaagaaacuagcugagaaaccccacaaaaauaguccgagugguugcugcggccuuggcuaauuucaucugguuuuacccucaaaccgguucuuuuggggugggaaacuggguguguuucaagggauccuuccagaggacucagagaaucacacuggugaggcuucgagcuuccaaaggugcugggcaaaacaguugccuuaauggcucucagaucgccugaaaaaauguccaggugucucacgccaggauugcccucucccaacagcgaggaggaaguaagcugucgaucccuugucgcucuggcucugccugcgcguacccgcacccagagccgcucagagccaggccucuggggacggagccugcgauguggggcuccagcgcccgcagagcguaguggccagaggugcggaucucaggucacgcuuccgagcucugcuggggugcagcuccuuccuccacgcccgggaucgaggauucccgaagggcagccggggccgccgagccucgggucuggucacucuccaaccgacgcagcggagagucaggcacaaaguccggugaccccggaaccgagcguagccucuggccugggagcucggaaacucugcccuagaacaguucaggucaagcuggggucggagggggucuucccucagugaccccaguucccugcgcgggucucucccauucuaggccacaguucccgcacacaaacuuuucccuacucauucaguccuuucggaacccugccuucauugcucggcuggcuccaggggucuggcgggcuaauacccgggacccaagaaagugucuaaugacccuuaccagaacgggucccgaaggaugggacuccauaauacguggggugcacacauccaagcccgacuuugacggguuaugggugcaaguguggaaagaaacgacaggagaacaaacuugggaagccggaccaagcgacacuucccugucccuaagucagucuccagagcgaccggcagcacucggccgcgaccccaggaugucgcuccuccaccccaacccccaguucucacggcucggaacccccaaagguaccauguuucgcccgcuagccaagugggaacgagaguuugggggggggguggguacggagagcuccccacgcgcucggcguucagccacccggacgaaguaaacuucuuuaacguuggccgcagggcugggcggugaggcccaggcgacagaggcccagcccggggacccggguggcgcgcggggagcgggagagagcucgcgugggcagcuccagauggccucugcccgagagaucgccccucggggcggcagggucguggccgcggcuucuccgacccucugggcggaggagcgagccggccagucgacccuacuccgcccagucgaggacacggaacuccggaaagcuccagccgggauaggcuggcucucccgggacaggggaagccuggcccggcaaauugaaaucgaggaagcaugaaauaaaaucagacgcgccgagugcagaaggcgaaagcggcggugggcgcggggcccgccgcgugugcguggguccgagugugcgugugagugcgugucuguguguccgcggcgccggccggagcacucaccaucucgccgggggagcgaggccacuucggggucggauuggaaauguugaggcuucgcuugcuuccuccgcgacaugcuggcucaaacaucagcuggggcagaauaaaaaauuacuaaaaaaaaaucuucucaaaauuacggaaaucgagcggcggcggcggcggcuccccccgcccgccggcccgcccgcccccuccccggcuccccggccccgggcacagcgcgcauguguccugcuauaauuaugauuaucaauaaugcauugcgauuaaucauagaggggcucuuugaaaggcgauuggcaccgggccagcgcuauucaaacccgcucgccuuaaucaauuaguucgugauuugcugcagaccccugucucuccgcgcgcuggcccaauaagccggccgcggggcuggcucugcgcgccgcgccgcccgacucuugguuaacccucuuggcgaccgccggggacuccgcggcccggccgccgggggccugccuccucgccacugcgcgcccagcgccccggccggcgccccccgcucguuccccuccccccucccccgcccuccaucccgggcugggccgacccgaauuagcaugcucgcccgggagccuagcggagcagggccgcguggggguggggcuggcggcgggggcuggggacccaggcugcgggcgagcggcgaacuuccuaacucccgcgcugcguacuggcccgcgagggggagggagucccguggcgggacgggguaggagagggcgccccauuucgugaguguuccuucauuuucuuuaagagcuaccagaaagcagcccacccccacucucauaaaaaaaaaaaagcgaguggggaagagccagccccacgccaguccgccucccgcucgcugccgggccucccucccgccugcccgccgccuggcucggagauccuucgcccagaguucuccacucucaggaucccgggcucgcgggggugcggagaagaggacccaggaaagguuuggggacgugauggguuuggggcuuggggggaggggcaguuuucucgccaccccauccucucccugccugggagcggcgacccuccagccucuugcuggcuccuuagcucccuuucucuaccuuggacauucccgggacaauuagggcugaaguuuucgggagaagcgccccgagcccgugggauaagggggcggcucggcuccgcccaggacccccucccgaaccuccccccggccgccccgguuggcugcagggcgcgucacuccgcggggaggcggcggccaccguggcgccgccaagcuccgggcggguggagagcaaggaccugccugagcuccgaguucagcuucugcgggagggaggggaggggcgcagcuaauucugugcuaagcagcgcuccccuggccuggguggugcugcuggagccagacccuaggcaccgccucuacccuggacccuagugcuccguguccuagggguggaggccgccaccucgucgcagacgagguggcuacccggagugagugagcauggaggggggguccuguucguugcccugcuagcuacgccgugacucgccuucacuuuuccgacacuugcuacgugcggcgcccaaacuuuucucuccaucucucucuguuucucucccagagcugggagccagccucucuuacccgcucacgggacccagggauccgggcccuguacucccucuuccggguuugggcgccugcgaaccugaggcuugguccucggcuuaguuuagaccuccuccugccucgggguuuccgcucgccgagguucccga

SEQ ID NO: 4628 - RNA, 1579 nt, Mus musculus
uuucuccuccuccuccuccuuuuuuuuuuuuuuuuugguuuucugagacaggguuucucuguguagcccuggcuguccuggaacucacucuguagaccaggcuggccucgaccucagaaacucagaaaucugccugccucugucucccaagugcugggauuaaaggcauguaccaccgcugcccggucaagcugucuucuuuacuucuuaauuucuccucaagcuucacggagagaaaaacaaaacaaaacaaaacaaaacaaaacaaaacaaaacaaaaacaacgcauaagcagaucaccuuaaaaucagagcugcaauuaaaaccucuuuucccagacaagcuguauagagaggagaggcagaggggucccuugaaaggcacccugugucccuuagcauucuccagcacuucacuuucggugacgccugaugugagagcaggucuccaucaccacugccaugacuuugccacauccuggaagaaccuucuuggggacccucugagcacuguauuguuccccugggaaaaugggaagaacauccguguccccagaguuacucuuucgguccugaagaacuugccaagccuaccucagcugcuccggugacaaaggcuaaugcccagugcuagccaggcugcugcuuugucacagauaugacacugccuggaaaaauauugagcuaucaaugggagaugaaccuagacuaccaaggucaauuccucguguuaccaaggcaagcugggagaugcauguacagaucuacaugcgaaaagaaagaccuacugcuccguggauuugcuguuugucuucucuuccacaucugggauccaaggcaguaaagguccuugacauuagcauggggucuuggguuugaaaacagcccacaagacagucucuauagcuuugcaccccucuccaguugcuggcugagccuucugaccugugcacagagauucaaaaggcuuuugguuuaaacaggugcugaaagccagggcaagccaaaauauuuugcucuuucugggucaugaacuguuugcuguuggaaacaucuauaugcacagacauauaggcuaaacauaacagaaacacaggaaaugaugacagaagucuuugggaggcaggagggagcccccagacuccaauaaaguccaucucuuaagcacauaccucuugcuuuuggccacagugacaggcaauaaauuauccauguugguucaaagggcaaggucaccucauaacaacauuguccauaugaugcagucaaaucaacgcuauucccaaaauaucgucuagagaaaucacgugcaugugcguguguauuuguauguguauguguauguguguguaugugcauuuguguguaugugugugguauguguguagugugugugcaugugcuugugugcaugugguguguaugcaugaguguguguuugugugugugucuguauuuguguauaggggugugugugguaugugugcauauguucauguguaugugugguauguguguguguguauagaguguaugugcgguuuuuuauauacacaagugugugugugugugugugugug

SEQ ID NO: 4629 - RNA, 2880 nt, Mus musculus
ugcuaaaugaguuuuauauauaaaaaaaaagacuaauuuuauucacagucacuuaacagcugguggcugcuaauugucaucuguuacauugggcaucagaauguggcaucagaaagccuguccaucuguccuuagcucugucaggauuccuuaugcuuccuguucacagucuacccccggaacaguuucccagagccagcuuaugucuccuggcucucaagacaggauucuuggagaaagaaagauggagggacagaggggcaugcggggccaaggguggcuuuuugagauagguaugucacccaggaagccaaacgcucccaacucggacuccugaguaguagggucaugggugugcccacuauggccagccauuggauucuagcucaaaaaguuucauuagcugaagaaguaagucacaugauuucaaaguaggagccugaggucauuguuccccauacggcugaaucaacccaguaccucaaauuguguguguguguguguguguguguguguguguguguguguguguguggugaaaggaagacacauacaaauacccaccuucccuaagcuuauccucaccugcaaaaugagaauacacaacauaaaugaggaucaguccagaaaacuauacaucacgguguuaacagcuucuauaguggggugauuagauuuaauauuccuuauuuguguugaacuaugcuugguaacaucccuauagaaauauagaaugcagaaacauggaugguuugucuuguccauguauauguguggcgugcauacauggaugcaugcauggaugcauguguguggauacguguguguguguguguguguguguguguguguguguguguaaguaugaaguuguugucaggugguuuccuugacugcuucccacuuuauguacguagguguugucucucccugaacuggaagcucacacauuuggcuuuucgagccagccagcuugucagcaaucuccucuaucuuuagaguauagggaguucgagcagccaccacaccuggccaacuuugacauggguucuggggauaugaaccccacuccucaugcuuguaaagccaaggcuuuagccaugaggcuguaucucuggccgccaccccucccuuuuuuggguguuguuuuugagacagaucucacugcuggcugacaucagauucgcuaucuuucagcuuccaucuccccguugcuaggaucucaggugcaccacccuucccaucaugcacuucuacaauaauaaauaaaaacaacagauuuccagguaagaugagaggccagaaacugccucuauauggcccgggugaggagaagaggaaauucaagacaaagccgacuuuugcaaacagagaacagagaagccuagggaaagucaaagaagucguggaguacagcugguaaguacaggcagaaagccagacaauguaagccaagccaaauacagacgcagucacacggggugguacccaggugaagagaaccugaaaauccuacccugaaggcaagccccuggcucucagggaccucagauucaguugcagguuuugagguagugagucuucuguaaaggaauuccguauuuacucuguguaguggcuauucuugguugucaacuugacuauaucuagacuuaacuaaaacucaugcaguugggaagacccgcccuaaaucaggccacuucugguggcagccuaucuaaaggacgugggaaaagcaagcuucugcccucugacuucacugucacuggcaaggucauccaccacugucaugagagcccucuuggggauucugguguauacugaagaccucugagacacccagucucacaaacugaaagacuacuggauucuuggauuagccaucggagacagucauuguuggacuagcuggaccacagccugucauccccuuuagauagauaaauagauaaauagaugaagauagauauagauaacagauggauggauagacagacagauauucauucugucaguucuguuccucuagagaacccgagcauacccuccaagucuuggugggaucccauauucacccugugcuaaguggccaggugcuaucuugagaaaggaacauucaaacugagcuaccccaugacucuaagaacaggaaagaaccaaauaacggaaccugaauuuaaccugacaaagccccaguauaagagacagcccugagaggcaguuaugaagaaccagauggauggaugcacacaggaaaccaacaagauaagguagcucugccuugguagaccaggacacacccuucaucugagaauaacccgagagcagcacagcccgagccugagggcaauguauggaccaaccucaggaggcaauacacuguucacugcuaaagagcccagaacucugaaacuccagcagagugcuugacacccaaagcuaugucccuccaucaaggugaaggacacuucuggaauuuggaaucaccaaggcaaguccucagcccaugaagaccugaugaggaggugccuuccacacucccauggcacuuaagagacauaggaccaccaccuccaccaccauugccaccaugcccaccacuaccaucaccaccaccaucaccaccaugcccaccaccagcuagcauaucagccacccagucugcaggugccauggagaaggcugcccagcccacagacugcaaagguaaguguggccugcagaggcuccuagaaugaaaagaagggcugcugguauaagcacagcucaggccaccccaggacaccuguccucauagccuucucuccagcacacuaccacaaaggcaagacuucagaagccuaccugaccggacacauguauaggacuggcagucuucag

SEQ ID NO: 4630 - RNA, 2187 nt, Mus musculus
auagggaucgugggggcuuuuauuacgggaauaaauucuacacauuuuugagggcacucacagauugugagcacaguaauguugauaauuauugauguuucuuaauuacuagcuauacauaauuaccagaaagcuguguucaagagaccaugaguuuuccaucagaucaugggaaggaaaguuuuccuuuucaaguagcugaaaauuuucaucuauauggaguaacuuuugcaaugccagauaaaugguacuggccuuaaauuugacucaaauuaaguucgcaaaauagaacacaauacaaauaagcaauguagggaguugagaguuccaagggcgugacugcgcaucuuaauucuccuucagugagguucucguuacuaaguauccuuuagaguaagcacagcuguaauuguaaccuuucuggcaccuuuuucucccagcuccaucaguaucucagcuaggagaaccaucuauucuggaggucaugaguucucucauuuaaagaaugagauugcuuagguagaagauguagcucucgguagugccugguuagcauggggaagacccuuuaaaauauuggcuuccguguugacucaguuggcaagagugcuugaggcccuacuuuggccaccagaauccacauguugaaaagacagaacugaauucugcaaguuguucucugaccaucacauacccccucucccauaaagagauguauauaacauuuuaauuaaaaaauuaaccaguucaucauguauaccgcaaccgauucugguuauguacaaaccagguugacaguguuccuauauggaaccucaaauucaggagauuuugguccacuaaaggaugcaugguaagucucacccacacuggauuugaaaacacuaagcagcuuugaacgaacauagagagguagguuuaccgaaguucaaaccuucagcauuuugucuaucuugaaccugaauagugauuuaaaaaauuaauuagguuauaaggucacuucugggucugaaaguagaggcugauggaauuuuagagccggaacgcuuuuagaagaucuguccagccucuucguuauacagaagagaagaccaaggcccugggauacuucgcgacaauguaggucagucaguuaauuagugacagaaggaacuccugugucccagcgccuucugaagacagugguuuucaagugcauucucaauuccugaaccagcuuagcacaccugucauuuauuuaugcagucccucuuucguuucccuuccccuuucuaauggcgauccgguacgugagcccugaaccuggggcagucuucccacucgaggcacgcugucgcguagaucaggacucgguccgggcgccuuuuccgcagcaggugcuccgcaccuagcuuucuuuaaucgcugcaucaucggcggcggccuucgccgggcucccgguuuucacaguacaccgcguguacccggggacguggagagcacggaggacguggugggucagagccacgccgcucagaagggcuuccagagcccacgggagugaccucggcgccgaccccgcaaggccucgggcagccggggcgugcccgcggggccugacguggcggggccugacguggcggcgggggagcggguucugcacugccccacgcuccggccagagggcgcccggccccagcccuuccccgccccgaggccgcccugggcugcgcguggaaccgcgcggaccgccccggagcaggguagcaaccccgccuccugcugcccuccgucggaggucgggccaggcggaggggcgcggagccgcguggguauccuccuuucuugggcagcccuagccggaccgagcgacgacccgagcugcaccggucacggccgccccugugcgcccgggccaaucagcggcgcggucacagauaugcaaaugaggcgccgguugcugcgggagugccgcucgcaggggcugguggggucgcgcugggggagugaaccgggccaaucaggcgggugcguggcgcgcggggggggggcgggggcggcgccccugcucgccucccuccuucgcucccggccgggcgcugacaggggggccuggccgagcagccgguaagugccgccgcucggcgcugccgcccgccuccuccggcguggggaggacacccggggcgcagcgggacagcaaacauu

SEQ ID NO: 4631 - RNA, 2187 nt, Mus musculus
aauguuugcugucccgcugcgccccggguguccuccccacgccggaggaggcgggcggcagcgccgagcggcggcacuuaccggcugcucggccaggccccccugucagcgcccggccgggagcgaaggagggaggcgagcaggggcgccgcccccgccccccccccgcgcgccacgcacccgccugauuggcccgguucacucccccagcgcgaccccaccagccccugcgagcggcacucccgcagcaaccggcgccucauuugcauaucugugaccgcgccgcugauuggcccgggcgcacaggggcggccgugaccggugcagcucgggucgucgcucgguccggcuagggcugcccaagaaaggaggauacccacgcggcuccgcgccccuccgccuggcccgaccuccgacggagggcagcaggaggcgggguugcuacccugcuccggggcgguccgcgcgguuccacgcgcagcccagggcggccucggggcggggaagggcuggggccgggcgcccucuggccggagcguggggcagugcagaacccgcucccccgccgccacgucaggccccgccacgucaggccccgcgggcacgccccggcugcccgaggccuugcggggucggcgccgaggucacucccgugggcucuggaagcccuucugagcggcguggcucugacccaccacguccuccgugcucuccacguccccggguacacgcgguguacugugaaaaccgggagcccggcgaaggccgccgccgaugaugcagcgauuaaagaaagcuaggugcggagcaccugcugcggaaaaggcgcccggaccgaguccugaucuacgcgacagcgugccucgagugggaagacugccccagguucagggcucacguaccggaucgccauuagaaaggggaagggaaacgaaagagggacugcauaaauaaaugacaggugugcuaagcugguucaggaauugagaaugcacuugaaaaccacugucuucagaaggcgcugggacacaggaguuccuucugucacuaauuaacugacugaccuacauugucgcgaaguaucccagggccuuggucuucucuucuguauaacgaagaggcuggacagaucuucuaaaagcguuccggcucuaaaauuccaucagccucuacuuucagacccagaagugaccuuauaaccuaauuaauuuuuuaaaucacuauucagguucaagauagacaaaaugcugaagguuugaacuucgguaaaccuaccucucuauguucguucaaagcugcuuaguguuuucaaauccagugugggugagacuuaccaugcauccuuuaguggaccaaaaucuccugaauuugagguuccauauaggaacacugucaaccugguuuguacauaaccagaaucgguugcgguauacaugaugaacugguuaauuuuuuaauuaaaauguuauauacaucucuuuaugggagaggggguaugugauggucagagaacaacuugcagaauucaguucugucuuuucaacauguggauucugguggccaaaguagggccucaagcacucuugccaacugagucaacacggaagccaauauuuuaaagggucuuccccaugcuaaccaggcacuaccgagagcuacaucuucuaccuaagcaaucucauucuuuaaaugagagaacucaugaccuccagaauagaugguucuccuagcugagauacugauggagcugggagaaaaaggugccagaaagguuacaauuacagcugugcuuacucuaaaggauacuuaguaacgagaaccucacugaaggagaauuaagaugcgcagucacgcccuuggaacucucaacucccuacauugcuuauuuguauuguguucuauuuugcgaacuuaauuugagucaaauuuaaggccaguaccauuuaucuggcauugcaaaaguuacuccauauagaugaaaauuuucagcuacuugaaaaggaaaacuuuccuucccaugaucugauggaaaacucauggucucuugaacacagcuuucugguaauuauguauagcuaguaauuaagaaacaucaauaauuaucaacauuacugugcucacaaucugugagugcccucaaaaauguguagaauuuauucccguaauaaaagcccccacgaucccuau

SEQ ID NO: 4632 - RNA, 3892 nt, Mus musculus
aguauaucuguacuucucuuuaggaauugcugccucugcuaucugccacccuuaggaaaggagcgacguccuuugugucucugaaccagauuacuccauaaaaccugauaacuccauaaaaccuccucauaaauguguagggauuagagcguuauauaaaaauagagcaaggacugacugaauaaagaacuauguuaacuucuguccaggaugcagcagcugaucuucaggugggcagugguguuuuuauuccugccauuguuacuaucauuugaacagcuuuauggggacagaagccaguuggcuucugcacaucuuacuuauaaaaucaacacgugggccagugaguuggagcucugccaggcuacugauuguaaugagcuguuggcuggucuucuagacaauacuucuuaacuuuuuugagaaaauaguuauucacucauuuacuuauucagcaaauauuuccuggggggggcugcuguuuuccaagcccugcuccaggcuuuggaaacacaucagggaccauaacugaagagcagccuccuuacagagguucucuucucauggggggcagaggaggguggcagguacuguuucccccaggcaacugcauagugugccuguaaaaugcacagagccagguaaacaaagcucaacacaucugaaccaaugccauuccauucagguuaaagauagcaaauuguccugccugagcuuccccauacauggucacuugugauagaugacucuugccuuugucauuguaaagccccuccagagaacaccagguguccccaggaacacuagccuagggauuccacacucauugucccuuagcuacucccuggcuccaacucaauuuaccagacauuugcugcuuuuaaaaccugcacuuuaagaaagguguuguacugggaaauccgccuuaagagagcacuuguaaauccacaccugugucauagguguuggggauuaugggugacagugugcuguccuuuaucaaugguuguuauuguugcugugacuggugugagucacuugucaguuguguaaauauugacugaguuccuagcugguacuauccuagacccuggggcaacagugaugaguaacccuugauuagaaauggguuauguaacacagaacaaccaauacucagaaagagauugagucacgauuucauggagauccaggucccagggagaaaagacggggauccugcuuaggugcucucgagugacucacaguuaagucguccucugaggauugcccuuccucugccacacugugcuggcugcucgugggcaaauaaacuggguguccuugagaacaaguaagaaggaaagaaaaucauguaugguguagguccuugaauagaaucuugcaagagauuccucauucucaauuuugaauguggggcaaaguagguuuuuuuucuagagcaaauuguaugauuaugucauagugguugucuguguagacucugagguuugacucuuggcuccacuuccauaacucuagggaagguacaacugaaaaucauaaguagacaaguuacuuaacucccugugaaccucacuucucccccuuuguaaucugccuagggauaaugguggaaccuguuucauaggguugauuuaaguaauuauaaaacaccuaggacaaguaccugacacacacggaguauucuguaaaaucauccuuaucauaggucaggugguaguuugaaugcgagcagcccucacaggcucauguguuugaaugucuccuucccaguugguggauuguucaggaaggauuaggggguguggcuucuagggggcguggccuuguuagagaaggugugguagaucaggacguuucaaaagcccaugccaggcucagucucuaugccuucuucugaaggaucaaacgucagcucugaguuacugcaccagcacugugucugccugccuguugcuaugcuucccgccguguugaucauggagucacccucugaaaccauaaacaagucuccaguuaaaugcucucucuuauuaauuaauuuccuuggccaaguugucuucucacagcaauagaacagugcccggacggaccaaaagaacaaagucaagaaugcacucuuucacacugcccucuccuuuggcagaguguccaaaugugaagccccacacugauaauggaggcccguuagugcugagugagguguagagaggaaacaaccugcgcuaguccuucucugggcuugggcuaaguauucgcaccuagaaaugacagauguaggucugggcuccaggcucucugagcaacuggguguaaaaaucuaggcaguucacagacacuuuggaucaauucaacuuuaccuaaaauacagcgucuugagccacgugacccuccaggcaggugacaucuuccagccuggauaaaagaucccggagagcggcaaucauagacauggcuuucucccuccuuucccuuaaaacuuggaguggagccaccgguagugauagugaacuagaaccagcugacaacaacuggaagugcucagugcucucugugaugagacugcagcucaggauacagagcacgucgcccaggcugacugcuagucaguaguagagaugaaacuuaaguuagcaugccuggcuccgcugcuaggagcacagugggacaguggcaaagcucugucagcuacucacauggcucaguguguugacuucggucucaccguacaggacguccagugcuuccaggucuuucccgguguggggauaagcaauuguguguguaaauaccuauuuccucugccaccugagcacaccucgccgugugugccgcucugagugcaucucucggcgaggcagucaucugcagcccgugccguaugaaucucgccaccauuagucuucuaacgggaagucuccaccuuuuauagcuguguuguuucuuuuguauugauugcaaucuuuuuaggaggcaggagaguggggaggaagaugagagaacaucaaaguugagccuccaagacucuguacagccuccaggucaaguaauuuuggggccguguuaaucaaggccgaguggagcaggcgcccugaggugaaaggguagcgauuuaucugcucuaucacagguuccucgucagcggaacaguauguuuauaucugggaaacaauuuacuacacgugaagaauagucauuuuauucuaucucagggguguccccaguguauuuuacaaauuuacucuguaaugaauauuccagguuauagauaaaguugagcuggcuucugguucagaaggugccagguuggcggagugcagcacagacggccugcagggggcacuguugcgucauuuaucagaacucuccaguaucuuguccuaggacaaaaacaaaccaaaccagagaaggaaaauaggccagucaccuuaaaauugcucauuaaaauuauuugacuggucccaguguuaggcaugagugucgaucgggcaguucaggauucaggcacagacagaaacagcuugccaugucaggaaaaaccgcagugauuggcaugacuucugauuagccuccucuguugucaccccuggacuuuguaauuuaauaaacauccacguuucacugaucaccuuuguuggcuccugagauguccacacuguagaaaagacuuccuucugugguguucugagugucuagcuugaguccuggaagaaccuuuuuagaaaucuugauucucuauuuuuuguguauccuucacugccaaagaugauugcuuguuuguuuguuuguuuguuuguuuaaugaagucauuuuuuucauggaaggcuccccugugggaccuggccugagcugucaguauaccacccagcuccuugacaguuccaggauu

SEQ ID NO: 4633 - RNA, 1121 nt, Mus musculus
aaggugggaaaaugagugguaucauucuagaauucucucugucagcacaugagauucuuagagaaucuugcauucuauaaggacuuaccagauaaggacuugccagaagcacuaagaccugaucaaucgcaugccguuuucaucaucaagacuucucaucagcuucgagaauaaaagaauaaaugauuccauuuuacugcccagcacuaacaauuggcugucuaguggagcucagucuccauuguuuacuuauuuuuccccccuuacaucauccuuuaucauaaggauucucuagcuuccuaaugcuggagcccuuuuauauaguuccaaccauaaaauuauucuguugcuacuucauaacuguaauuuugcuacuguuaugaauccuaauguaacuaucugacaugcaggauaucugauaugcgaccccugugauaagaggaguuugacuccccccaccccugcccccaagggucaggacccacagguugaggaccacggcuuugcuguuagcacuacagcaauugauauugaccaagcaccuagcucuguacaguugcuuucuaacaucaagaauacagacaaacuaagacauaagccuugucccugaagaguuugccaucagccuaggaaaauaaaacaaacaaaaaaaggcacaugaaaguaagaugcuaccagaggcauaggaacagccccagaggccuucggagugagacagcacaugaccgugcaugguuaucaaaggccuucauucccagguuccuuugaaaagaaaaggaugaguuuuagacucaucuaauaguaggaacucaaagauaccauuauagccucuaauauauuaaggaauggaaauacuguucucuaagcaaaugcuuuucaggggcugaaaagagagcucaauagguaaagugaaagaaccuaguggggaaacccccacucaauuaccguucagcgcgcacccaagaaucacgaacagacgaccaucuugauguaaaagcaugagguaguuuaaugacggagcuccaggccgacacauaucuccugcaggagacagagguguugaccacaugguggagccauaauggcggagcuccgguucgaaacguaucucacacaggaga

SEQ ID NO: 4634 - RNA, 1048 nt, Mus musculus
ucggcagauggccuggaacuucuuauaaaugagacaguaugaaaaaugauuccuucauacugccauuaccaaagcaggauuaggucaccccuggcaauuucagauuugcuuaaaaacacuccugccucaccuucuaauggauggccuguaaacaacaauuguuuauugacucggaugccuaaggacgagggucaguccgcuuccggggagggaagcauuaauuaacucccaccacuagaccggcuccuucuuuuccaauacgugcagugccugacuugguccucauuuccuuuuccaucaguccugaaggaaccgaggugaacgagcuccccugccaugggugucgggcuaaauggaccacagcagguacagaucuguuuaccugucugcacuugccuuuacacaaaauucaucaauuuuacaaaagcugccaacuaaccaggcaccgauacgagcgaagggcuuucagccugggcuuucucuuccuuucuaaccuggagaagugguagcuugguggccuuagaccagcacaaggccacuaugggaaugcuuaagaagaagagagugcuaccaacacauauuuaucccgacugcucuucggggcuucuuuuuuauuccccaaaagugcagugguucuaaaccaaguccuugggccaccuggcacucuuauuugguggcacauuaagaucacccauggggcuggagagguaccucgauggcaaagcacuugccuagcacauggggacccuggguuucauucacagaucugcaaacguauaaagggagggauuucgacaaccaucacucccugcauuauaccaauaucgaagugauccccugacccuucuaaauacaagaacauccuaagccagagggauccucagagcucacugaucccccagcucucugugugauucccuccccuuaaccaagauaucgcaaauuaccaagcccaugaagauccauagagaguguugcuaagugcccaggaauacuucugacuucuggccaggcaaugcagugguauguggcuggcucuggaagcuuc

SEQ ID NO: 4635 - RNA, 1158 nt, Mus musculus
ggggggugcagcaaacuuuauugaugguauucaagagaguagggaggccucccuaggccccuccuguuauggaggucugggguggaaauugugagggagaugcucaguguuggggguugaguugggauagggacuccucagcaacaagggccucucucuugcucucaguguccuugcuggggugggugguccaggguuuauuacuccuuggaggccauguaggccaugagguccaccacccuguugcuguauccauauucauugucauaccaggaaaugagcuugacaaaguugucauugagagcaaugccagccccugcaucgaagguggaagagugggaguugcuguugaagucgcaggagacaaccugguccucaguguagcccaagaugcccuucagugggcccucagaugccugcuucaccaccuucuugaugucaucauacuuggcagguuucucuaggcggcacgucagauccacgacggacacauuggggguaggaacacggaaggccaugccagugagcuucccguucagcucugggaugaccuugcccacagccuuggcagcaccaguggaugcaggguggcuacagucuucugaguggcagugauggcauggaccauggccaugagcccuuccacgaugccaaaguugucauggaugaccuuggacaggggggcuaagcaguuuguggugcaguaugcauugcugacaaucuugagugaguugucauauuucucgugguucacacccaucacaaacaugggggcaucggcagaaggggcggagaugaugacccuucugguuccacccuucaagugggucccagucuucuccauaguggugaagacccaguagacuccaccacauacucagcaccggcaucaccccauuugauguuagcggggucucacuccuggaagauggugaugggcuucccauugaugacaagcuacccauucaaaagaugcuuuucuugguuacaacacaccuuucauuccacugccagauagcucaucuccuuuucuuccuugugcccguguuuaacauccaguaauucccacaaacuucuuccugaggucuaccacacacucgcucaguguaguucagaacuccuauaauucaaccuuuggccagugaaauucugaccaug

SEQ ID NO: 4636 - RNA, 3559 nt, Mus musculus
uggcagaccugccgguuauagucaaaaguggcaacagcucauuuauuuagccaaaaaauagauacuuucuuguacaauuugguucacacguauguacauuuucccguauauacaaaaagagucagacaggcuuguucucuccguaaccccacuccccccccccccgaaaucaacacaacgaaggaaccucacaaucuaaauguggggugacuugggggagggccaagguggggggacuggcuuucuuucuuucuuuuguccuuuccuguuguuguuguuguuguuguuguuguuuaguguuucuuuuaagguaaucauacacagacaugcuugcaacucgucacuauacagagcgauuuuguuuuguuuuguuuuuuacaauuaguacaacgauuuaaaaaugguugaaaaguuaagacgaggagagagcugauaagaccagagcagcguccagaugguucuguggccuggaagagaacggaagcagagacagugagcuuuagaguuggggagacugcuuagauaggggauccccuauaaagccgguguuuagcugugggaguauuaacuaaaagcugagcuaaagagaucagaagucaagaccgggcuuggaaggaaguggacauuacgcagaggccuucugcgccacaggccucuuguaagggccagacuuccccuagcucuguaccacaggccugaggugcuccagccgagaauggaaccgugucuauggguccacaagaagugacagaagaguggauuuuuuggguccuuuagcaauaguuugccagcuacuuugcuaccuucccagggggcaaagggcucccgccacuggcucuguguuuuucuuauuccucccgaagggucucccacuaugcuucccaaauucggagucucuuaccgccuuggcaccggcuggaaagcugucuugaguaacuuuuucuccacuuccaaggcacuacagcgaucuguaggaaacagagggaagaaaaaggaggccuuuaaaacacaggcuccaggccuccagggcagcugcacccgccugcgagcaaagaggaaaacaccggcgucccacacacccccaaagccccguucuuucccuuuagucuaggcgagagccccaccaacacccucccacugugccccuacauuuuucuugucaccuguuccacucuccggcucggcaggccgagcauaggcggcugcggccgcagcgggaugaccugcggcuccgggaagucccagcaggugcuguggggccgagcccagcauggacagcgggugcggccgcggaccggccggcggcccugggaaaggccuguugguccaagcggggaauuugccaagcggcgccgacacgagucugugugccgcugcagccgcugcagcggccgcgggcgagagcugcagcgucgggggcgcaacggcugcgccgggaggcgaaccuccggcuccgggaggcgagcggcguggguuguccgggcugguggccgucucggccagugaccagaucuugggcuucuggagggcggaggagggcgccggggccggagcgcagggauccaggcuggaggguggagaagguggagaugcaggagcccuggccacgggcgguggcgguggggccaggcucaggaccgacaguggucgguccuccaagccuucggagcugucguccgagucgcuaguuuugcaguccgaaaugggucccaggccgaagucgccguuccugugcgccgccccagccagggucagcuccgacccggcugccgcgcugucuaaguuuuccaaaucgaucuccucauccucgucgucgucggccagccccucgccccccguguccuccuccucuccugcgagcuccuccuccuccaucuccagcucgcguuugcucucuuccucgucuuccucuucguccuccuccucccgcucgcucccauaagcauugcccuccucguccgugcgacuacggggagcccacgucaucuuguucuccuucuugaggcgccggcgcgcguuggcgaaccagguggacaccugggugagggucaucuuggugaugauggccaacaugaucuucucgcccuuggugggguacggguucuugcggugcucguugagccaggccuugagcgugcucgugcuuucccggguggcguucuugggacgggacggguccccgaacugguacuggccauagggguagaaggcggggugcgggugcgggaacgcggcggccguggccggaugcuggacgccagggcuguccuucagcucauacugagcgcccuguacgcacauggaaaaggaaggggacacgcgcgcagggagcgcgagugagcuccugccguccccaccuuuauccucccgccgggaccccagcuuucuucugcacgcucaccuugccccacaccccaacuccaaccccucucucccggguuucucuggcucuuaccagcugugggaagaugggcagcuccguggcguagggcaggaaggcgccguaacccugagcggcggcggcggcagcugcggcagcggcguagggugccccguacacugaugaaagcacauuggauagggacccagaggcggccaacucggaggcuccggcgccgggaccgcuccggcccccagcgcuacugccgccuccaccgccgcccgcagcucccgggcguucggguggguagagagggcggauguacugguauccgagcugggggaaggacaugguggcccgcggcgcaccuacggacugggggcccggacccccgagccgccgugcucagcuccggaccccggcuccggagcgcaucgggggcugggccgagcccgggccgcgcugcgucgcgcuccgcguucgccuauugaucugcuccgcggcgggcggcggcggcggcagcggcggcagcgaggagucaggucagguccgaacagauuggccgagauucccugggcuccgggcucugauugacauuucuacggggccucaagccccuccucucugcgcagcacucccuccucuaggccgggcgagccgcucugcgcuaggcgcucaguucugcccuccucuccgggagcugugucgcgccucgcuuccuucgcccuccucuaguuuacacucuccuccuguccuguccucuccccuccccucgcugcguccccccucaccccaccccuggccgcuuccgcucccgaggcuccuucgcaguccuggacgcugggaaacugcgguucuuuuugcucuuucuguuucucacgguugcuuuugcucaccuuucugcucucuucacuuuuccuagucugacuccucucuuuuaaaucucuuuacucucucguucucucuuccccucuuccccggucuccgcacccugagcuaaggcggcuuaaaguugaagacacuuagaacgcugugcgggggguguguguccgcgucagugucuguguguccguccccgcccuuccacccccuccuucacccuuccccaaaucucgagucugacgucgcgcccucuuauucgacuuuucccugcgucuccuccuggagucgccaaucacc

SEQ ID NO: 4637 - RNA, 3559 nt, Mus musculus
ggugauuggcgacuccaggaggagacgcagggaaaagucgaauaagagggcgcgacgucagacucgagauuuggggaagggugaaggaggggguggaagggcggggacggacacacagacacugacgcggacacacaccccccgcacagcguucuaagugucuucaacuuuaagccgccuuagcucagggugcggagaccggggaagaggggaagagagaacgagagaguaaagagauuuaaaagagaggagucagacuaggaaaagugaagagagcagaaaggugagcaaaagcaaccgugagaaacagaaagagcaaaaagaaccgcaguuucccagcguccaggacugcgaaggagccucgggagcggaagcggccagggguggggugaggggggacgcagcgaggggaggggagaggacaggacaggaggagaguguaaacuagaggagggcgaaggaagcgaggcgcgacacagcucccggagaggagggcagaacugagcgccuagcgcagagcggcucgcccggccuagaggagggagugcugcgcagagaggaggggcuugaggccccguagaaaugucaaucagagcccggagcccagggaaucucggccaaucuguucggaccugaccugacuccucgcugccgccgcugccgccgccgccgcccgccgcggagcagaucaauaggcgaacgcggagcgcgacgcagcgcggcccgggcucggcccagcccccgaugcgcuccggagccgggguccggagcugagcacggcggcucggggguccgggcccccaguccguaggugcgccgcgggccaccauguccuucccccagcucggauaccaguacauccgcccucucuacccacccgaacgcccgggagcugcgggcggcgguggaggcggcaguagcgcugggggccggagcggucccggcgccggagccuccgaguuggccgccucugggucccuauccaaugugcuuucaucaguguacggggcacccuacgccgcugccgcagcugccgccgccgccgcucaggguuacggcgccuuccugcccuacgccacggagcugcccaucuucccacagcugguaagagccagagaaacccgggagagagggguuggaguugggguguggggcaaggugagcgugcagaagaaagcuggggucccggcgggaggauaaagguggggacggcaggagcucacucgcgcucccugcgcgcguguccccuuccuuuuccaugugcguacagggcgcucaguaugagcugaaggacagcccuggcguccagcauccggccacggccgccgcguucccgcacccgcaccccgccuucuaccccuauggccaguaccaguucggggacccgucccgucccaagaacgccacccgggaaagcacgagcacgcucaaggccuggcucaacgagcaccgcaagaacccguaccccaccaagggcgagaagaucauguuggccaucaucaccaagaugacccucacccagguguccaccugguucgccaacgcgcgccggcgccucaagaaggagaacaagaugacgugggcuccccguagucgcacggacgaggagggcaaugcuuaugggagcgagcgggaggaggaggacgaagaggaagacgaggaagagagcaaacgcgagcuggagauggaggaggaggagcucgcaggagaggaggaggacacggggggcgaggggcuggccgacgacgacgaggaugaggagaucgauuuggaaaacuuagacagcgcggcagccgggucggagcugacccuggcuggggcggcgcacaggaacggcgacuucggccugggacccauuucggacugcaaaacuagcgacucggacgacagcuccgaaggcuuggaggaccgaccacugucgguccugagccuggccccaccgccaccgcccguggccagggcuccugcaucuccaccuucuccacccuccagccuggaucccugcgcuccggccccggcgcccuccuccgcccuccagaagcccaagaucuggucacuggccgagacggccaccagcccggacaacccacgccgcucgccucccggagccggagguucgccucccggcgcagccguugcgcccccgacgcugcagcucucgcccgcggccgcugcagcggcugcagcggcacacagacucgugucggcgccgcuuggcaaauuccccgcuuggaccaacaggccuuucccagggccgccggccgguccgcggccgcacccgcuguccaugcugggcucggccccacagcaccugcugggacuucccggagccgcaggucaucccgcugcggccgcagccgccuaugcucggccugccgagccggagaguggaacaggugacaagaaaaauguaggggcacagugggaggguguugguggggcucucgccuagacuaaagggaaagaacggggcuuugggggugugugggacgccgguguuuuccucuuugcucgcaggcgggugcagcugcccuggaggccuggagccuguguuuuaaaggccuccuuuuucuucccucuguuuccuacagaucgcuguagugccuuggaaguggagaaaaaguuacucaagacagcuuuccagccggugccaaggcgguaagagacuccgaauuugggaagcauagugggagacccuucgggaggaauaagaaaaacacagagccaguggcgggagcccuuugcccccugggaagguagcaaaguagcuggcaaacuauugcuaaaggacccaaaaaauccacucuucugucacuucuuguggacccauagacacgguuccauucucggcuggagcaccucaggccugugguacagagcuaggggaagucuggcccuuacaagaggccuguggcgcagaaggccucugcguaauguccacuuccuuccaagcccggucuugacuucugaucucuuuagcucagcuuuuaguuaauacucccacagcuaaacaccggcuuuauaggggauccccuaucuaagcagucuccccaacucuaaagcucacugucucugcuuccguucucuuccaggccacagaaccaucuggacgcugcucuggucuuaucagcucucuccucgucuuaacuuuucaaccauuuuuaaaucguuguacuaauuguaaaaaacaaaacaaaacaaaaucgcucuguauagugacgaguugcaagcaugucuguguaugauuaccuuaaaagaaacacuaaacaacaacaacaacaacaacaacaacaggaaaggacaaaagaaagaaagaaagccaguccccccaccuuggcccucccccaagucaccccacauuuagauugugagguuccuucguuguguugauuucggggggggggggagugggguuacggagagaacaagccugucugacucuuuuuguauauacgggaaaauguacauacgugugaaccaaauuguacaagaaaguaucuauuuuuuggcuaaauaaaugagcuguugccacuuuugacuauaaccggcaggucugcca

SEQ ID NO: 4638 - RNA, 7127 nt, Mus musculus
gccugaaaaacguuuaaaugagcuuauuugcaguaauaauucagcacguugguuuugccuucacauuuucacacugguuuuagcagaaaacaccaccaccaagccacaaaccaggacagcccuugagaccccugacaucauuuuaagacauaagaggaccaaggaagaaacauucguuuuuaugcucuugucuuccaagagucacuacucacacacccaaagcugccuuguuaauaacacaggaagcacuugaaccccaagugggaaggugcaaggcuuaggagcaugguuugcuccuagcuagguuuccuuucugcuaaccgcuacuuuccaguuugccgaaguaggggacggaucaaacgcuuucccagaaagagacacuugaguuuugaaaagcacucgguugaagcgaaacucuucaguccuuagccacgggcagaaugcuagaagguugggaaaccugacccuauucagagcugccuuuccacaaugcauuucggcccuggagccccugcuagggacuucccgaauaggaaaugggggagaaggaggcaggaaaauguccugaggugagcuguggugagguuugacugcuaaauagggguuccggggcucugagcucccagcaaguguaacauggcuuccuucccagucccaggcagagccuggccugcuucaacagaauuucacccuucugcaggcccugggucccuucaccugaacuuggcuggccucggggaagagcugccucuguuggauaacuggggggagggguguucaaccuuauccccgcugagggccaacuggccagaguucaaccuggcggggcaaacgauguccacccgcccgccggauggcguagggccguguuucauccuaaaggaucacucaaguugcaaacaauguguagccauuagagaacagacucuccuucccagaacucuaaaauagcggggaaggguuuucaggccgggaccagggacgcuacaaccgggcgggcaagcgaggcuggcuucccuucuccaagguuuaacccggguagugacgccuuucuggaagccagagcaggcggagggagagcagggcgcuccuagaggucacguccuuguccccccgugggucacuauggccaccaggcccaguccccacuaccgagcucucuuggguccacaccaaccuugcccacuccgcaccgcagagggagucgcaucauuuccaugcaacaaugcaaacgcgcucauuaccauauucucaauaugcaugaagaaaaugugcggcguuggccgagccccauugcccugcuuuggccuccgcauccaauaaggcgacauauucaucucccaagauggaugaggagggaggggaugcccgagaagcagauccacgggcgggggaggggacagacuguagaggaaaggaaaagagaagaaaccagcaaaggagagccugggguagaucaagauugaaauagggcagaugggguaagagagggagggagaaaaggaagaagaugaaacugaggagggggggggcagagacacggaagggagaggcaaaaaagaaugagcuuuaagaaaacgguccaggaaaauaaaaauaaaaggaucgaacaacacacuuggacucaaagaaagagaaaaauacauccccggaaaucaaacauacagaaagugugagaaauagacaggacggaaaagaaagaaaaaaaaaaagaucagcgaaaaagcucagcgcagguggaaaguggauguuuuugcagagagaaagagaaacaaaaccacuggugcacagggccacgguuuuccuuccaugcugagauuccgggagcugcguagagcuggccacucgaaggccaguggcaggggcccugguccgggaggugcaggcagagaugggcacgcuggagagccucgcgcuccuucuggggccgcagggccaguucggcgguguacaaauccggccuggggcccacgcugcugccgccgcagccuuucugaccggcggccucucuuaacuccgagaaagaaguuugcaaaguuugccucaaaguuucccguagcgccucuggaccagggacagccucccgggcccugacggcuuacagggcucagccagcguugcacggcagacgugccggcgcccggcccgcgccuccugggaugcuccgaggccggauucacagucaaaugugaauuccucccggugcuacgccaggccaugcaucugcaaguccguguggcugcuaauagcggagagagagaaugagaaagccagagagggggagagagagaaaaggaaaaaaauauucucagcucaauuuaagucucauggaaagggcuuacaacuguaauuaaaucauuaaauucuugucuacgcuucacagagcggagagaaauuaacuucccaccaaccucauuuucuauuugaacaugaaauaaugauuuucugcccgucuaauuacaaagccaacaucugaucaagccagcauccagaggggauuaucgcaugcgcgaguauuagaccucauuaccagcuugagugcaaaauuauuacaucuuguaauuggauggugagauuuauauacagaucggcccgguuucuguaagauuguaauuacaagcuucguugguuagcuacuuaucagaacuuugcaggaaaacaaaacaaaugacugaggaaaacgagcguuucauuaaccuguaaccccagcuggggggggggggagcguacgcagcagccucugcaagaagcugaaggauagccagcccgcaccgccucugggggacucugagccuugggaggaaaggagugaacucuguccgagcugggagacacagcugcagaagcucccaacgacggggggcacgggcacaucggggagcuggaccaggggagggaagagaugggggcuggugguucggaguguccgaccccgaagcuggugggccucuggcuacacauagggcaccccuuguaguuguccuccagcgcgcacagcuucgugcgccacguguccucggcguacaccuuuucuguaugcuccuggcgcccugaucccagaccacagagcguccgcggcgagcgcuuugugcacugugccuguugggagaaagagggggugagggagaagcuccugcuggucuccugcuguugcgcucaggucuuuccccaaucaacucccgaugcaccugcuucuccucacucucugugcgaaucugucugucugaccuaaucuccuggauuaaaaaucccaugaaaagcuucagcucuccgcggacucgcgaguuuagucuaagagcugaguuccacuggccuggucuuguugaggaaucagagccaugcagugacuccagucgcuugggauacugggucccggcguggguugcugauuucagggccagaccaaagcucuucccaguuggucacgggguaacugguagcuguuucuacuccaggccugggaugccuggaggaaucuaauuaagcgagguucuuagguucaugccugggucuagagguucacccucugggccaggggcggccccguggccggcgugaguccuuccugagaacagccuggcucuuccgguguucuuucucucagcccaucaucgcaaucggacacaaccaggucgauagcugguuaaugcaguaaggaaggaaggagcaucucagaggcucuugugugguguuguugugugguguugcguuuuguuuuucuuucccuucugaaaaacaaaacaaaacaaacaaacaaacaaaaaggaaugaaauacucgugguuuugcccagacauguacagcgaaaccccuucgcccaccuugcaaucuggcucugucgcccauuggucugguccaguucuguguagguaggucgucccggcugucuuaaaagacucaccauccuauacacaggaaagauccuggaaaauaaugucaccucuauucuacaacccuaagaccuuugcuugagcaggugagcccuggcuuccugugacagguuuaaccagaaacggaaucaggcugcggggaagccauucgaaggccugagcugauccuacuaugccuccucuguccaggcucaccuuaaagccaaccuccagcaccaggcaaggagaccaggagaccacagagaagcugcacagauucaauuuaggaagaccccacaugcugacaucgaacccuagacuugguagcuccccaaacuucuguuuguguuucucccacuaauuuucugaguuaguaccuccuggagccuaaggucaguggaaugcagccagaggugggacaugggggucaaaacuggaggccagggccagggagaaagaaauccauucccuaacuguauucacacuagagcccggccagcccgggacccuuagauuccuccaagcuggcgaguuccgguuugauucuuaguucagucggaggcccuuggggugguuuuucugccucuaagcuagggcucuucacucuacugaagaaucgcagccggggaguuguucaguccgcaggcccacagcaggccuggcccgcgcgugggucgccgcuacagccuuaucugggagcuccagcuaucccgggaauuucaguaugacuuuccacugcacacacuaauccgugacggugggcacuuggacacucacauuucaaguuagauuuaggaaauauccuaccauaaaaccaaagucuugcuccccgcccccacaaugcacacucucuacggcucugggggaauucucgccaaaagaaaaacgcugggucuggggaccagagagcggaaaggggagggggauagugaaaugaauggucgcaauuaaaaaaaaaaaaaucacaccaacauagaaacuucucggaagagcuuucggaaaguucccagagccuaggcucuaaguuucucugcuccucccccacuccauagccaggagcuccaccaacuccuugcuuguuccaccagaccaccuaggcgccaaacucacuauuucuugugaggauucucaacaagguacccuggagguguaaauguagcaaacugcgggguucccccgcccuccccccacccagcacagaauaggucuuuuaaagcucggagaggcagcacucccaacucccaggcagcacguucacucuuuuagcugcaggcuuaggcuuuggagaacgaccuagggaccagagcugaaaagugcaaagggagccacgggggggggggggggagggcgggaagccccggaagccugccuugguccaggguccugucccaacccggaacuacagcuucgaagggggcugagaauugaggaguuggaagaccugaggggcuaggugacccuguacuaagccgccacucguggucucggcucuccccuccgagugcgggcaggagggggcgggaagagacugaguccagucccgccccgccccgcccggcgcucuguacucgcgggggagggccgccucgcccagaaggcucccgggugauuggcgacuccaggaggagacgcagggaaaagucgaauaagagggcgcgacgucagacucgagauuuggggaagggugaaggaggggguggaagggcggggacggacacacagacacugacgcggacacacaccccccgcacagcguucuaagugucuucaacuuuaagccgccuuagcucagggugcggagaccggggaagaggggaagagagaacgagagaguaaagagauuuaaaagagaggagucagacuaggaaaagugaagagagcagaaaggugagcaaaagcaaccgugagaaacagaaagagcaaaaagaaccgcaguuucccagcguccaggacugcgaaggagccucgggagcggaagcggccagggguggggugaggggggacgcagcgaggggaggggagaggacaggacaggaggagaguguaaacuagaggagggcgaaggaagcgaggcgcgacacagcucccggagaggagggcagaacugagcgccuagcgcagagcggcucgcccggccuagaggagggagugcugcgcagagaggaggggcuugaggccccguagaaaugucaaucagagcccggagcccagggaaucucggccaaucuguucggaccugaccugacuccucgcugccgccgcugccgccgccgccgcccgccgcggagcagaucaauaggcgaacgcggagcgcgacgcagcgcggcccgggcucggcccagcccccgaugcgcuccggagccgggguccggagcugagcacggcggcucggggguccgggcccccaguccguaggugcgccgcgggccaccauguccuucccccagcucggauaccaguacauccgcccucucuacccacccgaacgcccgggagcugcgggcggcgguggaggcggcaguagcgcugggggccggagcggucccggcgccggagccuccgaguuggccgccucugggucccuauccaaugugcuuucaucaguguacggggcacccuacgccgcugccgcagcugccgccgccgccgcucaggguuacggcgccuuccugcccuacgccacggagcugcccaucuucccacagcugguaagagccagagaaacccgggagagagggguuggaguugggguguggggcaaggugagcgugcagaagaaagcuggggucccggcgggaggauaaagguggggacggcaggagcucacucgcgcucccugcgcgcguguccccuuccuuuuccaugugcguacagggcgcucaguaugagcugaaggacagcccuggcguccagcauccggccacggccgccgcguucccgcacccgcaccccgccuucuaccccuauggccaguaccaguucggggacccgucccgucccaagaacgccacccgggaaagcacgagcacgcucaaggccuggcucaacgagcaccgcaagaacccguaccccaccaagggcgagaagaucauguuggccaucaucaccaagaugacccucacccagguguccaccugguucgccaacgcgcgccggcgccucaagaaggagaacaagaugacgugggcuccccguagucgcacggacgaggagggcaaugcuuaugggagcgagcgggaggaggaggacgaagaggaag

SEQ ID NO: 4639 - RNA, 5504 nt, Mus musculus
aagacgcggguguaaggcgagccuccugggauccauaaucuggaauccucaagggauuggaauugucugccuuuuugauaaaagaugucagcuccccuucugggucuggaagagaaagaagccuucugauucugacacuacuugugugucaccaagucuguggagagaaaaaaaaaucucgcuuaugguaaauguacuuccuguguccgucaaaguccuuauuauuuuuuuuuucaggagaaaacuaagccaaauugggguuugggaaggacacaguccaaagcccuuguucugcuuggagaggcugcuucaugcagauggaagguucuugauuguuaccuaauucaaagguuuucaaaaccaacuccagaauuggcaauuguuaucucuuuaagaggaccgggcccaauuaacccggagagugagagaguucugcuguuccuggucugugguuguuguaugguuuguuuugccucuggaaaaaaaugcugcuugaaaaaauuucuuccucagcugaaguucaacaaaggaaaaaaaauuagcccuaugaagaaucagcagcagacuuccucacacaugagaaaccuggaggaaauaaauauuuauugaaugagagccugaauauuaaauagccaccaagaaccaaggcaagugauuagauccaaaaggaaaagccaagugacaucagagacugcugacucaagcaagcuagagcacaggugugcucacacccaaccccuccaggacacuuccagaagacacucauucacccaacaagcaugcaugguacauccggucucuucuggauucuccaaaguggacuaaggugguacagagcaggaagccacagccucuugucaccgaaagcaacuaucuauuggguaggagggaaggaggaggcagacagaaucuaaggacacaaaugaccacagacuuaauacgaacacaagcaccaccucccccacuaucuuuugaagauugguccccagcugguggcaauauuuuugaaggcuguaaauacuuggagaggugaggucaaacugaaagaaguggggggggggguauauaguaucggugccugcuuccucucucaguaccugcuuccuguucagucgugaagagaagaguguccucuaccacacguucuagccaccaugcaccuggaaucaagcaucauggagugggaauguccucccugucccccaagagccacaaacuaucuaacaaaacuccagugcuuuucuugggaaauugcuaagaugauauagauuauuuccauagcccuuggccuccuuccggaucuugaagguaaaacccuguugcagaagaugcagcacacuuuagacacacaagacuuggaggagucaagccggaacggacauagggucauccuuccugaggacuagaucucauaguaucugaagaggcacaguaagaugcugcgggggaaaaagacaguuaauaguccuacccagcuauacaucucugagucacaaugacugucuugacaaguuagccucaaugguauaguaguagcacuuuuaucucagagcaaucaacagcugcccaacuggaguuaaagaauaucuacucaauaggagggagccauguuugguacgguaaaucuagacaaauaacuacgacugcucgucauagacccuaguggagaagcuacuacuacuauuuuccuaaaccaguguccccucuaccuauauuacaaauuauucauccuuaugacuacagauaccuguaggucucagcucucauuaacgaaguuucuuuuuguagcagauggagacuauuacagagaucaacaacugauccaaauguggagaauaaauucagguagaguacacuuuugacgcaucuacaauucaaccacuaggcucagagaaugccauggaaaagagugcaaagauuguaaaagccacacccugacaccugcuguuacaugaugucuuugagacaugacagggaagcuguaccaaugaaaccucaaaaguaugcuuaccuaaacaggacuuacaccaugauaacaucaguugacaugucauugcggguggaggaaauuucauaaggucccucuccuggaugaagagcuaccggcaaucaauggcuggaaagaaagagaggagcuauuuucuccaggcgccaguucccugauaggagauccaagcccagaugaucagcucuaaacacguguaaguaugcacaacauuaaauggacucaguagaauauacauuuaauacauaauuauuauguauauauguaauuaaagaagaggucaugaacuugagaaggaggcggggcauggaaggaguuggaccagaguggggggguguggaaguuauguaaauacaguacucauguaugaaauuaucaaaaauuaaaauuugaaauaaaaaggaagggagcagaggugacagaaagugguauagcuaagagaagucuccuugcccagcauuugggaagaguugaguucacuccucaguacugaugaaagaaacaagccaaaucaaaacaaaaacuaaaggcuuguuugacaaaaggcagaccgcuucccagaucuugucuuaaucggaguuagcuugccuggagcaagccaacacugcaaggcuuuggcuaaauggccacccugacucauaucauuaagaggauuugccaucauguaugaagguagaugagggucuccauuccuucuggagucauuucccgcagcugcuggaccuacaggagcccagcauccauccaucuugaugagaagcgauugccccaguucaaccagcacaggcgccgccccgcgccauuuauuuauuuuaacaaguucaucagagcacacauggcuggugugucaccagcaugcugcuuuucuuucgcugucugugcuaauuguauaaauacgcccagaggcucgauagaacuccuaacucagccugccaugaguggcccacucagggcgugggcuguggcuauuucaaagcagggcuuguuucucuugaggcuggcagucucuagucucuugauuacauuuguaugcugggccuuuuugaagcacuuagacacaggagggaagguucugcagaaggcagcugucccugcuggcacucugguuccagaaaauaccaacucuuauccccagccccuucuguccugggauuauguuguagggcaaaugggccaacuuagggcucaagggcuggccaccuugaggaacgaaugcuuuugccaggcugugcucagacggcugucaccagugauugauggugagguggcgggaggcuguuggacuggggccaguccuugggaacagaugauaaauuugggacccauaucacaggugguggagaagagggugaaaugaaauaaaugugaccaacuuuuauucugaaagcaugaguuuggggauuuccugguuuacgcugggggucuccucggguuuaagcccccugucuccuccacauccccguucacaucccgaccuauaaauuucauuuuaauaaaagaggugucuagccaagagauggagcaauuuuuaaggcuacaaaugucucccuggcugacccccauguuucacacauuucaucucuagcucuagaugccccuucugugucuguguuguggguaugccaaaaacaaaacaaacaaacaacaaaagagaauaaaaaaccaaaagcaauagaccacugugcuuugaaacgcguccugacauggaacaaaucggucugaggagggacucuugacuuggagcuggcauggcaggcuaggggaauggaaacccaggacccagagaggcaagauccagagcaguagccagagagcucagaccacugucuccugcuacccugauucaucucucacaccccaccccacccaaaccuccuggagucucagguccaccuguuggcacagcugugaagcaucuugcugucccguuccuaaugggcuuccagggcucggguuacaggcugugcuggggcccagaacaaagcuggggagaggcaccuucuaggucuuucugcuugcugguagauuucuauuccccggugcugaccacaagcuuucuguucuagggccaaccuccuaagccacuagccuugcuaguguguacccaaagcaaguccucggacccaugccagcccucuuucagauggcacucaccccgcaaagcacuuagcguuuuaacuucacaaauacaggagacugcccucgguaugugaagcaugucacauaccacacaaaccuuugucccaaaggucucuuuucaugcgaccugucacuauaucacccuguggccaaaaccccuaagguguggccaccccccccccaugugcccuccuccucgucuggccuuuauucacauccuugagucucuuauggacaaaauguauuuauaguuagaguuuugcugaggcaccuggcuaugauccaaccauuuggaaggccgaggcaagcggguggcacauuagagccacacugguugcauaggaagcucaaggcuuacuuugguucuguaaccaggcccuuucucuugaugccuccuccaccucagauuugcauuugauaggggugauggaaaacauucacuucuuaaaugacaguaaugacccgaaguugucuuuucaaauaggcguauuccaauacgcaaaaguuaaaaaccacuuaucccucccagaagguaaggaaaagccuggugaugugaggcaggcuaaggagaggccacauggugcaccagcugagcguaaggcugagcccaagucuaugcuuuggcucuuauuagcuggacuaugacaacuuaggaugcagcacuuggggcugaugucccucagugugggagcaccaugacuggggugcuccaggcugcuggggugcccauccugcuguaacaacggcuccaagagcugggucgcaccuguuuucccuagugaaagcuuugccugugggcagaguccaaaccucucacuauggcucucagaccugucucuacucaguuuuugcagaguuuuccugugacauuugucaccccuucugaccugcaccuccaagccaccugcuuggcuuuaagcuucugcuucuguccugcccucugccaaaggguuccuuucucucuuguccaucagguaaacccuaguguucacagacuugugugaauaccagccccucuguguguccuagggcauuccagucugaaaucccaacauucuguaggcugagaaagauggaucaagaguucaaggccagccuggacggaagaucaagacugucucaaaaugagccggcuccucucaagaacauugauagcgcuugggcacagccaggaugagaccucagaaagagcaggaccucaccaaaauguuuccacccaauugugaaaaagagcuaaauugcucuuaagucugaugacuucuuuccuuaauuaauuaacaaaugcucauacuaaugaaucagaagagcuuaauucaugucucuauuuugaaaaaaaauaaaaagaagugaaauuguucca

SEQ ID NO: 4640 - RNA, 2585 nt, Mus musculus
auacaaguucucuggagguuuauugaaauauuaauccauacaauauaugacaucuuaaaagaccacuggcuucauauauuuugucauuaacaauucuuuauuugcuguuggguaucauuaauuguuccuaacaugauaaaccacugacucuguaaacaaggaccugcuaggugguacaguggauaauggucuugcugcgaagcugggugacaugggcucaauuccucggacccacaugguggaaggagaucaaugacuccugaaagcuguuccacauucugcccauggcaugcauacacacacauacaugcacucuagaacauacacacacgugcacacaugcacacacacacauacacacaauaaaauccagauguauaaguaauuacuuggcaaaggcacuucuguuuuccaaacucucaaaacuauauuuuuuaaacugaaaagagacuuuucacuuuuacucuaagcgguucagcaguguuuuugcacugagaagugucccaggagcugggaguagcuuagugagugccugccuacauguaugaaacccuacguucaaucuccagcaucgaagcaaagaaagaaauggauugaaccucauucccaaaugcucaugucccucguuuugaaaaccaauaauuuuauuaacugacuaauaacaugguaaggcugguguggugguauaugccuaugaccccagcauuugggaaauagaggccagccuggacuacaccaggagauacucuggcaaaauaacaacaaauaagcaaauauauggccaaaaccaaaccaaacaaauacccaguuuucuaaaaacauuguaacuacaguaaucacuaaagccagcguguuuguuacuaacuucccccaauuacugugccugagcagucagcuggagucaguuacuagaucccacaugaauguucucuccacuguccccacaucccccucgggaucacaugucccuuggaucacguucccucucccuccucccucagugugagcccacauaccaugugcagaggguuuggcagcccuaucuacacagucauaacuagaucuuaccuguuauucaacccacacucuuauuuuggaauaagaagcaaacccuaugggcccugaaaacagaggaucuagguccacccgaagguacuaacugugguaugaccuggagccagucucuugaggcauaggcuuugcaggccacucaguucagagaauggaacagcuuaauuccugaaugcucugaagacuugaggaggcaagucacugaagacuccagagcaugugaaaaggagcuuaugaguccugaggcuuugagccuaagggucaccugguggcacacccaacagugacggugucaaggaggauggagugucugaugaaccuuaacagcaugcacagcagagagaagaauuagagucaucaugggucuuuucggagcuuuuuaagaauuaaagcuuuagcuuuaguccccaagaguacaagccaaaaaaaggucuguuugggaguuggaagugaaggaagagauuugaggaugcucucacagguaaggcgcuugccuagcgugcacaggcgcuuugucugugagcagcuccacaaagacagauagagaaggagaacugagaagacaaacacuaucaccauaaaggcagugcuuaauaaaccgaacuuuagauauggccuguuauaagcuugacuuucuuauucuugaguguuuaacuagcuuaaaucccaguguuccccuccucggauuagaaugggucuuagagggaaauaugggacaccaaagugggaaaggaggagucagggcaagucccauccugucacuuuagugguaaaaacgaaacaacaaaacucacagaacugcaugcugguccuuaagguggugccugcaagugaccauuccacauuagaggccagcacuaugaccuagucuccaaaucuacaaagccaagcuagggcauagggaaucuacagcaggaccaggagaaguacugcuggcagcaauggagggcacacaaccaguucaaggaaugucagaaggaacuaaaacaaacagguagcaaguccuccaagcaguccaucuuguacuucagacccuggguuagcaucaacauuuugugagacucugcucauaaucccagagguccuuuagcaagauuuccaacaccaucagccacugcuaacucuuaaggcuuggcuauccugaaaaccccuuucccugagggcugcagaucauagugguuugggcauacuuagauaguuuuaugguuaauauacuaugguauaaauaaauaaagcucaguguaaauaucuccacugaaaauacauaugcaauaaaaugacaaaucaaacagguuaauaacgaaguccauaauaaauagcucaggcauaagcaugcagagcauuagcagagacucauauagacuagcucucuuugaaaaggaauaaauggggccuagcaaacacagaaguggaugcucagagucagcuauugaauggaccacagggcccccaauggaggaacuagagaaagaacccaaggaacuaaagggaacugcaacccuauagguggaaca

SEQ ID NO: 4641 - RNA, 3663 nt, Mus musculus
caguccccccaccgacuacaccccgggaaggaggagcuucgcgcgcacacaaggcgucagaauccucaauuuccaacuuagcaucuuggcaggaccuuugcaaagccaaaagcagagccccccggugcaaagagcgagggagggggguggggggagagaaagccuagcccgggcaagcggggcgcgcagaggagcgggcgcggcggucgcagccagaggcgcgcgggaagccaaccaggaggcgccgcgggccggagcccgggagccggggcucgaagagcugcggcccggggcagccagaagccaggugcccucucgcucgcccucgcagggcgccgcccggcucguuggccgccgcggcgcggcgcgccccaugcccguguguggccauguccuacccgcagggcuacuuguaccagccguccgccucgcuggcgcucuacucgugccccgcauacagcaccagcgucauuucggggccccgcacggaugagcucggccgcucuucuucgggcuccgcguucucgcccuacgcuggcuccacugccuucacggcucccucgcccggcuacaacucgcaccuccaguacggcgccgaccccgcggcugcggccgccgcugccuucucuuacguggugagugugagcuggguccgaggcgggcgggcgggcgggcgagcgagcgggcagccggggccaggccugcagagcccgguugcgguggacacgggccuaggcgccaccucacccgccaagcuucgcggcccuugcaaacuugagcaauugucuaauucagcuucacucgagccgcgggcuccggaguggcucuggcgaaagccgcgucuugcugggaucgccgagcugaagggaaggcuuuggggcgcggggagggggggggauugauuggucuuuacuauaaagaacggcauuuggcucaaagcucugggacaacccgcaaauuucuucuucuucuuccuccucuuucuuuugguuuugccauguuggaaaaaguaguucaaaagaagccgaccggaauuccaaacaguaguagugugcuaaaucuauguaaauguguuuggccucgccuuuaauuaauccccaaaauguugcaaauccguaauccuaucuucgcaauccgauuuggaaguauuaaauuucugaaacggccagcgagaugcgguguauccggguuuuuacggcggggugugauuucuggaaaagcgcaacggcuucgguuagggauagcauuuuuagaccgucggugugcaagcuaaggcucagcuugucuaucgcauuucuuugaagauuaaagaaagagccuuuccuucccuuguuguaccccuugcgcccaacaugcggccgcucuggagcagagcucugaguuguugcugaggcugcucaggccucuaagagaaccgugggcccuuccgcagaggccagaucugagaccugggcaccgaggucccccagcagaugguggccuccaagguggugugcuaaacccugaacagccucaggggucccgaagggccagaaucagaauuggggggcccugcugccuucugaggagggggaagguggucacucuugcguuuaaaccagccagcucugccucaggggaagcuggagugcgggcccgcgcuggcacucaaaaccaaggacagagggaaaguggguuucagucuuuuggguggcuauguagcccacacccucacucacuuaaccucugccugucccucacagggcucucccuacgaccacacucccgguauggcagguuccuugggauaucacccuuaugcagcaccucugggcuccuauccuuauggggaccccgcguaccggaagaaugccacucgggacgcuacagccacucucaaggccuggcucaacgagcaccgcaagaacccguaccccaccaagggagagaagaucaugcuggccauuaucaccaagaugacccucacccagguguccaccugguuugccaacgcgcgccggcgccucaagaaagagaacaagaugacguggacgccacggaaccgcagcgaggacgaggaggaggaggagaacaucgaucuggagaagaacgacgaggacgagccacagaagcccgaggacaagggcgaccucgagggccccgaaucagguugguggaugcgggaaaggguauguugagcgggacucgaaaggcaaagggggccuggagggggcgcgcacgggucccugccucugcuggcaggaacccgggccuggccgcguggccuccacgccucugacagccuggguuucgcccacaggaggagcagagcagaaggcgacugcgggcugcgaacggcugcaggggccgcucagccccgccggcaaggagaccgaaggcagccucagcgacucggauuuuaaggagucguccuccgaaggccgccacgaugagcugcccaggcccccgcgcgcgggcgaguccuccccggcugggcccgcaaccgcucgucuggcggaagacgcggguccucacuaccccgcgagugugccggcucccggcccgcacccaucagccggagagcugccccccggcucgggcggauccucggucauccacucgccaccgccaccuccgccaccgccuccggccgugcuagccaagcccaaacuguggucucuggccgagaucgccacauccucggacaaggucaaggacgggggcggagggagcgagggcucuccaugcccaccgugcccagggcccaugggcgggcaaacgcuuggaggcagccgcgcgucuccugccccagcgcccgcacgcucacccuccgcgcagugucccuuuccgggcgggacggugcugucccggccucuuuauuacacggcgcccuucuauccgggcuacacgaacuauggcuccuucggacaucuucacggccacccagggccagggccaagcccuacagcggguccuggcucucauuucaauggauuaaaccagacgguguugaaucgugcggacguuuuggcuaaagacccgaaaauguugcggagccagucucagcuagaccugugcaaagacucccccuaugaguugaagaaagguauguccgacauuuaacucuggugcgguauccccggacuuuccuaauuuauuaaaaccauggccuuggcaguuauuuuuccaucaccaagagagagaaagaaaaaagaaauaaacuaccccucuuauucagaaguuuauaguuuauggagauggauggcauaaaaauguauacaucuccacacucgaaaaaauuguuuuagccaacugaaaagaaaaaaaaacuuaaaaggauuuguauuaaaucuuauucuguauauuuaauguagcauuuuuguauuuaaauugauaauucaguaucuuugaaguaaauuaugaaaucaagacaccuguacaggcauuuaauguuuuuguaauauaaauauauacauuuguguucccccaaaacuguuucauaguuuaaaaauacaaguuuaauuuaauuuuuuacaccuauugauuuuuuuccuggguaugagcuaaaauauuauuacagaaaggaagcagguuauacgcuuagauuuaaaaaaaaaaguaagagaaacugcaguggucuuuguaaaaugcaaaauauuuaauuaaaggagauuuuaacauaac

SEQ ID NO: 4642 - RNA, 26137 nt, Mus musculus
cacccuccccucuccacccggugcugccagcacucuuccagcccagccggccacaucuggcgucugcccgcccuuguuuccgcugcauccagacuucccugguggcuggaggcucugugugcauccaggaguuuagauauacaaagggauugccaggaccugcaagcacccgcggcagugguguguauugggacgugggaccccguuaugagcuccugagccccgagaagcagaggcaguagaguaaggggaucgccgugcagggcaggcgccagccgggcggaccccagggcacagccagagaccucagggugacacgcggagcccgggagcgcaacgauggaggcacgaguggccuggggagcgcuggccggaccucugcggguucucugcguccugugcugccuguugggccgcgccaucgcugcaccaucgcccaucaucaaguuccccggcgaugucgccccuaaaacagacaaagaguuggcagugguaaguugcuaugcuggcuuagacaaauuuaggaaauagaagacgcaggccacccucccucuucugacccccucuacuggcacacagccuugggaggaacuuugguaaacaucuuugagggucucuuucuuggccaguugauggagagguuggcuuuuguaaacaacgggggugggggugggggugggggggaggaggcuuugguaagaagaggccacugauaaguaaguugggggaguucaggguacguccaagggaccaggaagaagcaaaggagggagaugauugcccugggaaacaucuggaaaggguugcuuuugugaauaauagggacuuugacuacuuaccuaagggauuugguucuaggagggcuuuauaaaugucuuuuggacccaacaggagagcuggcaacagaaccuuuggcaagcaucuugucaggccuuuagggcaaucaguuuaagggggaaucucuugaaaauggggugugugcuuucgcauauaauuuguauaagccuuuggccacaaaaggauagccaaagcaaggcuuggcaaacuucugggaaacuuuggcacacaucuagagacaggccuuuggugagaugcuggaagggaccauuuggcaaguaauuugaggcuggagggaagcagacugugcauuuugagggaugucuuguuuuaaugcagaaguuguccaggaggguccaaggagaguuucuuugaacuuuucccugggaucagaggacacaaggaaacaacgcgccuggcuggcaggccugaggagcaggagcagaaggccagggcgcguggggcgggggcggacugagccgggcuggggucggccagcggccaguaagaccuccuucuuggccagacuccagagcugcggcuuaguuguugugugagcgugcgccuggcucuagggcguccuggcagcagcauccaucgcauccaucacauaagcuagauggggaggcaacugcaaagcgguacccacucuccauccacuggccauggguugguuuagaugcuuugcugggucucaggacaugucucuuuauugccuuuauucaaucauuuuagaaaucuuccagucagccucuuccccaaucuauccaagacuaggaaucacaugccaugccgggggggggggcggggggggacaccaaaucucuuuccacaaggcuuccuuuacagcaaugguucuuaaccuguggggcgugacccuuguguagacggaaugacuccacucccuaaggcguccauauaacagguggagagagcucaauaagguggccaaggauggugcacaccugggaagaccgggacaggaacguacuggguucaacuuaaagugaaaagccgccccucccaaaagaaaacaacaaaaaaaaaaagaagaaaggaaggaaggacgagagagagagagagagagagagagagagagagagagagagagagagagaaaauaaagaaagggaggaaggaaggaagguaggaagggggaaagggggagagagagagagagggagggagggagggagggagggagggaggaaggaaggaaggaaggaaggaagggagagaaagaaaagaaggaaggaaggaaggaagaaagaaagagagagagagagaaagaaagaaagaaagagagaaagagggggcuuuuaacuuacaugaucugacuuccugcacauccuauguuaaccuacuggccuggugaucucuaaugacugauuuaacuuccagaguggauguuucuuugaagucagagggucauaguggcaccaucuuugugauagauggucagguacuucuagauuccuggaagagugucuggcgcuuaggaaacacucaauacacaucaggcauuguuacuauuacauuacuauuauggucauuacuaucaugcccucuuuuugcccuuugcugagugccuccaagcagguaagagccagucuagaagccggaacuccuagcuccuuuugccauuccagccagacuuccccacguauuuaaguuugcauuugugauucacccacauucuugcgccaggguuugaaccuuacagaguaaaagugccugucuugaucaucaguuuauccugcaguagcacagggauugacacaugguggccuucacacauugcuuguugagcagcugguuguaguuuggggcagaccaucuaaagaauaaggccagcaucuuuuuagaaaugguggagcuaagauuugaacucaggucugcuaccagacccaugccagacacaauccuuaaauuucuucauaagaaaaaaaaauaugaggaaaauaauguauuccuaggucugcugggagguucagucagauagaagcuggggucugaggguucaagcaugggcucuggagcaugaccgcuugaugucaaaucccgauuugccauuugugagugguguccucuugagcaaguuucuuaaguugucugauuuuuuucuuagauucuuccucuuccucugcacgacggggagagagagagagagagagagagagagagagagagagagagagagagagagagagagagagagggagagggagagggagagggagagagagagagaguuacauaagcuaauaucuacugaguuauaaauucaaggaaauaaaaggugguagcuaugcccuuuacaagugaaucaccccacuggugggugacagaacucauuugaaagcccaaggcuccauucacugucuuuagauuccugguuccauccugucccaguuagugaauguuuggcagaaguugggguuaaugggcauugccaucccaauguggaucccgacuuugagaguuccugucucuuucagcaauaccugaacacuuucuauggcugccccaaggagaguugcaaccucuuugugcugaaagauacccucaagaagaugcagaaguucuuugggcugccccagacaggugaccuugaccagaacaccaucgagaccaugcggaagccaagauguggcaacccagauguggccaacuacaacuucuucccccgcaagcccaagugggacaagaaccagaucacauacaggugcccaggagggucuggggggacacagagucaggacccugagggaugugugcuuccuugggaauugccuuccuaguuuaggggauccaugaggugucauuccucagagcugagcauucagggacuuugcauacagaguucuugauguguggcuagguuugagucucauauucacuaaugauugaggcacuggucuuacucucuugcacuuagaguugguacccuugccaaugaaacagggcuaagaaaucugcuccucauaggggcgguugaggagcuacauuagauuaaauguaaaucaaagguuuccacaauguuugauacagagcaagggucuacaaguguuggugauugucauugucaucugggugggucacugggucaaguggaggaagcuugaugaccagcugauaauuguguucuuaaucuuauagugguuuuaugauugguugcuaauugagccaagaccucuccucuaugugccugguaucgaucaagggugagaucucugccuuuuguuugauauuguacuguuuauuucucuggugcccuugucccagacagaaugagggaugagaaggucugagauuguagagacaucaaggcaguauaggaggguguucucagugaguuuugcucaacacaucugcugcacgagaacacuugcacacacacacacacacacacacacacacacacacacacacacacacacacacacaugcacacacaugcacacacacgcacgcacgcacacaugcaugcacacacucuaugcacauagacacuugcacaauugcauauaugcacagucguaugcacuucucccccuucuaggaucauugguuacacaccugaccuggacccugaaaccguggaugaugcuuuugcucgggccuuaaaaguauggagcgacgucacuccgcugcgcuuuucucgaauccaugauggggaggcugacaucaugaucaacuuuggacgcugggguaggcagaacugggcuggagaaugggguagcacagagacaacagggcuagguagucauuugagaagcauggggaucccgagggcagcuuacugagaaguguagacaucggaugcucaucagauggagguagcagagcauguuccagacacuggaaagccacggcugugauagcagaggaugcaguauaguauacccugcuugcagcaaaaacggacugcacccuguaaaugacagccccuagaugcauauggcuacuuggauauaacauaauaagaaagaccuuaacaauuuaaauucaguagucccaauagcaaugcaggaggaaguggaauagaaucuggggccaagcuaccaugugagcuguugguaucuggcagcaguauacguaugaaggcuggugguauggauaugaguagguaaaacaaugaagguggagggcaugggaaaggcaauguggaccuggggguaaguaagggaaacauucuguuacaguagaguccgaaggcuagcucuguggauagugaugacugucuggcaugagaauagagcauagugaggaagauggaguugaugggaggccauggaugccaggaagggauugggcuaucaugcugugguggcacugaagacauguggguggguacaguguuccugauagcaaugaacagagcaaaggucuaucuguggugcaggggagaggaccauguguccucgaggaguaugggccacaggaugggagcaaccaagcgagagcuuuuccauugacucccagugaugcuuauuccauaaaaccccaguaggaaaugugaaagggacagguauuuggagggcugaggaacuccaaacacagauaaggcuguggcugagcuuaaggaugcagcugugggggcagggaaugauaacagcuaagaggcaauguggauuucagagcauggagauggauacccauuugauggcaaggauggacuccuggcacaugccuuugccccgggcacugguguugggggagauucucacuuugaugaugaugagcuguggacccugggagaaggacaagguaagauagcuuccgucagccuucauuccugucuccuagcaaucuaaccccacuuucagcccuucauuugcucugaugggaucagggcaaugggaggaggagggaacucagcuuucaggaugagcccauagcgcaaggcccugagaggugggucucaggcucuguguguccugcagugguccgcguaaaguaugggaacgcugauggcgaguacugcaaguuccccuuccuguucaacggucgggaauacagcagcuguacagacacuggucgcagugauggcuuccucuggugcuccaccacauacaacuuugagaaggauggcaaguauggcuucugcccccaugaaggugagcaucugcccuggccccagcccucacccuacccaggcccucagccuagcuagggguaccugccaugccuacauccuccacauuccacaggccagccaaccuucauccccucaucuaaguguccauuauccugcuuucagcugucacugugucccgccucuacuguguugcuuuaaggacaggcacacauucuaagaaguguguugcucaaguucaucgucacugugugaacauaguauccugacacaagcugagaagggaacagagucuccagucagucugaccucauggaccacugucacauaggacucccacccuguguguguggucuguuguagcuuaaaugcuauuuuuguggugcacaaccauuucugcuuacuuuuucauauuuagauaagugacuuagcuuuauuauuugugagauuauggauuugauuuauugauuauuuuuucuaacauaugggagaaugauuuugaauguaucaacauuuuuuuggagggccacuuuauacuucauacaaacucuaugguucaaggccaggaggccaggagaagagagacaaggccuagagacagaugaagagcuuagcagugggagaggaacaaggcucaguccaagcugguaccugauccaaggaggaucuucagucugagaauauuagccaucccucccaaacugggcccacuguaccaaagagagucacuuaaaguggucagagcuaugccaucugacucugccuucugucccugugccaggacagguauccagcuccauucaguguguguguguguguaugugugugugugugugugugugugugugugugugugugugugugugugugagugugcauucaucagagcucgaaacauuuucccucuucuaccaucuauugaggaaaaagugugaagggcagagggguauugauauccacacucaaucuacuuugaaagcuuccuggacacacuuucuaaucauaaaucuugguaaaaguaugcaugacaucauacuuggccaggccaucucacuugaugguucuaaacaucagaaacccagaaaaaaaauguuggagaaaugagagaaagaaaauacagaccuacuucuaaguauuaguuuauuccccaacucauaaaggcauuucuggaucauagacuaaggacagucuguuugggguaagggggggcuauaauuguauauaauuguauaugguugugacucuuccugccccuauugcaacauaacaguagcaccaaucaucuggacaggggggaaggaacaaagagcuucuaauugccuuccuguuuacauuuccuuuccucugucuuuucgaggcagauccaacccauggccucacacacgguagagcugaucuccuccaccacagacuucuauccucagccuuguuuaugcuuuuaucacggaagcuaaacuuuguaguaagacucaagcuacugacgauuaguaagucagagguucuaaaauaaaaaucugugucuugcauuucccgguuggacaugggcaaagcacagaaacccuuuccagagucagcccuucuguggauagauacagguuccguggauagauaggaaacagccuugaacaucucaagcuuggacagguucucucugugucagacauuggcuauugauuugguccucggccagguucaaguacgcacaaggcacacguguuugggucuuggggcagcgauucugauuacucagccccuccugacggcugauucagugucucuucccugaccuucucuuugggaagagggugggucccagaggagaugggcuucugggugggaucaaaguuaucacuuaacccuccugauucugaaucaccagggccucuggacuuagaucuaucgcuucucuaagcuuuacucuuucugguccaucagggaaaggugucuuguuugggggggaguggagaauagcaaugaagauagagacccaccccccgucccugcacugggaagccagggguugaguucuauucagcuugugguagaguuaacagacccagugaggucaccccuggcacugcuguacacagaugguccucguuacgcacuugugguuuugcuaguuggcaauuccagacacacaccauuuuguaacuccagaguggaugcagggaugggagccuugggggaucucaagacaggcugaccuugauccggucucuccccauucuccagucaugcccuacccuguggucaucagaguaggaggcuaagauaccagcuaccccuucuccuucuccccuccuuucuguggggauuggcuauagcaucaguggagauguccagagaauacugaaacuuucucgagaagucaguguucacugguauuuuagauuuauuuauuuauuuaucauuuuaaacuaguguagguguguaugucuuugugugcguauguacagaugaguguaaguaccucugaggcuagaagcaucaaaucccuguagcuggacuuacagaugguugugaauuauuugacaugagugcugagacccaaacuuggauccucuggaagagcagucauugcuuguaacugcagagccaucucuccagccucuagagauuguuuguaauuaauauuuuuaacagcuacaacuacucuuaaaugaaccagcaagugggugacuagccaagucuacccagccaguuaucucucucaauggcaucuuuucccucucuuccccuccccagccuuguuuaccauggguggcaaugcagauggacagcccugcaaguucccguuccgcuuccagggcaccuccuacaacagcuguaccaccgagggccgcaccgauggcuaccgcugguguggcaccaccgaggacuaugaccgggauaagaaguauggauucugucccgagaccgguggguaucccugccucucuaugcuccucagaggcaagcauuuugacauuuaauacccacuuggcuaccuacagcaucuuccccaagacuagcugugguaccacaaaggcgugggagucagcuguugcaggugugcuauugauuccuggccagcuggcucacagccugcuagccaguuugcacccagucuuucagcucugacacuguaucucccucccucugaccuugaaucuuuccccucaccuucucuugacugcaucgcuucuaugucucaucucuuacucauccuuucucacuguucuuuucuccaacauguguuuacugagccugcuucuugaagcuaaagcagagauuugcguuuguaagacugugugccucaaggcucaucuucuagggcaguguguugagaccaucugcucucucagcccucugggugucuggccucucugcuccuaucuacaaggguccauuucuagacucugaacuauggcuaccuggguuuaaaccuugggucugguacuuaacuuucaaguauuaucugcguagcaaguuucuuaaucucuuugagccucuucaagacaagucccaucuaugacauggagaugucacuauagggucucuccuaugacagggcuauugauggaggugaauaggauggaccaguacccagugagugcauguuaaugucaccgucuugucauugguucccgacuguggccucagauccucugcugccucuugaccucugucuuuuaccccccagcuauguccacuguggguggaaauucagaaggugccccaugugucuuccccuucacuuuccugggcaacaaguaugagagcugcaccagcgccggccgcaacgauggcaagguguggugugcgaccacaaccaacuacgaugaugaccggaaguggggcuucuguccugaccaagguaugaggcccuggccuuuggguagagacacuggacaccccuccacaccugaccuggaacaaccugagguccagacgauggaucaagcauagauauugucucuaaacaagauacccccauuguaccuucagaucuagccuucagagcagaggaaacucugcuccggcagggaagacagguucccugcuuagguccagacaguuuagguggacauucauacagcuucaaaaugagaugacuaggcacugacccugaguggggaucagcccugcuuuugcauuucuuaccuaccacuccagcuacccuuccagacaggacugucacuagcaggagucauugaaagaccuuacuguuggucuuugagcugggcaaccuucacugccuagaugcccaggacuucaguguuucagguagcccaaaauguuuaggcaaggggauggguccaggaucuggcagaauuagguggguuucuauucuagauugauuuuuguuguugugaaugaacacuuagggaggaaagaucuacaaagaggcuuacacucccagauugagggaagucagggcaagaacuuaaggugagaaccuggaggcaagaaccauggcaggauagcacuguguaguuagcucacaggcugauggcaggauagcacuauguagcuagcucacgggcugacgcuuagcuugcuuuccuguacagccuaggguauaugcguagggaacggagcugcaguaagcuaugcucucugcaucuauuaauaauaagagaguuccucggcagcaugccuggagaccaaccugaugaagaucaacagucaacugagaguuuuaacgaugacucuaggcuguguggcauggagaguugaugcucaccgggacacucuuccuucugugaugauugcuuuucucuuguauugaggugcacuuuggugaaugcuggccaaaugagguuuucuuaggaauuuuuucuugcccgccaaaggcuaucauaggagauagucugacaccccugcuuggugcaacuucugccuauggugagaucuccacccaugugaagaguuuguggccacucaggcugccacguacaaagcauaauauacugguggcuuaggacaacauaaacugacucuuccccuagucagaaggcuggaaguuuacaaccaaagugucucuccccaucccccuacccccacccccaugccuguaucaccuuauugcccgcuucagccauuauaugucacucucuggucccuaucggucccuuugucucucuuccuaagagguuguaauccacaguggguuaagggcucguuggcugcaaugaggguagcauuuuaacugauucaucuauuugagacaggguuucacuaugcagcccagauucgucuuaagcucacaacccuacuucagcaugucaagcacuggaauuauaguuagauauaucauucuuggcucuggcuuccauuuuggugaugucugcaaauaagauggcauguccuagguaaccagggacagaauucuauuuuauacuaucaucaucaucaucauuauuauuguuguuguuguuguuauuguuauuguuauuguaguggggcuugugggauaauugagucacagcacggaggguguggcacacgauuugccugcucuccauggccaagccugagcaagccauacaggcaugaauauguuuuguuucaguuuccccaugggacuggauuugcuggcauacacuaggcgaauguuauaucaucaagcugcauucccaggggaguggcuuuuacuuccuucccugggaagaaauggugaaacccugaggccagacucucccucucacucuucuucuuugagauccugagcagcagguuuugugucaacucucacaaagggcuaaaaagcaugcuuuuucacagaugggacuugaagcagaugccccuuucucucgcccucauaccacaugcagccaucauugggaaaaggcaagaggaugcugacuggccuacucaaaagcaacagcacucucagcacaagggaaaaaccaauaugugccacuucuagaacuuuuagcucuacccuggaguuguccucccccaaaccuccuuccuauuaagcaagucuugaugccugucuuauuucucucuugaauuccaccucaugucccugcuuuggcacucaggauauagccuauuccucguggcagcccaugaguucggccaugccauggggcuggaacacucucaggacccuggagcucugauggccccgaucuacaccuacaccaagaacuuccgauuaucccaugaugacaucaaggggauccaggagcucuaugguaagccgcagcuugugggacucugaggggagaggugucuucgaggaucccacagccugggugggaagacgcaggaguggaaaaugccagaccucaucuaguuagaauggccagggacaucaucaggggacauggcucgugccugguccucaggcuuuagaguaaugcuccaaagggcuucugagacagcucuguccuuucuagacucuaguuauccaugccucucuugguucccauuuccaugugcuagguauaugaacugaggcuaagaaaggcguuuagcccaauaucaacuagguuucagcagccagguaggguuuaggauccagaagagggagcugccuacagggcagaauuuucucuggcgugaaauggguguuacuaguucuuguaagaugcucauguuucauuuugccauagaaacauaauaacugcuuccugccaccaaugauggccuauugucugcgcuuucagugagguuagaggcuaaaaagcagccagucaauuucuuaaaaaaagaaaucaauuauauaauaguccuagugguuccuggaccaagcgcguggugaaagugaaaccuggauggggaagcucacggacucugaacuugggaaagaaucagagaugcagacauugaugggugacauugcagucccgcuaaggcuacaugccagcuggaaugaugcaacuguucgccucccuagacuccacuguugcgcagccugaggaguacaaaagcaaauccuuaagaaagugccacaccucuacuggcaccagccagccuucucuguucuuaaaguaagagaccacacaagagucaagcgucuggucccuucucuaagcucaggcucuacccagguagacugcucuuuuuuuuuuguagccuuagccaguuaagugaguaguacagggguugagccuggcgaugagaagccuuguugcuggguagagucuagggucaggugucuccccauucccuagggcccucccccgaugcugauacugacacugguacuggccccacaccaacacugggaccugucacuccggagaucugcaaacaggacauugucuuugauggcaucgcucagauccguggugagaucuucuucuucaaggaccggugagugagguugcuuuugucuuucuuacccucuaaccucuguccuuucccauuguucuugugcccccacuguuguggagggcuccuggagccucacagaaugaccugcaguaagcaguuuuugcuugugucucacaacccacagcucuugguagcuuacaauucaaguggcucucuugaauucugggucaaccagauaucuaagccuuugaaucagcaggucugauauauucuacaugccgcucauucucccauaguuugccuauacuugugguaaaugacaagguguuagaggcuaaaucaaaccauacucauacauugaaagauuucauccaugcaauaucugagaaucuucuaccagugaauucaaagaacauuacuaagcuggccaccccaguccacuucaucccagccuuuaaaagucauaaugugcuaacauauagcaaggcacauauagacaugauucuaaaguaggacagagagaagaauguaggggaauuagucagucuuccauuggccuucucucagaaugcuauugaucucaagugaccaaauugaugucuguauagauagcaagugagguuagguggagggagauuauuuccuucauucuaugaggcccugguaaugacaaaugguugagugucacccuaaugcccuggcugcuugggauaugagaaauaguaucuaggaccucguuaaaaaguccauuuauaugaaaaaaaguacauucauccaucuaucuguccaucaucuauccaucuaguuagaccuacuucaaucuauuaaucugguauauauguauguaugcauguauguaucuuuugaucaauugauccaucuaccaagcaucacuguccuucuguucucuauuaccuuuccauacauugacccaauaauccauucaucuauucguggaguauaacgguuagaaaaaugggcgguggaaguagaaaucuacacgaauucucuacggguuguaucaucaccggcagguucacuauuuccuuuagaccucagcuugcccauuuuuaagauggggcugauauuuuacccuaucaaauagagcaaauauaaggauuagaugaguuuagugcuuagaacaaugccagcaucauuaccugccaucuuaauaaaucauaauuuagcaucuauugugacgguugccuugaaggguuuccaugauaguuacgaaagggaagagagagugccaggaguuaauaucauaucacuguucucagaagaaguacccacacuuccuagaauagaggugauuuucgugauaggaguaccagguuaggaagcauacaucugagauagagauaaaaguuccugauguauacaguguggguuagagaauccacugaggcuaaaagauauccacagaaugucuuccuucuguuccaccaaggguuucucuucagacacagggcaggugugggauacaaaggcucugccuuccccagagucuacgugcucaguaggugauaacaagaagauagagagugaaaugagccucaaaaagcaguaagucagauccaguuaggucuuagugccggaaccagguuuagugauuguagaugcuacugguguccugcuguaccuuguagaagagggagaagagguuaguagggguucuacucuccagcaagguccccagcuugcagcacuugcuucuguggaaacugaucauguaucgagcugccagaugugggaaucucagaaacagcucugagccaaggcuuucuaucagaaggaccuagauguauguucaauggagucauugaauugaucuguaaauaauuaaacaguaacagugccaggcacugggcagacagggcaguacuacaggauccuugaauauggauucuggcauuagauaugaacuuaaauccaggcacuaccauaaucuaucugagugucguuggcaaauuaggaucaugucccugccuugugugugcuguuucaaguaaccacucucucuugcaccagauuaaauaguggaggaaaaguuggucuuucaugguauagugucaagggauaaagcugugcugcuuuaaggggcaaagaaggaccugugauuugucuuuguccauugauaccucugcauggcauguaugccaagauuggguuccaaguugacugccaguggccugagagagagagggggagggagggaaggagagagagagagagagagagagagagagagagagagagagagguguagaggugagacacuagucuaucuguucaaucuugucaugcugauggcaagaaaauguucaguuaaccaacuuuggcaaacagagucacccagaaggcguguucaaacagagucucaaucauaagccagagaauucugcucugcagaugucagguucacauuucuauagcaagcccaugugcugcuggggcugcuggggcugcuggggcugcuggggcugcuggggcugcuggggcugcuggggcugcuggggcugcuggggcugcuggggcugcugauugcaauuugagaucagaggcuuacucaugaccaaccaauacucaaggccacgugcagcugaggauagcuuuugucuuuguaacucaauggcaaguccuguuacaauguugagagguugccuucaccugggaccaauuccuaggaugaggaugagcucaugggcaacaggggcucccugugcugaaggauaauuauaccuauggagcugagaggaagggguuggggggagggagggagggagggagggagggagggagagauagaugcugggcagaucauuaagcucacauguuacaguuaugaguguuacauuuuacaaggcucauccauaaaagugcuuggugcuuaguaugccccugguaaauguagcucuuauuuugccaaagcacauagauccguuccauuuacauucugaaaaugcuccgaaguacugucaguugcugucucagcuggcuucucaucaaauaggacaggugagguaaacagcagacacuccaggcacucagugcugcuguugagagucacugaggaaggacacaggggagggagacagacaaucuagggaggcuuccuggaggagguggggacaagagcaaacaguggcuucccagcccuggcaucuugcagagcagugucccuccuauuccccagugucucucugcaaccuucuuuugaccuugccuccuucugccacccucccauguuucugaguugguuuucugguucucugagcugcagagcgauggaaggcgugacagucugugguccauuccuguuuccagguuuauuuggcggacagugacaccacgugacaagcccacaggucccuugcugguggccacauucuggccugagcucccagaaaagauugacgcuguguaugaggccccacaggaggagaaggcuguguucuucgcagguauguaggagggucucgcuggcccucaguuucuguuuaacuggauccacuucuccaccaaaccacaguucucaggcaccugcagguacugcagcuccauuagggaccugccucaacaucacuccccaaagcacagugucuuuguuaggguuucuguuguguuaaaacaccagguucaaaaguaacucgaggaagcaagggcuuaauucagccuacaguuguacgcaggaacccaaggcaggaacugaagcagaagccauagaugagcucugaacacuggcuugcuccccacugcuuacucagccugcuuucuuaugcacuccaggaccaucugcucagaaguggcaucacccacagugggcuggcgccucccacauugaucacugauuaagaaaauggcccacagguuugccuagaggccaauuuuauugaggcauuuuauuuuugcaauugagucccccuucucagauaacucuagcuucugucaaguugacaaaaggaaaaaaaaaaccuagccaacacaccuuagauuuaucuagcauauuuuauuucugcuaggcacccagcauccaccagccucaccccuaggacaaacauuuccucuccucugggcucuuuguugaucuuuguuuccuuuccucuaagaaaauagaaguuccuuucagugcugauauuucccuaacaacuuuccagggcuagaggcuuagucaguagcuaccuuaguuagaccuuuaagugugugugugugugugugugugugugugugugugugugugugugugugugcaugugugucugucucucucugucucuguuucuguauguaugcguauguguauaugucugaguaugugagucucuuucucugucucucucuguuucucuuucucucuucauaucacugucucucucugucucugucucucucugugugugcaugcauguauguuuguguguguauguguguugggguguggccaugagugaagguguucacagaggcuagaggcauugauucccccuggaacuggaguuacaggcaugucuuaggguuuuuauagcuuugauaaagcaccauggcugaaaguaccuuaggaaaggaaggguauauuugaucuuauaucccaccauccagggaagucagggcaggaacucaaggcaaguaccuggaggcagagguuguaagccacccacauggguaacuuggaaucuaacuccagucuuuaagaauaggaagcagucacagucacaccauuucuucagcccccagcggugggugccucaaguuuaacauaaaauguuuuguuuaaacauguaucgguuugaauagagcguggugucugaaaccuggauacaaacaaacuuuuauacaaggugucuagaauccaaagacgcauaaccuggcgucuagaucccaaagaagcaccacuuuaugaggcuuguuacuucuaucuuuguuuucagacaggguuuuaucagacaacucaggcuggccuuugcauuugcuguguagcccaggcuggccuugaaggcucagcuaacuuacugucucauauacaggcagcuuucaucuccauccuuuggugaccauagguucuggccaagugagcuuuggcucucagggcacuuuguccaagugggaaagaggggcuucuugugguugcuaugacaugugcauuggcugcuuaucuuccacaucgccucccuugacugucaccuuuuaccaccaacuuguaaaacccugugcacaugaguuggggaugcaacucaguugguagaauacuugccuaacaugcacaaagcccugggcuucgguucucagcccuauagaagucaggggugggggagucugccucccuguaaucccucaggagaaugagguagggaugaugagauguucgaggccagccuggguuacaugagcucaucucaaaagaaagugaaauaaaacgugauccugugcucgaggccugccucuagggucaaagcugggaucugagcagaaggucacacccgguugagaaagaccaagcaggcucuucugucagagagaugacaggagggccagguuggccggagguauuucccgacagccaccagcucaucuucugucccuucccucagggaaugaguacugggucuauucugcuaguacucuggagcgaggauaccccaagccacugaccagccugggguugcccccugauguccagcaaguagaugcugccuuuaacuggaguaagaacaagaagacauacaucuuugcaggagacaaguucuggagguaagggggucccagguacaauggcgacauggcuaguuucaugcggaaagacacuauguggcuugauauacacaguguggguagaugucuccucccugguucccagccugccagggaagaggcccuccaaggggagucaggaugcacuuucuuuguaauauuguuaggguaaugcuugccuaaguuuccuuuccuuuuucagcugucucugauugggcauaaagacaucuagucuagagcccccuguuagggcaauguagaagagcugguaacacaguuagagagacuaguggcuauuguugcugguauaugccagaugcuaauuggaaggcccaguguaguacaagucacaguucuuccaacuuuucaccggcaggaaacaguugcaagggguuaaaaacuagcuucaguuccuacagagccauggagugacaacugggcuuugaguccuggcauucuggcccuggagagugucuuuguccuccaaugcccuagaaaccgagggagggaaguugaagguaagggagcagagggaaaugaggaagacagcauccaaccaggcccugggaagccacagacagccucccccaugucugcagcaggcacacucccucuugacugcaggcaucccccacaucacgucaguagcaggcacccuccccuaugucugcagcaagucuggccaguggugcagacuggcagggggagcaguuuacaagcagguggcucuguuccaaguccucugaaaagaaggcucuagcacugagaggcaaaggugaggaugaggggccagagaaagcaguauccauagacauagcuuaaacccacgaguaugcuuacaauccuucacagcuuagcggucaggaaacugagaccuaaagaaacuaacgaacucagucgucccacuuacauguaagugugcuggcccggagauacgccuaaagaugcuuuuccucugucuuccccagugucgccuucacugugccuucugggucauuugaucagugaguggacuagaguucuauagcaccccuccaucucccccaucccacguucuguggcugucauuguauucaagccuuucccaggaacuaguaauggaacucccacacuuggucuggcgucccugaacaaacaauccugcuuccuucauggccucugucuccucccccuucucuuccccucaccccaccagcaacuggccugauucagaagcugcuuaugucccggggcugcccauggcaggguggaauucuggacgcacugcugagauacuuagcaaccuaagcugauugguaucucaagccucaagaagaaaaacagucugucaggaaaccacugagcugaccucggcacaugggcuccggaacacccccggcaugcccacguacugcgaauggcaucccaggcacucugaaucuuucaaaccgaguguggaaggagggagagauggagagucacagacaagugauucgggaaucucagaauccuauaaacccuaggugauuugucugcaaugucugggaaguacucccacagaaccccuccuacacacccuaugugcauauacaugcaagaacaggcaugucccaugugagcaggggugugcauacauacacagacucacaggcccugaaaugucuuccugguuucuuuucaucuuuuuccuugauaaggccucuaauucuagaugcuagaacagauacuguccucugcugagggugcuccaugagccuuugauaaaggggccagacuagaaagggcugaucucagacaggucugucccaggaaaggugacacagaguuugagauacuuucaugggccaugguuguaggggagagagagagagggaaagggggugggaggggggagagggagagacagacagagacagacagagacagacagagacuagggugaucaguuggcuccagcaggccagcugcugcuuuuugaaguccccacugaaaccacagauaagcauucagugucccuuaugugcuuuguauagaauuaggugcuggugaugagcucugauguagcuccucauugucuuccuggagcuuauggugcaaagaggcucaaaaacguuugcaugguuaccaaaccugagucuuacuccagauagaagcucugcauauccuguggauugauuucucauuuaauguagauauuguuaugagcaccauuuucuggaccaaggguacaaaagcggaaguaugucaaagacacccguggaaaaccuaggacacaaaugccucuucugacucuccguuucacccucuacaucuguagacagucauucaagaugacacuugagagacagggaggaagggacaccucuccugacauggcacggcacuguagucuuccuggaugaaaagaacuuucuggaagcaagcugguucauuucucugacccucaccuauacaguggguggggguugauuccugcccucucuuugugcuagggggaauccuuggggcuuggggcacacaucucuguaacauuguaauuucagggauuuacaguggggggcucaguagaggucauguagaugggggguggggauggggauuuugagcuagguuuuggcaacuugggcccugaagaaacagcuuuuccaagaaauuguuauucagaugaagcuacaguugugaagguuuuucugacaguucauggggugauggguugcaagggaacccccuagaaaagacagaugugggauaggcuuugguuggugccccugacugaggugguagggcugcuucuagggaaaaggagguccauccaggaugcuguguggaggaaagaaagcuuggccaucccuagaaugguaccuaaaaggaucugcuuagaaauuucugccuuggaggugagguuugaccuuguuuacugagauagccacaggcacacaguggggggcgcauuagcuuguauaguguuaccucuuuauaauaaauauagcuaguauguugggaggaagacagagggaaagagaagagaggaaaaggaaagcagcaauuuaaaagugcuccaagaaacuugaaacaacagcaaggagaaggauuuccuaacgcuuaagguguuuaccuggauuaaauucagggccugguagaacauguacccugacagcucuggcugggacugcauagcauucagucugcccggugacucacggccuugagcuuacacccaccacauggcauuguaaccucacucucucugagccucgguuaacucccagacauggcuugugauccccgcuugacagaugaagaagcagcaauuuguucaaaccacacaauggaagaauuaugggucugguucacugguccuaggacugcagcagggagucaaagguugccagggaggggcuugagacguggcucagcacucaacagcacuaucugcuguucuccaagugcuggguuuaauucccagcacccauacgguucauaaccaucucuaguucucggggaucugacucccucauuuggcuuuugaggacacuuacucacaugacacacagacauacaugcaggcaaaacacccaaacauaugacaaauuaaaugaaaaaaaauggccuuaaaagaaugaucacuucccuaauccugcugaauaccagacaugggagaaaugcaagcuugugcuucuugguggcagucacacuggcuguugcuuuuagggauugucucaagccauucaauuaggagguaguggugagggauccagacccaggucugacccucacauugcuucuuacuuccccuuugaagggccacgucuuauucccuggacccauucugugccaucggugaagggggugggcaggggauuggccuccacagaagccaucuaugucacccugucucuuuccuagauacaaugaagugaagaagaaaauggaccccgguuucccuaagcucaucgcagacuccuggaaugccaucccugauaaccuggaugccgucguggaccugcagggugguggugagcuacccaggccucuguuagcguuccaggauugccugacccgagccagaaaacagcuccucuuuggcacacacuccugcagggcagucccagaaaacaagccagucccuucagcucagugcugggaaggcagccaguccccugacccuugcuggcccggccaagcuccaggcuguaagaccuagaaaggcccuuacagcugcagagccuggagccccagaagggaagggcugggaggccuccagggaccaggaauauggccuggugcccuaaauucauucuggggguugagccaggcuguauuggguuucucaggaggccuuuuaagcaccucccaucagaagcagggcucuacucaagacaaggcaaacuuugucaugcucugucacuccugcggcagugacccccacuccgcugcuugcuucuuugcagcaucagcacaggacaguaauuggaauuugaaaaccauauucccagggaggcuucugugacucucuaggauccuggaaaugaacucaguuuggcuuucauggcuuauuagaggagauuuuaauucagcaccacaaaggugugugugugugugugugugugugugugugugugugugugugugugugugugugguguggguguggaugcucuuaccaucugcaaagcucauaucccugagcuuccaugggaagugaagaaagaaagccauguauaaucaggugcuccauuaaggauugcugucaaagucccuacugugagcuaggguuuuaaacggaguagacagggucauucauguuuggaggaauucacacauuccagagccucuagagaccaggagggaaaacaguagaaaagaaauaugcauauguguguguguuuggguggguguguauaugugaguaagugugugugugugugugugugugagugugcaugcuucugugcaugugucugagugugggucugacuaugugcacacauguaaaugugcacuauugagugcaugaauuuguacauguguguaaguaugaguguggaccucaguguguguguauguguguguguguuggugaguauaugaguauacguguggguguguguauauaugugugugccuauuuaugagugugcauguguagaucugaauguuugugugugcauguguauggaccugaguguguguguuuguguguauguguacuugagugugcaugugggcuaaguguguggggcacuguguaugugugugagaguuuguguguauauguggcuaagugagugugagugugugggugggucugugugaguguauuuguggggggcugaguguaugugagaguuuguguguaugccugagugugugugugugugugugugugugugugugugcuugagugugugugugugcuugugugugugugagggcugaauaugugcucacggagggacgugauuguugugugacugugugugagugugugggaagucugagagagagagagagagaguuuuauaagaaaccagaggcaagugauucacugacagcgaagggucauuccucagccucugcugacugcugaccugaaagaguagggucugguggguuuauuuauuuuagagguuuaaagagaagccagacauccgcauuuucauaugcuauugccagauguguugacaucuuggcaacucauucagaauuaaagacaaagagaagcaaauauuuauguuuagauucauauucauauuuacauuuauuuauauuuauacuuaaauaugggccuucugcuccccaucccaugauauaugauauauguguuuggcuugugcucagaaaggugcuguugucaccaguagcaaauauugaguaacuuaaucucauaacaaauucuaaguuaguaguuuucaaccugugggucuugaccccucuagggggaucaaaugacccuuucacagggguugccuaagaccauuggaaaaaagauauuuacauuaugauucuaucaguagcaaaguuacacuuauuauguagcaaugaaauaauuuuauggcuggggaggggucaucacaugagaaacuguauuaaaggguaaagacccacaggucaagaaccgcugcucuaagaaguugguacccugaucccuggcuuagagguacagcuacuaagagaccuaacuuccaagccauuccucacauuccucccuuccuccagagggucuucccugguugaaaagcugcuuccccaugccaagcagacuuagcagcucccagggaccuccugcguaucacguaaggucagaguggguccagucucucuucuuucucucucucuuaggucauagcuacuucuucaagggugcuuauuaccugaagcuggagaaccaaagucucaagagcgugaaguuuggaagcaucaaaucagacuggcugggcugcugagcuggcccuguucccacgggcccuaucaucuucaucgcugcacaccaggugaaggaugugaagcagccuggcggcucuguccuccucuguaguuaaccagccuucuccuucaccuggugacuucagauuuaagaggguggcuucuuuuugugcccaaagaaaggugcugacuguacccucccgggugcugcuucuccuuccugcccacccuaggggaugcuuggauauuugcaaugcagcccuccucugggcugcccuggugcuccacucuucugguucuucaacaucuaugaccuuuuuauggcuuucagcacucucagaguuaauagagacuggcuuaggagggcacugguggcccuguuaacagccuggcauggggcagugggguacaggugugccaagguggaaaucagagacaccugguuucacccuuucugcugcccagacaccugcaccaccuuaacuguugcuuuuguaugcccuucgcucguuuccuucaaccuuuucaguuuuccacuccacugcauuuccugcccaaaggacucggguugucugacaucgcugcaugaugcaucucagcccgccuagugaugguuccccuccucacucugugcagaucaugcccagucacuuccuccacuggauggaggagaaccaagucaguggcuuccugcucagccuucuugcuucucccuuuaacaguuccccaugggaaauggcaaacaaguauaaauaaagacacccauugagugacagu

SEQ ID NO: 4643 - RNA, 26137 nt, Mus musculus
acugucacucaaugggugucuuuauuuauacuuguuugccauuucccauggggaacuguuaaagggagaagcaagaaggcugagcaggaagccacugacuugguucuccuccauccaguggaggaagugacugggcaugaucugcacagagugaggaggggaaccaucacuaggcgggcugagaugcaucaugcagcgaugucagacaacccgaguccuuugggcaggaaaugcaguggaguggaaaacugaaaagguugaaggaaacgagcgaagggcauacaaaagcaacaguuaagguggugcaggugucugggcagcagaaagggugaaaccaggugucucugauuuccaccuuggcacaccuguaccccacugccccaugccaggcuguuaacagggccaccagugcccuccuaagccagucucuauuaacucugagagugcugaaagccauaaaaaggucauagauguugaagaaccagaagaguggagcaccagggcagcccagaggagggcugcauugcaaauauccaagcauccccuagggugggcaggaaggagaagcagcacccgggaggguacagucagcaccuuucuuugggcacaaaaagaagccacccucuuaaaucugaagucaccaggugaaggagaaggcugguuaacuacagaggaggacagagccgccaggcugcuucacauccuucaccuggugugcagcgaugaagaugauagggcccgugggaacagggccagcucagcagcccagccagucugauuugaugcuuccaaacuucacgcucuugagacuuugguucuccagcuucagguaauaagcacccuugaagaaguagcuaugaccuaagagagagagaaagaagagagacuggacccacucugaccuuacgugauacgcaggaggucccugggagcugcuaagucugcuuggcauggggaagcagcuuuucaaccagggaagacccucuggaggaagggaggaaugugaggaauggcuuggaaguuaggucucuuaguagcuguaccucuaagccagggaucaggguaccaacuucuuagagcagcgguucuugaccugugggucuuuacccuuuaauacaguuucucaugugaugaccccuccccagccauaaaauuauuucauugcuacauaauaaguguaacuuugcuacugauagaaucauaauguaaauaucuuuuuuccaauggucuuaggcaaccccugugaaagggucauuugaucccccuagaggggucaagacccacagguugaaaacuacuaacuuagaauuuguuaugagauuaaguuacucaauauuugcuacuggugacaacagcaccuuucugagcacaagccaaacacauauaucauauaucaugggauggggagcagaaggcccauauuuaaguauaaauauaaauaaauguaaauaugaauaugaaucuaaacauaaauauuugcuucucuuugucuuuaauucugaaugaguugccaagaugucaacacaucuggcaauagcauaugaaaaugcggaugucuggcuucucuuuaaaccucuaaaauaaauaaacccaccagacccuacucuuucaggucagcagucagcagaggcugaggaaugacccuucgcugucagugaaucacuugccucugguuucuuauaaaacucucucucucucucucucagacuucccacacacucacacacagucacacaacaaucacgucccuccgugagcacauauucagcccucacacacacacaagcacacacacacacucaagcacacacacacacacacacacacacacacacacucaggcauacacacaaacucucacauacacucagccccccacaaauacacucacacagacccacccacacacucacacucacuuagccacauauacacacaaacucucacacacauacacagugccccacacacuuagcccacaugcacacucaaguacacauacacacaaacacacacacucagguccauacacaugcacacacaaacauucagaucuacacaugcacacucauaaauaggcacacacauauauacacacacccacacguauacucauauacucaccaacacacacacacauacacacacacugagguccacacucauacuuacacacauguacaaauucaugcacucaauagugcacauuuacaugugugcacauagucagacccacacucagacacaugcacagaagcaugcacacucacacacacacacacacacacacuuacucacauauacacacccacccaaacacacacacauaugcauauuucuuuucuacuguuuucccuccuggucucuagaggcucuggaaugugugaauuccuccaaacaugaaugacccugucuacuccguuuaaaacccuagcucacaguagggacuuugacagcaauccuuaauggagcaccugauuauacauggcuuucuuucuucacuucccauggaagcucagggauaugagcuuugcagaugguaagagcauccacacccacaccacacacacacacacacacacacacacacacacacacacacacacacacacacaccuuuguggugcugaauuaaaaucuccucuaauaagccaugaaagccaaacugaguucauuuccaggauccuagagagucacagaagccucccugggaauaugguuuucaaauuccaauuacuguccugugcugaugcugcaaagaagcaagcagcggagugggggucacugccgcaggagugacagagcaugacaaaguuugccuugucuugaguagagcccugcuucugaugggaggugcuuaaaaggccuccugagaaacccaauacagccuggcucaacccccagaaugaauuuagggcaccaggccauauuccuggucccuggaggccucccagcccuucccuucuggggcuccaggcucugcagcuguaagggccuuucuaggucuuacagccuggagcuuggccgggccagcaagggucaggggacuggcugccuucccagcacugagcugaagggacuggcuuguuuucugggacugcccugcaggagugugugccaaagaggagcuguuuucuggcucgggucaggcaauccuggaacgcuaacagaggccuggguagcucaccaccacccugcagguccacgacggcauccagguuaucagggauggcauuccaggagucugcgaugagcuuagggaaaccgggguccauuuucuucuucacuucauuguaucuaggaaagagacagggugacauagauggcuucuguggaggccaauccccugcccacccccuucaccgauggcacagaauggguccagggaauaagacguggcccuucaaaggggaaguaagaagcaaugugagggucagaccugggucuggaucccucaccacuaccuccuaauugaauggcuugagacaaucccuaaaagcaacagccagugugacugccaccaagaagcacaagcuugcauuucucccaugucugguauucagcaggauuagggaagugaucauucuuuuaaggccauuuuuuuucauuuaauuugucauauguuuggguguuuugccugcauguaugucugugugucaugugaguaaguguccucaaaagccaaaugagggagucagauccccgagaacuagagaugguuaugaaccguaugggugcugggaauuaaacccagcacuuggagaacagcagauagugcuguugagugcugagccacgucucaagccccucccuggcaaccuuugacucccugcugcaguccuaggaccagugaaccagacccauaauucuuccauugugugguuugaacaaauugcugcuucuucaucugucaagcggggaucacaagccaugucugggaguuaaccgaggcucagagagagugagguuacaaugccaugugguggguguaagcucaaggccgugagucaccgggcagacugaaugcuaugcagucccagccagagcugucaggguacauguucuaccaggcccugaauuuaauccagguaaacaccuuaagcguuaggaaauccuucuccuugcuguuguuucaaguuucuuggagcacuuuuaaauugcugcuuuccuuuuccucucuucucuuucccucugucuuccucccaacauacuagcuauauuuauuauaaagagguaacacuauacaagcuaaugcgccccccacugugugccuguggcuaucucaguaaacaaggucaaaccucaccuccaaggcagaaauuucuaagcagauccuuuuagguaccauucuagggauggccaagcuuucuuuccuccacacagcauccuggauggaccuccuuuucccuagaagcagcccuaccaccucagucaggggcaccaaccaaagccuaucccacaucugucuuuucuaggggguucccuugcaacccaucaccccaugaacugucagaaaaaccuucacaacuguagcuucaucugaauaacaauuucuuggaaaagcuguuucuucagggcccaaguugccaaaaccuagcucaaaauccccauccccaccccccaucuacaugaccucuacugagccccccacuguaaaucccugaaauuacaauguuacagagaugugugccccaagccccaaggauucccccuagcacaaagagagggcaggaaucaacccccacccacuguauaggugagggucagagaaaugaaccagcuugcuuccagaaaguucuuuucauccaggaagacuacagugccgugccaugucaggagaggugucccuuccucccugucucucaagugucaucuugaaugacugucuacagauguagagggugaaacggagagucagaagaggcauuuguguccuagguuuuccacgggugucuuugacauacuuccgcuuuuguacccuugguccagaaaauggugcucauaacaauaucuacauuaaaugagaaaucaauccacaggauaugcagagcuucuaucuggaguaagacucagguuugguaaccaugcaaacguuuuugagccucuuugcaccauaagcuccaggaagacaaugaggagcuacaucagagcucaucaccagcaccuaauucuauacaaagcacauaagggacacugaaugcuuaucugugguuucaguggggacuucaaaaagcagcagcuggccugcuggagccaacugaucacccuagucucugucugucucugucugucucugucugucucucccucuccccccucccacccccuuucccucucucucucuccccuacaaccauggcccaugaaaguaucucaaacucugugucaccuuuccugggacagaccugucugagaucagcccuuucuagucuggccccuuuaucaaaggcucauggagcacccucagcagaggacaguaucuguucuagcaucuagaauuagaggccuuaucaaggaaaaagaugaaaagaaaccaggaagacauuucagggccugugagucuguguauguaugcacaccccugcucacaugggacaugccuguucuugcauguauaugcacauaggguguguaggagggguucugugggaguacuucccagacauugcagacaaaucaccuaggguuuauaggauucugagauucccgaaucacuugucugugacucuccaucucucccuccuuccacacucgguuugaaagauucagagugccugggaugccauucgcaguacgugggcaugccggggguguuccggagcccaugugccgaggucagcucagugguuuccugacagacuguuuuucuucuugaggcuugagauaccaaucagcuuagguugcuaaguaucucagcagugcguccagaauuccacccugccaugggcagccccgggacauaagcagcuucugaaucaggccaguugcugguggggugaggggaagagaagggggaggagacagaggccaugaaggaagcaggauuguuuguucagggacgccagaccaagugugggaguuccauuacuaguuccugggaaaggcuugaauacaaugacagccacagaacgugggaugggggagauggaggggugcuauagaacucuaguccacucacugaucaaaugacccagaaggcacagugaaggcgacacuggggaagacagaggaaaagcaucuuuaggcguaucuccgggccagcacacuuacauguaagugggacgacugaguucguuaguuucuuuaggucucaguuuccugaccgcuaagcugugaaggauuguaagcauacucguggguuuaagcuaugucuauggauacugcuuucucuggccccucauccucaccuuugccucucagugcuagagccuucuuuucagaggacuuggaacagagccaccugcuuguaaacugcucccccugccagucugcaccacuggccagacuugcugcagacauaggggagggugccugcuacugacgugaugugggggaugccugcagucaagagggagugugccugcugcagacaugggggaggcugucuguggcuucccagggccugguuggaugcugucuuccucauuucccucugcucccuuaccuucaacuucccucccucgguuucuagggcauuggaggacaaagacacucuccagggccagaaugccaggacucaaagcccaguugucacuccauggcucuguaggaacugaagcuaguuuuuaaccccuugcaacuguuuccugccggugaaaaguuggaagaacugugacuuguacuacacugggccuuccaauuagcaucuggcauauaccagcaacaauagccacuagucucucuaacuguguuaccagcucuucuacauugcccuaacagggggcucuagacuagaugucuuuaugcccaaucagagacagcugaaaaaggaaaggaaacuuaggcaagcauuacccuaacaauauuacaaagaaagugcauccugacuccccuuggagggccucuucccuggcaggcugggaaccagggaggagacaucuacccacacuguguauaucaagccacauagugucuuuccgcaugaaacuagccaugucgccauuguaccugggacccccuuaccuccagaacuugucuccugcaaagauguaugucuucuuguucuuacuccaguuaaaggcagcaucuacuugcuggacaucagggggcaaccccaggcuggucaguggcuugggguauccucgcuccagaguacuagcagaauagacccaguacucauucccugagggaagggacagaagaugagcugguggcugucgggaaauaccuccggccaaccuggcccuccugucaucucucugacagaagagccugcuuggucuuucucaaccgggugugaccuucugcucagaucccagcuuugacccuagaggcaggccucgagcacaggaucacguuuuauuucacuuucuuuugagaugagcucauguaacccaggcuggccucgaacaucucaucaucccuaccucauucuccugagggauuacagggaggcagacucccccaccccugacuucuauagggcugagaaccgaagcccagggcuuugugcauguuaggcaaguauucuaccaacugaguugcauccccaacucaugugcacaggguuuuacaaguuggugguaaaaggugacagucaagggaggcgauguggaagauaagcagccaaugcacaugucauagcaaccacaagaagccccucuuucccacuuggacaaagugcccugagagccaaagcucacuuggccagaaccuauggucaccaaaggauggagaugaaagcugccuguauaugagacaguaaguuagcugagccuucaaggccagccugggcuacacagcaaaugcaaaggccagccugaguugucugauaaaacccugucugaaaacaaagauagaaguaacaagccucauaaaguggugcuucuuugggaucuagacgccagguuaugcgucuuuggauucuagacaccuuguauaaaaguuuguuuguauccagguuucagacaccacgcucuauucaaaccgauacauguuuaaacaaaacauuuuauguuaaacuugaggcacccaccgcugggggcugaagaaauggugugacugugacugcuuccuauucuuaaagacuggaguuagauuccaaguuacccauguggguggcuuacaaccucugccuccagguacuugccuugaguuccugcccugacuucccuggauggugggauauaagaucaaauauacccuuccuuuccuaagguacuuucagccauggugcuuuaucaaagcuauaaaaacccuaagacaugccuguaacuccaguuccagggggaaucaaugccucuagccucugugaacaccuucacucauggccacaccccaacacacauacacacacaaacauacaugcaugcacacacagagagagacagagacagagagagacagugauaugaagagagaaagagaaacagagagagacagagaaagagacucacauacucagacauauacacauacgcauacauacagaaacagagacagagagagacagacacacaugcacacacacacacacacacacacacacacacacacacacacacacacacacuuaaaggucuaacuaagguagcuacugacuaagccucuagcccuggaaaguuguuagggaaauaucagcacugaaaggaacuucuauuuucuuagaggaaaggaaacaaagaucaacaaagagcccagaggagaggaaauguuuguccuaggggugaggcugguggaugcugggugccuagcagaaauaaaauaugcuagauaaaucuaagguguguuggcuagguuuuuuuuuuccuuuugucaacuugacagaagcuagaguuaucugagaagggggacucaauugcaaaaauaaaaugccucaauaaaauuggccucuaggcaaaccugugggccauuuucuuaaucagugaucaaugugggaggcgccagcccacugugggugaugccacuucugagcagaugguccuggagugcauaagaaagcaggcugaguaagcaguggggagcaagccaguguucagagcucaucuauggcuucugcuucaguuccugccuuggguuccugcguacaacuguaggcugaauuaagcccuugcuuccucgaguuacuuuugaaccugguguuuuaacacaacagaaacccuaacaaagacacugugcuuuggggagugauguugaggcaggucccuaauggagcugcaguaccugcaggugccugagaacugugguuugguggagaaguggauccaguuaaacagaaacugagggccagcgagacccuccuacauaccugcgaagaacacagccuucuccuccuguggggccucauacacagcgucaaucuuuucugggagcucaggccagaauguggccaccagcaagggaccugugggcuugucacguggugucacuguccgccaaauaaaccuggaaacaggaauggaccacagacugucacgccuuccaucgcucugcagcucagagaaccagaaaaccaacucagaaacaugggaggguggcagaaggaggcaaggucaaaagaagguugcagagagacacuggggaauaggagggacacugcucugcaagaugccagggcugggaagccacuguuugcucuuguccccaccuccuccaggaagccucccuagauugucugucucccuccccuguguccuuccucagugacucucaacagcagcacugagugccuggagugucugcuguuuaccucaccuguccuauuugaugagaagccagcugagacagcaacugacaguacuucggagcauuuucagaauguaaauggaacggaucuaugugcuuuggcaaaauaagagcuacauuuaccaggggcauacuaagcaccaagcacuuuuauggaugagccuuguaaaauguaacacucauaacuguaacaugugagcuuaaugaucugcccagcaucuaucucucccucccucccucccucccucccucccuccccccaaccccuuccucucagcuccauagguauaauuauccuucagcacagggagccccuguugcccaugagcucauccucauccuaggaauuggucccaggugaaggcaaccucucaacauuguaacaggacuugccauugaguuacaaagacaaaagcuauccucagcugcacguggccuugaguauugguuggucaugaguaagccucugaucucaaauugcaaucagcagccccagcagccccagcagccccagcagccccagcagccccagcagccccagcagccccagcagccccagcagccccagcagccccagcagcacaugggcuugcuauagaaaugugaaccugacaucugcagagcagaauucucuggcuuaugauugagacucuguuugaacacgccuucugggugacucuguuugccaaaguugguuaacugaacauuuucuugccaucagcaugacaagauugaacagauagacuagugucucaccucuacaccucucucucucucucucucucucucucucucucucucucucuccuucccucccucccccucucucucucaggccacuggcagucaacuuggaacccaaucuuggcauacaugccaugcagagguaucaauggacaaagacaaaucacagguccuucuuugccccuuaaagcagcacagcuuuaucccuugacacuauaccaugaaagaccaacuuuuccuccacuauuuaaucuggugcaagagagagugguuacuugaaacagcacacacaaggcagggacaugauccuaauuugccaacgacacucagauagauuaugguagugccuggauuuaaguucauaucuaaugccagaauccauauucaaggauccuguaguacugcccugucugcccagugccuggcacuguuacuguuuaauuauuuacagaucaauucaaugacuccauugaacauacaucuagguccuucugauagaaagccuuggcucagagcuguuucugagauucccacaucuggcagcucgauacaugaucaguuuccacagaagcaagugcugcaagcuggggaccuugcuggagaguagaaccccuacuaaccucuucucccucuucuacaagguacagcaggacaccaguagcaucuacaaucacuaaaccugguuccggcacuaagaccuaacuggaucugacuuacugcuuuuugaggcucauuucacucucuaucuucuuguuaucaccuacugagcacguagacucuggggaaggcagagccuuuguaucccacaccugcccugugucugaagagaaacccuugguggaacagaaggaagacauucuguggauaucuuuuagccucaguggauucucuaacccacacuguauacaucaggaacuuuuaucucuaucucagauguaugcuuccuaaccugguacuccuaucacgaaaaucaccucuauucuaggaaguguggguacuucuucugagaacagugauaugauauuaacuccuggcacucucucuucccuuucguaacuaucauggaaacccuucaaggcaaccgucacaauagaugcuaaauuaugauuuauuaagauggcagguaaugaugcuggcauuguucuaagcacuaaacucaucuaauccuuauauuugcucuauuugauaggguaaaauaucagccccaucuuaaaaaugggcaagcugaggucuaaaggaaauagugaaccugccggugaugauacaacccguagagaauucguguagauuucuacuuccaccgcccauuuuucuaaccguuauacuccacgaauagaugaauggauuauugggucaauguauggaaagguaauagagaacagaaggacagugaugcuugguagauggaucaauugaucaaaagauacauacaugcauacauacauauauaccagauuaauagauugaaguaggucuaacuagauggauagaugauggacagauagauggaugaauguacuuuuuuucauauaaauggacuuuuuaacgagguccuagauacuauuucucauaucccaagcagccagggcauuagggugacacucaaccauuugucauuaccagggccucauagaaugaaggaaauaaucucccuccaccuaaccucacuugcuaucuauacagacaucaauuuggucacuugagaucaauagcauucugagagaaggccaauggaagacugacuaauuccccuacauucuucucucuguccuacuuuagaaucaugucuauaugugccuugcuauauguuagcacauuaugacuuuuaaaggcugggaugaaguggacugggguggccagcuuaguaauguucuuugaauucacugguagaagauucucagauauugcauggaugaaaucuuucaauguaugaguaugguuugauuuagccucuaacaccuugucauuuaccacaaguauaggcaaacuaugggagaaugagcggcauguagaauauaucagaccugcugauucaaaggcuuagauaucugguugacccagaauucaagagagccacuugaauuguaagcuaccaagagcuguggguugugagacacaagcaaaaacugcuuacugcaggucauucugugaggcuccaggagcccuccacaacagugggggcacaagaacaaugggaaaggacagagguuagaggguaagaaagacaaaagcaaccucacucaccgguccuugaagaagaagaucucaccacggaucugagcgaugccaucaaagacaauguccuguuugcagaucuccggagugacaggucccaguguugguguggggccaguaccagugucaguaucagcaucgggggagggcccuagggaauggggagacaccugacccuagacucuacccagcaacaaggcuucucaucgccaggcucaaccccuguacuacucacuuaacuggcuaaggcuacaaaaaaaaaagagcagucuaccuggguagagccugagcuuagagaagggaccagacgcuugacucuuguguggucucuuacuuuaagaacagagaaggcuggcuggugccaguagagguguggcacuuucuuaaggauuugcuuuuguacuccucaggcugcgcaacaguggagucuagggaggcgaacaguugcaucauuccagcuggcauguagccuuagcgggacugcaaugucacccaucaaugucugcaucucugauucuuucccaaguucagaguccgugagcuuccccauccagguuucacuuucaccacgcgcuugguccaggaaccacuaggacuauuauauaauugauuucuuuuuuuaagaaauugacuggcugcuuuuuagccucuaaccucacugaaagcgcagacaauaggccaucauugguggcaggaagcaguuauuauguuucuauggcaaaaugaaacaugagcaucuuacaagaacuaguaacacccauuucacgccagagaaaauucugcccuguaggcagcucccucuucuggauccuaaacccuaccuggcugcugaaaccuaguugauauugggcuaaacgccuuucuuagccucaguucauauaccuagcacauggaaaugggaaccaagagaggcauggauaacuagagucuagaaaggacagagcugucucagaagcccuuuggagcauuacucuaaagccugaggaccaggcacgagccauguccccugaugaugucccuggccauucuaacuagaugaggucuggcauuuuccacuccugcgucuucccacccaggcugugggauccucgaagacaccucuccccucagagucccacaagcugcggcuuaccauagagcuccuggauccccuugaugucaucaugggauaaucggaaguucuugguguagguguagaucggggccaucagagcuccaggguccugagaguguuccagccccauggcauggccgaacucaugggcugccacgaggaauaggcuauauccugagugccaaagcagggacaugagguggaauucaagagagaaauaagacaggcaucaagacuugcuuaauaggaaggagguuugggggaggacaacuccaggguagagcuaaaaguucuagaaguggcacauauugguuuuucccuugugcugagagugcuguugcuuuugaguaggccagucagcauccucuugccuuuucccaaugauggcugcaugugguaugagggcgagagaaaggggcaucugcuucaagucccaucugugaaaaagcaugcuuuuuagcccuuugugagaguugacacaaaaccugcugcucaggaucucaaagaagaagagugagagggagagucuggccucaggguuucaccauuucuucccagggaaggaaguaaaagccacuccccugggaaugcagcuugaugauauaacauucgccuaguguaugccagcaaauccagucccauggggaaacugaaacaaaacauauucaugccuguauggcuugcucaggcuuggccauggagagcaggcaaaucgugugccacacccuccgugcugugacucaauuaucccacaagccccacuacaauaacaauaacaauaacaacaacaacaacaauaauaaugaugaugaugaugauaguauaaaauagaauucugucccugguuaccuaggacaugccaucuuauuugcagacaucaccaaaauggaagccagagccaagaaugauauaucuaacuauaauuccagugcuugacaugcugaaguaggguugugagcuuaagacgaaucugggcugcauagugaaacccugucucaaauagaugaaucaguuaaaaugcuacccucauugcagccaacgagcccuuaacccacuguggauuacaaccucuuaggaagagagacaaagggaccgauagggaccagagagugacauauaauggcugaagcgggcaauaaggugauacaggcauggggguggggguagggggauggggagagacacuuugguuguaaacuuccagccuucugacuaggggaagagucaguuuauguuguccuaagccaccaguauauuaugcuuuguacguggcagccugaguggccacaaacucuucacauggguggagaucucaccauaggcagaaguugcaccaagcaggggugucagacuaucuccuaugauagccuuuggcgggcaagaaaaaauuccuaagaaaaccucauuuggccagcauucaccaaagugcaccucaauacaagagaaaagcaaucaucacagaaggaagagugucccggugagcaucaacucuccaugccacacagccuagagucaucguuaaaacucucaguugacuguugaucuucaucagguuggucuccaggcaugcugccgaggaacucucuuauuauuaauagaugcagagagcauagcuuacugcagcuccguucccuacgcauauacccuaggcuguacaggaaagcaagcuaagcgucagcccgugagcuagcuacauagugcuauccugccaucagccugugagcuaacuacacagugcuauccugccaugguucuugccuccagguucucaccuuaaguucuugcccugacuucccucaaucugggaguguaagccucuuuguagaucuuuccucccuaaguguucauucacaacaacaaaaaucaaucuagaauagaaacccaccuaauucugccagauccuggacccauccccuugccuaaacauuuugggcuaccugaaacacugaaguccugggcaucuaggcagugaagguugcccagcucaaagaccaacaguaaggucuuucaaugacuccugcuagugacaguccugucuggaaggguagcuggagugguagguaagaaaugcaaaagcagggcugauccccacucagggucagugccuagucaucucauuuugaagcuguaugaauguccaccuaaacugucuggaccuaagcagggaaccugucuucccugccggagcagaguuuccucugcucugaaggcuagaucugaagguacaauggggguaucuuguuuagagacaauaucuaugcuugauccaucgucuggaccucagguuguuccaggucagguguggagggguguccagugucucuacccaaaggccagggccucauaccuuggucaggacagaagccccacuuccggucaucaucguaguugguuguggucgcacaccacaccuugccaucguugcggccggcgcuggugcagcucucauacuuguugcccaggaaagugaaggggaagacacauggggcaccuucugaauuuccacccacaguggacauagcugggggguaaaagacagaggucaagaggcagcagaggaucugaggccacagucgggaaccaaugacaagacggugacauuaacaugcacucacuggguacugguccauccuauucaccuccaucaauagcccugucauaggagagacccuauagugacaucuccaugucauagaugggacuugucuugaagaggcucaaagagauuaagaaacuugcuacgcagauaauacuugaaaguuaaguaccagacccaagguuuaaacccagguagccauaguucagagucuagaaauggacccuuguagauaggagcagagaggccagacacccagagggcugagagagcagauggucucaacacacugcccuagaagaugagccuugaggcacacagucuuacaaacgcaaaucucugcuuuagcuucaagaagcaggcucaguaaacacauguuggagaaaagaacagugagaaaggaugaguaagagaugagacauagaagcgaugcagucaagagaaggugaggggaaagauucaaggucagagggagggagauacagugucagagcugaaagacugggugcaaacuggcuagcaggcugugagccagcuggccaggaaucaauagcacaccugcaacagcugacucccacgccuuugugguaccacagcuagucuuggggaagaugcuguagguagccaaguggguauuaaaugucaaaaugcuugccucugaggagcauagagaggcagggauacccaccggucucgggacagaauccauacuucuuaucccggucauaguccucgguggugccacaccagcgguagccaucggugcggcccucggugguacagcuguuguaggaggugcccuggaagcggaacgggaacuugcagggcuguccaucugcauugccacccaugguaaacaaggcuggggaggggaagagagggaaaagaugccauugagagagauaacuggcuggguagacuuggcuagucacccacuugcugguucauuuaagaguaguuguagcuguuaaaaauauuaauuacaaacaaucucuagaggcuggagagauggcucugcaguuacaagcaaugacugcucuuccagaggauccaaguuugggucucagcacucaugucaaauaauucacaaccaucuguaaguccagcuacagggauuugaugcuucuagccucagagguacuuacacucaucuguacauacgcacacaaagacauacacaccuacacuaguuuaaaaugauaaauaaauaaauaaaucuaaaauaccagugaacacugacuucucgagaaaguuucaguauucucuggacaucuccacugaugcuauagccaauccccacagaaaggaggggagaaggagaagggguagcugguaucuuagccuccuacucugaugaccacaggguagggcaugacuggagaauggggagagaccggaucaaggucagccugucuugagaucccccaaggcucccaucccugcauccacucuggaguuacaaaauggugugugucuggaauugccaacuagcaaaaccacaagugcguaacgaggaccaucuguguacagcagugccaggggugaccucacugggucuguuaacucuaccacaagcugaauagaacucaaccccuggcuucccagugcagggacggggggugggucucuaucuucauugcuauucuccacucccccccaaacaagacaccuuucccugauggaccagaaagaguaaagcuuagagaagcgauagaucuaaguccagaggcccuggugauucagaaucaggaggguuaagugauaacuuugaucccacccagaagcccaucuccucugggacccacccucuucccaaagagaaggucagggaagagacacugaaucagccgucaggaggggcugaguaaucagaaucgcugccccaagacccaaacacgugugccuugugcguacuugaaccuggccgaggaccaaaucaauagccaaugucugacacagagagaaccuguccaagcuugagauguucaaggcuguuuccuaucuauccacggaaccuguaucuauccacagaagggcugacucuggaaaggguuucugugcuuugcccauguccaaccgggaaaugcaagacacagauuuuuauuuuagaaccucugacuuacuaaucgucaguagcuugagucuuacuacaaaguuuagcuuccgugauaaaagcauaaacaaggcugaggauagaagucugugguggaggagaucagcucuaccgugugugaggccauggguuggaucugccucgaaaagacagaggaaaggaaauguaaacaggaaggcaauuagaagcucuuuguuccuuccccccuguccagaugauuggugcuacuguuauguugcaauaggggcaggaagagucacaaccauauacaauuauauacaauuauagcccccccuuaccccaaacagacuguccuuagucuaugauccagaaaugccuuuaugaguuggggaauaaacuaauacuuagaaguaggucuguauuuucuuucucucauuucuccaacauuuuuuuucuggguuucugauguuuagaaccaucaagugagauggccuggccaaguaugaugucaugcauacuuuuaccaagauuuaugauuagaaaguguguccaggaagcuuucaaaguagauugaguguggauaucaauaccccucugcccuucacacuuuuuccucaauagaugguagaagagggaaaauguuucgagcucugaugaaugcacacucacacacacacacacacacacacacacacacacacacacacacacacacauacacacacacacacacugaauggagcuggauaccuguccuggcacagggacagaaggcagagucagauggcauagcucugaccacuuuaagugacucucuuugguacagugggcccaguuugggagggauggcuaauauucucagacugaagauccuccuuggaucagguaccagcuuggacugagccuuguuccucucccacugcuaagcucuucaucugucucuaggccuugucucucuucuccuggccuccuggccuugaaccauagaguuuguaugaaguauaaaguggcccuccaaaaaaauguugauacauucaaaaucauucucccauauguuagaaaaaauaaucaauaaaucaaauccauaaucucacaaauaauaaagcuaagucacuuaucuaaauaugaaaaaguaagcagaaaugguugugcaccacaaaaauagcauuuaagcuacaacagaccacacacacagggugggaguccuaugugacagugguccaugaggucagacugacuggagacucuguucccuucucagcuugugucaggauacuauguucacacagugacgaugaacuugagcaacacacuucuuagaaugugugccuguccuuaaagcaacacaguagaggcgggacacagugacagcugaaagcaggauaauggacacuuagaugaggggaugaagguuggcuggccuguggaauguggaggauguaggcauggcagguaccccuagcuaggcugagggccuggguagggugagggcuggggccagggcagaugcucaccuucaugggggcagaagccauacuugccauccuucucaaaguuguaugugguggagcaccagaggaagccaucacugcgaccagugucuguacagcugcuguauucccgaccguugaacaggaaggggaacuugcaguacucgccaucagcguucccauacuuuacgcggaccacugcaggacacacagagccugagacccaccucucagggccuugcgcuaugggcucauccugaaagcugaguucccuccuccucccauugcccugaucccaucagagcaaaugaagggcugaaagugggguuagauugcuaggagacaggaaugaaggcugacggaagcuaucuuaccuuguccuucucccaggguccacagcucaucaucaucaaagugagaaucucccccaacaccagugcccggggcaaaggcaugugccaggaguccauccuugccaucaaauggguauccaucuccaugcucugaaauccacauugccucuuagcuguuaucauucccugcccccacagcugcauccuuaagcucagccacagccuuaucuguguuuggaguuccucagcccuccaaauaccugucccuuucacauuuccuacugggguuuuauggaauaagcaucacugggagucaauggaaaagcucucgcuugguugcucccauccuguggcccauacuccucgaggacacaugguccucuccccugcaccacagauagaccuuugcucuguucauugcuaucaggaacacuguacccacccacaugucuucagugccaccacagcaugauagcccaaucccuuccuggcauccauggccucccaucaacuccaucuuccucacuaugcucuauucucaugccagacagucaucacuauccacagagcuagccuucggacucuacuguaacagaauguuucccuuacuuacccccagguccacauugccuuucccaugcccuccaccuucauuguuuuaccuacucauauccauaccaccagccuucauacguauacugcugccagauaccaacagcucacaugguagcuuggccccagauucuauuccacuuccuccugcauugcuauugggacuacugaauuuaaauuguuaaggucuuucuuauuauguuauauccaaguagccauaugcaucuaggggcugucauuuacagggugcaguccguuuuugcugcaagcaggguauacuauacugcauccucugcuaucacagccguggcuuuccagugucuggaacaugcucugcuaccuccaucugaugagcauccgaugucuacacuucucaguaagcugcccucgggauccccaugcuucucaaaugacuaccuagcccuguugucucugugcuaccccauucuccagcccaguucugccuaccccagcguccaaaguugaucaugaugucagccuccccaucauggauucgagaaaagcgcagcggagugacgucgcuccauacuuuuaaggcccgagcaaaagcaucauccacgguuucaggguccaggucagguguguaaccaaugauccuagaagggggagaagugcauacgacugugcauauaugcaauugugcaagugucuaugugcauagagugugugcaugcaugugugcgugcgugcgugugugugcaugugugugcaugugugugugugugugugugugugugugugugugugugugugugugugugugugugcaaguguucucgugcagcagauguguugagcaaaacucacugagaacacccuccuauacugccuugaugucucuacaaucucagaccuucucaucccucauucugucugggacaagggcaccagagaaauaaacaguacaauaucaaacaaaaggcagagaucucacccuugaucgauaccaggcacauagaggagaggucuuggcucaauuagcaaccaaucauaaaaccacuauaagauuaagaacacaauuaucagcuggucaucaagcuuccuccacuugacccagugacccacccagaugacaaugacaaucaccaacacuuguagacccuugcucuguaucaaacauuguggaaaccuuugauuuacauuuaaucuaauguagcuccucaaccgccccuaugaggagcagauuucuuagcccuguuucauuggcaaggguaccaacucuaagugcaagagaguaagaccagugccucaaucauuagugaauaugagacucaaaccuagccacacaucaagaacucuguaugcaaagucccugaaugcucagcucugaggaaugacaccucauggauccccuaaacuaggaaggcaauucccaaggaagcacacaucccucaggguccugacucuguguccccccagacccuccugggcaccuguaugugaucugguucuugucccacuugggcuugcgggggaagaaguuguaguuggccacaucuggguugccacaucuuggcuuccgcauggucucgaugguguucuggucaaggucaccugucuggggcagcccaaagaacuucugcaucuucuugaggguaucuuucagcacaaagagguugcaacucuccuuggggcagccauagaaaguguucagguauugcugaaagagacaggaacucucaaagucgggauccacauugggauggcaaugcccauuaaccccaacuucugccaaacauucacuaacugggacaggauggaaccaggaaucuaaagacagugaauggagccuugggcuuucaaaugaguucugucacccaccaguggggugauucacuuguaaagggcauagcuaccaccuuuuauuuccuugaauuuauaacucaguagauauuagcuuauguaacucucucucucucucccucucccucucccucucccucucucucucucucucucucucucucucucucucucucucucucucucucucucucucucuccccgucgugcagaggaagaggaagaaucuaagaaaaaaaucagacaacuuaagaaacuugcucaagaggacaccacucacaaauggcaaaucgggauuugacaucaagcggucaugcuccagagcccaugcuugaacccucagaccccagcuucuaucugacugaaccucccagcagaccuaggaauacauuauuuuccucauauuuuuuuuucuuaugaagaaauuuaaggauugugucuggcaugggucugguagcagaccugaguucaaaucuuagcuccaccauuucuaaaaagaugcuggccuuauucuuuagauggucugccccaaacuacaaccagcugcucaacaagcaaugugugaaggccaccaugugucaaucccugugcuacugcaggauaaacugaugaucaagacaggcacuuuuacucuguaagguucaaacccuggcgcaagaaugugggugaaucacaaaugcaaacuuaaauacguggggaagucuggcuggaauggcaaaaggagcuaggaguuccggcuucuagacuggcucuuaccugcuuggaggcacucagcaaagggcaaaaagagggcaugauaguaaugaccauaauaguaauguaauaguaacaaugccugauguguauugaguguuuccuaagcgccagacacucuuccaggaaucuagaaguaccugaccaucuaucacaaagauggugccacuaugacccucugacuucaaagaaacauccacucuggaaguuaaaucagucauuagagaucaccaggccaguagguuaacauaggaugugcaggaagucagaucauguaaguuaaaagcccccucuuucucucuuucuuucuuucuuucucucucucucucuuucuuucuuccuuccuuccuuccuucuuuucuuucucucccuuccuuccuuccuuccuuccuuccucccucccucccucccucccucccucccucucucucucucucccccuuucccccuuccuaccuuccuuccuuccucccuuucuuuauuuucucucucucucucucucucucucucucucucucucucucucucucucucguccuuccuuccuuucuucuuuuuuuuuuuguuguuuucuuuugggaggggcggcuuuucacuuuaaguugaacccaguacguuccugucccggucuucccaggugugcaccauccuuggccaccuuauugagcucucuccaccuguuauauggacgccuuagggaguggagucauuccgucuacacaagggucacgccccacagguuaagaaccauugcuguaaaggaagccuuguggaaagagauuugguguccccccccgcccccccccccggcauggcaugugauuccuagucuuggauagauuggggaagaggcugacuggaagauuucuaaaaugauugaauaaaggcaauaaagagacauguccugagacccagcaaagcaucuaaaccaacccauggccaguggauggagaguggguaccgcuuugcaguugccuccccaucuagcuuaugugauggaugcgauggaugcugcugccaggacgcccuagagccaggcgcacgcucacacaacaacuaagccgcagcucuggagucuggccaagaaggaggucuuacuggccgcuggccgaccccagcccggcucaguccgcccccgccccacgcgcccuggccuucugcuccugcuccucaggccugccagccaggcgcguuguuuccuuguguccucugaucccagggaaaaguucaaagaaacucuccuuggacccuccuggacaacuucugcauuaaaacaagacaucccucaaaaugcacagucugcuucccuccagccucaaauuacuugccaaauggucccuuccagcaucucaccaaaggccugucucuagaugugugccaaaguuucccagaaguuugccaagccuugcuuuggcuauccuuuuguggccaaaggcuuauacaaauuauaugcgaaagcacacaccccauuuucaagagauucccccuuaaacugauugcccuaaaggccugacaagaugcuugccaaagguucuguugccagcucuccuguuggguccaaaagacauuuauaaagcccuccuagaaccaaaucccuuagguaaguagucaaagucccuauuauucacaaaagcaacccuuuccagauguuucccagggcaaucaucucccuccuuugcuucuuccuggucccuuggacguacccugaacucccccaacuuacuuaucaguggccucuucuuaccaaagccuccucccccccacccccacccccacccccguuguuuacaaaagccaaccucuccaucaacuggccaagaaagagacccucaaagauguuuaccaaaguuccucccaaggcugugugccaguagagggggucagaagagggaggguggccugcgucuucuauuuccuaaauuugucuaagccagcauagcaacuuaccacugccaacucuuugucuguuuuaggggcgacaucgccggggaacuugaugaugggcgauggugcagcgauggcgcggcccaacaggcagcacaggacgcagagaacccgcagagguccggccagcgcuccccaggccacucgugccuccaucguugcgcucccgggcuccgcgugucacccugaggucucuggcugugcccugggguccgcccggcuggcgccugcccugcacggcgauccccuuacucuacugccucugcuucucggggcucaggagcucauaacggggucccacgucccaauacacaccacugccgcgggugcuugcagguccuggcaaucccuuuguauaucuaaacuccuggaugcacacagagccuccagccaccagggaagucuggaugcagcggaaacaagggcgggcagacgccagauguggccggcugggcuggaagagugcuggcagcaccggguggagaggggagggug

SEQ ID NO: 4644 - RNA, 41583 nt, Mus musculus
cugaaauggaagaacaguggacuuagcuuccccuuuauuuucaugugcagccuggaaaggugucaaagacaagcucagugcuuccuccuccaaguaaaacacaggagcgaccacgcccucccaguugaacagcauuauaaaccacgccccucccaguugaacagcauuauaaaccccaacccaaacggcacacacagagcagcgugggacuccacugcccccacaccacacuacaagagauuuuccuuuuuauuauuguugcuuuacaauaaaaacaaauugcuacgcucucagcaaaacaaaguaaaacaaaacaaaaacccacaggaauuuaacuaacagcaguucaagguaaggcuuuugaaagauuuauugaaauaaauuaucuucaccuaggcgccuguuauccuuucucaguuacuuaucaacagucuaaaaacuuccagguauguaaaauacauuuaacuuugccaauaauuuuagauaauacuggauuuuucccaaaaggacuaccauaaaacuauguuuugaaacauuaaaaaaaaaaaaccuuaauccaaugggacauaaaacuauguauccuaugauugcauguuucaaauccuuaaauacguggagaauuugagccgaucugggaccgagucugcuugaggcauguggauuauucaacauccucuguuuccguuuaaugagacccacaggaacaaaagcagggaacucaagggcuccagggacaaagauacgaaagguguuucuucagcaguguccuccaaacaccccugcccuugcugggcaggccccaugccuuuuuccaaggaucaaacccauauguuuagcauagccuaauuggguugaccaaggaauuaaagucauaaccaaaggaaaggaagaggcggcagccaugggggcaagcuucugugaugcgagagcaccagagugacggaagugaagccagcuggggacugggcucagauugguccugaauguuaagggcagaaaagggccuccucauucugcagcccugagcuuccucuuucuacuccagguaccaaaccaguucuuucuacaccauguccugcuggucuagagguccaggcgccugugggacuggccuccucccuaagcacagcauuuaaucguaggcuacuuugccauagugguggucaggcuccugcugcgcaccuucugacugcuguuaugcacccuccccaagauccgugcuuccuuccagcuguggugcuaaaauacucaacaucugcugugguuuauaucaaaacagaaauucaaacuagcugcugcaggcaggcgagcgccccagugcccacuucuuuuugcucguccccuacucccaacaaguccagucaacaccagaagaggccaugccuagaguuaaaaugugcaauguuucuaaggggaagagaaaugucacaaagaaaguauuacaaaggauuaaauuugucagcuguccacacacuaaagaccacaugcuuuaugcagcagcaaugcagucgcaggucuccacacagcaggcagaacugggacaggccucuuccgguagguagagcugggcaggaggcugaggaaggugaggaagcacuagguuguccguugccucugaagucuccgcucagcagcggcugccagcauccuucggcgcagggucacggggucagaggaugugccuucagaagggaggagucucucugaggccccaucaucuucagaacuuuuguuuaagaaccgccuauaagaaauaaagccacaagagagagaaagaugggaaacgggaagacaguuuccccuucuccacaggcaucuucacaaagcugucacucaagcccauccugugaugagaagagccuugcccauggcucggguacagugcagcucagcagcagggcgcuugcucaguguguguaaaacccuguacucaacccaaaacuauaaaaggagaggaagcgaggaagaaggcagagccaagaaggaugcagagggaagaagccaggcaggaggccagcacagacucguccauggaugaacauaauucccagggagaggaugaucaaauggcaguucaacuuucucugcucucccucucucccucccacagacagcacugggucuuauggcaacaggucugugcaaggcccacaacccagcugcaagaacugaaguaaguuucuucccacccccaagcacagugcaugcuccagccaccaccaacugcagggaacucauggaucgcaggugccuggcucagacugccgguccaaggaacagugcucaagaggaaucuuaaaggcagaccucccucggguccuggcaggauuaaccacccuaaguaucgguuuauuaccugugucugucacauggguuaacaguguuccuccucagagccaauucagguauaggcugagacacauuggcacccgacugccaucugccccguaacuuaugugugccaacuagggcuggagaaucaacucacuuucgagccugcugcaggaggucauccuugcgcugaacuaacaugcgcugucucucaucagcagacuuggagaagcggcuuccacgggccucaaagucuuccaccucaauaggcucuaguucuaccucacugaaguccaaggucuccucuaggcgaggacugagguccagugguacacgcuccgucuggacagagaggcagcuguuaacacaggccuuugccuucccuugacaagugcaccccuacacaagugucugcuggaacuuuugccagacaggaagcagaagcaggagucuugggcucugaggaggcauaccaccagggccugcuccaaucacgaaugugauacgggaaacgggacucuaacaguggggucuagcaggcaaaaguaaguuacuagugucaggccuuccaaggugauaacccucuccugucucugcccugcucacugcuuucuagccugugaugaugaaauuuccuccaucaaaagaucuggucaccaugaacucaacuaccccagcacaccuccccacugugacagacuaaaacucucuccaacuauuaaccagaauacacagcucuucccuuaagcuguugcugccaagggcaagguggccguaaguaacgcaggaccacgcugcacuccugcagcacagcuccugguaagcugaccucaccuggacagaagcuucucccuccuccaggucagggcugggccucuccacugggcuguucagugcaggccucaggcuauccgaccgcugaaagaaagcaugcagucauucaggguggggugacaaaggggcaggugacaguuuucgacacagcucacagccugaaaggugagacgaaggauguggaggcccucauggaguuccauguuugagaguaguuaguaacugcuccauauucagcuuccuguucaauaauagugauugcacaacaaaagcaagggcaaaggucaacugcgcggaguaaacacuguucccgguuuucauaaccuuccuaaagugcucugaagcaggcauugcaauuaagucuccagacuagagauguucuggguccuccccacaggcuuuaucgcuuaaggucugaguaccuucaugucugcugucugguuuauguguuucacugacagcccuauccagccauaugaggcaacucugccagcuccaaaggcagcuaacaaucaggucagagagcugagacccaagggaccauauagcuagcaccuuagcccagcugucuccaaaggcuacacucgucaaaagagcuucaucuuuuugaauuguauugauauauuucuguucacuuauaggcuguacacaggaacuuuugguagaugacugucuggccuuauauuacauuccucaguauuacugaaggcuccucucuugcuuuuucugugccucucucagaggccgagugaugaggcacaaacucugaccuuuuuaaugaaguccaaaguccaagccucagcucccugagagaugugaacugucacuaacacaccacaugauguacaaccagccuucucuuggagugccagugcuccauaaaccauagccccauguucgccccucucuacuucuacaaagaauguuuuacuggaccacagucuugcucauccacauccucacugccaauggccacuuuauuugcagcagacuguggaccaagcagagccuaaauagucacucuuugcucuucacaaaaauagaugccagccucugacaggagccaauggcgucccgguacagaccugcagugagggaaagcugauuugggguauguuucugcauaaaauguacuuggauuaucuguauuuaccuuugguuaaucuguucucaugaaagauuugaaugaaaugaaauucauauaaacccuuccucaaauuauaaauaauauuuagguguuaggacuaauucuuuguaaaaauaaaauacauuuguuaggcauaaagcuccaguuuuaccugcguggggaaagguacuugaauccguccuucuaagauguuaucuguuguuaucuccacggagcgugucaucuggagguccuggagcacaaggugguacgggaccugagggaacaucuccugaaucugaugagccuagagaaacaugaaggacacacagcaaaggucacucucagcagauuugagggucaguacgcacacuuggcaggcccuggacacagaggcugacaucauuaucuugaaagcacagguaaaggccauuuuggcucagcagaucaccugcacacugcuuucuuuuuauuguuguaggguacuagacuucugggauaccagcaauuucaaaguaaagagcagacagaaaucuaguaguaucucaagaaagggucaagucagaguaucuucuggcuuuaaagaucuauuugaugacuuuaugugugccaguaucuaccuacguguauccuaagcuaacaggauccuucuaaaguucgauguucagacacagcauguguaguauucauauccacuaugccaagggagagccagacugggacuccauuagaugacaucuggaaacaggcacagggagagggaaagcagagcaauguggggcugggcguucugcucaggagcuugucuagcaggcaggaggcccuggcuggggagaaacugaccucaaaagaaccuuggacccacagagaggagcagcagagccacucugacucuuguuagauuaagucuacacagcugugugagcuaaacuugagauuaaccaaagcacauuuuuacugcauacaaauaauaagcgcaacuuuaaaaaauagaauuaaagaauguaaguuucuauaugcaaaacguaaaauauauuuuuuaauuuauaaacuuuuuuuuuuaagauuuauuuauuuuguguaugaguacacuguagcuauuuucagacagaccagaagagggcaucagauccuauuauagaugguugugagccaccuugugguugcugggaauugaacucgggaccuuuggaagagcagucaguggucuuaacacugagccaucucuccagcccaucuuuuuaauuuauaaaagucaauuuuuagccaggcauggugacaugccacucucacucuagcacccagaggcagaggcaggaggaucuauaaguucaauaccaaccuggguacauacuaggauuaugaaaauaucuaguacugccucagaacuacaauuuucaaacaaugcucuagauccaucacugcacacacuuagagguuuagccauguguguacaggacaaauacauaaauuuccauccauacuucaaauucauccauacuuccauucaagcaccucaaaacuugugugugugaacacaugcauguguuuuauacauauaaauauauuuuauaaaugcuugcauucuagguuuguauuguagaaaaaucuccauaauuuacagagcaagagagaaaagagagaggaagaagcaggaaagaccacugccuuggaguacgacugaaugucaguuuccuuuuuucuuuuuuuguuuguuuugcuuuuuucuuuucuuuuuuuuuuuuuuuuuuugguuuuucgagacaggguuucucuguauaucccuggcuguccuggaacucacucuguagaccaggcuggccuggaacucagaaauccgccugccucugccucccaagugcugggacuaaaggugugugccaccacugcccagccuggaugucaguuucaaaggagcacagcaucacaaacugcacgugauggcuugugucucagcacugcaacugaaagagcagcucaggugaaaacuguccagagcuuugcugagucacuugggagagacaauggcaagauguucagugcccagagggcccaaggcuccgcaucacuggagacccccucacagcauguggacuggaaggaacauuuuaucccaaucaaaucaaagcaaagugggaagagucucuacaagcauucuccccuccucaccuagcucuccaccaauugaggaaaagaaaaagggaaacaaagcuggauccauuuuauugaacuuucuaucauaaaucuuucuaccagaaaauccagucaguuaaauacuagauuuuaauuaaaaaugcauaguuccaguaaauucguugugcuaaaaauuaguuauuugaaucaucugaaguagacuaaagagcugauagggccuaccuaagauuuuaaaccaaccccuucucaggaggcucacaccuccuggaaugaagcuguugccagccagagucagccaagagcccuccagcgcucuuccaucccagagcaccuauguuuguuuacauggugaugaucucagaggaaggagcaagagggagacagcaggagccguguauccugcauuuucuauguuugcugugaucaaaaaccauuucuauccugucuuuuuauccgcagcuuuucccuuugcauacuggccucgcaugucuccacaggauagcaagggccagaauccccacagcuuuaaggcacuauuccacuauaugcacaaguuuccucucuguccauucauucacauucaaacugcuucuacuucuagccuacuguaagccaaucaaucuuuccuuuuucacccaaaccccaaacauuguccgcagcucuaucaccccuccuucugucuuuaaagcucucuucccuuccccacuuccacccuaccccuucaccugaagggugguacccuugcagucaguauuucuccugguuuuguaccucaacuucuacuuuucuaaagaucauuccuagucacacauuccucacuaaaaaacaacccauggcugugcucucuaaucccaauacucaggaggcugaggcagggggaucaugaguucaagccaaccuggacuagagaaccuaucuccgaaagcagggagacgaggguguagugcaguagcaaaacccuugccuagcaggcccaggcccuagacuuaguguccagcaugaggaaagaagagaaggggacagaggcagaggggaggaaagaaggagcccgaacauauaagcaauacccaggauuaacucccaagagcuccaccagggagggagagaccagggagggagagaggaagggaugaaaaagaaaagaauuuccuuugacaaacccuucccaaguucccaguacaaccucaccacagccugagcaacuguuuccuuccuauacaccaaccaucuugccaaccuuugagcuuacacacaacccacccuucccaagaagacucuugucugccuugagggcacugcaauugcugagcugaguacaguccacucacagagacacacuuuuuguuccuuugcuuguuuguuuguuuuuguuuuuguuuuucgagacaggguuucucuguguagcccuggcuguccuggaacucacucuguagaccaagcuggccucgaacucagaaauccuccugccucugccucccaagugcuggcacuaaaagcaugcaccaccacacccagcucagagacagacuuuuagccagguuugguggcacaugccuucaguuccaacacucaggaggaaaaaaggcaggcaggcuguucuacauagaauuccaugucagacagaacccuauuccaaaaaccaaauacacagcuucagaaaaauacaaaaacaaaaaguauuuggacaauuuccuugagccaacagcaugccucaaaguuacaaggugcagagacaugcacacacacacacacacacacacacacacacacaacacuuuggaggcaaagaaacaaaaaaaauguauuugauaauucuuauguaauucuuuauauuguucacucuuguugauacuuccuucugaauguuugcuuaaaucaaggagucucagcgugggcuugggucacaguaagguagaccugguagugagcacugccacagguaaaacacaagcaaguucccgacuggugugggcugccugccuuacuaccugagcacucacuagucagcaccagcuuauuaucgugucaaggcucugagguagcacucuuaguacauucaggccuggauuuaaucuuuuguuccagacagggagagaagaggggagggagacaaagaagagaggagugaauggaaagaaauggaaguggucccugaaaacuuggcugugcuaugagaaaccagcaaggucaugcacccuauccccgccacccuauccccgccacacuauucacaugucauggagcuccuugugcccuccugaccacucacuaguucucaucuuaaacagucagcaauucuuaccauggcauuuagcugagaguugcuugccugcgugaugccaagaauguugguagugugcaucacuucaacugaaaaacuuggcagccagcuugcaauccgggacccuaagacaaaucagaguccaacacaagaauuagugcccuggucccugccccagugucaucuguuuccaggcacucuaccaagugccugagggcuuucuuuaugcuuuccuuuuuugccaaguguuuucuccagauuaguuuauucuguccucaccaaaaccuacacgugcuuuccacuccccugagagaugugacucuggccccaaccuuggucuuuggucccugaggcacugagaaguuagggaaacacauccaagaccacacagguuaaugacguggcagaacgugaggccagacagccauuccaccugcaaucccuucucucgucaaggguucccaugacuccgaaacugcucuagcagcucagguccacuccucugcuacaaccagcacaaauuacuccucauguggaugagccauuuccaucauuaccuucaugaaguacuuucugcuuaauauaacuuaaccuuggucugggcauugugcugaaugccuuguuuuaaauagguauagggguguucucuuacccauucaagagagguacacaccuccauucccuaauauacaccuuuacucugaucauuugggagacagaggcagaaggaucucugugaauucaaggucagccuggucaacauagugaaccccaagccagcaagggcuacacaaugaaacagugccuugcggaaugggggguugguuaccuuaguuuucagauuauaaauucuuuuucaaagcguucuccaacauagguuuguggagugauguaaucauuagcaggugucguuucuauuguuuuaggaucacaauucaaagccaucaugugccaacuacaaaacauucagaucaagcuucagagcuucaugugugggguuguauugcuuuacgaccaagcugcagcaugcgauacaagggaucuugccaaaacaagggacaaagugaugggauauauauauauaucuccaucuccaagaucugccaacacauuucagaagcuguaccuaguaagcaagucugguggugcaggucuguaaucccagcuucuugggagguacagacaagagaauuaacaagugaaaagccagccugagaaacaucaugagacccugucucaaagagaaaucagaaaauggcuggaacuacauggcucagagguaaggggcuggacuagcacgcugaggcccacauggaagaguucagcacugagcgagaacaagcuugugcuuggcucuuaggaaucgcugucugucuggaagcuuuaccugucaaauaaagcugacuggcuggcuguagcugaggcaggaaauuccaugggaagcaaggauucugggacagagccagaugugaaggauuugccccaggaacauggagaagggcagaagcaugggagaggaacaaagguaaccagccacaugguacaacuagaauagaauaaugggaugacuacucuaugagucagcugggaacagucaaagcuugcggccaaggugucuguaaauaccguuugagucucaggagcucggggcuguggggaaaaaccccacuuuuacacuugggaugguucucuuuaugagucaccauguaaccccaacuggucuggaacucucuauguagaccagguuggccugaaacucacagagauccgccugccucugccccugccucugccucccaugugcugggacuaaaggucugugcucuacucccuuuguuaauaacagaaccaaaacagcuccuugaagcuccuucagacgcuggccucuucuccccuugagccuuucaggacuguaccaauacucuuacgauauuucacccugagauuaacuuaaaucagagucugaacagcaccucuccuaagaaaauuccagagcaggaauucaucaacccauggcacuggaauugaugggcucaguauccacugggaggcgugacuccaggagagauagauaaucagccccuauaaauacccaugacuuuagaauccaagcugcaggacuagccaugcuuuaugaagaaagcaacagggcucccuucagauuccaccuauguccucccugagaggacaacucaaggaaccuucaucauaaguuuacauaacacaccaauacaaccaacuuuuagcaaaggcuaacuauugaacuaguuauguggguuccuuaaagacacacuaauucaguuucacuacuuccaccuccccaccucacccuccaccuccuuuguuuuucaagacaaggucucuguguagcccuggcugcccugaaaaucauucuguagacaggcuggccucugccuccugagugcugggauuaaagccaugcaccacugaccgucucaccccacuuauuaaugacacagaauaaccccucaguuccaccuacucauccguccacccugaacacuucugaaacugaggcauaaggcagacacgguggcuacaaaccuguaaacauaacucuagagaaacuaaggcacaacaacccuagguucaaggccagucugugauacacagaaaaaacaaaaacaaaacaaaacaaaaaaaccuguauuaaaacuaaauaaaggaaguuaaaauguaauacaaggcuggcaagauaacccaucaagugaagguucuuaucuaaaccugauaagccaguuaguccccaggauccguaacacaagaauagaaccaauguucacaaauugcccucugaccuccacagggauaccauguaguauacauauacaugcacuacaaacauaaccacacagaauaaaugaauuuaguaaaggacaguaaaaaaauuuuaaguacuaguaaacuugucuauacagggcaguuuacaaauccuaacaguaucacuuuagcagaaagccacacggauagcuguagaaguuggagccacuuuaccaucgaaguggaagaagugauugugcugguucaagcgaggccugccuucggcagcugcuacaggaaccaaguucucguccagguucucuccuugauggucuucccuggcacgacugccaucagcaauauuaagagacauucugcauguuggacaagaggugucuuguucuagccaagaacgaaggcaggagcuaucaaagaguucaaaggaagagauagaacauauucaauucucuucagcauauuuugugagaaaucaccagaauuacuguuuuucucauuucgcuuuacuuguauuuaccaguaaccagauguaaaugcugacaaauacuuguggccaccaccucuacugcagacaucuaccauccucuggcuauggucccuccuccaccacuucauggccuggcuucucaccuccagcuccauucggcuacugcagagcccauguggcucacucagccagcauucagccucuuccacccuggacugcuuuacuccaacgaucuuccuauuuacuacacagcuaccgaccaauauggcuauaaccauggccuuuucuucaaaacacuggcucuguagagcucauucacuccucucuauccagcaccucacuuaaaauucuucaguggucccugcccauccagcagcucuccagcccuggccgacaucuaccccacuggcagacacacuccuucuuccaccaugaaucccacgcuggcuucuaucugauuccaucaacacaccaacucugcccucugcuggagcugcuccuugugccucccauuuuacacccuccugaccugcucugccuucaaagaucucacuccugcuaaaagucacuuccuccuaaucugaaucagauuccuauguuacuacucuucagaguccuguuucccucccucccuucucucucucucucucucugucucucucucucucaguuuuuugagaugggguuucccuguguagucuuggaacucacucuguacaccagacuggccuuaaauucagagauucuaccuccugagugcugggauuaaaggcaggcaccaguacuucagaggccuguuuuucuaaaacacaccucuaaaucuagcaguagcaaaauacuaaauccauguacaaaauuauuuuucuuagucuugauagcucugaaauaugagaucuucucugaucuuggagauuuauggaagggccaagccugugaucuuugcuaauggaucacucaaguguucuugguuccacuucaacccaguucucuagaacucaaaauggggaaaauuuuugaagaaagcuaauaaauagaaauuaaguuggcuaaugcggauaaagaaacaucuaaaggcaaaaaaaaaaaaaaaggcucacagguuaaaaaauaaaugcuagucacagguuuccaagcaacaucaccaacaaggccaggcugagguaacauuccugcucucgugcugggaauauguucaaagccacugaaaaaggacagaaacccauucccaaacacccuguacacagcuccuacuugugaaaaagauguccacagggcaguuuccuugcagccugcauggagucccagcagauugcacagucaucauuauugacagcuaguuccucuggaguugcaacagcaaaccuguagaacacacagcaggcccaggaggaacucaucaauuucacacaccgccaaaugacaccacugcaaucagacccccagagauccaaacugucccuaagaagacaaaaaggaguacccacuaaugcugcccuugcuggugugggccagccucucacaagcuggcaagggagagugucggcagugagagagccauguccacaagcagacauguuuaagucgugaucaagacacaccuucacaaaacaaacaugucagaagaaccccaggagcuuccaaucaguagcaacaacagacacugacuaaaaauaagaacccugaaucucuggaacccuccccacaucccaggaaggaaguucuaugucaucccuaaaagaaagccauacuuucuuaccuggcuuccauguuuccuaccacucgcaaauaauucuugugucgacggauucgacgcuguaccucauggaacagguaacgaaguugcauaaagaugaccaagcuagccauagauaaccagauguugccaaauaacuaaaaaaagauagagggaaguaaauuauacaauaaaaacaaaugugaagggcuaaggacacagcucaacacugaguaaaggaguaagauacugaguuagaaucucuagcacccauagaaaagccaggccugagccagucaguuaauccuggaagaucuguguguauuccaggccagccuagucuauggacagaguuccaggacagccaaggcuacaaaaaaaaaaaaaaaaaaaaaaaaaaaaccccaaaacuaaacagaaugccagguguggccaugcacauuuguaaccccagagcuagaaggauaaagccggaaggaucugaaauucacugagcagugcagugcgucagugagcucuagauucagugaagaaaaccuguuucaaaaacaggguggagagcaacaggggagagcacuucccaucaaccauugggcccacccaaggauccacacacacaccugugugcaggcgagcacacacacacacaacuuccucacaugaaggaacauguacagcagaggcucuuuaaggucggugaaagggaaacagaacaaucucucaguauguuauauaaaugcauguauuuauccaauggcccuagacaguacacauggcucuuccgccuaggcauccucccucccacugucacaaccucuccugaguaaucaacccaaaauuuaaaagcuuaauguaaaaagauguccagucauacaaacuuacauauucauucauucauauauauauauauauauauauacacacacacauuaaguuauauagacucuagaucuguuuuagaguguaguguuuaucugcaagguuuuuuuuaauaauaaaauuuauaaaguuaaaaaauaaagcaaacugcuaaaccuuuuucaucuucaaaaaguacacuuauaaaugugaugucccagugccuuuuaaauguuacugugaugaguuuauaaauugcccauuacuacacugacucuuaucauuauuaguuagauuuuuuuuuaaaugcccaccugucaaagagacuuacauuuccuuucuauggugcuggggaccaaacccaggacauguuauauuuuauaggugagugcucuucucuuagcuacaucccuagucaguccuugguguuuguugagacaaggucucaguauguacccaggcugaucuugaacuugaugauucuccugccuuuucuucacaaguucuagaauuauagguggguaagacugaacuggcuucacaccaaaauuucugacacaccaauuuaaugagguagauuuuaaguacagagacuuuguuuucaauuacaaagguaggaaaccauaccauaaauccuuagaagguaaaagcagcaagaauuccuuccuucccauuaccacuaaagagcauguguugaguaggaaagccacagacacugcagggaaggccccuuucccaugcucugaggaugcucuauugacuggucagcaguuuaauggcauguccuaccacagcacuuaccuccugcgcugggcaccaccacccgaagcaugugggugugggggacucaccagcaugugggugugggggacucaccagcaugugggugugggggacucaccagcauguggguaugggggacucaccagcaugugggugugggggacucaccagcaugugggcgugggggacucaccagcaugugggugugggggacucaccagcaugugggugugggggacucaccagcaugugggugugggggacucaccagcaugugggcaugggggacucaccagcaugugggcgugggggacucaccagcaugugggcgugggguacucaccagcaugugggcgugggggacucaccagcaugugggugugggggacucaccagcaugugggugugggggacucaccagcauguggauguggugcaugagguccagggacaggagagcgagcuccaugacaaagucgguguaauacacauagguucccuuuccuucccacgucccuucgugguugaggucccagaggugaauuacauaucuacaauauagacagaaaagagaacagcauguuagcugacuacuacaaguaaauuuaacuuaaacaugguauaguuuagucacauuguuauauauuuuccuuuaacuuaaauaugguauaguucaguuacacugucauauguuuaaaacuauuacaucucaaagccaacugaacaagcaacugucggucaccucuccaacauuucuacucaccuuaaaaucacaugagcuguucucacggucacaagaagagacugcaaaagagaaauacuucuuagucuaauuaaaaagcagauuucuaaaaaacaagauggaaaguaaauuggucaaguuuaucacccccaguuucugaggaauaucuuccuaacccaggagaucagcuugugcugagccuuuuccagcugacagcaauaaagcagccaugccugcccaccuccuaggaaugcccuuugcaaugaugagguccauccuacauggcaaacacccacuucuaucugacacaacucuaagucaccaugguugauuaccuaaaaggggaucugacuggggugacgcuguauugccaacaacaugucaccuacaacugucacacugucacacaugggcacagcagcucugcccucaggcuuuuguauccuucauuuaccagaagcagaagaacaaaggaaucaaaccccaaagaagacucucaugauauuuuuuuaacuagaaacugaucuuaagaaacauuucugcaagccacacaugaucauacacacuaauacucucaggacaggaggcucaggaguuugaagccaauguauacugccugagugcugucuaaaauggggaggugaaguuguuugcuucuugaaacaagaucucaauauguagucuuagauggcccgcagcuauguauguagaccaugccgacuugaagcucagagaucucccuggauucugggagucuaagucuacagaugcaccacacccagccacucaaccuacuuuaaacguguuuacuuuuagggcuaucuuucucaaguuuggcggacuaugaacugaaaguuagacaaucgggacaaaaaaaauaaaauaaaauaaaagcaaguaagaauauaguucgaauaauacuuuguaauaaaauacuuaaggcaaucuaauuauuauauguauguauguuuuaaauaggucuuuuaaagaggaaacacauuuacuacauaccuuuacauauacauacucaacugggauuacauuuucaauaaguacuuaaauguuuuccuaauuuuaaaaauuguaauauuuauuuuaugugauugaugcacaccacaugcaugccugguaaccuugaccaucaagaggguguaggagccuuuguaacuggaauuagggacaacugaaggcuuacauauggguggcugggaaugaaaccugggcucacugaacgaagagucagggcucuuaacuguugagucaucucuccagcccuggacccuuucuaauuuuacauauacucugaauugacuacuacuaggcaaaauaaauuuuaaccuugcuucuaacaaacuccuaaauauuuacaccuaauuuguuuugacaauaaaaccaguaucuucaguauaucuacuacauagcucucucuuauccaaaagagguauguuguuucuuucccuuuuuuuuucacacaggaucucacuauauagcccuggcuauccugaaacacacuauauagaccagacuggccuugaacucacagagaucagccugucucugccccccaaacacugggauuaaaagcguauuuuauauacauguaagguguguguguguauauauguauguguguguaucuuuuuuccuauauguccuaaugcauuaccauauuauauuauagguagccuguccugguuuauaccuaguguuuccuuugcuucauugaucuuguacacuauggucauuauuaagcagauagagguuaucuggugauagucagaauuuacugucaacuggacagaaucuggaaccaccuaguagaugggcuucuaagcaugcuuucgggauuauacggauuagguuaagugaggcagagagacccauccacucugaguguccaccaucccgacugggacccuggacugaauagauagaagagaacugagccgcagcauguguucacugccuucugcuucuucagggcaaaugcaaugugaagagccagcuuccuccuccugccaccaugucuucccugccgaaacagacuguauccaucaggaacaauaaaccaaaauaaagccuuucuccuuuacuuuaucacagcagcauuaaaguaacuaggacacgcaaacacaagcacugggacacuaccuagguaaucaaauaguuggccaguuaaauaaccagcaggugaguaaaagcaauauggaugcccuaaacaaauaaaugacucaugcuucaggcagcccaguacccagcgucacucugcuccucaggacagugcagaauggacaacuuauacuguggggcaagaguagcgacugaguaggagagggcacgugacauggaguuuaaaugcagcaccaaaacccaaaacuuaucaaugauuaccuccagaauuuuccauuuaauaauuucagcuaucagcuuacugaagauaacucagacuguggagaguaaaauuaaaaguaucuaguauauuucaucuuuccaauuagcaauuauagguaaagguaauuacaaaguuggucuuuggcugaaggaaaguugaauauaaagagcacagacugaagagauggcuuaguaguuaagagaacuugcugcucuagcaaggaucuaggcuuggaucucagaacccacguggugguucauaguccccuauaauuccaguuuaaggagguccaauguccucugcugaccucugaaggaaccagggauguacaugcaacaaauauauacaugcagggaaaacacuuggacacauaaaaaaauaaacuaaauaacucuagaaaaauauuuaacauauauaaaaaacuuuggguucugggugaccgagagcacuggcugcucuuccagggaaucaguguucaguucccagcacccacaugguagcucccaacugcacuccaauuccaaaagucuaacacccucuuccagcuuccaugggcgcugcacacaaauagcacacacacauaaauauaagcaaaacacaaacacauaaaaaaguaaaccuuuaauuuuuaauuggguuucuaccagagaaaagugguaucuuuuuuguuguuguuguuguuuuguuuuguuuuuuguuuuuuguuuuucaagacaggguuucucuguguagcccuggcuguccuggaacucacauuguagaccaggcuggccucaaacuuagaaauucaccugccucuggcucccaagugcugggacuaaaggcaugcaccaccaccccccagcaaaaagugguaucuucuuuaaguuuuuagaaagcauuuuucuaauuauuuauuauuuauuuaauguauaugaguacacaguagcugucuuuaaacacaccagaaaagggcaucagaucccauuacagauggucaugagccaccaugugguugcuggaaauugaacucaggaccucuggaagagcaguuagugcucuuaccagcugagccaucucuccagccccauuuuguuuauuuuuaaauauucagggaggagagcccacacccaagaauacaaaagaagcacucacuagauucaguuacaggauauuaaagacaaaagaggaaaccaugaagguggaaagugguauguggggagguccaaggggaguccaagaaaagcugggauaaaccugaucaagacacacuguaugcacauaugaaacugucaaagaauaaauaaauaaauauucucuauaccacaaagcucaggcuggugagauggcucaauagguaaaggcacuugucaaugaccuaacaccaugagcucaauccugggacucacaggguggaaguagaacugacucucacaagaguccucugaccucuacacauacacuguagcacaacuggguccugcuggucaggacaaguggcccccaacguggggccaggguaccuuuuaccuuagguggagauuauggaguuuaacucccccagagaaguucgucgcgacuaagaaaaaauaagcaguugaggaacgcucucacagcucaugggagaaagucguccucgguaagugauucaucuccacugagaaaugggaacuaaacuuucaaaagaggcagccuucauuaaaggcuuaaagacaucucucagggaaagagggguuugaguuaagaaaaaagauuugauaaacuuuuuuauucuuauagaucaagcaugccccuaguuuaucauugaugggacagagauacauuguaaaaaaaauggugaaagguaggcagagauuuaaaugauaaacuagcuaaugaggguccugauguggucccugcaaccaucuuuucuuauugaggaguaacuaucagaagcuaccacugugccuccucucacuucucuggcagaauucccaaaagaaggagauaaagaauuaaaauuugaacaugagagagagagagagagaauaagcuucagaaaagcaguuauccccuguuugggaccuuuuagcaaaaaaagagggaaaaugaagauaagcuauuucagagcucuccuugggacagaaggaaauugagagacguccugcuuccucucuggcuccuauggagauauucuuaguucugguuaggauaucugggucccuuugagacaucaagcucuauucccugucuauugucuguccuuggugcaccauuuguccauaugucucucuauuuauguuuguuuuuguuuuguuguuucaaugauuguuguucuguguuucaugugggaagaaaaugggcaaaacuuuaucugcuggcuguccauccuuugauuuaguuuaacuuguuuaaaaggcagucucaaugugcacagcagaaacugauaaguuauacugcacuguggcugggagucaaggacagcuggaaaagcccugcuagaggcugauuaucuacacaggaguucuuaaaggggcaggcagccuuuugcuuauaacagaaaguuagcuuaaaauugggaacuaaggguuggagucauucuaaacaacauguggcaugaacaaaccgagcaaaacaggucuuuaaagauacuucaaaauagggauaaucuuugggccaggacucuggcagagugcucagauugagaaauguuugcguuuggguugacacugagcucagaggggagcaaccucagcgaagcuuguguggcauuucuuuuguuucgcaaaccaugacuagggaaguucuugagaccucaccucucccucccuuccuuuuagcuaaaagagccuuguugcaaaccuagauagauguuguucuaaauaaguuuaaauucaaaguuuauaaaaggucaaucaggcuguggaauuuaucaggacaucgcaauuugacuugcauacuuuauauaaaguuauaguguacagaguuuacauauauguaauuuuauauuguuuccuaagugaaaaguauuuuaguaacuaaugcuuuuaaguccuugcucucacgcaaugaaccuuuuaaguacuggggaguagcuguaauuccagguaagauucagaggcaauaucuuuuaauacuuaggguuuuuuagcuauauuagaaaauugugguacagaaaaucuaagaaggaaaaauugauuugcuucaaaauuuuauuuucaaaaacuuccaggagauguuaaguggcuaagaccuuaccuugaggccuuaaagcaacuuaaaccuuuguuaggugcuaucuagugagauucaaaauuacuggugagaaacaaaaagguuucacagaaagcagaggaaacuucugugaucaauuguuaucaauuauaaucaaugguaauuaaauauuaccugcucauuuuauuuaugugcccacaacaaaucuuuggcaagagaaaacauuguuguaaaaucauccuucuucaccucaaaguaaaguuuuaacauccuauuaggccacuguggugcuaauaaggaauuauaagauaaauucauauauuuuagaaaaacuauaacaaaaauugugucuuaagaaccuaagugucuguuccuuguuccaaacagccauuaauuuggugauuacagaauauuaauauuugaucuacugauacuaucauuuuaaauaaaauugauaaucauuaucccaaagauaaguuaaaaauuguuuauaagcaugcuucuauaucuucuauaaauuuaugcaugcaugcaucccauuuacugugcuuaaaaaacagcccuucuaugggagaaacguauaugugaauuggaucacacacuuauucuuuugaguuuccuccuguuucaacacagauaauuaaauugugugcuguagaugguauuuuaaaauguugaacaaucaaacuuuaaguuguauauuaauagucaauauuaucucucagagcuuacaauugcuuaaaauuguucaucccucagaugcuauuaauucucaagcuugcaauuguuuaugcaaauucuaagaaaaaauacuguuccuuuaagaagacuguuuuuggacaguuaagaaauuguccuggguugccuggaaaagacccccaagauuugcuuuuguguuauagagguuuacauagagcucuaacugauaaggauuacagauagcuccuaaaaagauacaaacucaggauuauuuggguuuuagacuuacuaaucaaccuguuuuucccuagaagauaaaacugcaaagcuucuguaaggcaaaagacacugucaauaagacaaaaaaggccaccaacagauugggaaaggaucuuuaccuauccuaaaucagauaggggacuaauaucuaauauauaaaaagaacucaagaagguggacuccagaaaaucaaauaaccccauuaaaaaauggggcucagagcuaaacaaagaauucucaccugaggaauaccgaauggcugagaagcacaugaaaaaauguucaacauccuuaaucaucagggaaaugcaaaucaaaacaaccuugagauuccaccucacaccagucagaaugguuaagaucaaaaauucaggugacaggagauguuggugaggauguggagaaaaaggaacacuccuccauuguuggugguauugcaagcuugugcaaccacucugcaaaucagucuggcaguuccucagaaaauuggacauaguacuaccggaggauccagcaauaccucuccggggcauauauccagaagaugucccaaccgguaagaaggacacaugcuccacuauguucauaggagccuuauuuauaauagccagaagcuggaaagaacccagacgccccucaacagaggaauggauacagaaaaugugguacauuuacacaauggaguacuacucagcuauuaaaaacaaugaauuuaugaaauuccuaggcaaauggauggaccuggagggcaucauccugagugagguaacccaaucacaaaagaacucacacaauauguacucacugauaaguggauauuagcccagaaacuuagaauacccaagauauaagauacaauuugugaaacauaugaaagucaagaagaacaaagaccaaagcguggacacuuugccccuucuuagaauugggaacaaaacacccauggaaggaguuacagagacacaguuuggagcugagacgaaaggauggaccaucuagagacugccauauccggggauccaucccauaaucagcuuccaaacgcugacaccauugcauacacuagcaagauuuugcugaaaggacccugauauagcugucucuugugagacuaugccagggccuagcaaacacagaaguggaugcucacagucagcuauuggauggaucacagggcccccaauggaggagcuagaaaaaguacacaaggagcuggggggaucugcaacccuauagguggaacaacaauaugaacuaaccaguaccccccauagcucgugucucuagcugcauauguaucagacaauagccuaguugggcaucaguggaaagagaggcccauuggucgugcaaacuuuauaugccucaguacaggggaaugccaaggccaagaagugggagugaguggguggggaaguggggggggacuuuucagauagcauuggaaauguaaaugaauaaauaccgaauuuauaaaaauguggaaauuuuuaaaaaaagaguuaagaucaccaaucuugacaagucuuuucauauucauuguaauuguugucaauuaacuaauuguguagauccuaauguagauaaggaaucugcuguuaugauuuuguuaaagagaccugcuuauguuuugcugcuuguuagaguuaggaaaugauccuugguuuaaaaaucugggaaugcaaacuuggaaaaggucaaaugagcaauuuuaggauuuacuguuuuaauugcaauuuuaacuucaauaucuaccacaccuuuagaucaacagcuacauacugcucauuuuguuaaugauaugcauaagaauauuuccauggcuuugucagagcaacuuauuauagauaaaaauuggaggcaaagguuaaugucuuagaaguaguaguuucaacaguaagacaggauauagcaaauauuaaggcuacaaagacaaauuucagauauuagaagaauguugcuuauucagugacauucagaauugccucuaguauuguuagagagauagugaaagaaaucaggcuuuacuauccacuacauaaaaguuagaaaucucgggacaagcuuaacaauguaaguuuagaauucuuuuuauaguuauguacggcagaacuuauuguugccaugguuaaugccucacuacaagccauucaugaggccaauucuacccuugcuagggauuguuggaguugucauuugucccagccuucuuuuuaugaaggaauagcccuuuuuagagaagugauugccaccaaugauacuuccuuucugagauggcaucuggagucuagagaagggcugacucuuggccaaauaucugguauuggucucugucuuuuaggaccccagaugcuuccccacucacaccuguuugaaguguguaaucaaacccuggcucacuaccauacuucccagccuuuugggaccuuuuguggguauuuugcugcuuuugucuuuugacccuugggccuuuaauagauuaaccaguuuuguuaagucacagacugaagcugcuuuaagcaagccaguugcaguucacuaccaucgacuggauaucugagacucagacgaagaucucccuuccacugaugcaaaaagagcaacugcuggccuccaguuuucugcccuugcugcaaaugcagaguucccuugguuccucaagccguagagacaauagagaugaggagggugaccuccagcuccuaauauagccuaaagagccacaaauugugguauuaccauuggcauaauucuuguggguacagcccacagaggccuugcugaaucuaagguugacaauucuccuuuaggagcugcacaggacucagaccugugcauacugguucaugauaauacgaacccaguaugagcaccaggugggugcgaggcuaugcacugcaggggaagguccaacuagaccauuucugaguucccuaagaggcacaccuaguuugcacagagguugguaucuaauuccaguuacaaccaaaaaaucuuucuaaggcucugccuccucuccccaaaagauacuaagagccaugagugugggucgugacagcacccacgggaggaaucagaucaaugcucucccagcagguuaaugcccacucauccaaggaugagaaggucauuugaucaccucaguuaaauguggcuuuauuacauuuaauuaaaaggggggagauguuagagaccauaccaugagaaaauaaaccuuucgcaguuucucacccuaauagccaaauggccuuguguuaggagcaggucagcuccuccucccuauccuuuccuggcacauaagacccuaaaaguuugaauuauaguccucucuuccuuaucucuuccugacucccaagauuucuaaggaccugaguuaugugcugagcccagcuugacaccccgggcuguuaaggaggaaucuacacuccugagauaagacucagggugccuccugccugcagucagaauucagccuucauguacccagaugccugcuucuuuguucuuuguuaauucucccucagccccucccuauuuccccucacugugugcuuauaaccuggcuuuucagccuaauaaacucagacuuugacaggaauccuccuuggucucucucuuuuuuccccacccauuucucuugcagguuugcgguuccccucguacccaugaauagcuggguccugcuggucaggacacacaugaaguaaguaaacgccacuaaaauuugguuuugcagccaagcauaguggcacaccuuucaccccaacagucaggaagcagaggcaggcagauuucuuugaguuugaggccagccugauuuacauugaguuccaggugagccagagcugcauaaugaggccauuucucaaaacaaacaaacaaaaaaucauagaaggcuagagacaauucuugcauaucaugacagaucaaucuccagcaaaacacacacacacacacagacacacacacacacacacacacacacacacacacacacacacacacuaaaccccuuuaaaguaagaaacacaguuuaaauaauuauuauauaaauuuuuauuuggcuuuaaaaauuauuauauauauuaauauucaccacaaaccguuucuuuuaaaucuugaaaggaaugcuuuuccuacuuuggaggaagaacauuugaauugcauuugccucuuugaaacuucaaacaguucacacauuagggcucagggucucuaccaccaauauaacagaauuaauaaggaaucaaauguguaaagaauuuaaaaugauuccugcugggcugugacccaaugguagaagacuugcccaggauguacaaaauccuacguuuaacgcaacaaucccuagcaugugguaacugcuguaugugaucuaugugcacauggaggccugaaaacgaugccagcuauucugcucugucuaucuuugucuuacuguccugaaacaaggucucucugugaacucagagccaggucgaccagcaaacccagcacgccugccucugcuccacacagcacuagggucagaguaugugcacacugccacaccuagcuuuuacgauggugccaggauucaaacucagcaccucacgcuucacagcgcucucaccugccaacccagcccccuaguccugaauugcugagaaaaauaauucuccaaagaucauaugaaauaggucauuuaaaagcauccaguaccagcacccaacaaaagcaggaaaccaauaaaugccuguuaaaagaccaaauauguuuuaaagcaaucugccauccacccucuggucuugaaaauguuuaggaaucuaaucagagacagccugugccuggcaccuuaccucugcagccaugaaagccaaggugugcaugccauguguguagccugugacacagcagacgacugccaguccacagcaggagagcagcauagcaaucagcagggacaggacucucccauggcugcucauuggaguggugggagaaaaggaaagcugaaagggaccgaacagaaaaacaguuaguccauucuuccaccauggcaacugcccucagaauucaagaucaauuugguaucuuugcuugggguaccacacuaacacagaaaaguccaaauucuaccgugaccuaaauacaugagcugagauuuauagaucuuuaucauuuaauuugccagacauaauaugcacuauauuuccaugagauuacaaucucuagaaggaugucaauuagcuaucauuuuauaggacucagacagugcccuuuuuugcuuuguuucugcuuuucuugcagaauucacuuggaggccuagccuguuagggcuaggacaauggaaagaaaucaggugcggaagucccacucauaaugguauguugauccuaggcaaggacaagugcgugccuagaaaggagaccuggagcuauaacugcugcuguacuggaugcuggcuacaaucagcccagaaaggaaggcuaccagcuccaccauguaagaaugggaacuggaaaagaaagaaaagccuucaagaagaagugcuaggccaucuccaucaacacugacacaagguccuagagugggcucagcugggaggcugcuucagauguguuuaccucagccuggaugagguguucacuggcacgggucugaccugaagucucaggcagaucuuacagccagacuggaagcagaggcagcucacucagucuugacuccaagaagaaaaguacauaccagugagaaagaaaagcuccaccagucagggcaagagaagaaaaauggggaacucuccagaagagcucaggauguacacaggguauacaucaaggcuccuucacacucugaccuaagccaaggcuaggaguggcuauagggcuuggggaaugggggcaagggagcucccuggaaaacaggcaucuuaccacugcaggcggugacagcugagcuagcaggccuuagcaugcaacccugugacuuucucacacugugucucacauuaaacuuggcacacacaugugaaugagcaaggaaagaggcuggcuaaaaacucacguauucaaaucugucuuugcagagcugaaccaucagaugcaggaagacaaguccagcaaaccagaggcaccacaucaccacuuccuccacagucuggacauucagcacuccaaaaaugaaaaugaacuuguagaaaauaaaauuccaaaacuugucuuugagaugcuaaaaggaaaaaaguuuguaaaggugagucgcagcauaccaaguggacuucauugauguuaauagaacaaaagcaagguuacagagcacucuguacagaaggcaaagaaaacaguuaucucauaaugaguagagguaagacaaagugauugugaacugaaacuugcaaucugaaacaguuauaaaauuuuaaccauuaaaaagcaguugcuuugguggcacaugccuuuaaucccagcacucaggaggcagaggcaggcggauuucugaguuugaggccagccuggucuacaaagugaguuccaggacagccagggcuacacagagaaacccuguuucaaaaaaacaaaacaaacaaacaaaaacaaaacaaaacaaaaacaaaaaacaaaaaagcaguugcuuaguauccuuaaguacaaagaaguaaaaguauauuauauuuuacauguucaccaagguuaucaguauuauuuuuaagacuucuguauccugacuuaauaaauaauagaaaagauuaaacuuucuaaauaaucaaaaacuauaaaaguagggcugcggagguggcucaguggguacaguauuuaucaagcacugaagaccugaguuuggaagcccacacccaagaaagccaguggagaagcacacuugucugcaaccccagucagugcugaaggacagagucagguagguccucgcagcucauuggccaaacagucuagacaacugaugagcuccaggcucagugaaaaccuggcucagaaaaagaaauggaaaggggcuggagagaugguuuguggcuaagagcacuuacugcccuggcagaggaucuggcuggguuccaugcccagcaccuacaugaggcgggucacaaagcacguggugcaauaaacucaugcaagcacauaaaccaaaaccaguucuuuuaaaucuuuaaaaacaaaaaggugcaaaggaaugggaaaaguccuccaacgucaaacucuggccuccacacacaugcaaauauacccacaaacauauacgacaugcacacauauaaauauacuccacacaaaaaauacuaauaaaaauuagaagucagaggaggaaggaggggcuaugaucaggaugugaagugaauaaauaaauuaaugaaaaaauuaaaaggcuacuugcuaauauauaaucaauaaaaucuuuacaacaaaaaauauuuaaaacuauaucuauacagcuaaguaugguuauaucugccuauacaaucccuauacuugggaagccagguugaacugcauaggacccugucuuaaaaaaacaaaacuugccaggcagugguggcacacgccuuuaguccuagcacuugggaggcagagauaggcagauuucugaguuugaggccagccuggucuacagagugaguuccaggacagccagggcuacacagagaaacccugucucgaaaaacaaaaacaaaaaagaacaaaaaaaaacaaaaaaacuuaaaccaaacaaaauaauauuaaaguaaaauaauguccuuaauauuuauuaucuuuuuuccuuuguucaauaugaaaauauauuagggcuggagagauggcucaguagguaagagcacugacugcucuaccaaaggugcugaguucaaaucccagcaaccacaugguggcucacaacuaccuguaauaagaucugaccaccucuucuggugcgucugaaguaagcuacaguguacuuauguauaauaauaaauaaauauuuuuuuuuaaaaaggguauuccauaagccaaagauuauguucuucuuugcuacauuauuuuuuaaaauuguuauauguguaugaauguuuugcuguauguuauaucuguaacacgugagcugccuggugcucccagaggucaggaguguuggaauacccuagacuggaguuacagauggcugugagccaccauguggauuuuuggaauccacucugguccucugcaagaacaagugcuccuaacugcugagccacuuguucuucuacacaaugaaaacuuacagcuuuaaacaucaucacugucuuggggcagggaaaaggugaggacacagucgaugaguccuagcaaucacagacauuaaauaccugguuaccuagcuacuaauggaggcaguaaaaagcuugagaaagggaagaauaaacucaaggauuuucuuuuucuucgagacaggaucucucuacauagcccuggcuguccuggaacucacucuguagaccaggcuggccuugaacucagagaucugccagccucugccuccugagugcugggauuaaaggcaugcgccaacacugcuuagcaaaagcaagagacuuuuagauaugaucuuuaugaacugcaaauauuuuacaaauuuaaaauaaaguuaaagcugggagugugguuggauaguaucuacaaucccagcacuuggagguagauggcaguggcaagagggucuugaguuagaggucagcaagaccccaacccaaagagaagaauuaaucugagaguuuaaaacacuacccugaccagauauguuguauucagagaacaaaguuaacucagaaaaaaaaagagagagagaaagagagggaaggaaggaaagagggagggagggagggagggagggagggagggagggagggagggaaggaaggaaggaaggaaggaaggaaggaaggaaggaaggaaggaaggaagacuuuuguagcucucuccacagaaaaggcaggccccagaagcaaugcugccacugcucuuacacaguguauacagcuggucuggaugcugguucugaacaccaugucccaagaaaguaaaccuggaauccugggugagcgucuguuucuagggcaggaacaguaagagaccuugaaguaucacugguuguggucccuggcucuccuacugugcaacugugguauccuuggcaugacauguuucaguuucccaagcuauaaaggggaucuuuguauaacagucuaugucucacaaaauaguuggcaaauuaagugcauuaguauauguaaagugcuuuuuagacagccauaauaggcauugaauguuuuaaauauuuuuaaaucaaaaacucccuggcgggagagaugcugaguaauugcugcucuuauagaggauacaacuucgcaucccagcccccgaaugguagcuaacaaccaucuacaaacugaaacucaguucuagggguccauuccuucuucuagccuccacaggcaacaggcaugcagaugguucacauauauauguguaaguaaaacacucauauacauaaagaaaucuuuaaaaacaaacgucaagaaaaagaaagaaacaacucucacugaccuaagccucuauuuaacauuguaguauuuauuccacuuuggguucucagugucuuugccgcuaauauuacucuuauuucuuaaacuuuaagaacucauggagcaaaucuaugucaauucuuuagucuuagcucaaaauaguucugguuuuguuuuguuuuguuuuguuuuuuuuugggggggggucucugugguuucucuguguagcccuggcuguccuggggcuugcucuguuggccuagaacucaaagguccaucugccccugucucuccgagugcugggaaagugugcaccaucacccagcuucaaaauaguucuuaauaaacaccacugggugguguucaucauaaagcaggccaacaaagagcagcagaacacauguggccuagacugaaaaggcugagcuggccaauagcaaaagcaucaaacccuggaagguaagguuuccguaagguuugcccugacagcaaacacauuagaggagacacggcacugagcaccagccgcugacucagacagcagccaccagccugcuccacguucagcccacaaagaaccaaggcuuugaaagaauuuuuaaggaaaaucugaagcacgagguaugaagaaaggagcuucuggggcagcagugacggaaucccagcacuggguggcugagacgugaggacugcugagcucaaggucggccugcucgacaaagcaaguugcaggccuacagaacuacauagcaaggcccuguuuagacaaaacaaaaucaugaagaaauaguucuaaugggauagccuagcuauccugaguacaauuaaaugaacuauuucaucaaggcuagcuucucuacucuuauuccugugcugugaguaccaagaucucauugggaaacucuucccaagcaggaaacucuacucuugaaaaacgcaugcugaaguaucuaccuaggguaaaauuguaugauguccccuacguaauucaaguggauuagaaaaccuauguaaauaagagacucuagggaccugggagaugacucagagcugcaagcacugugacaguggccagaucaguaagagcccagcugaaaaaggaacauggagaacaggaggaagacuuaaaauucuccacacacacgccaaauacaggugagugcacucggacccguguguguccagaugugcacacacacacacacacacacacacgcaaaacuaaaacaugacucuggaugaaauacaugcaggaguucuuuguaguauacauggaauuuucuauaugcuugaaauauaauagcauuuuuaaaauuucuuuucaagaaucugaucacuuaccugucuuucacucacucgaagagggccgaacacaauacacuggauaagcuuagccaccaacaucaaaacacagcaagcaguauucaccagaaccugcacacaaaccaaagaaaggaaguuuaguucuggugaggcacaaauauggugcacaguuuccgaugggccuuuuugguuuccuaacagugcaaacuaaguguuacugaagcuaacggggccgaggcauggggcggaaaagcucauugagucagaccccugccccacugggugcccuccagcaggccgccuuccucagacuugacagaacccuauggaaacucuguaugucucuguaaaacuguaaauaccaagcuuggcaugauggcacauaucuguaaucuacacacuacaaaagcuggggcagaaggacuaaaagcccaguccaaacacugucucaauaaauaaguaaccacaaaaaaguauguaccuucauucccacaugaacuuucagauagcuaucagauaacuggucuaaaagucacaucaucaguaaaauccagaacucaaagaugcugcccugacaaguggaagaggguaggauuauggaaaaaacaaauucagauaauggagagggacaacaaaauggaaagauacucuggguaccagugccaaaaccaaggccuucuuccacauuuauugacaaaacuuucguucuuucuuccuuuuuuaaaaaaaaaaaagauuuauuuauuauuauacauuaaguacacuauaacugacuucagauacaucagaucucauuaccgaugguugugagccaccaugugguugcugggauuuaacucaggaccucuggaaaacagucuuacccacugagccaucucgccagcccaaaacuuucuucuuuaaaauaauuuaaaaauaggaauuuucagacauaaacagcaaguggguaagucauauuucccuuaguuuggucaucgcuauuguuuugagacagauucucacguacccuagauuggccuugaacuccuuauucuccugucuccagguccuaagcacuaggauuauaaccucaugucaccaugcccaccuggucuaccccucuauuuuuaaaagcaaauuauaauggagggagagagaagaggagggagagggagggcaagagggcauaugaugaaaggggccuucaggagagcaagcucccucacaucucuccggguucccucuguauccccaccacaaacuccuguggaagaacacauaauggcagcccuaccccacacaaaaagaauaaaucacgcuuaguucuauucuguuaccuaguggggccaggaaguaagauauuuuuaaaggauuaaaacaaaaauaguuccaaugguguguugggggaacuauuugguacuggucuaaagucacaugaucauaaaaucauucaauuaaugagguagaaaaaaaaacaguugaucaaaaauccuacagccugggggcuggcgagauggcucagugguuaagacacugacugcucuuccaaaggucaugaguucaaaucccagcaaccacauggugacucacaaccauccauaaugagaucugaugcucccuucuggugcaucugaagacagcaacaguguaacaguguguacuuagauauaaaaauaaaauaaaucuuuuaaaaaaaaauccuacagccuuuugacuccuuauguaagaaucuaguucaaaaacauuucagcucacaccuuuaauucuaacacgucagagagacuuuuggagguaggaaagaguagaaguugaacuuuucaaaaaaggauuuaagaaaaaucauuugugcgccugggugugcgcgugcgugccuguaugaugugugugugugugcuggugccuguggagaccagaagagaguguuggauccccugaagcugaaguuacugugacugugaggcaccacguggcuucugggaauugaguccucguggaagagcagucagugcucuuaaccgcugauucauuuucccggcccugcaaagaaacuguaauacaucucuugagucaaaaacuuaaaagagcuuaacugaaaguuguaaaacuaagucuuguucaugacucaggugcagugguuuuuggguagagaaauaaugguagacuaaguuugaguucaaagucauaaucuucauuucuuuccccuaucccuugaacauuuacuaaaugcacugcauuuguguuuuaaauucaaacgaugauaugcaaaccagggggggggaucugcuuuuaaaaaauaugucccaauuaagcuguuggaguuuaguugaucaucuuugccugguaagggaguugguaugaggguuguggauuuucgugaccuagcuucuaacuuauaugacugaaguuuccauugagugguaaaauacaauggaggcgcaucuguuacaggucuacuucagcaccuuaaaaaugaguauugucagccgggugugguggcacaugucuuuaaucccaacacucgggaggcagaggcaggcagauuucugaguucgaggccagccuggucuacaaagugaguuccaggacagccagggcuacacagagaaacccugucucaaaaaaaacaacaacaacaaaaagaguauugucagguuucugggggaaaaauuauuuuugagauuuuauuuauuuuuauuuuaaguguauggguguuuuaccugcauguaugucuggguaccacuugugugugugugugugugugugugugugugugcaguggagggaguugguugucagacuggcagccgagagacaccucaugagugcugggagcugaacccccuagaagagcggccaguguucugaguuacugagccaccuccccagcccauuccccuuuacuaaaauuuuguuuuauaugacuuacacaugugugccuguguacucuccaagugcccauggaagucaggcaugguagauccuucuagaccuagaguuauaggcaguugugaguugcccaacaacaugugcugggaccacacugaaaguuccuuauaauacugggguuucaucacccauaucuaaacauuucuauuuuaaucuaaauggaagacuugaaaauuagcccaucaccugguggugggggcacaagccuuuaaucccagcacuugggaggcagaggcagggggaucuccgugaguuuuagaucagccuggucuacagagugaguuccaggacagcaaaggcuacacagagagacuauguuugggggggaaggaggauugaaauauagcaugacuauaaagaaaaacagggcuugaaaaacuauguggagccuggcccggguucagaccagaggcugcacugcagagcuggccuggguugccuacccagacccugucucacagaaaagaaagggaugggggaagggaaggaggagagggaaaagaaagcacacagccacaggagggaaauguauuuaaaagaaauaaccuuuacaagaacaccaaggcaacggaggguuggaaaaacuaaaauaaguuuaagguucucaauugugcuuucuuggaauaguuuaaugauuaucaacaaugaacuacucuacaucuaauuauaaaaaaaaaaaaaguguuggggcuggggcugggauggcucaggggcugggguggcucaggggcugggguggcucaggggcugggguggcucaggggcugggguggcucaggggcugggguggcucgguggguagaagcuccuguuaauccugcagagaccucacuugguuccuagcacucacaauauggcuccagccaucuggugcuccuguuccagagaauccaaugacgccuuccaacccccaaggcaccaggcaggugugcaguacacauuucuauaugcaggcaaaacacucauacccauaaaacaaaucuucaaaaaaaauaaagaaaaaggcccuaacuucacaaguauucaauaugucauccuaauaaacacaguaacuuuucaaucucaacugaaaauguaaacauugugccaagcauggcggcccaggccuacaagucuaucaugggggaggggaggcugaggccaccacacagggacugacagcaggcggcacagcacucuguccuaagcagccagacugggucucuaaaaccagagaagaaaaagaaacucaacaaaacgagcuucagcugcucaaaggcacuaacaggagcauuugaccuuuaaacccuaaaucagaugcuuccaaggaccccgaacacuccugcagaguuggcgugucagcccccacuucaagcccaacaagcaugggacaaacugagucucuaagaaccauaaaccauaggucugcugcagcaagccugaucuggacagccgcuucccuucacuuggacagcagagaagagcuauuuuaaaaugucaucugugccauacaccgaacuccucucacaggcagaauccaaucacgcuaaaaggguucgccagaccacuguacaagagcagagaaauggagcccucguguccaucccugaagacuucacaaacaggcagccaguggauccacgggaggugcugauagcaucagcccaggaagggcacacgccugacacgucaagguaacguuagauaaaaguucaaagcagcauccagcucagggagagaauaaaacgcaggugcaggugugaaacagaaagaauaugugcacauguauacgcgugcaagccacagaaaugaacuggguaaaggacuugaggcugacuguuucuuagguucccauuuaaggccagcaccagcuacaaggagcugaaugggaugcagguggaacagggaccuccuuucgcugucuaucacuuuuguuuacuuugaccuuugaaauaugaacuugcaggaucugucuuuuaaaguuuuaaguuuagaaccaaccuaaccaguucugaaauuccaccuacuuuucucacugcauguggcaggaggagugacaagccaaagauggcugucauaagccacaagugagccucagugccacaccugaagagaaggagccucaaaggcuugucaccugucucucagcagggccaccuccucuuaccucuggucuccuuccaaccucucaacucccuuuaagucagagaagcuguagucagucccacacagcaagccuuucuccuaccuggaaaccccacaggacuucacauguguucuauugucaccuauuguaaguagccucauuuacauaugagucauuugaggguaggggggaagugcuguugguagcugagucuuccucagaaagguuuucaucugccugugcuaauaucaaaccuccugagagacuacugcauguguucuacaaagacaaguucuagagagucugacaaaacaauaacuaguaagacuuccgacuggcaaugacaaaggacagguucuuguuaaucuugcuuggcauuggcagacaauguuuuguucuuaggcggggaagggguucccccccuuaaugucuaaggccuaugagugaggcucaagaagcauccauuuugacaaaggcccaccacacugacacucaguguuaccugccaggaacaggggagguuuuuaaagagugugaggcauagcugcgcaaaguaaguacuaaacgauaaacaaaacucacagcacacacaagauagaucugggcagacaccaugagugccaaaacuccagaggacaugcaagaaaaccgaauaaagcucaacugagaaauaaggauucaaaggaggggaaggaaugaucaaucuauaugagguaagacugugcaaagaaaaagaacauucuuuaaaaugacaauucucagaaacgccaaagggaaggccuuagauuaauguuuuaugaaauguuauuaaccuuggaauuugaacguggguuuugcaagaagaaacuuacgaaaaaaaaacauuaaacaauacuauuggcuguucuaguaauagaauaaugguuccagcuuaaaacaagguaucaacgacuacauacacuauagucuucacccuugucaaaagcacucccaacauaauaauucuaaguuguuuacccuaaagacgaacaguucaucuuuucuuaggaguagagaaaggggaacuuugcccuucacugccuucuaugaaacuaugcaccaaaggaccaggaggcgucaucugcagcccacgaaguucacaaaucccgcugcuuccugaugaagcacagugggaauaauuacaacaaaugaguugcauuauaguucuacaaacuuauaacauuaaccccucagucauuuacagccuucucuaggcgccguguggggagauacgauccccaccaagccacaggaaauccaagugacaauuuuuuaaauccgggagcaacuuuuccuauuucugaggguucauagaagaggcacucaagugcaaggugagagcaaaauuuucucagaucugcccagccuaaaaugauguaacaaacgaagccaguacuuguggcauguggacauugcuuaucucgcaccggcagacaaacuagaacccuuguuucaaaauggaucgcuaaacggaggaaucgcguucaaaggaggggcugccacaccgacccgaaaguguuuugcugcuuucugucaaaaagggaacagucacaaaccaucgcggggggugguugggggugagauaaaaggacguagcuggucuguuugcuucguuaaauagcgcccaucgggacuaacgcauugacaaauagcaccauuucgaaguugucuggcgaagaguaaaaugucccccuaacuucggccuucucuucgucggcgagccgcccccaacaacgccgagcuaaaccggacgugucgcggcuucucacagccucgggucgccgcaccccgccgcccuggagcccgcggguccgaccgcccuugccucgacuguucuccccggcaucccgacaccuucucuccgcggcccgccacgcucgcagcgccgcugggccucgagccccacgcgagggccgcgguccccgggccgaggaggccggggucagggcccggccacgccccccugcggauaaugggugacauggcggcucccgcccggccgcccgcccccgcgcccggcccgcagccucgcucacccacacgaacaggcuguccgacagcagguacugggccacgucgcgggcccgggggccgccggcggucaggcgcgccucgggcugcaguggggccguuagcggcuccggcucacccgagccguccuccggcugacugagggcgcgguaggcgcugacgauggugcccagcaaggccaggccgcugaggcccguguaggugcggaggcugggccacgggaagcgcucgaggaagagcagcggcauggcggcagcgacgggcuccggcccccgaggcuucccgcgcugcggccaggcgccugcggcggccuugcgaaaggcgcccacgggcucuggcgucgcugccgcugccgcugccgccgccgcugcgccgggccgagccgggccgcuccuagcugcucgcgccgcuccgccccgcgccgcucccgcugcugccccugccggcgcggaagagccucggcggacucggggcgggccgccgccccuagcgggacgcgggcgggacgggcgcgggggcgcggccuucgucccccgcccacagccggcgcucugcaaccccgagagcacaggacccggccuggggccccgcgucccggcccccugcagcauccuuggcgacccugggcccacugaagccacgagcgcacccgagccgggcucuggggugagccuggcccguaggcaaugacggcaggccugugugcguggucaggcggcagggugagggugcgggaccccugccccuggccacuugucgcuuguuccuccccgccaaagcugguaaacccgccaucccaccacccuguagacuagaggcuuccuugguguccuaaagaagcgacaugaugcuuaggaaauaagagaagccuugagauagaauauuuuuaaaacggaggaaccaauuuaaccagaaauaaaaaucuguucccucuuagcua

SEQ ID NO: 4645 - RNA, 41583 nt, Mus musculus
uagcuaagagggaacagauuuuuauuucugguuaaauugguuccuccguuuuaaaaauauucuaucucaaggcuucucuuauuuccuaagcaucaugucgcuucuuuaggacaccaaggaagccucuagucuacaggguggugggauggcggguuuaccagcuuuggcggggaggaacaagcgacaaguggccaggggcaggggucccgcacccucacccugccgccugaccacgcacacaggccugccgucauugccuacgggccaggcucaccccagagcccggcucgggugcgcucguggcuucagugggcccagggucgccaaggaugcugcagggggccgggacgcggggccccaggccggguccugugcucucgggguugcagagcgccggcugugggcgggggacgaaggccgcgcccccgcgcccgucccgcccgcgucccgcuaggggcggcggcccgccccgaguccgccgaggcucuuccgcgccggcaggggcagcagcgggagcggcgcggggcggagcggcgcgagcagcuaggagcggcccggcucggcccggcgcagcggcggcggcagcggcagcggcagcgacgccagagcccgugggcgccuuucgcaaggccgccgcaggcgccuggccgcagcgcgggaagccucgggggccggagcccgucgcugccgccaugccgcugcucuuccucgagcgcuucccguggcccagccuccgcaccuacacgggccucagcggccuggccuugcugggcaccaucgucagcgccuaccgcgcccucagucagccggaggacggcucgggugagccggagccgcuaacggccccacugcagcccgaggcgcgccugaccgccggcggcccccgggcccgcgacguggcccaguaccugcugucggacagccuguucgugugggugagcgaggcugcgggccgggcgcgggggcgggcggccgggcgggagccgccaugucacccauuauccgcaggggggcguggccgggcccugaccccggccuccucggcccggggaccgcggcccucgcguggggcucgaggcccagcggcgcugcgagcguggcgggccgcggagagaaggugucgggaugccggggagaacagucgaggcaagggcggucggacccgcgggcuccagggcggcggggugcggcgacccgaggcugugagaagccgcgacacguccgguuuagcucggcguuguugggggcggcucgccgacgaagagaaggccgaaguuagggggacauuuuacucuucgccagacaacuucgaaauggugcuauuugucaaugcguuagucccgaugggcgcuauuuaacgaagcaaacagaccagcuacguccuuuuaucucacccccaaccaccccccgcgaugguuugugacuguucccuuuuugacagaaagcagcaaaacacuuucgggucgguguggcagccccuccuuugaacgcgauuccuccguuuagcgauccauuuugaaacaaggguucuaguuugucugccggugcgagauaagcaauguccacaugccacaaguacuggcuucguuuguuacaucauuuuaggcugggcagaucugagaaaauuuugcucucaccuugcacuugagugccucuucuaugaacccucagaaauaggaaaaguugcucccggauuuaaaaaauugucacuuggauuuccuguggcuugguggggaucguaucuccccacacggcgccuagagaaggcuguaaaugacugagggguuaauguuauaaguuuguagaacuauaaugcaacucauuuguuguaauuauucccacugugcuucaucaggaagcagcgggauuugugaacuucgugggcugcagaugacgccuccugguccuuuggugcauaguuucauagaaggcagugaagggcaaaguuccccuuucucuacuccuaagaaaagaugaacuguucgucuuuaggguaaacaacuuagaauuauuauguugggagugcuuuugacaagggugaagacuauaguguauguagucguugauaccuuguuuuaagcuggaaccauuauucuauuacuagaacagccaauaguauuguuuaauguuuuuuuuucguaaguuucuucuugcaaaacccacguucaaauuccaagguuaauaacauuucauaaaacauuaaucuaaggccuucccuuuggcguuucugagaauugucauuuuaaagaauguucuuuuucuuugcacagucuuaccucauauagauugaucauuccuuccccuccuuugaauccuuauuucucaguugagcuuuauucgguuuucuugcauguccucuggaguuuuggcacucauggugucugcccagaucuaucuugugugugcugugaguuuuguuuaucguuuaguacuuacuuugcgcagcuaugccucacacucuuuaaaaaccuccccuguuccuggcagguaacacugagugucaguguggugggccuuugucaaaauggaugcuucuugagccucacucauaggccuuagacauuaagggggggaaccccuuccccgccuaagaacaaaacauugucugccaaugccaagcaagauuaacaagaaccuguccuuugucauugccagucggaagucuuacuaguuauuguuuugucagacucucuagaacuugucuuuguagaacacaugcaguagucucucaggagguuugauauuagcacaggcagaugaaaaccuuucugaggaagacucagcuaccaacagcacuuccccccuacccucaaaugacucauauguaaaugaggcuacuuacaauaggugacaauagaacacaugugaaguccugugggguuuccagguaggagaaaggcuugcugugugggacugacuacagcuucucugacuuaaagggaguugagagguuggaaggagaccagagguaagaggagguggcccugcugagagacaggugacaagccuuugaggcuccuucucuucagguguggcacugaggcucacuuguggcuuaugacagccaucuuuggcuugucacuccuccugccacaugcagugagaaaaguagguggaauuucagaacugguuagguugguucuaaacuuaaaacuuuaaaagacagauccugcaaguucauauuucaaaggucaaaguaaacaaaagugauagacagcgaaaggaggucccuguuccaccugcaucccauucagcuccuuguagcuggugcuggccuuaaaugggaaccuaagaaacagucagccucaaguccuuuacccaguucauuucuguggcuugcacgcguauacaugugcacauauucuuucuguuucacaccugcaccugcguuuuauucucucccugagcuggaugcugcuuugaacuuuuaucuaacguuaccuugacgugucaggcgugugcccuuccugggcugaugcuaucagcaccucccguggauccacuggcugccuguuugugaagucuucagggauggacacgagggcuccauuucucugcucuuguacaguggucuggcgaacccuuuuagcgugauuggauucugccugugagaggaguucgguguauggcacagaugacauuuuaaaauagcucuucucugcuguccaagugaagggaagcggcuguccagaucaggcuugcugcagcagaccuaugguuuaugguucuuagagacucaguuugucccaugcuuguugggcuugaagugggggcugacacgccaacucugcaggaguguucgggguccuuggaagcaucugauuuaggguuuaaaggucaaaugcuccuguuagugccuuugagcagcugaagcucguuuuguugaguuucuuuuucuucucugguuuuagagacccagucuggcugcuuaggacagagugcugugccgccugcugucagucccugugugguggccucagccuccccucccccaugauagacuuguaggccugggccgccaugcuuggcacaauguuuacauuuucaguugagauugaaaaguuacuguguuuauuaggaugacauauugaauacuugugaaguuagggccuuuuucuuuauuuuuuuugaagauuuguuuuauggguaugaguguuuugccugcauauagaaauguguacugcacaccugccuggugccuuggggguuggaaggcgucauuggauucucuggaacaggagcaccagauggcuggagccauauugugagugcuaggaaccaagugaggucucugcaggauuaacaggagcuucuacccaccgagccaccccagccccugagccaccccagccccugagccaccccagccccugagccaccccagccccugagccaccccagccccugagccaucccagccccagccccaacacuuuuuuuuuuuuuauaauuagauguagaguaguucauuguugauaaucauuaaacuauuccaagaaagcacaauugagaaccuuaaacuuauuuuaguuuuuccaacccuccguugccuugguguucuuguaaagguuauuucuuuuaaauacauuucccuccuguggcugugugcuuucuuuucccucuccuccuucccuucccccaucccuuucuuuucugugagacagggucuggguaggcaacccaggccagcucugcagugcagccucuggucugaacccgggccaggcuccacauaguuuuucaagcccuguuuuucuuuauagucaugcuauauuucaauccuccuucccccccaaacauagucucucuguguagccuuugcuguccuggaacucacucuguagaccaggcugaucuaaaacucacggagaucccccugccucugccucccaagugcugggauuaaaggcuugugcccccaccaccaggugaugggcuaauuuucaagucuuccauuuagauuaaaauagaaauguuuagauaugggugaugaaaccccaguauuauaaggaacuuucaguguggucccagcacauguuguugggcaacucacaacugccuauaacucuaggucuagaaggaucuaccaugccugacuuccaugggcacuuggagaguacacaggcacacauguguaagucauauaaaacaaaauuuuaguaaaggggaaugggcuggggagguggcucaguaacucagaacacuggccgcucuucuaggggguucagcucccagcacucaugaggugucucucggcugccagucugacaaccaacucccuccacugcacacacacacacacacacacacacacacacaagugguacccagacauacaugcagguaaaacacccauacacuuaaaauaaaaauaaauaaaaucucaaaaauaauuuuucccccagaaaccugacaauacucuuuuuguuguuguuguuuuuuuugagacaggguuucucuguguagcccuggcuguccuggaacucacuuuguagaccaggcuggccucgaacucagaaaucugccugccucugccucccgaguguugggauuaaagacaugugccaccacacccggcugacaauacucauuuuuaaggugcugaaguagaccuguaacagaugcgccuccauuguauuuuaccacucaauggaaacuucagucauauaaguuagaagcuaggucacgaaaauccacaacccucauaccaacucccuuaccaggcaaagaugaucaacuaaacuccaacagcuuaauugggacauauuuuuuaaaagcagaucccccccccugguuugcauaucaucguuugaauuuaaaacacaaaugcagugcauuuaguaaauguucaagggauaggggaaagaaaugaagauuaugacuuugaacucaaacuuagucuaccauuauuucucuacccaaaaaccacugcaccugagucaugaacaagacuuaguuuuacaacuuucaguuaagcucuuuuaaguuuuugacucaagagauguauuacaguuucuuugcagggccgggaaaaugaaucagcgguuaagagcacugacugcucuuccacgaggacucaauucccagaagccacguggugccucacagucacaguaacuucagcuucaggggauccaacacucucuucuggucuccacaggcaccagcacacacacacacaucauacaggcacgcacgcgcacacccaggcgcacaaaugauuuuucuuaaauccuuuuuugaaaaguucaacuucuacucuuuccuaccuccaaaagucucucugacguguuagaauuaaaggugugagcugaaauguuuuugaacuagauucuuacauaaggagucaaaaggcuguaggauuuuuuuuuaaaagauuuauuuuauuuuuauaucuaaguacacacuguuacacuguugcugucuucagaugcaccagaagggagcaucagaucucauuauggaugguugugagucaccaugugguugcugggauuugaacucaugaccuuuggaagagcagucagugucuuaaccacugagccaucucgccagcccccaggcuguaggauuuuugaucaacuguuuuuuuuucuaccucauuaauugaaugauuuuaugaucaugugacuuuagaccaguaccaaauaguucccccaacacaccauuggaacuauuuuuguuuuaauccuuuaaaaauaucuuacuuccuggccccacuagguaacagaauagaacuaagcgugauuuauucuuuuugugugggguagggcugccauuauguguucuuccacaggaguuugugguggggauacagagggaacccggagagaugugagggagcuugcucuccugaaggccccuuucaucauaugcccucuugcccucccucucccuccucuucucucucccuccauuauaauuugcuuuuaaaaauagagggguagaccaggugggcauggugacaugagguuauaauccuagugcuuaggaccuggagacaggagaauaaggaguucaaggccaaucuaggguacgugagaaucugucucaaaacaauagcgaugaccaaacuaagggaaauaugacuuacccacuugcuguuuaugucugaaaauuccuauuuuuaaauuauuuuaaagaagaaaguuuugggcuggcgagauggcucaguggguaagacuguuuuccagagguccugaguuaaaucccagcaaccacaugguggcucacaaccaucgguaaugagaucugauguaucugaagucaguuauaguguacuuaauguauaauaauaaauaaaucuuuuuuuuuuuuaaaaaaggaagaaagaacgaaaguuuugucaauaaauguggaagaaggccuugguuuuggcacugguacccagaguaucuuuccauuuuguugucccucuccauuaucugaauuuguuuuuuccauaauccuacccucuuccacuugucagggcagcaucuuugaguucuggauuuuacugaugaugugacuuuuagaccaguuaucugauagcuaucugaaaguucaugugggaaugaagguacauacuuuuuugugguuacuuauuuauugagacaguguuuggacugggcuuuuaguccuucugccccagcuuuuguaguguguagauuacagauaugugccaucaugccaagcuugguauuuacaguuuuacagagacauacagaguuuccauaggguucugucaagucugaggaaggcggccugcuggagggcacccaguggggcaggggucugacucaaugagcuuuuccgccccaugccucggccccguuagcuucaguaacacuuaguuugcacuguuaggaaaccaaaaaggcccaucggaaacugugcaccauauuugugccucaccagaacuaaacuuccuuucuuugguuugugugcagguucuggugaauacugcuugcuguguuuugauguugguggcuaagcuuauccaguguauuguguucggcccucuucgagugagugaaagacagguaagugaucagauucuugaaaagaaauuuuaaaaaugcuauuauauuucaagcauauagaaaauuccauguauacuacaaagaacuccugcauguauuucauccagagucauguuuuaguuuugcgugugugugugugugugugugugugcacaucuggacacacacggguccgagugcacucaccuguauuuggcguguguguggagaauuuuaagucuuccuccuguucuccauguuccuuuuucagcugggcucuuacugaucuggccacugucacagugcuugcagcucugagucaucucccaggucccuagagucucuuauuuacauagguuuucuaauccacuugaauuacguaggggacaucauacaauuuuacccuagguagauacuucagcaugcguuuuucaagaguagaguuuccugcuugggaagaguuucccaaugagaucuugguacucacagcacaggaauaagaguagagaagcuagccuugaugaaauaguucauuuaauuguacucaggauagcuaggcuaucccauuagaacuauuucuucaugauuuuguuuugucuaaacagggccuugcuauguaguucuguaggccugcaacuugcuuugucgagcaggccgaccuugagcucagcaguccucacgucucagccacccagugcugggauuccgucacugcugccccagaagcuccuuucuucauaccucgugcuucagauuuuccuuaaaaauucuuucaaagccuugguucuuugugggcugaacguggagcaggcugguggcugcugucugagucagcggcuggugcucagugccgugucuccucuaauguguuugcugucagggcaaaccuuacggaaaccuuaccuuccaggguuugaugcuuuugcuauuggccagcucagccuuuucagucuaggccacauguguucugcugcucuuuguuggccugcuuuaugaugaacaccacccagugguguuuauuaagaacuauuuugaagcugggugauggugcacacuuucccagcacucggagagacaggggcagauggaccuuugaguucuaggccaacagagcaagccccaggacagccagggcuacacagagaaaccacagagacccccccccaaaaaaaaacaaaacaaaacaaaacaaaaccagaacuauuuugagcuaagacuaaagaauugacauagauuugcuccaugaguucuuaaaguuuaagaaauaagaguaauauuagcggcaaagacacugagaacccaaaguggaauaaauacuacaauguuaaauagaggcuuaggucagugagaguuguuucuuucuuuuucuugacguuuguuuuuaaagauuucuuuauguauaugaguguuuuacuuacacauauauaugugaaccaucugcaugccuguugccuguggaggcuagaagaaggaauggaccccuagaacugaguuucaguuuguagaugguuguuagcuaccauucgggggcugggaugcgaaguuguauccucuauaagagcagcaauuacucagcaucucucccgccagggaguuuuugauuuaaaaauauuuaaaacauucaaugccuauuauggcugucuaaaaagcacuuuacauauacuaaugcacuuaauuugccaacuauuuugugagacauagacuguuauacaaagauccccuuuauagcuugggaaacugaaacaugucaugccaaggauaccacaguugcacaguaggagagccagggaccacaaccagugauacuucaaggucucuuacuguuccugcccuagaaacagacgcucacccaggauuccagguuuacuuucuugggacaugguguucagaaccagcauccagaccagcuguauacacuguguaagagcaguggcagcauugcuucuggggccugccuuuucuguggagagagcuacaaaagucuuccuuccuuccuuccuuccuuccuuccuuccuuccuuccuuccuuccuucccucccucccucccucccucccucccucccucccucccucccucuuuccuuccuucccucucuuucucucucucuuuuuuuuucugaguuaacuuuguucucugaauacaacauaucuggucaggguaguguuuuaaacucucagauuaauucuucucuuuggguuggggucuugcugaccucuaacucaagacccucuugccacugccaucuaccuccaagugcugggauuguagauacuauccaaccacacucccagcuuuaacuuuauuuuaaauuuguaaaauauuugcaguucauaaagaucauaucuaaaagucucuugcuuuugcuaagcaguguuggcgcaugccuuuaaucccagcacucaggaggcagaggcuggcagaucucugaguucaaggccagccuggucuacagagugaguuccaggacagccagggcuauguagagagauccugucucgaagaaaaagaaaauccuugaguuuauucuucccuuucucaagcuuuuuacugccuccauuaguagcuagguaaccagguauuuaaugucugugauugcuaggacucaucgacuguguccucaccuuuucccugccccaagacagugaugauguuuaaagcuguaaguuuucauuguguagaagaacaaguggcucagcaguuaggagcacuuguucuugcagaggaccagaguggauuccaaaaauccacaugguggcucacagccaucuguaacuccagucuaggguauuccaacacuccugaccucugggagcaccaggcagcucacguguuacagauauaacauacagcaaaacauucauacacauauaacaauuuuaaaaaauaauguagcaaagaagaacauaaucuuuggcuuauggaauacccuuuuuaaaaaaaaauauuuauuuauuauuauacauaaguacacuguagcuuacuucagacgcaccagaagagguggucagaucuuauuacagguaguugugagccaccaugugguugcugggauuugaacucagcaccuuugguagagcagucagugcucuuaccuacugagccaucucuccagcccuaauauauuuucauauugaacaaaggaaaaaagauaauaaauauuaaggacauuauuuuacuuuaauauuauuuuguuugguuuaaguuuuuuuguuuuuuuuuguucuuuuuuguuuuuguuuuucgagacaggguuucucuguguagcccuggcuguccuggaacucacucuguagaccaggcuggccucaaacucagaaaucugccuaucucugccucccaagugcuaggacuaaaggcgugugccaccacugccuggcaaguuuuguuuuuuuaagacaggguccuaugcaguucaaccuggcuucccaaguauagggauuguauaggcagauauaaccauacuuagcuguauagauauaguuuuaaauauuuuuuguuguaaagauuuuauugauuauauauuagcaaguagccuuuuaauuuuuucauuaauuuauuuauucacuucacauccugaucauagccccuccuuccuccucugacuucuaauuuuuauuaguauuuuuuguguggaguauauuuauaugugugcaugucguauauguuuguggguauauuugcauguguguggaggccagaguuugacguuggaggacuuuucccauuccuuugcaccuuuuuguuuuuaaagauuuaaaagaacugguuuugguuuaugugcuugcaugaguuuauugcaccacgugcuuugugacccgccucauguaggugcugggcauggaacccagccagauccucugccagggcaguaagugcucuuagccacaaaccaucucuccagccccuuuccauuucuuuuucugagccagguuuucacugagccuggagcucaucaguugucuagacuguuuggccaaugagcugcgaggaccuaccugacucuguccuucagcacugacugggguugcagacaagugugcuucuccacuggcuuucuugggugugggcuuccaaacucaggucuucagugcuugauaaauacuguacccacugagccaccuccgcagcccuacuuuuauaguuuuugauuauuuagaaaguuuaaucuuuucuauuauuuauuaagucaggauacagaagucuuaaaaauaauacugauaaccuuggugaacauguaaaauauaauauacuuuuacuucuuuguacuuaaggauacuaagcaacugcuuuuuuguuuuuuguuuuuguuuuguuuuguuuuuguuuguuuguuuuguuuuuuugaaacaggguuucucuguguagcccuggcuguccuggaacucacuuuguagaccaggcuggccucaaacucagaaauccgccugccucugccuccugagugcugggauuaaaggcaugugccaccaaagcaacugcuuuuuaaugguuaaaauuuuauaacuguuucagauugcaaguuucaguucacaaucacuuugucuuaccucuacucauuaugagauaacuguuuucuuugccuucuguacagagugcucuguaaccuugcuuuuguucuauuaacaucaaugaaguccacuugguaugcugcgacucaccuuuacaaacuuuuuuccuuuuagcaucucaaagacaaguuuuggaauuuuauuuucuacaaguucauuuucauuuuuggagugcugaauguccagacuguggaggaaguggugauguggugccucugguuugcuggacuugucuuccugcaucugaugguucagcucugcaaagacagauuugaauacgugaguuuuuagccagccucuuuccuugcucauucacaugugugugccaaguuuaaugugagacacagugugagaaagucacaggguugcaugcuaaggccugcuagcucagcugucaccgccugcagugguaagaugccuguuuuccagggagcucccuugcccccauuccccaagcccuauagccacuccuagccuuggcuuaggucagagugugaaggagccuugauguauacccuguguacauccugagcucuucuggagaguuccccauuuuucuucucuugcccugacugguggagcuuuucuuucucacugguauguacuuuucuucuuggagucaagacugagugagcugccucugcuuccagucuggcuguaagaucugccugagacuucaggucagacccgugccagugaacaccucauccaggcugagguaaacacaucugaagcagccucccagcugagcccacucuaggaccuugugucaguguugauggagauggccuagcacuucuucuugaaggcuuuucuuucuuuuccaguucccauucuuacaugguggagcugguagccuuccuuucugggcugauuguagccagcauccaguacagcagcaguuauagcuccaggucuccuuucuaggcacgcacuuguccuugccuaggaucaacauaccauuaugagugggacuuccgcaccugauuucuuuccauuguccuagcccuaacaggcuaggccuccaagugaauucugcaagaaaagcagaaacaaagcaaaaaagggcacugucugaguccuauaaaaugauagcuaauugacauccuucuagagauuguaaucucauggaaauauagugcauauuaugucuggcaaauuaaaugauaaagaucuauaaaucucagcucauguauuuaggucacgguagaauuuggacuuuucuguguuagugugguaccccaagcaaagauaccaaauugaucuugaauucugagggcaguugccaugguggaagaauggacuaacuguuuuucuguucggucccuuucagcuuuccuuuucucccaccacuccaaugagcagccaugggagaguccugucccugcugauugcuaugcugcucuccugcuguggacuggcagucgucugcugugucacaggcuacacacauggcaugcacaccuuggcuuucauggcugcagagguaaggugccaggcacaggcugucucugauuagauuccuaaacauuuucaagaccagaggguggauggcagauugcuuuaaaacauauuuggucuuuuaacaggcauuuauugguuuccugcuuuuguugggugcugguacuggaugcuuuuaaaugaccuauuucauaugaucuuuggagaauuauuuuucucagcaauucaggacuagggggcuggguuggcaggugagagcgcugugaagcgugaggugcugaguuugaauccuggcaccaucguaaaagcuagguguggcagugugcacauacucugacccuagugcuguguggagcagaggcaggcgugcuggguuugcuggucgaccuggcucugaguucacagagagaccuuguuucaggacaguaagacaaagauagacagagcagaauagcuggcaucguuuucaggccuccaugugcacauagaucacauacagcaguuaccacaugcuagggauuguugcguuaaacguaggauuuuguacauccugggcaagucuucuaccauugggucacagcccagcaggaaucauuuuaaauucuuuacacauuugauuccuuauuaauucuguuauauuggugguagagacccugagcccuaaugugugaacuguuugaaguuucaaagaggcaaaugcaauucaaauguucuuccuccaaaguaggaaaagcauuccuuucaagauuuaaaagaaacgguuuguggugaauauuaauauauauaauaauuuuuaaagccaaauaaaaauuuauauaauaauuauuuaaacuguguuucuuacuuuaaagggguuuagugugugugugugugugugugugugugugugugugugugugugugucuguguguguguguguguuuugcuggagauugaucugucaugauaugcaagaauugucucuagccuucuaugauuuuuuguuuguuuguuuugagaaauggccucauuaugcagcucuggcucaccuggaacucaauguaaaucaggcuggccucaaacucaaagaaaucugccugccucugcuuccugacuguuggggugaaaggugugccacuaugcuuggcugcaaaaccaaauuuuaguggcguuuacuuacuucauguguguccugaccagcaggacccagcuauucauggguacgaggggaaccgcaaaccugcaagagaaauggguggggaaaaaagagagagaccaaggaggauuccugucaaagucugaguuuauuaggcugaaaagccagguuauaagcacacagugaggggaaauagggaggggcugagggagaauuaacaaagaacaaagaagcaggcaucuggguacaugaaggcugaauucugacugcaggcaggaggcacccugagucuuaucucaggaguguagauuccuccuuaacagcccggggugucaagcugggcucagcacauaacucagguccuuagaaaucuugggagucaggaagagauaaggaagagaggacuauaauucaaacuuuuagggucuuaugugccaggaaaggauagggaggaggagcugaccugcuccuaacacaaggccauuuggcuauuagggugagaaacugcgaaagguuuauuuucucaugguauggucucuaacaucuccccccuuuuaauuaaauguaauaaagccacauuuaacugaggugaucaaaugaccuucucauccuuggaugagugggcauuaaccugcugggagagcauugaucugauuccucccgugggugcugucacgacccacacucauggcucuuaguaucuuuuggggagaggaggcagagccuuagaaagauuuuuugguuguaacuggaauuagauaccaaccucugugcaaacuaggugugccucuuagggaacucagaaauggucuaguuggaccuuccccugcagugcauagccucgcacccaccuggugcucauacuggguucguauuaucaugaaccaguaugcacaggucugaguccugugcagcuccuaaaggagaauugucaaccuuagauucagcaaggccucugugggcuguacccacaagaauuaugccaaugguaauaccacaauuuguggcucuuuaggcuauauuaggagcuggaggucacccuccucaucucuauugucucuacggcuugaggaaccaagggaacucugcauuugcagcaagggcagaaaacuggaggccagcaguugcucuuuuugcaucaguggaagggagaucuucgucugagucucagauauccagucgaugguagugaacugcaacuggcuugcuuaaagcagcuucagucugugacuuaacaaaacugguuaaucuauuaaaggcccaagggucaaaagacaaaagcagcaaaauacccacaaaaggucccaaaaggcugggaaguaugguagugagccaggguuugauuacacacuucaaacaggugugaguggggaagcaucugggguccuaaaagacagagaccaauaccagauauuuggccaagagucagcccuucucuagacuccagaugccaucucagaaaggaaguaucauugguggcaaucacuucucuaaaaagggcuauuccuucauaaaaagaaggcugggacaaaugacaacuccaacaaucccuagcaaggguagaauuggccucaugaauggcuuguagugaggcauuaaccauggcaacaauaaguucugccguacauaacuauaaaaagaauucuaaacuuacauuguuaagcuugucccgagauuucuaacuuuuauguaguggauaguaaagccugauuucuuucacuaucucucuaacaauacuagaggcaauucugaaugucacugaauaagcaacauucuucuaauaucugaaauuugucuuuguagccuuaauauuugcuauauccugucuuacuguugaaacuacuacuucuaagacauuaaccuuugccuccaauuuuuaucuauaauaaguugcucugacaaagccauggaaauauucuuaugcauaucauuaacaaaaugagcaguauguagcuguugaucuaaaggugugguagauauugaaguuaaaauugcaauuaaaacaguaaauccuaaaauugcucauuugaccuuuuccaaguuugcauucccagauuuuuaaaccaaggaucauuuccuaacucuaacaagcagcaaaacauaagcaggucucuuuaacaaaaucauaacagcagauuccuuaucuacauuaggaucuacacaauuaguuaauugacaacaauuacaaugaauaugaaaagacuugucaagauuggugaucuuaacucuuuuuuuaaaaauuuccacauuuuuauaaauucgguauuuauucauuuacauuuccaaugcuaucugaaaaguccccccccacuuccccacccacucacucccacuucuuggccuuggcauuccccuguacugaggcauauaaaguuugcacgaccaaugggccucucuuuccacugaugcccaacuaggcuauugucugauacauaugcagcuagagacacgagcuaugggggguacugguuaguucauauuguuguuccaccuauaggguugcagauccccccagcuccuuguguacuuuuucuagcuccuccauugggggcccugugauccauccaauagcugacugugagcauccacuucuguguuugcuaggcccuggcauagucucacaagagacagcuauaucaggguccuuucagcaaaaucuugcuaguguaugcaauggugucagcguuuggaagcugauuaugggauggauccccggauauggcagucucuagaugguccauccuuucgucucagcuccaaacugugucucuguaacuccuuccauggguguuuuguucccaauucuaagaaggggcaaaguguccacgcuuuggucuuuguucuucuugacuuucauauguuucacaaauuguaucuuauaucuuggguauucuaaguuucugggcuaauauccacuuaucagugaguacauauugugugaguucuuuugugauuggguuaccucacucaggaugaugcccuccagguccauccauuugccuaggaauuucauaaauucauuguuuuuaauagcugaguaguacuccauuguguaaauguaccacauuuucuguauccauuccucuguugaggggcgucuggguucuuuccagcuucuggcuauuauaaauaaggcuccuaugaacauaguggagcauguguccuucuuaccgguugggacaucuucuggauauaugccccggagagguauugcuggauccuccgguaguacuauguccaauuuucugaggaacugccagacugauuugcagagugguugcacaagcuugcaauaccaccaacaauggaggaguguuccuuuuucuccacauccucaccaacaucuccugucaccugaauuuuugaucuuaaccauucugacuggugugagguggaaucucaagguuguuuugauuugcauuucccugaugauuaaggauguugaacauuuuuucaugugcuucucagccauucgguauuccucaggugagaauucuuuguuuagcucugagccccauuuuuuaaugggguuauuugauuuucuggaguccaccuucuugaguucuuuuuauauauuagauauuaguccccuaucugauuuaggauagguaaagauccuuucccaaucuguugguggccuuuuuugucuuauugacagugucuuuugccuuacagaagcuuugcaguuuuaucuucuagggaaaaacagguugauuaguaagucuaaaacccaaauaauccugaguuuguaucuuuuuaggagcuaucuguaauccuuaucaguuagagcucuauguaaaccucuauaacacaaaagcaaaucuugggggucuuuuccaggcaacccaggacaauuucuuaacuguccaaaaacagucuucuuaaaggaacaguauuuuuucuuagaauuugcauaaacaauugcaagcuugagaauuaauagcaucugagggaugaacaauuuuaagcaauuguaagcucugagagauaauauugacuauuaauauacaacuuaaaguuugauuguucaacauuuuaaaauaccaucuacagcacacaauuuaauuaucuguguugaaacaggaggaaacucaaaagaauaagugugugauccaauucacauauacguuucucccauagaagggcuguuuuuuaagcacaguaaaugggaugcaugcaugcauaaauuuauagaagauauagaagcaugcuuauaaacaauuuuuaacuuaucuuugggauaaugauuaucaauuuuauuuaaaaugauaguaucaguagaucaaauauuaauauucuguaaucaccaaauuaauggcuguuuggaacaaggaacagacacuuagguucuuaagacacaauuuuuguuauaguuuuucuaaaauauaugaauuuaucuuauaauuccuuauuagcaccacaguggccuaauaggauguuaaaacuuuacuuugaggugaagaaggaugauuuuacaacaauguuuucucuugccaaagauuuguugugggcacauaaauaaaaugagcagguaauauuuaauuaccauugauuauaauugauaacaauugaucacagaaguuuccucugcuuucugugaaaccuuuuuguuucucaccaguaauuuugaaucucacuagauagcaccuaacaaagguuuaaguugcuuuaaggccucaagguaaggucuuagccacuuaacaucuccuggaaguuuuugaaaauaaaauuuugaagcaaaucaauuuuuccuucuuagauuuucuguaccacaauuuucuaauauagcuaaaaaacccuaaguauuaaaagauauugccucugaaucuuaccuggaauuacagcuacuccccaguacuuaaaagguucauugcgugagagcaaggacuuaaaagcauuaguuacuaaaauacuuuucacuuaggaaacaauauaaaauuacauauauguaaacucuguacacuauaacuuuauauaaaguaugcaagucaaauugcgauguccugauaaauuccacagccugauugaccuuuuauaaacuuugaauuuaaacuuauuuagaacaacaucuaucuagguuugcaacaaggcucuuuuagcuaaaaggaagggagggagaggugaggucucaagaacuucccuagucaugguuugcgaaacaaaagaaaugccacacaagcuucgcugagguugcuccccucugagcucagugucaacccaaacgcaaacauuucucaaucugagcacucugccagaguccuggcccaaagauuaucccuauuuugaaguaucuuuaaagaccuguuuugcucgguuuguucaugccacauguuguuuagaaugacuccaacccuuaguucccaauuuuaagcuaacuuucuguuauaagcaaaaggcugccugccccuuuaagaacuccuguguagauaaucagccucuagcagggcuuuuccagcuguccuugacucccagccacagugcaguauaacuuaucaguuucugcugugcacauugagacugccuuuuaaacaaguuaaacuaaaucaaaggauggacagccagcagauaaaguuuugcccauuuucuucccacaugaaacacagaacaacaaucauugaaacaacaaaacaaaaacaaacauaaauagagagacauauggacaaauggugcaccaaggacagacaauagacagggaauagagcuugaugucucaaagggacccagauauccuaaccagaacuaagaauaucuccauaggagccagagaggaagcaggacgucucucaauuuccuucugucccaaggagagcucugaaauagcuuaucuucauuuucccucuuuuuuugcuaaaaggucccaaacaggggauaacugcuuuucugaagcuuauucucucucucucucucucauguucaaauuuuaauucuuuaucuccuucuuuugggaauucugccagagaagugagaggaggcacagugguagcuucugauaguuacuccucaauaagaaaagaugguugcagggaccacaucaggacccucauuagcuaguuuaucauuuaaaucucugccuaccuuucaccauuuuuuuuacaauguaucucugucccaucaaugauaaacuaggggcaugcuugaucuauaagaauaaaaaaguuuaucaaaucuuuuuucuuaacucaaaccccucuuucccugagagaugucuuuaagccuuuaaugaaggcugccucuuuugaaaguuuaguucccauuucucaguggagaugaaucacuuaccgaggacgacuuucucccaugagcugugagagcguuccucaacugcuuauuuuuucuuagucgcgacgaacuucucugggggaguuaaacuccauaaucuccaccuaagguaaaagguacccuggccccacguugggggccacuuguccugaccagcaggacccaguugugcuacaguguauguguagaggucagaggacucuugugagagucaguucuacuuccacccugugagucccaggauugagcucaugguguuaggucauugacaagugccuuuaccuauugagccaucucaccagccugagcuuugugguauagagaauauuuauuuauuuauucuuugacaguuucauaugugcauacagugugucuugaucagguuuaucccagcuuuucuuggacuccccuuggaccuccccacauaccacuuuccaccuucaugguuuccucuuuugucuuuaauauccuguaacugaaucuagugagugcuucuuuuguauucuugggugugggcucuccucccugaauauuuaaaaauaaacaaaauggggcuggagagauggcucagcugguaagagcacuaacugcucuuccagagguccugaguucaauuuccagcaaccacaugguggcucaugaccaucuguaaugggaucugaugcccuuuucugguguguuuaaagacagcuacuguguacucauauacauuaaauaaauaauaaauaauuagaaaaaugcuuucuaaaaacuuaaagaagauaccacuuuuugcuggggggugguggugcaugccuuuagucccagcacuugggagccagaggcaggugaauuucuaaguuugaggccagccuggucuacaaugugaguuccaggacagccagggcuacacagagaaacccugucuugaaaaacaaaaaacaaaaaacaaaacaaaacaacaacaacaacaaaaaagauaccacuuuucucugguagaaacccaauuaaaaauuaaagguuuacuuuuuuauguguuuguguuuugcuuauauuuaugugugugugcuauuugugugcagcgcccauggaagcuggaagaggguguuagacuuuuggaauuggagugcaguugggagcuaccaugugggugcugggaacugaacacugauucccuggaagagcagccagugcucucggucacccagaacccaaaguuuuuuauauauguuaaauauuuuucuagaguuauuuaguuuauuuuuuuauguguccaaguguuuucccugcauguauauauuuguugcauguacaucccugguuccuucagaggucagcagaggacauuggaccuccuuaaacuggaauuauaggggacuaugaaccaccacguggguucugagauccaagccuagauccuugcuagagcagcaaguucucuuaacuacuaagccaucucuucagucugugcucuuuauauucaacuuuccuucagccaaagaccaacuuuguaauuaccuuuaccuauaauugcuaauuggaaagaugaaauauacuagauacuuuuaauuuuacucuccacagucugaguuaucuucaguaagcugauagcugaaauuauuaaauggaaaauucuggagguaaucauugauaaguuuuggguuuuggugcugcauuuaaacuccaugucacgugcccucuccuacucagucgcuacucuugccccacaguauaaguuguccauucugcacuguccugaggagcagagugacgcuggguacugggcugccugaagcaugagucauuuauuuguuuagggcauccauauugcuuuuacucaccugcugguuauuuaacuggccaacuauuugauuaccuagguagugucccagugcuuguguuugcguguccuaguuacuuuaaugcugcugugauaaaguaaaggagaaaggcuuuauuuugguuuauuguuccugauggauacagucuguuucggcagggaagacaugguggcaggaggaggaagcuggcucuucacauugcauuugcccugaagaagcagaaggcagugaacacaugcugcggcucaguucucuucuaucuauucaguccagggucccagucgggaugguggacacucagaguggaugggucucucugccucacuuaaccuaauccguauaaucccgaaagcaugcuuagaagcccaucuacuaggugguuccagauucuguccaguugacaguaaauucugacuaucaccagauaaccucuaucugcuuaauaaugaccauaguguacaagaucaaugaagcaaaggaaacacuagguauaaaccaggacaggcuaccuauaauauaauaugguaaugcauuaggacauauaggaaaaaagauacacacacauacauauauacacacacacaccuuacauguauauaaaauacgcuuuuaaucccaguguuuggggggcagagacaggcugaucucugugaguucaaggccagucuggucuauauaguguguuucaggauagccagggcuauauagugagauccugugugaaaaaaaaagggaaagaaacaacauaccucuuuuggauaagagagagcuauguaguagauauacugaagauacugguuuuauugucaaaacaaauuagguguaaauauuuaggaguuuguuagaagcaagguuaaaauuuauuuugccuaguaguagucaauucagaguauauguaaaauuagaaaggguccagggcuggagagaugacucaacaguuaagagcccugacucuucguucagugagcccagguuucauucccagccacccauauguaagccuucaguugucccuaauuccaguuacaaaggcuccuacacccucuugauggucaagguuaccaggcaugcauguggugugcaucaaucacauaaaauaaauauuacaauuuuuaaaauuaggaaaacauuuaaguacuuauugaaaauguaaucccaguugaguauguauauguaaagguauguaguaaauguguuuccucuuuaaaagaccuauuuaaaacauacauacauauaauaauuagauugccuuaaguauuuuauuacaaaguauuauucgaacuauauucuuacuugcuuuuauuuuauuuuauuuuuuuugucccgauugucuaacuuucaguucauaguccgccaaacuugagaaagauagcccuaaaaguaaacacguuuaaaguagguugaguggcuggguguggugcaucuguagacuuagacucccagaauccagggagaucucugagcuucaagucggcauggucuacauacauagcugcgggccaucuaagacuacauauugagaucuuguuucaagaagcaaacaacuucaccuccccauuuuagacagcacucaggcaguauacauuggcuucaaacuccugagccuccuguccugagaguauuaguguguaugaucauguguggcuugcagaaauguuucuuaagaucaguuucuaguuaaaaaaauaucaugagagucuucuuugggguuugauuccuuuguucuucugcuucugguaaaugaaggauacaaaagccugagggcagagcugcugugcccaugugugacagugugacaguuguaggugacauguuguuggcaauacagcgucaccccagucagauccccuuuuagguaaucaaccauggugacuuagaguugugucagauagaaguggguguuugccauguaggauggaccucaucauugcaaagggcauuccuaggaggugggcaggcauggcugcuuuauugcugucagcuggaaaaggcucagcacaagcugaucuccuggguuaggaagauauuccucagaaacugggggugauaaacuugaccaauuuacuuuccaucuuguuuuuuagaaaucugcuuuuuaauuagacuaagaaguauuucucuuuugcagucucuucuugugaccgugagaacagcucaugugauuuuaaggugaguagaaauguuggagaggugaccgacaguugcuuguucaguuggcuuugagauguaauaguuuuaaacauaugacaguguaacugaacuauaccauauuuaaguuaaaggaaaauauauaacaaugugacuaaacuauaccauguuuaaguuaaauuuacuuguaguagucagcuaacaugcuguucucuuuucugucuauauuguagauauguaauucaccucugggaccucaaccacgaagggacgugggaaggaaagggaaccuauguguauuacaccgacuuugucauggagcucgcucuccugucccuggaccucaugcaccacauccacaugcuggugagucccccacacccacaugcuggugagucccccacacccacaugcuggugagucccccacgcccacaugcuggugaguaccccacgcccacaugcuggugagucccccacgcccacaugcuggugagucccccaugcccacaugcuggugagucccccacacccacaugcuggugagucccccacacccacaugcuggugagucccccacacccacaugcuggugagucccccacgcccacaugcuggugagucccccacacccacaugcuggugagucccccauacccacaugcuggugagucccccacacccacaugcuggugagucccccacacccacaugcuggugagucccccacacccacaugcuucgggugguggugcccagcgcaggagguaagugcugugguaggacaugccauuaaacugcugaccagucaauagagcauccucagagcaugggaaaggggccuucccugcagugucuguggcuuuccuacucaacacaugcucuuuagugguaaugggaaggaaggaauucuugcugcuuuuaccuucuaaggauuuaugguaugguuuccuaccuuuguaauugaaaacaaagucucuguacuuaaaaucuaccucauuaaauuggugugucagaaauuuuggugugaagccaguucagucuuacccaccuauaauucuagaacuugugaagaaaaggcaggagaaucaucaaguucaagaucagccuggguacauacugagaccuugucucaacaaacaccaaggacugacuagggauguagcuaagagaagagcacucaccuauaaaauauaacauguccuggguuugguccccagcaccauagaaaggaaauguaagucucuuugacaggugggcauuuaaaaaaaaaucuaacuaauaaugauaagagucaguguaguaaugggcaauuuauaaacucaucacaguaacauuuaaaaggcacugggacaucacauuuauaaguguacuuuuugaagaugaaaaagguuuagcaguuugcuuuauuuuuuaacuuuauaaauuuuauuauuaaaaaaaaccuugcagauaaacacuacacucuaaaacagaucuagagucuauauaacuuaauguguguguguauauauauauauauauauauaugaaugaaugaauauguaaguuuguaugacuggacaucuuuuuacauuaagcuuuuaaauuuuggguugauuacucaggagagguugugacagugggagggaggaugccuaggcggaagagccauguguacugucuagggccauuggauaaauacaugcauuuauauaacauacugagagauuguucuguuucccuuucaccgaccuuaaagagccucugcuguacauguuccuucaugugaggaaguugugugugugugugcucgccugcacacagguguguguguggauccuugggugggcccaaugguugaugggaagugcucuccccuguugcucuccacccuguuuuugaaacagguuuucuucacugaaucuagagcucacugacgcacugcacugcucagugaauuucagauccuuccggcuuuauccuucuagcucugggguuacaaaugugcauggccacaccuggcauucuguuuaguuuugggguuuuuuuuuuuuuuuuuuuuuuuuuuuuguagccuuggcuguccuggaacucuguccauagacuaggcuggccuggaauacacacagaucuuccaggauuaacugacuggcucaggccuggcuuuucuaugggugcuagagauucuaacucaguaucuuacuccuuuacucaguguugagcuguguccuuagcccuucacauuuguuuuuauuguauaauuuacuucccucuaucuuuuuuuaguuauuuggcaacaucugguuaucuauggcuagcuuggucaucuuuaugcaacuucguuaccuguuccaugagguacagcgucgaauccgucgacacaagaauuauuugcgagugguaggaaacauggaagccagguaagaaaguauggcuuucuuuuagggaugacauagaacuuccuuccugggauguggggaggguuccagagauucaggguucuuauuuuuagucagugucuguuguugcuacugauuggaagcuccugggguucuucugacauguuuguuuugugaaggugugucuugaucacgacuuaaacaugucugcuuguggacauggcucucucacugccgacacucucccuugccagcuugugagaggcuggcccacaccagcaagggcagcauuaguggguacuccuuuuugucuucuuagggacaguuuggaucucugggggucugauugcaguggugucauuuggcggugugugaaauugaugaguuccuccugggccugcuguguguucuacagguuugcuguugcaacuccagaggaacuagcugucaauaaugaugacugugcaaucugcugggacuccaugcaggcugcaaggaaacugcccuguggacaucuuuuucacaaguaggagcuguguacaggguguuugggaauggguuucuguccuuuuucaguggcuuugaacauauucccagcacgagagcaggaauguuaccucagccuggccuuguuggugauguugcuuggaaaccugugacuagcauuuauuuuuuaaccugugagccuuuuuuuuuuuuuuugccuuuagauguuucuuuauccgcauuagccaacuuaauuucuauuuauuagcuuucuucaaaaauuuuccccauuuugaguucuagagaacuggguugaaguggaaccaagaacacuugagugauccauuagcaaagaucacaggcuuggcccuuccauaaaucuccaagaucagagaagaucucauauuucagagcuaucaagacuaagaaaaauaauuuuguacauggauuuaguauuuugcuacugcuagauuuagagguguguuuuagaaaaacaggccucugaaguacuggugccugccuuuaaucccagcacucaggagguagaaucucugaauuuaaggccagucugguguacagagugaguuccaagacuacacagggaaaccccaucucaaaaaacugagagagagagagacagagagagagagagagagaagggagggagggaaacaggacucugaagaguaguaacauaggaaucugauucagauuaggaggaagugacuuuuagcaggagugagaucuuugaaggcagagcaggucaggaggguguaaaaugggaggcacaaggagcagcuccagcagagggcagaguugguguguugauggaaucagauagaagccagcgugggauucaugguggaagaaggagugugucugccagugggguagaugucggccagggcuggagagcugcuggaugggcagggaccacugaagaauuuuaagugaggugcuggauagagaggagugaaugagcucuacagagccaguguuuugaagaaaaggccaugguuauagccauauuggucgguagcuguguaguaaauaggaagaucguuggaguaaagcaguccaggguggaagaggcugaaugcuggcugagugagccacaugggcucugcaguagccgaauggagcuggaggugagaagccaggccaugaagugguggaggagggaccauagccagaggaugguagaugucugcaguagaggugguggccacaaguauuugucagcauuuacaucugguuacugguaaauacaaguaaagcgaaaugagaaaaacaguaauucuggugauuucucacaaaauaugcugaagagaauugaauauguucuaucucuuccuuugaacucuuugauagcuccugccuucguucuuggcuagaacaagacaccucuuguccaacaugcagaaugucucuuaauauugcugauggcagucgugccagggaagaccaucaaggagagaaccuggacgagaacuugguuccuguagcagcugccgaaggcaggccucgcuugaaccagcacaaucacuucuuccacuucgaugguaaaguggcuccaacuucuacagcuauccguguggcuuucugcuaaagugauacuguuaggauuuguaaacugcccuguauagacaaguuuacuaguacuuaaaauuuuuuuacuguccuuuacuaaauucauuuauucugugugguuauguuuguagugcauguauauguauacuacaugguaucccuguggaggucagagggcaauuugugaacauugguucuauucuuguguuacggauccuggggacuaacuggcuuaucagguuuagauaagaaccuucacuugauggguuaucuugccagccuuguauuacauuuuaacuuccuuuauuuaguuuuaauacagguuuuuuuguuuuguuuuguuuuuguuuuuucuguguaucacagacuggccuugaaccuaggguuguugugccuuaguuucucuagaguuauguuuacagguuuguagccaccgugucugccuuaugccucaguuucagaaguguucaggguggacggaugaguagguggaacugagggguuauucugugucauuaauaaguggggugagacggucaguggugcauggcuuuaaucccagcacucaggaggcagaggccagccugucuacagaaugauuuucagggcagccagggcuacacagagaccuugucuugaaaaacaaaggagguggagggugagguggggagguggaaguagugaaacugaauuagugugucuuuaaggaacccacauaacuaguucaauaguuagccuuugcuaaaaguugguuguauugguguguuauguaaacuuaugaugaagguuccuugaguuguccucucagggaggacauagguggaaucugaagggagcccuguugcuuucuucauaaagcauggcuaguccugcagcuuggauucuaaagucauggguauuuauaggggcugauuaucuaucucuccuggagucacgccucccaguggauacugagcccaucaauuccagugccauggguugaugaauuccugcucuggaauuuucuuaggagaggugcuguucagacucugauuuaaguuaaucucagggugaaauaucguaagaguauugguacaguccugaaaggcucaaggggagaagaggccagcgucugaaggagcuucaaggagcuguuuugguucuguuauuaacaaagggaguagagcacagaccuuuagucccagcacaugggaggcagaggcaggggcagaggcaggcggaucucugugaguuucaggccaaccuggucuacauagagaguuccagaccaguugggguuacauggugacucauaaagagaaccaucccaaguguaaaagugggguuuuuccccacagccccgagcuccugagacucaaacgguauuuacagacaccuuggccgcaagcuuugacuguucccagcugacucauagaguagucaucccauuauucuauucuaguuguaccauguggcugguuaccuuuguuccucucccaugcuucugcccuucuccauguuccuggggcaaauccuucacaucuggcucugucccagaauccuugcuucccauggaauuuccugccucagcuacagccagccagucagcuuuauuugacagguaaagcuuccagacagacagcgauuccuaagagccaagcacaagcuuguucucgcucagugcugaacucuuccaugugggccucagcgugcuaguccagccccuuaccucugagccauguaguuccagccauuuucugauuucucuuugagacagggucucaugauguuucucaggcuggcuuuucacuuguuaauucucuugucuguaccucccaagaagcugggauuacagaccugcaccaccagacuugcuuacuagguacagcuucugaaauguguuggcagaucuuggagauggagauauauauauauaucccaucacuuugucccuuguuuuggcaagaucccuuguaucgcaugcugcagcuuggucguaaagcaauacaaccccacacaugaagcucugaagcuugaucugaauguuuuguaguuggcacaugauggcuuugaauugugauccuaaaacaauagaaacgacaccugcuaaugauuacaucacuccacaaaccuauguuggagaacgcuuugaaaaagaauuuauaaucugaaaacuaagguaaccaaccccccauuccgcaaggcacuguuucauuguguagcccuugcuggcuugggguucacuauguugaccaggcugaccuugaauucacagagauccuucugccucugucucccaaaugaucagaguaaagguguauauuagggaauggagguguguaccucucuugaauggguaagagaacaccccuauaccuauuuaaaacaaggcauucagcacaaugcccagaccaagguuaaguuauauuaagcagaaaguacuucaugaagguaaugauggaaauggcucauccacaugaggaguaauuugugcugguuguagcagaggaguggaccugagcugcuagagcaguuucggagucaugggaacccuugacgagagaagggauugcagguggaauggcugucuggccucacguucugccacgucauuaaccuguguggucuuggauguguuucccuaacuucucagugccucagggaccaaagaccaagguuggggccagagucacaucucucaggggaguggaaagcacguguagguuuuggugaggacagaauaaacuaaucuggagaaaacacuuggcaaaaaaggaaagcauaaagaaagcccucaggcacuugguagagugccuggaaacagaugacacuggggcagggaccagggcacuaauucuuguguuggacucugauuugucuuagggucccggauugcaagcuggcugccaaguuuuucaguugaagugaugcacacuaccaacauucuuggcaucacgcaggcaagcaacucucagcuaaaugccaugguaagaauugcugacuguuuaagaugagaacuagugaguggucaggagggcacaaggagcuccaugacaugugaauaguguggcggggauaggguggcggggauagggugcaugaccuugcugguuucucauagcacagccaaguuuucagggaccacuuccauuucuuuccauucacuccucucuucuuugucucccuccccucuucucucccugucuggaacaaaagauuaaauccaggccugaauguacuaagagugcuaccucagagccuugacacgauaauaagcuggugcugacuagugagugcucagguaguaaggcaggcagcccacaccagucgggaacuugcuuguguuuuaccuguggcagugcucacuaccaggucuaccuuacugugacccaagcccacgcugagacuccuugauuuaagcaaacauucagaaggaaguaucaacaagagugaacaauauaaagaauuacauaagaauuaucaaauacauuuuuuuuguuucuuugccuccaaaguguugugugugugugugugugugugugugugugugugcaugucucugcaccuuguaacuuugaggcaugcuguuggcucaaggaaauuguccaaauacuuuuuguuuuuguauuuuucugaagcuguguauuugguuuuuggaauaggguucugucugacauggaauucuauguagaacagccugccugccuuuuuuccuccugaguguuggaacugaaggcaugugccaccaaaccuggcuaaaagucugucucugagcugggugugguggugcaugcuuuuagugccagcacuugggaggcagaggcaggaggauuucugaguucgaggccagcuuggucuacagagugaguuccaggacagccagggcuacacagagaaacccugucucgaaaaacaaaaacaaaaacaaacaaacaagcaaaggaacaaaaagugugucucugugaguggacuguacucagcucagcaauugcagugcccucaaggcagacaagagucuucuugggaaggguggguuguguguaagcucaaagguuggcaagaugguugguguauaggaaggaaacaguugcucaggcuguggugagguuguacugggaacuugggaaggguuugucaaaggaaauucuuuucuuuuucaucccuuccucucucccucccuggucucucccucccugguggagcucuugggaguuaauccuggguauugcuuauauguucgggcuccuucuuuccuccccucugccucuguccccuucucuucuuuccucaugcuggacacuaagucuagggccugggccugcuaggcaaggguuuugcuacugcacuacacccucgucucccugcuuucggagauagguucucuaguccagguuggcuugaacucaugaucccccugccucagccuccugaguauugggauuagagagcacagccauggguuguuuuuuagugaggaaugugugacuaggaaugaucuuuagaaaaguagaaguugagguacaaaaccaggagaaauacugacugcaaggguaccacccuucaggugaagggguaggguggaaguggggaagggaagagagcuuuaaagacagaaggaggggugauagagcugcggacaauguuugggguuugggugaaaaaggaaagauugauuggcuuacaguaggcuagaaguagaagcaguuugaaugugaaugaauggacagagaggaaacuugugcauauaguggaauagugccuuaaagcuguggggauucuggcccuugcuauccuguggagacaugcgaggccaguaugcaaagggaaaagcugcggauaaaaagacaggauagaaaugguuuuugaucacagcaaacauagaaaaugcaggauacacggcuccugcugucucccucuugcuccuuccucugagaucaucaccauguaaacaaacauaggugcucugggauggaagagcgcuggagggcucuuggcugacucuggcuggcaacagcuucauuccaggaggugugagccuccugagaagggguugguuuaaaaucuuagguaggcccuaucagcucuuuagucuacuucagaugauucaaauaacuaauuuuuagcacaacgaauuuacuggaacuaugcauuuuuaauuaaaaucuaguauuuaacugacuggauuuucugguagaaagauuuaugauagaaaguucaauaaaauggauccagcuuuguuucccuuuuucuuuuccucaauugguggagagcuaggugaggaggggagaaugcuuguagagacucuucccacuuugcuuugauuugauugggauaaaauguuccuuccaguccacaugcugugagggggucuccagugaugcggagccuugggcccucugggcacugaacaucuugccauugucucucccaagugacucagcaaagcucuggacaguuuucaccugagcugcucuuucaguugcagugcugagacacaagccaucacgugcaguuugugaugcugugcuccuuugaaacugacauccaggcugggcagugguggcacacaccuuuagucccagcacuugggaggcagaggcaggcggauuucugaguuccaggccagccuggucuacagagugaguuccaggacagccagggauauacagagaaacccugucucgaaaaaccaaaaaaaaaaaaaaaaaaagaaaagaaaaaagcaaaacaaacaaaaaaagaaaaaaggaaacugacauucagucguacuccaaggcaguggucuuuccugcuucuuccucucucuuuucucucuugcucuguaaauuauggagauuuuucuacaauacaaaccuagaaugcaagcauuuauaaaauauauuuauauguauaaaacacaugcauguguucacacacacaaguuuugaggugcuugaauggaaguauggaugaauuugaaguauggauggaaauuuauguauuuguccuguacacacauggcuaaaccucuaagugugugcagugauggaucuagagcauuguuugaaaauuguaguucugaggcaguacuagauauuuucauaauccuaguauguacccagguugguauugaacuuauagauccuccugccucugccucugggugcuagagugagaguggcaugucaccaugccuggcuaaaaauugacuuuuauaaauuaaaaagaugggcuggagagauggcucaguguuaagaccacugacugcucuuccaaaggucccgaguucaauucccagcaaccacaagguggcucacaaccaucuauaauaggaucugaugcccucuucuggucugucugaaaauagcuacaguguacucauacacaaaauaaauaaaucuuaaaaaaaaaaguuuauaaauuaaaaaauauauuuuacguuuugcauauagaaacuuacauucuuuaauucuauuuuuuaaaguugcgcuuauuauuuguaugcaguaaaaaugugcuuugguuaaucucaaguuuagcucacacagcuguguagacuuaaucuaacaagagucagaguggcucugcugcuccucucuguggguccaagguucuuuugaggucaguuucuccccagccagggccuccugccugcuagacaagcuccugagcagaacgcccagccccacauugcucugcuuucccucucccugugccuguuuccagaugucaucuaauggagucccagucuggcucucccuuggcauaguggauaugaauacuacacaugcugugucugaacaucgaacuuuagaaggauccuguuagcuuaggauacacguagguagauacuggcacacauaaagucaucaaauagaucuuuaaagccagaagauacucugacuugacccuuucuugagauacuacuagauuucugucugcucuuuacuuugaaauugcugguaucccagaagucuaguacccuacaacaauaaaaagaaagcagugugcaggugaucugcugagccaaaauggccuuuaccugugcuuucaagauaaugaugucagccucuguguccagggccugccaagugugcguacugacccucaaaucugcugagagugaccuuugcuguguguccuucauguuucucuaggcucaucagauucaggagauguucccucaggucccguaccaccuugugcuccaggaccuccagaugacacgcuccguggagauaacaacagauaacaucuuagaaggacggauucaaguaccuuuccccacgcagguaaaacuggagcuuuaugccuaacaaauguauuuuauuuuuacaaagaauuaguccuaacaccuaaauauuauuuauaauuugaggaaggguuuauaugaauuucauuucauucaaaucuuucaugagaacagauuaaccaaagguaaauacagauaauccaaguacauuuuaugcagaaacauaccccaaaucagcuuucccucacugcaggucuguaccgggacgccauuggcuccugucagaggcuggcaucuauuuuugugaagagcaaagagugacuauuuaggcucugcuugguccacagucugcugcaaauaaaguggccauuggcagugaggauguggaugagcaagacugugguccaguaaaacauucuuuguagaaguagagaggggcgaacauggggcuaugguuuauggagcacuggcacuccaagagaaggcugguuguacaucaugugguguguuagugacaguucacaucucucagggagcugaggcuuggacuuuggacuucauuaaaaaggucagaguuugugccucaucacucggccucugagagaggcacagaaaaagcaagagaggagccuucaguaauacugaggaauguaauauaaggccagacagucaucuaccaaaaguuccuguguacagccuauaagugaacagaaauauaucaauacaauucaaaaagaugaagcucuuuugacgaguguagccuuuggagacagcugggcuaaggugcuagcuauauggucccuugggucucagcucucugaccugauuguuagcugccuuuggagcuggcagaguugccucauauggcuggauagggcugucagugaaacacauaaaccagacagcagacaugaagguacucagaccuuaagcgauaaagccuguggggaggacccagaacaucucuagucuggagacuuaauugcaaugccugcuucagagcacuuuaggaagguuaugaaaaccgggaacaguguuuacuccgcgcaguugaccuuugcccuugcuuuuguugugcaaucacuauuauugaacaggaagcugaauauggagcaguuacuaacuacucucaaacauggaacuccaugagggccuccacauccuucgucucaccuuucaggcugugagcugugucgaaaacugucaccugccccuuugucaccccacccugaaugacugcaugcuuucuuucagcggucggauagccugaggccugcacugaacagcccaguggagaggcccagcccugaccuggaggagggagaagcuucuguccaggugaggucagcuuaccaggagcugugcugcaggagugcagcgugguccugcguuacuuacggccaccuugcccuuggcagcaacagcuuaagggaagagcuguguauucugguuaauaguuggagagaguuuuagucugucacaguggggaggugugcugggguaguugaguucauggugaccagaucuuuugauggaggaaauuucaucaucacaggcuagaaagcagugagcagggcagagacaggagaggguuaucaccuuggaaggccugacacuaguaacuuacuuuugccugcuagaccccacuguuagagucccguuucccguaucacauucgugauuggagcaggcccuggugguaugccuccucagagcccaagacuccugcuucugcuuccugucuggcaaaaguuccagcagacacuuguguaggggugcacuugucaagggaaggcaaaggccuguguuaacagcugccucucuguccagacggagcguguaccacuggaccucaguccucgccuagaggagaccuuggacuucagugagguagaacuagagccuauugagguggaagacuuugaggcccguggaagccgcuucuccaagucugcugaugagagacagcgcauguuaguucagcgcaaggaugaccuccugcagcaggcucgaaagugaguugauucuccagcccuaguuggcacacauaaguuacggggcagauggcagucgggugccaaugugucucagccuauaccugaauuggcucugaggaggaacacuguuaacccaugugacagacacagguaauaaaccgauacuuagggugguuaauccugccaggacccgagggaggucugccuuuaagauuccucuugagcacuguuccuuggaccggcagucugagccaggcaccugcgauccaugaguucccugcaguuggugguggcuggagcaugcacugugcuugggggugggaagaaacuuacuucaguucuugcagcuggguugugggccuugcacagaccuguugccauaagacccagugcugucugugggagggagagagggagagcagagaaaguugaacugccauuugaucauccucucccugggaauuauguucauccauggacgagucugugcuggccuccugccuggcuucuucccucugcauccuucuuggcucugccuucuuccucgcuuccucuccuuuuauaguuuuggguugaguacaggguuuuacacacacugagcaagcgcccugcugcugagcugcacuguacccgagccaugggcaaggcucuucucaucacaggaugggcuugagugacagcuuugugaagaugccuguggagaaggggaaacugucuucccguuucccaucuuucucucucuuguggcuuuauuucuuauaggcgguucuuaaacaaaaguucugaagaugauggggccucagagagacuccucccuucugaaggcacauccucugaccccgugacccugcgccgaaggaugcuggcagccgcugcugagcggagacuucagaggcaacggacaaccuagugcuuccucaccuuccucagccuccugcccagcucuaccuaccggaagaggccugucccaguucugccugcuguguggagaccugcgacugcauugcugcugcauaaagcauguggucuuuaguguguggacagcugacaaauuuaauccuuuguaauacuuucuuugugacauuucucuuccccuuagaaacauugcacauuuuaacucuaggcauggccucuucugguguugacuggacuuguugggaguaggggacgagcaaaaagaagugggcacuggggcgcucgccugccugcagcagcuaguuugaauuucuguuuugauauaaaccacagcagauguugaguauuuuagcaccacagcuggaaggaagcacggaucuuggggagggugcauaacagcagucagaaggugcgcagcaggagccugaccaccacuauggcaaaguagccuacgauuaaaugcugugcuuagggaggaggccagucccacaggcgccuggaccucuagaccagcaggacaugguguagaaagaacugguuugguaccuggaguagaaagaggaagcucagggcugcagaaugaggaggcccuuuucugcccuuaacauucaggaccaaucugagcccaguccccagcuggcuucacuuccgucacucuggugcucucgcaucacagaagcuugcccccauggcugccgccucuuccuuuccuuugguuaugacuuuaauuccuuggucaacccaauuaggcuaugcuaaacauauggguuugauccuuggaaaaaggcauggggccugcccagcaagggcagggguguuuggaggacacugcugaagaaacaccuuucguaucuuugucccuggagcccuugaguucccugcuuuuguuccugugggucucauuaaacggaaacagaggauguugaauaauccacaugccucaagcagacucggucccagaucggcucaaauucuccacguauuuaaggauuugaaacaugcaaucauaggauacauaguuuuaugucccauuggauuaagguuuuuuuuuuuuaauguuucaaaacauaguuuuaugguaguccuuuugggaaaaauccaguauuaucuaaaauuauuggcaaaguuaaauguauuuuacauaccuggaaguuuuuagacuguugauaaguaacugagaaaggauaacaggcgccuaggugaagauaauuuauuucaauaaaucuuucaaaagccuuaccuugaacugcuguuaguuaaauuccuguggguuuuuguuuuguuuuacuuuguuuugcugagagcguagcaauuuguuuuuauuguaaagcaacaauaauaaaaaggaaaaucucuuguaguguggugugggggcaguggagucccacgcugcucugugugugccguuuggguugggguuuauaaugcuguucaacugggaggggcgugguuuauaaugcuguucaacugggagggcguggucgcuccuguguuuuacuuggaggaggaagcacugagcuugucuuugacaccuuuccaggcugcacaugaaaauaaaggggaagcuaaguccacuguucuuccauuucag

SEQ ID NO: 4646 - RNA, 3461 nt, Mus musculus
ugccuaacaaauguauuuuauuuuuacaaagaauuaguccuaacaccuaaauauuauuuauaauuugaggaaggguuuauaugaauuucauuucauucaaaucuuucaugagaacagauuaaccaaagguaaauacagauaauccaaguacauuuuaugcagaaacauaccccaaaucagcuuucccucacugcaggucuguaccgggacgccauuggcuccugucagaggcuggcaucuauuuuugugaagagcaaagagugacuauuuaggcucugcuugguccacagucugcugcaaauaaaguggccauuggcagugaggauguggaugagcaagacugugguccaguaaaacauucuuuguagaaguagagaggggcgaacauggggcuaugguuuauggagcacuggcacuccaagagaaggcugguuguacaucaugugguguguuagugacaguucacaucucucagggagcugaggcuuggacuuuggacuucauuaaaaaggucagaguuugugccucaucacucggccucugagagaggcacagaaaaagcaagagaggagccuucaguaauacugaggaauguaauauaaggccagacagucaucuaccaaaaguuccuguguacagccuauaagugaacagaaauauaucaauacaauucaaaaagaugaagcucuuuugacgaguguagccuuuggagacagcugggcuaaggugcuagcuauauggucccuugggucucagcucucugaccugauuguuagcugccuuuggagcuggcagaguugccucauauggcuggauagggcugucagugaaacacauaaaccagacagcagacaugaagguacucagaccuuaagcgauaaagccuguggggaggacccagaacaucucuagucuggagacuuaauugcaaugccugcuucagagcacuuuaggaagguuaugaaaaccgggaacaguguuuacuccgcgcaguugaccuuugcccuugcuuuuguugugcaaucacuauuauugaacaggaagcugaauauggagcaguuacuaacuacucucaaacauggaacuccaugagggccuccacauccuucgucucaccuuucaggcugugagcugugucgaaaacugucaccugccccuuugucaccccacccugaaugacugcaugcuuucuuucagcggucggauagccugaggccugcacugaacagcccaguggagaggcccagcccugaccuggaggagggagaagcuucuguccaggugaggucagcuuaccaggagcugugcugcaggagugcagcgugguccugcguuacuuacggccaccuugcccuuggcagcaacagcuuaagggaagagcuguguauucugguuaauaguuggagagaguuuuagucugucacaguggggaggugugcugggguaguugaguucauggugaccagaucuuuugauggaggaaauuucaucaucacaggcuagaaagcagugagcagggcagagacaggagaggguuaucaccuuggaaggccugacacuaguaacuuacuuuugccugcuagaccccacuguuagagucccguuucccguaucacauucgugauuggagcaggcccuggugguaugccuccucagagcccaagacuccugcuucugcuuccugucuggcaaaaguuccagcagacacuuguguaggggugcacuugucaagggaaggcaaaggccuguguuaacagcugccucucuguccagacggagcguguaccacuggaccucaguccucgccuagaggagaccuuggacuucagugagguagaacuagagccuauugagguggaagacuuugaggcccguggaagccgcuucuccaagucugcugaugagagacagcgcauguuaguucagcgcaaggaugaccuccugcagcaggcucgaaagugaguugauucuccagcccuaguuggcacacauaaguuacggggcagauggcagucgggugccaaugugucucagccuauaccugaauuggcucugaggaggaacacuguuaacccaugugacagacacagguaauaaaccgauacuuagggugguuaauccugccaggacccgagggaggucugccuuuaagauuccucuugagcacuguuccuuggaccggcagucugagccaggcaccugcgauccaugaguucccugcaguuggugguggcuggagcaugcacugugcuugggggugggaagaaacuuacuucaguucuugcagcuggguugugggccuugcacagaccuguugccauaagacccagugcugucugugggagggagagagggagagcagagaaaguugaacugccauuugaucauccucucccugggaauuauguucauccauggacgagucugugcuggccuccugccuggcuucuucccucugcauccuucuuggcucugccuucuuccucgcuuccucuccuuuuauaguuuuggguugaguacaggguuuuacacacacugagcaagcgcccugcugcugagcugcacuguacccgagccaugggcaaggcucuucucaucacaggaugggcuugagugacagcuuugugaagaugccuguggagaaggggaaacugucuucccguuucccaucuuucucucucuuguggcuuuauuucuuauaggcgguucuuaaacaaaaguucugaagaugauggggccucagagagacuccucccuucugaaggcacauccucugaccccgugacccugcgccgaaggaugcuggcagccgcugcugagcggagacuucagaggcaacggacaaccuagugcuuccucaccuuccucagccuccugcccagcucuaccuaccggaagaggccugucccaguucugccugcuguguggagaccugcgacugcauugcugcugcauaaagcauguggucuuuaguguguggacagcugacaaauuuaauccuuuguaauacuuucuuugugacauuucucuuccccuuagaaacauugcacauuuuaacucuaggcauggccucuucugguguugacuggacuuguugggaguaggggacgagcaaaaagaagugggcacuggggcgcucgccugccugcagcagcuaguuugaauuucuguuuugauauaaaccacagcagauguugaguauuuuagcaccacagcuggaaggaagcacggaucuuggggagggugcauaacagcagucagaaggugcgcagcaggagccugaccaccacuauggcaaaguagccuacgauuaaaugcugugcuuagggaggaggccagucccacaggcgccuggaccucuagaccagcaggacaugguguagaaagaacugguuugguaccuggaguagaaagaggaagcucagggcugcagaaugaggaggcccuuuucugcccuuaac

SEQ ID NO: 4647 - RNA, 21548 nt, Mus musculus
cacuuccggcguguguuccgcgccucuugcucucgacuguuaauggcgggugguggcugcugagcgggacgcagauaaccgcugcccgccccgcggacgucuccccgggcccccgcuuucugcacguccccggcgucggagcuguucagcaugucuguggugccgcccaaucgcucgcagacgggcuggccccggggggucaaccaguucggcaacaaguacauccagcagaccaagccccucacccuggagcgcaccauuaaucuguaagugcggcgcggccucggccguugaugcucucccagugcgcgcuccucccucacgccggaugcggguugucccuuccgggaugcgcgcuuucuuuccuagaccuguuucucgaccccgacuuggcaguuuuccuauuuuaaaagcgagguucguuucccccuuucccuucauucagccaugguuagaaccugcguuugcuuugaauucauaauguguguauccuuucaauccguugcugguuguuucaucgcacauguauuuguguuuauuugaacaauucucaguuuuguaggguguacauuucuuuuacaguaacuuuuccagauuaaccucugacauccuaguuuuuuuuuuucccccuuuaaauguuggguaguguuccauccaguggccacauuuuauuaauuuucgcgcuguuuggucuaccuuuuugcauuuguaugucuugucuaccaaagugccaacauacaguaucauugcagacucccaguagaccuaaaauugcgaggacacacucuguugucugguuguacuuucagaggucggagguaccuuacauguugucccgacagccuguuugcaggcuguuuuguuuucaacaaaccuuugucuuaagcagaugauugcauuucgggaucacucaaacaaaauuuuguuguggcaagaaauugagauugggauauagcuuauaauguuugguaccucauucccuaguguggagcugauucuaaugggaaaaaaguguccaguuuagacugguuauuuguuuaaaaugugcaagacauugcugagagugggguuuguguaagucauuuuagugacucaccuuucauauucaaauaaauaaacaaaucucucauauucaaguaaauaaaccauuccuccuaaaacuaaaugugacaugaaguugaaaacuuguugagcucuugagaacuguucucaagaacaacuacuacuauuguuuuugacaaaacaaguaauggcacgcaaacuucgguaaugaaaugcaagguuuauaaaauguggaaauaguugacagucgugucugugcaaauuuacuuuugucccacaauucacaguagcacuuuaauuuucugucacuuaagugcuuauaagauucccauaaaaugggagaggcgagugcuccuuuaaaaagaguggaggagcacaggaguuguuugcuaacugguagugggcuugccucguguguggaaugcccuggauucuaucgccagcaccucaaaaaagugaaaaauuggaagcaugacuucaccauaggucuucucuaaacucuccuugauuacugugucuguugacagcagccacuggggagaguuguugaaauccauguacuuugagcaggcgguuuugcagguugagcacguaacuuuugcuuccuguguaaaugcaguguugagaaguaaaauuguugugcugugaacuugaguucaccugaggggguuacccauuaaguagcaaguacaucuuuuguuucugcaguccauucccauucaggaaacacuggaugggucccaguguaccacugugugcaugcacauggcccgguguguagaugcacacucugcuuuaagaugccuacaguaugaugugggggagaauaugcucuuugugggcugcugcucagauuucacagcuagaaauuggaacauuucguucugcugagauccugggauguaggagauagcccuugcaauagaaauguguuguggcuagucucaauucuuuguaauguagguuggggaaaccaaaaguuaacucauguaaugcauuguacaguacauaaaacuguguguaguaacuucuuccuaauauuguugguauaagauucauuuuuggaucuaccgcaaaaguguugauagucuuuaaaguccccugaaaauggcauguuuuuauuauuuuagagcuacuuuauguuuagaauuugaccucuggaauuaaucuuuuccuuuuggcuaccuugauuucccuucucaagaacaacugaggagagagaguauguaguugucuauuaccgucaagaggguuuuuugguuugguuugugugugugugcauguugcacaugugugcuauaugcauucaugcagauauauauaguuguguaugugggguauauguguguguguucacagcauuugugaauguauguugugcgagucacagcacauguguggaagucaggacaaucucaggagccaguccaccuuguuugagaauagggucucuuuugaucugcgccagguuaccugacucguaagcuuccggggauuuuucugucugcccuccagcuugcuuugggagcacugggcuuuuagguguuccgacugcagccagcuuugcauggguucuggagauuggaccucagaugcaguuugcaugucaggugcuuuacacaugagcaucucagcagccuaguuuuguaguguuugcaggugugccuacguaugcuaucucuccagccccucccuucccacuuuuuuuuuugagacgagagucccucaccauccuugaacuugcagaguaagcuaggcugauuggcuggcuagugaaccccagaaauacaucugucuucaucuccacaauauugggacuacugugcucagauuguguguguguguugguugguggguuuuauuguuuguuuuugguagguuguaaauguaguucuggggguuuuucuauccccuccucucucuccccuuugcucccagguagugacaaaacauuucagugugcacuuuauccugaauaaaaggauuugguguucuuauuaacaagccgcagccacuaugccaugcagauucugagcuauucuaauucaacuaggcugccaauacccagccaaauggucuuuugucugaaucucgcccuagcuuagucugguccauguguguccucauggcccugguugcucucuccaccuucuuccuucucucucuccuuuugagaccacauacugggaucagaaguccugcccuauucucuucugcccagcugauuggcagaucagcucuuuauuaacgcaucagagguaauggaaaccaguuuuuacauaacauugagacugaagguacuuggccaugccauugucaggacuguaaccaggugucugggcauagaaaucagcaucugagaagacagugcacaaaaccuucuccaaccgugggagcuggagauugaauuuagguccucauguuugcuugacaaguacuuuacuaucuucccaggccuauaucaagggguuuuugguagaugaaauacuuugggauuagccauguucagucaaaauauucuuacuggggaaaaaaacuauauucaagggguugcaagguagacugugguacaguguaaauauggauuugaucuuuacuaagcaagaugaagucugacaccuuaagucacaguuuggguucucuuacacaaggcucagagggaaagagaaaacaggucuaagccacugguacuacaugaccuuaaucccagcauuugggagggagaggcaggugggucucaguguuaaaggccaaccugauaaauaagugaguuccaggucagcucuaugaaaaaacaagcagccaaaaacugaagaaguaaaguugauccaaaaaaggaacuagaaaaauuugacuauuuguuaacugggaggaacagagaauaauuggcaccaccagugagguggcucuaaggaugggggugcuugcugcuaagacuguugaugugaguucaguuccccagaagccacauggugaaaggagagcacagacacacauuguagaacaccauacauauauguguacaaacacucauuuuuaaagauauuaaaaggcaagcaacuagagagcugcugauagacagugguggcucagcacauaggagaaaacagauuagcuguuaguacagguugguuaauagaaguuguaacuagauuagucagaggaaccaggcugcuacuucugguaucagugccaugaaaugaucuaaagccaguauagauaaacacuuggcuaagcauuucagggaccuuagggcaguguugucugugacugaggaauggaagagcuggguucaggaaucaggcagcagcaguacccugcucucugcucucucauagcugcuuacgaagcuuugacuggucuggcacaguguaguuuuguauguguuuguaugguuucuguauguguuguuuugaacuguccugguaaguaaauaagagcauugguucucaugcuaauguuuguauuuggcucacagguacccgcuuaccaauuauacuuuugguacaaaggagccccucuaugagaaggacagcucuguugcagccagauuucagcgcaugagggaggaauuugauaagauugggaugagaaggacuguagaagggguucugauuguucaugaacaccgccugccccacgugcuccugcugcagcuggggacaacuuucuucaaauuguaaguaguguuagaaauaacagcaggacaacguguaaaaaaugacuguuuuaaugcagcuuaaaauaaaagucuaaccuuuauuuauuuaaaccaguaccaugaaugagucuuugaagaaaagacuuuucuccaguacaaugcuuauuuccuuuccauagagcuacauuaggccaaacucgauuucucaaagugaugggacuauuacugaauucaguuguuuucauguagcuuaaucacuugagcuuaugacucuaaauauuuacuugcccacuggucagauugugccaaaaagaaaggccuugccggguggugcuggugcacgccuuuaaucucagcacucgggaggcagaggcaggcggauuucugaguuccaggacagccagggcuacacagagaaacccugucuugaaaaacaaacaaacaaacaaacaaacaaacaaacaaacaaaaaaaagagagaaagaaaggccucaaaacuaaauugauagucuugaaaaaugucccauucgggacuacagagauggcucagugguuaagagcacugacugcucuucugaagguccucaguugaauuccuagcaaccacaugguggcucacaaccaucuguaaugagaucugaugggggaccagagauucaauucccagcaaccacaagauggcucacaaccauauguacaucuacaguguacucauauacauaaaauaaauaaauaauucuuaaaaaaaagaaaauguccccauucuucagaucuaagaaugcagucuguucucuggguauuuguuugcuaaacuccauuaaaucuagcuuuccuuugaggaggcugacauggauuguuggccagugauugugcucauuauauauacacuaguuuugcuguuuaaacuuaggauuguauacaguggucugguacuuaauauuauagauucaacuucccagcacagccuccaccuuuggcccuuguuuugauggcuuaucagaugucacuggaaugugucuucucaguuacccgauugaagugaugauaguuguguucuugcuguuauccccaaauuguauucaauuguaacgugaacuuguuaacuuuuacagaccugguggggaacuuaacccaggagaagaugaaguugaaggacuaaaacgcuuaaugacagagguauuuuucuguuuaaccacuuucacaauucuauugcccaucugaauacuaucuacuuaauaaauaaucaaauucucaugugucuuguagaaauaaauuuaauuugagcaguuuuuagucaguaaguagaacuuaaaucugaauuaguauaaauuguuuucuggaaaauaaauaugucugagaucuuaagcugagaucaaaggauuaucuuguucaagaccauuuagguuacauagugaguucuaggccagcugggccacacagagugagacccaauugcuaaauaaacuaaaaugucgaugaaacaauaaugcucaggugccgcuuugguagcgguuuccgaggaaagcuacucacguuuccucugguucuucugaaaacuaccaaaacgucaggagaaaggucauuuuuuuuuuuuaaagguauaaaauucaguaguguuuauggaaugcaaaaaugagaccuuaacaaaaagaugaagucauaacuaagcgagagccagaaggcuguggagcacaccacagcagacucagcagaaauggagcucagcaggauguccgucagaaacgcagcggagaagaacggagaggcugagggauugcccgugcuagcuuccagggccagugagcccgugcgucagcuggauugguugacucuauaaagguuauauugauauauauugucuuucccauucuguccaguugugccaggacugacuauugacugagucagugggcacuaaaccagcuaacauuuagcaguaaaauguuuaagagauggggagaauaucugaaaacuuggauccugacuaguaagcaguguaggagucacgcugugaaguaggacugagagcagccgucaguguggaacagaacaguaccguuccuagcugagaggugguacugggcagaagacuggagauuucugcucugcagagugaccaguccaagaaaaguaggugauuuuauuugaagucuuacgagggggcauagcugugucagaacuccugcaccuaaugagcagauauaucauuggcuugugaagagaccuuuuuacgaaaauacagucuaaaaaagcaaaaggaauucagccaaaauggaagcuaaaugagucacaaaaaucaugauucucucggaguaauagcggaagugcuguaucugugaaucgaggagccgcuuagaagacuuuagcagggcaggugggauggcucaguuaauaaaggugcuugucaccaagcuugacgaccugggcuccaucuccagaaccccuguacgggagggagaaacuugaguccacagaguuguccuguaaucgcuuguccugugaucucuuguccugugaucgcuacaugcacuguaaagcaacuguaggaaaaaauaguuauuuaaacucuugcagaaauuucaaaacuguacugucuuauaccauuucuuaggagacaauagagaaaguuugcuuucaagaugaaggaauaaggcaggaaugauauaauaaucagaccaugaaugugcagugcuguaggggacaggccaaagaaggccuugugcucagcugugaacugggcuguugccagagcagaauagacugauagaggaaaaggaagacggguaaugguugccguuugaacugaaaacugaucugagcucucagauagugugggaauaaaaacauuaccucagauaaguaaucaugguucauacuagcagugaaucauauugauaacaugacccuuucauaugauuugauauccuauuagaauggcauuuuaccucuguuaucuuccgugccagaaucucaguguuacugagaaauacuacucaaaaauccuaacucgcauuucucaaaucugucaagaucaucaaacuaucauaacugucacuguccagagcagccucggggaaacugauggcauaaguaucguaucuuaaaugggauccugggccugaaaagggacauuaggugcagaaauuaaagauacccauaaacugucuggguuucuuuaguaugauauugauucauugguuuaacagauguguuauaagaucaucagagucggggaaaggugcaggcaucauggcagugcccggccuguccuaauauucuacggcaguuggaaaaaagaaauacuggucaacauagagauaaauacugggcaaaacaacugaacccagaagggaauucucagguguguguauucauuacuauauuacuuugcacagauacuuggucgucaagauggaguccugcaagacugggucauugaugacugcauugggaacugguggagaccaaauuuugaaccuccucaggucaguauucaguuguguucaccaggcauuugguaaagcagaaaagucacuaauucaagacauuuaaagagugacuaagggcuaguaagguggcucaguggguuugcuaccaagccucaugacccaaguuugaucucuggaacucacaugguagaaggauaggacaauguuguggcaucuacacacacacacacacacacaaagugaaaacguuuuuuuuuuuuuuaagauguauuuauuuuuauguauauguguguuuugccugaauguauguauccuguggaagccauagaggaugucggaucucuggagguuggagucacauaugguagcgagcugccauuuggaugcuaggaauugaaccuggguccucugaaagagcagccagugagugacucuaacugcugagccaucucuucaauuacccucccaccaccuuuuuuuaaaaagaaauauuagaugucuuuuuguuuuuguuuguuuuguggucaaugguaguuugccugcauguuugucuguguaggugucagauacucugaaacuauaguuauagacaguugugagcugcuuugggggugcugggaauugaaccgaggucuuuuggaagaacagccaguguucuuaacuacugagccauuucuccagccccauaaauggaaauuuuuuaaauaaaaaaugaaaaaauaaucagaguagaccuuagcuucccauuucuuauucccauuucuuaauuuugauuuaaaaaccauuuuuaagaccaaacagcuuuuuccuuucuuguguaugagugugugucuguauauauauauaugucugaugccuggggagucggagggaggaagugggucccaggaaguauaguuaagacgguuguuaguuaccacaggugcugaaaaugggacccucucucucuuaagguuuuauugaugugaagagucacuaugaccaaggcaacucuuauaaggacaacauuuaauuaagacuggcauauagguuuagagguucaguccauuauugccaaagcaggagcauggcagcauccaggcaggcauggugcaagaggagcugagaguucugcaucuucaucugaaggcugcuagcagaauacuacccaagcaucuaggacuaggauguuaaagcccaugcccacagugacacacccacucuaacaagaacauaccuccuaauagugccacucucugguccccauagguuuguucaaacauaugaguccaugggagccauaccugaacauagccacucccugaccuaaccuaagaauauacaaaccaccacacuucucaaacacaaaagaaacaaguagaaauguuuaaaauuuuaaaaagaucaaaguggaccuugacuuuuaauuuuguuuucuugacucuuuaauuuagauuuagaaaacauuacaaagccaagcggaguuuccuucuucucuucuuauuuugucuuauguaugcauguauauguauguauaugugugucaauguauguauguaugugaugugauguauaucgaauguaauagauagccaagucuagacuugaacuauucuuccucucucuccaaagcauugggauuauaccaugccaagacaguaaaccacaguuucaggaugauucuguuguuuuguuuccuuuuugacguguuaacgauugaaccacaucuuauguaugcagggcuaauuccagcccaccgugcuucuuuuaagagaaaaaauuuaaaauauguagaaguagaauuuauaguaaguaaaauucaccuuuaacaauaaauucauagugaaguguuuuuuguuauguuuguuuguuugagauaggguuucucuguguagcccuggcuguccuggaacucacucuguagaccaggcuguccacuaacucagaaaucugccugccucugccucccaaaugcugggauuaaaggcaugcaccagcacugccuggguuuuauuauuuauauauauauuuauauauauucuaauguauaugaguacucugucuucaugcacacaagaagaaggcauuagaucccauuacagaugguugugagccaccaugugguugcugggaauugaacucaggaccucuggaagagcagccaguagucuuaaccgcugagccaucucuccagcccagaugaaguauuuuucauucccucccucuuacugcugcuucaucuuccugcuuuccccauggacuguuugaagcaaauccuagguguuguuucaguuguaaauauuuuagugugaauuguaaaggagauuuuauuuuauaaagcauuggcaauggaaacuagaaagaugguuuaguagagggccagcguuccauuuccagauauauauugggugguucauaaccaccucuaacuccagccucagggaucugauagcucucccucugugggugccugcaccuauauguguagacacauauguacacacauaauuaaaggcugaguaaacccuuuccuccccaacuugcuuucugguuguaguguuucguuccagcaauagaaacccugacuaagacaguugauuuucauaacguuaguguuaacaggucauucauuguugauaacuuccuagagucaugaagucucuggagauguguuuuucuuuuuuaacacagaaaaccuuaaccucaucaacuacuugguuacucuggaguauagaguucuauaggaaauaguagaugcuucuuuuccuuuccuaaguuuucagaagaaugcauucauccuucaaagauacauuauggagugaaaaaggcagauguggauacagauugagaagugagacaggaaguagcaaaguauagggagaggggaaccagaagcagcagucauuuaaaaaaaaaaaaagguaggcaugguggugcaucgcuaaccucgguauucugugggcaugguggugcaucgcuaaccucaguauucuggagguagaggcagaaggaguucaugcccaaucuuagcuccauagugagcccugucucaacaacaucagagcaaaacccccccacaccccuacccccaagaacaguauugaccuuacuauaaccaugaacagcuagaucaauauugcuaagagcugucaaggaaccauagugaaugucccucugaauugucugucaggaagauggaaacccagggacugcugccuccccuuuggcaagacuugaaugaauuucucuacaauuucaugaguugagaaacuuugcagacuccagaaaggcuuggccuacccuaacaucugagggagaaugauucucaggugggcuaugaacgccucauuagaauguugguaugacuguggacuuaauauauuuaagguauuuaaguccacuauaaugaccaauaauguuacugaugcucagauauucauaauuuggauaguaucuuaacguugggucuuaagucuuuugaaccgaucaaaagcccuauuauuggagagcuucuuuucuuuucauaacaguauguuccagaucagguuuuacauaauauuggacaggcaaaagauguucuguccucuccugacugccuguguaccuggggacaagugcacagggcucuguggacacugguguuccugagcauugccacaacacaucugugaccuggcuuuaagaagcaagguuucuccauacacaaaauggugaaguuguuauuucaaagauacguguaacaauucuucuaaacaggcuuugguuucuuggccauuccuugaccuaauuggaaggaaagcgcucagcgauaacucaaaggucuuccaggcuguuugcugaguacccuccuuuuauaucagauuguucucaaagcaguaguuucucuaguucuuuuuguccuuuuaauuuuucuaaauauuuucucuauuucacccagcaguuauacugcccauuugccagaucuccacuugacuguuguacuuaaacagcugauggguuuacuauuuauuacguguguguaaaggcccuuacuguaucuguuagguagauccauuaaagagaaacaagacagaagcauaccccauaccagcagugcacuaggaaguguacauauagagaagccaucagauaagcguuacagugagacuggguuagcuuaugaggguaguugagcuuugugucuguaauuagaagaacuugauaguuauuaacacaugagguguuaaggauagugauguuugaaaccuacaaguuacucucaucuucuguuuuaguauccguauauuccugcacauauaacaaaacccaaggaacauaagaaguuguuucugguucagcuucaagagaaagguaagguacuuuaucuggaaggcagccgucuaaaggcucuuguaguguguucucugagguuguccgcuugucuccuccagguuucuugaguagcuuuaggcucacuguaagacagaaacacaucauacuuaugcagaaggccucgagauugucuuuuaagagucuuuagaccugcaaccucccauuccuaugccccccaccucaagaacagaaccaagcuccaaggucucguguaaccuacgcuggccucgaaugccugauccuaaugccucugcuucucaggaacugggguuacaauuacuggggucacaggcuuucacuauuacucagccucuugcucuguaguccagcucaccuccaagugugugugcucucgugcauaugugcauaugggugccggugugggaacuaaacuccaguccucuggaagaauagcaauugcucuuaacugcuggguuguuuucagccugcuuauccgcuucucccucccuggcugugaguguccuuaggaauguucucauuccagcagcucaccaauuagguuacacuggcuggccaccugucucugcuuuuaccagcaccaggauuacaagucuacauuaucuggguuugggggcuugaacucuguuccuugugcuuagaaaucuugaucaaccuguuucagccucuugagugcuggaauugcuacaaugccuggcuccauuucuuacagaaguuuuauaggagaauuaaaaauuaaguuauaaacccaaggcaauuuucaauuugcuuuuuuaaguuguuuauggcauuucuuucuugagaggauguuucaaauauauauuuaaucucuagaugucacagacaacccaaagugaguaaugagaauugucuuuuuccuuaaaaguuuuucucaagccgggcagugguggcagacaccuuuaaucccagcacucgggaggcagaggcaggcggauuucugaguucgaggccaaccuggucuacagagugaguugcaggacagccagggcuacacagggaaacccugucucgaaaaacaaacaaacaaacaaacaaaaaauucucagagcuggggagauuguucagcuggguaaauugcucauugcagucaucagaaccugaguucgauucuucagcacccauguaaccagaugagcccugugcuguaccucuguaacccugccccgguaagcagagagacaacugggguuuucugagcggccagucuagcuaaaacagugagugccaccuucacugagaaacuuuaaaaaguaagguggugggggggggacgacuuugggccagguggguuaguacacaccuuuauucuuaacacucaggaggcagaggcagguggaucucuaaauucaaggccagccuggucuguggagcagguuccaggacagccagggcuacacagagaaacucugucucaaacaaacaaacaacaacaacaaaaacagggaugaggguugaggggauugaggaaaagauccugcugcuacccuccagccucuguccugcacaugcgccugcaugggugaacacacacaucaaagcuuuucucaaauguacaauuguugauuaauugcaaagugggagaaaaauuauaugaaagauuaaagaaauugaauacuguuuuuguuuuguagccuuguuugcagucccuaaaaauuacaagcugguagcugcaccauuguuugagcuguaugacaaugcaccgggguauggacccaucauuucuagucuuccucagcugcugagcagguaugcagaguugaacuuuguaagaugucaaauuaaagacauccggagccacuugagaagugauagugcacaaacuuuaaggcuuaaggaaaauaaagacaguugauauauuuuuacauuguauguaaucacuagauuaaaacaugcuuaaaaguaccggaagacucaaauuauggcaugauguucugacauguaacuauucuuucucagaucuggugucuuccauaguuugcagucuauucaaagaagagaugguacaacagucaauauuuaaaauacaaaaguacugaucuauaugaaaguagggacaaucaccaggcauaguagugcacuccuucaaucccagcacuuacucgggaagcagaggcaggugcaucucugagaguuugaacuggucugcagagcaagcaggauagccagggcaucuuacacagagagacucugucucaaaaaaaaaaaaaagacggggaaggggcgagauacucaaaucuuuuaguguaauuuauuuauuuauuuauuuuggaacauacugcacuuaggucugaauuggccaaaugguauguagcccuauaguuuuauauggagucugaauuuuuagguaaauaggauuaaaaaagcaaaacaaaaaaaaaaacaaaaacaaaaacaaaaaacaaacaaaaaaaacccacuacagggucucucuacauagcccuggcuauccuggaacucauuauguagaccaggcugguugaaaaaccagagaucuuccugucucuucuugggagugcugggaucaaaaguguauaccaucaugccccauuugaguaugcauuuucuacauuuauuuuuaguuuaguuucuucaugccaaccauagauaagaacugcagauaaaacaguuuauuaugaggucaggcauguuugcuguacugugaguucacagccauccugcucugcacaauaaguuguaggcuaaccagggcuauggcuguaggcuaaccagggcuauggcuguaggcuaaccagggcuauggcuguaggcuagccagggcuauggcuguaggcuagccagggcuauggcuguaggcuagccagggcuauggcuguaggcuagccagggcuauggcuguaggcuagccagggcuauggcuguaggcuagccagggcuauggcuguaggcuaaccagggcuauggcuguaggcuaaccagggcuauggcuguaggcuaaccagggcuauggcuguaggcuaaccaggguuauggcuguaggcuagccaggguuuccugugucaaacagcaacagaacagaacauggacuaugugcugagagaugguuuaguggcugagaguguggcgugcucuugcaguggaucugagcuuaguucccagcacucacugggcagcuucacagcugccugauaucucuggcaccugugcucacaugugugugcacaugaacacuuucacuccugugcuuguguucucuccuuugugugggugugugacugacaaagucuuuuggcuugugcagucaguauuuggauuuaaaucuuaguuuuuuaugauuuacuuuuauguacauuggucuguugcugcauguauguaugagggugucaaaucuguggaacucgaguuacagaguugugagcuguuuugugggugcugagaaugaaccuggucccccgaagagcagccugugcucuuaaccacaucucucuagcuccuuucaguacuugccaguaguaaaacuuguaacaaacucuaauacuuauuugccauauauuucauaugcaaaugagaaugguaguuucuucauaggacuguagucagagagcacauacaaagugcuuagaacauaguacuuggaaguacuuauuacauguuagucuaacagcauccuagccaugauacuuacugcuucuguggaagcuuggugaggguagaaucggccuuuuuacugugucgcuaaccauccuucagcccuugcucuucugcuuuggccuccugcuguaucgugugcacaugaacaugugugugcacagagcaaaggugcuguaucgugugcacaugaacaugugcacagagcaaaggugcuguaucgugugcacaugaacaugugcacagagcaaaggugcuguaucgugugcacaugaacaugugcacagggcaaaggugcuguaucgugugcacgugaacaugugcacagggcaaaggugcuguaucgugugcacaugaacaugugcacagagcaaaggugcuguaucgugugcacaugaacaugugcacagagcaaaggugcuguaucgugugcacaugaacaugugcacaggguaaaggugcuguaucaugugcacaugaacaugugugugcacagggcaaaggugcuauaucgugugcacaugaacaugugugugcacagggcaaaggugcuguaucgugugcacaugaacaugugcacagggcaaaggugcuguaucgugugcacaugaacaugugcacagagcaaaggugcuguaucgugugcacgugaacaugugcacagggcaaaggugcuguaucgugugcacaugaacaugugcacagagcaaaggugcuguaucgugugcacaugaacaugugcacaggguaaaggugcuguaucgugugcacgugaacaugugugugcacagggcaaaggugcuauaucgugugcacaugaacaugugugugcacagggcaaaggugcuguaucgugugcacaugaacaugugcacagggcaaaggugcuguaucgugugcacaugaacaugugugugcacagagcaaaggugcuguaucgugugcacaugaacaugugcacagggcaaaggacauguaagaacuguuuaugccuucaaggaacuuugugauucauaauuaaccuaauuuacacucuuaaugugucucaggguaaguacucagcugcacuucugcagugggaccagugaggucaauguucauuguaguauagaaauguuuaacaugucggaaggggagagauggccaggugaagguggaaacuauaacuaauacuguuuuuaauaaaaguuuucuguuuuuuuaaaugcagguucaauuuuauauacaacugaauuccuguaugcagaaguaaaagaagccgucucuaugagcacagcuuacacguguagaagaguaacuguagaacaaguuuugguuuucucuuguucccuaaauugccaccaccuuccuguuugaagaguaaaaugaauaugaccgagauagugguggaaacauguggcaguguucauuagcuuuugguucuacucauacuuuuuuuuguacauuaaagaaagugaauuucuuauuuguauuuuuuuuuaaguuucucauuaaacucugaaaagucuuagagccgaggauccuuuuuucccugcuuuagacuggggaauguuaaaacaugaucauggaugagauaaggugagauugugggcccuuugcuccaguaguguuggaagcauaugguccuaggcuguuacagguguuuguaaugaggacuuuccuuuacucuggggaacuaaauuucucugauuaaguucaagguacaguguguaccaaacuacacucuguuacaaagaauucccaauauauuaccugacgaguauauuuuauaaaacucucuaggccuuacuucacaagucaagacauuaaacauuugggaguacauuaaaaauagguaagcugaaaaccauuggaauugguauaaaaagaaguccaucuagaacucauugcaguauuuucauauaauggcauagugauuguuugcacugcuguggauugcuucuuacugagugagccaugacaaaauuacaugaguuuuuaaacucucaaauuauagaguuacaguuaugggaaucugagguguuguauacguaaugauaaacaugauuuuaguaagcagcaaagcuuuucaaaaguauuuuagaguaggcuggguauggcgguacauacguagaaccccggcaccugggugccuaaugcugggggaaccagaaucccaguauagcugagauacuuagcaagucccuaccucaaaaauaauagaaacaaaggaauagucugaaucaacuggauucuagaggucaagacaaguuuugucagcccaaggaaaacagcaacuuuaaauuucuaguacacugccugcaugguuaguaugaaauuauaggaguaaaguuucaggacaaagaugguggagaguggaggcacagaucuuugaucacagcacuccagaggcgaaggcaagcagaccucuugaguucggggcaagcuauggggacguggugagaccccuaucucaacaaaguuuuaagauuggagaguugcuuuugcauaggacuuggacuugguucuaagcacacaugugguggcucacagccaucuguaauuccaguuacauggaucugacauggcugaccuuggacaccagacaugcaugugguacauauacuuauaggaaggcaaaacacucauaaaaauaauggguaaaggacuuggcugauugugucauugcggccaccauaguugcuuuauugcagacuuguuggcuguaggcuuaauguagugaaggaaaaguuacaagaggcagccagcuuaacauuuguaauaggcagagauaagcuugauuaguucucacacuuuuaugcugucuugacaguugggccaaguguggcugaggaauuaaacucauucaaguuuauuuagagucuucugcaaugucuaaccaugccugugcuugguaagcacuagucuucguauccaagagugacaacuguugcccucuuaaaagccacuaguucuccuccaggggccagcaguuuugccccaguaguuuauguaacagaguccagcuagcugagugugguggugcacaccuuuaaucccagcacuggggaggcagaggcaggcggauuucugaguuuugaggccauccuggucuacaaaagugaguuccaggacagccaggguuauacugagaaacccugucuugaaaaaccaaaaaaaaaaaaaaaaaaaaaaggaguccagcuaauccuucagacgggaggguagacauggagcuagguugacuacgaucaucuuuuacuguugggcacuggagagagaugcuauagcaccgguuucagguguucguguuaauguucugggagaguggagaaguguaaacggccuaccugagauucagagugcugucagaaagcagugcuugagcuggagucacuccuaauccacuuuguaacuuaagcugacucggauuccuccaacuguaagugcuugagccaaccauucauauucugagaccuuuaaguuacuugcuguucuaaucauggguuguaaggggauuguuuuugcuuuuugguuuuuuuuuuucucgugacaggguuucucuguguagcccuggcuguccuggaauugacucuguagaccagguuggccucaaacucagaaauccgccugccucugccucccuuccaaguacugggauuaaaggcaugcaccuccacugcccagcggggauugguuuuaaacagaacauucuugucacauaaacacaaaguuuuaaagcuuucuggucaauuccauuuggaucccaauacccuuguuuccugaugaacagagaugaauuagagagguacaaauuuuauguguucuuucaggcauucaaagagagcacagguguuaagguuucuuugaucuguaacaucacccuuaagauguaagucuucgauugucauucuaaccauuuauauucuaaauauuggagaguauuaaaauaagcccuugaacaauuuuuaaaacuguuucuaaaaaaaugaaaggccucuugcauuauuuuuuuuauuaacgcuaguaguacauacuaguaaagggagaugaugaaaaagcuuauucaauuguuuaaagcccuaguuagaacuaucuccccuuuuggaaaauugaaaaaaaaaaucccaacugaugggcgacaauugggaugucuuuuuuuuuuuuuuuuuuaagaguaggcaacacuaauugguggaaguacaugcaggcuuuuaaucccagcauuuggaaggcagagacaggugggucugugaguuagaggccagcuugcaaccuggucuacaaaggcucaagacagccacagcuacacauagaaacccugucucaagaccuccccucugccaaaaagaaugugugggugugaugccuucaggugcaucuguguacccuguguguacgguguccauggagaccagaagagaguaucagaucucuugggacuggagucagacauggcugugagcugccaagugggugcuaggcaucuaaauuccuguccucugaagagcagccagcagucugugcucuuaaggcugagccugguccauaaaauguuagucuaguggccauuaucucucaagggcaccuuacaugguuccugcaugaugagcugucccaagcuguggcuuucaucagcucagcucuccucuuggcuuauccauuuaacuugcuguucugcaauccaagcuggcuacacguuuaugacagugacuuauuuuuguguucucagcuccccaaacuuaaaaagcuuuuacugguuuaguguuuggguugcuggcugcuggagaggauuuucaguuuucuaugaaagaagcuuagcuuuuguaguuuaagauuagauuuuccaacacauuccacuuguuuucuaucucuugcuuggguuaaacuggacucacuugaguuugccucuguuuaaauacaagcuguaauucaucuggagccauuaaauucacuuuacuauuaacucauauaacacacauggcuaugaggggggaaaaaaaacccaaccaaauauaucaagauuaagccaguuaagugcacuuuguauucuagugagggauuaaggcuagagcuaaguuggaagaaaugcaggcauuauacuguuccauugagagaagagcagcguguugagaaagcaaagcuuuggcuagggaugcugcuguucagugggaaagcguuugccuaggaagguuuggguucaguccauguguccuccaaacagagaaguugguaauuauguucauauauaguauacaagcaccauuuauaguugugacuuugagaauuugaaccugguuuguuuauaggaauguauaaagaaacuggaguuuuggguuauguuuuuauauuuguaaagcaaaaguuugaucaaaaugaucauuguucuuuuuaaaaguuuuauuucacuguuauuucaauaaaaauauuuaaaacugaau

SEQ ID NO: 4648 - RNA, 30727 nt, Mus musculus
ugaaauaaggaaagaggguuuucgggaacuguaguuucuggagggaaguagcguccugacuuccuuggcgugggucugugcaccgugagaagaugaacgggaagcggccggcggauccuggcccagcgcggccaaugaagaagggaaagaagcagguaucggcagaguuuucggacgcugucacugaagaaauccugaggaagcagguggcugaggccuggagcugccggacaccguucagccaugguaauggggugcuguagggaggcgcggcagcaagagguguggggaggaucgcagccaccuccgacccgggcgcugacugcugcucgguucauuccauauucugcuugauuuggcaagccuggggaggaaaauaaauauaagcuccggacacuauggggaagugggagacauguagccuggggguugaauucuagaaucagaggucacucagaaucccucugcugauuguacgucauugggcaaugcauauaacuuugcuuaagggccaguuucuucguuuauaaaacggaaucguuaauaguauucccccuccgaaagaugggauugacaaacuaauguuuguagacauucauaaacguuuccuugagaaccgguaaauagcuagcaagcgagggucacucuccgcuguuacguggacugucuaacccacgcugguguugaaagcugccagagaagcaagcaccuggauuuaccaguuuucacguaccuugucguuggccuaagugacgcacaaaaccaacauaaucuugaaaggaacgaucauuccagacauagcuacaaguuauuaccuuauacaaugugacucuggcugggugcgucuugaauuuucucagacuugccgauugucuguuucauuugaguguuuaaacaggggaaccccugggcgcucaggacgcaggcagaagaugauuacauaaaaugcaggcuccggcugcccagagacuucucaguuucuuugucuguugcaaaggcguagugacuauaucaucgauuccucaguuguagagaauauaaaugaaauaaugcuuauaaggcaccacugggucaagauugguuguuauucauaaucuaguggaagugaaaucaguuagagguuaaaaaccaccuguuuuuuuuuuuuuuguuuuguuuuguuuuguuuuguuuuuaaacccagaaauuuagggaaagaaagggugguauuaaagagaaauagccagccaguuuugcuacucuuauuauuuguuuuacuucgcucuggagagaaugaguuaagaaucuaaaauguggggcuggagagaugguucaguguuuaagagcacugacuguucuuacagagguccugaguucaauucccaguaaccucauggcucacaacaucuguaaugggauccgaugcccucuucuggucugucuguagagagugacgguacacucauguacauaaagcaaauaaaugaauaagucuuaaaagaaaaagaaucuagaaugcauuugaugcaagagucaguaaacuaaauaacuuaaaauaaaaacuaagagcuuccauuggcgucgucccuuccacucauuaaagccuaacagggaagcauaguaucugagaacaguaguuuugaaugagcacaguucuucaugaauuuuagucuuuaacgauuggacuaccagaacuucaugauggucucuucuuguauucuauuaugcugcuugguggucagacauacagaagagaggaaagaccagggugcuauuuuccuuccaacagaagcuauugccuuggacauggauccuuuccuucacugugugaucccaaacuucauccaaagccaagacuucuuggaaggacuucacaaagagcuuuugagccuggacuuccaugaaaaguacaaugauuuauauaaguuccaacagguaauuuauucucauugcauucauuggcucuuccuccccagaaaucccuuagcuauaaaaucauccacuaaucauggcuacagagauagcuuagugguuaagagcacuuaucgcucuuccagaagcuccagucaaguucccacaucgacuucaggggaauucaugaaucccuaaaaucacccagugcgcacacccucaggcagauacacaugcauccaugcaauuuaucuauuuauuaagacucaaggcucuagauuagguuuguuuucauucuucaccuuggcauugucaaacauuccuuuaacaugaccuuacugaguguugacuguguauuaauugcugugacgguuaucagggagauuuuugacaaaguucugcucucuaccaucuacaguaauaaagaugauagugacagagaugaagaagaaaugcuuuaagccuguaagugaguggaccauaaacaacgggaugacauaucccugcgcgguggcaugguggagagucuucuauuucaguauaauagccguucaaacucuugaguucaugucuuggcuuuugugacuugacauacuguaguuacaauauucuguacugcaauauaucuaggaggaagagaaaacuguuuuccuuugggcaguagcagagcuguuuugacccgaacacugugagugcacuaagcacauacucugcuguugcuucaccuccaauuucccauucuuuuuugguggacaguagaaguuaacaaaagggauuaucuugaaaucuaaguuauuuuuuccuacucuuagaaggcagcccugucuagcacagaaguacaagucguugguuuccccaguaugaagccaucuuuaacauguggaucaucgcucucucauaaacucucuaggcuugucaggguugaaaaauucagaaaggggcugcagagauggcugagcagguaagcauccuggcugcucuuucaggggaccugcauuccagucacagcaccuaaaugguugcccccacccaucuauaacuccaaucccagggacuggauauacaugaauauauacccauacauguaaaauaaaauuaaaauaaaaugaggaagcagaugaagaauuaucucugcuuucuuugcauucccccuugauuuuaucuggaauaagagagugauuaacaucuuacucucuuacgcuuuagcugaucauccgcucagacccuaccccacucuaguuuguagaccuuguacauaugauugaauaacccaaccuaaauacucacaugaugagacacucagagauucuaaugaaaaucauacuuuuauccaaguuuauuagauuaaugaaaaaccacgguuaucugcuguuauaauuauaucaacuuuucaacccuaagcaauguguaauuacuaaguugagggguguguguguguguguguguguguguguguguguguucagcaauguggauguacaugugugccuuuucucaggcacuauccacguuuacuuugaaucaguuucucauuagccugaagcucaucaucaaguaggccaggcaggcugaccaacgagcuuagcacugagauuguaagcacaugccagccagcuucuucucuguggguuccgaggauugaaccuacauccuuguguggucaggcaagcauuguaaugacugagcucucuucucaaccucaggaugguuuuuauuugaugcuguucgacaaaagaaaggguuuuguuaauaugaaaucaaaaugagcaaaaaaacaaaacaaaacaaaacccaaaacaaacaaaaaauggcuaugggugguaaacgagaaaaacuauugccuauuguaaaaucauuuuuaccuugcucacuuuuaggaaguaucucuuuaccuguacacuucuucuuugcaugugcuauaaauuuagcagauaauugggucucugacauauucugaccauuuaauguguuauaguuuauauacgcuuggcucagggaguggccuuuuuggaguaggcaagucacugugggugugggcuuuaagacccucauccucacugccuggaagccaguauucugcuagcagccuucagauggauauaaaacucucagcuccuccuguaccuugccugcauggaugcugccaugucccuaccuugaugauaauggauugaaccccugaacauguaagccagccccaauuaaauuguccuuauaagaguugccuuguguaaaugagcuaaauaccuaauaaaaaauggaaaaaaaaaaaaaaaaaaaagaguugccuuggcagggcagugguggugcaugccuuuaaucccagcacuugggaggcagaggcaggcagaauucugaguucaaggccagcuggucuacagagugaguuccaggacauccagggcuacacagagaaacccuaucuggaaaaacaaaaacaaaaaaaaacaaaaaaaaaaguugccuuggucaugguguuuguuuacagcaguaaaacccuaauuaagauagaaguugguaccagggacugggguauugcugugaaagaccugaccauguuuuguuuuuuucuuuucuuuucucuucuuuucuuuucuuuucuuucuuucuuuucuuuucuuuuuuuuuuuuuuuuuuuuuuuuaagaagacuggauuuugggacuuuggauuuggaaagaauuggaaugcuuuaaaugggacuuaauuagccauccuaguaggaauauggaagacuuuguugcuaagagugauuugaauuguggggaucuggcccaaaaaauuucaguguagaauuucaauauauggccuagaaacuguuuugguaguauuuuggugaagaauguggcuaccuuuugcccuugucuaaagagucugccugaggcuaaagugaagagacucauauuacuugcauugacaaguuaagucucagaaacaccuaucauugacuuuguucucugguuaagucucaugaagagcauuuuaagcaagcauagcaagcugagaaaggaaaaauauaaaauauaugguuugaguuuuaauggggcacuaggaagugaaauggagcugaaugcuguguucagagauauuaaauugaauuaagggaguagugaccuugugacaagaucccacccaccuaaauuuagguccaggcuuggauguacaagccuuuaauuccaagaggcaaaggcuagcagaugucugaguucaaggccagccuagaacagagcaaguuuuaggugaagaaaaacuuaaauucaagcuugguggaccacaccuuuaaucccagugcuuaggagacaggcuacaaagcaaguuccaggacagccaagcuaagacagugaaggagauggaaaacagaaagcuggugauaauguaauaaaacagggggggacccuguuucaaccccagcaagcagcagauuuugacagcuuuggccacgugacucuaccuuuagaguccagaauagaagggacuacugaggcaauuaaugcugguuagcuagagcuaagaaauuaauagugauuaagaagagaccagcaucacugaggugaaaucuucugagaaauguuuucugagagcacaaagaagcuguguuccagagauagcuacgguuguaccucguacugcagcuguacuugguaauguguaaaagucacccaggugguacugguuuugaagguaugaaggggucaugaagaguagcugaggcuuagcauugugagaggccauggaaggccauuggugaagguacagacacaguuacaguugaugacccgggacugaagggguucuauaaaggaguugaggcucggugccaugaagagagcccaugaggggcuauugaugaagcuuaggugcaguggaggacccuaguguauuggagaugccaguaccaugggaugaucaccaagaacaucaaccugagcuuaagaguacuacagagggcagagcuggagaagugaugccagcccuuuggggagcccagaagaucauguauggaucucagacacugaaaccagaagcuguuaauguugaaguugccuuggagaccccaagauguucaagauuccagggcuaucugcugaggaaggcugcuaacagggaguggaaccaacccaggagaaagaaguuuguugcagucaacaaagaugaaaaaagaguugaaaaucugaagacugcacugacaucagacgaggagaugcagagugugucuugcuuuggggauuguaauuaagugauuaaaugaaucucagaagagacuuugaacuuuggaccuuuaacauuguugagacugcuguagaguauggggacuuuggaaguuggacuaaauguauuuugcauuaugcuauguuuaaguaugcccccccccauagacucauauguuucaacaagccuaugggggccagaaaauggaaugugaugguuuguauaugcuuggcccagggaguggccauguuggaguagguguggcccuuuuggaguaggcuugucacugugggugugggcuuuaagacccucauccucacuuccuggaagccaguauucugcuaacagccuucagauggauguaaaacucucagcuccuucuguaccaugccugccuagaggcugccaugucccuaccuugaugauaauggauugaaccucugauccuguaagccagccccaauuaaauguuguccuuguaagaguugccuuggucauggugucuauucacagcaguaaaacccuaaggcauaaugcaccugucauuaggauuuauguaauagucuauauauuuuaagcauuacuaaaugcauacguuaugacagcccucggucauuaaguucucaucagagcccugugaaggaagaguacuaccauuccuguguugcggggaggaagccacauacauuuuuccuucaguucagaguugucccuuuaacaauaauaacagaaaccuauuggauuuuucuuuucauuaaaagauuuucaaucaaaugaaaauugagaagcucuggagcuaacuuucccuucuauuuccauccugauuuuuguuuguuugcuugcuuguuuugagguuaguuugauuuggugugauuuguuugauuguuuguuuagagacugggucucuagauagagccagggcuauccucaaacugccacuccuccugccuguacuuccuggguagggaggguccaggccugugacaucccaccggcuagcacaguucuuaaaacugcagacugcuucaaguccuucucauccuccugucagcacacacuaucacgcuuuugacuuuaucgcugcccuggaacuguaccuauugagucacuucagccuccacauaaguaaaucccauggucacuaggcauucuuugaccuuucaugagacugacacauaugcacuauguuacaaaggcaggcaguccuccaucucucagaagcauuuguacucccuccuggagacacauugcuccucuccuuucgggguaccauacugacuuaaugauuuuucuguuacugugaagagacacuauggccaaagcaacuuacagaagaaagcauuuagugagcacuuacagucccagaggguuagaguccgugaccaucgugguagcgaguauagcagcagcaggcagguaagcacgauucuagagcaauagcugagaauucaaaucacucacaagcacaaggcagagagcuauaacuagaaaucgugugagcuuuaacaucaacgcccauccccagugacacaccuccuccaacaauaccacaccuucgguuccuucccaguaguccaccaauugggaaccaagcauuuaaauagacaagccuguggcagccaaucucauucagacuacuacacauacucucuuaauuuuucuuuuuuauuguagagcacuuuuucuuacuuuccuuugcuggguuuuccucuuaugaccaccaguuuuuaaaaacuuuaauuaauauuauugggggaggcucagugggacagugagucaaaggacagcucuggggaacugggccuugcucuuccuuucaccuuuaugugggcuccagguagcacacucuggucagcaggguuucacacacgcaccuuuacacacucagccaucucaccagcuuauauaaccaacguccuagugacagaguccuuccuaauaucagaacugcucaaggauuggaucucugaauuaagauggaacacagauuuccauggagccucauagcuugcugucucuuccuggaugucuucuaggagucucuggguuaggaccaacacuaaacuaaucuccuucagcugauucugcuguuccucuuggucucagaucaaaaggaauccauucuuaacucccaguucacucuucaugcccuguccaccuuggaugcauccuucacugccucccaaaacacuuccuacacuuccccagucaacagaguucaccccguccaagcugucucucucaccauaguuauauauuggaguauuuugucucuauggagaucggccauagagacaaaaacuagggugaugcuuguuaaaaguuaguaguagaaaaaaaaugaaggcugcuaucuugacccaccuacauaacggucaccauuaguuccuuucuguaacuggaaucaagagaauuggaaaaucaauguucacaucaaaaccugcucacaaauguucacagaaguaccauucauuuauaguaauuguaaaguagaagcaacuagaugucuauccacaaguaaugcuaaacgaaaugcaguauuccagucuaguggagaguaagucagaccugcaacaugagugaaccuuagaaacaauuugguaaaugacagaagccagacucuggaaccagugaaauaguucagcagguagaagcacuugccacugaguucagaccugaauucagagcccacagaaaaaggcuagaugugugucaaacaucuguaaucucacccuccucugggggggugggagguggaagaaugaagccugugggccagcuagccuggaguccaguacaguagaaauaaaagagaccuucccucaacaaagugcugaacccugaugucugugaccauggcacagccguggcacauuaguacuacacauacuaaugcacauauacacauacuaauaauaaugaauauaaauaagugaaaauaagccagacucaaaauguuaauuguuauguaauuucuuuuaaauguucacaauaggcagaucggccauagaaacaaaaacuagggugaugcuuguuaaaaguuaguaguagaaaaaaaaugaaggcugacugccuaauagacacaggauuucauuuuguaguguuaaauuuuaggcuuaugcaacaugguugccaacauugugaaugugugaaacccauggaauuauauacuuucaagagguuaaaauacuagauucuauacaaggaggauuuccuuucaagauuuuaucucaugggggcuggagagauggcucagaguuaacacuggcugcucuuccagaagucuugaguucaaguccuagcaaccauaugaugagaucuggugcccucaucugguguguagguagaacacuguauacauaguaaagaaauauuuuuaaaaaaaaagauuuuaccucauguuccuucuuugccugaaaacuagugacucaggugacagccaaaguacauagcauggcuccaggccaacacagugcuuugcauuaggccuuugagccucaucucccucugcuucccauuugauuuccccagccacuuggguuuuguuuuguuuuguuuuguuuuguuuuguuguguuguguuguguuuuguuugcagcgauuugccucuuccucacugagguccagccuggguacccugcuuaucauugcagacccuucccacucucaacacagcccauuccucucugucugcaguuguccugugcauauggcaccuucaugcuaauaaaucacuuuuuaugucuauucuaugucuucuucaacaaaccuaaauuguucuguaaugaccacuuagcuauuuguugauugaguaauguacagucacgugcccaugucagacugcaaaauggaguggucacauagcagaccagauaguucucuccagagccuaggcuccuagccacagaguucuacuauuggaguccucuuugcauauuuaacaaggaaaucuuuuuuucucuccccuuuaugaucaagucugaugauuugaagaaccgaaaagagccccauaucucagcuuuaagguaagcaaguaauuacacuuguuaggugccaaauguguguuaggcacagcacugaguuuuaaauauuaggucauaaagucuguguugacauuuuuguguuugguaaaggacguaacaaacccuaagaaacuagauaacuucuuuaagaaacucaacagaacgugagagagcuaagauacaaguuuaagccuuggaucacuugaucacccucucucucucccucccucccaucuucacacccuccuuuccuuucuuuuucccuucauuccagacagggucucaggcuggucuagcacugucuauguauguagcucaagcuggccugaaagucacagaaguccuccgaccucagauuaccaagugcugauuacaaacaugagucaccaugucugacuccaaauucuuaauaauaaaauguuuggcuuucuuaguuauggaugaagcaaaguaacaauggcgauagcauuuucuacucgugaagcuaggaaguacuaaaaguuacuuacacuccaguguugacagguagauccauuuucauacugccacaguacuuuagaagauacccuuaaaaguagguauuuaaaaaauuauuaugcucaugaguguuuugccugcuugaaugcauaugcaccauguguauccaguacccauggacaucagaagaugauauaggaaccccuggaacuggaguuccagaugguugugagcugccauguggguucugggaacugaaccaagguucucugcaagagcagcugguucucuuaauuagagccuccugucgcuauuugcacaaguaugcacauuuuauagaguaguccuaagaucacgacaaaagaaagaagugcucaaagaaauuuccauacaagaaaugacaccauuaauauauguguguauuuuaauaaacauaauauagucacacuucacuuugugaauacacugauuuuuuuuuuuuaucucuaagaucuaguauccaggauaguuacuauuuuauucucuuguaguuagcaaccuuuucgccccuuagagauucauaacaguuacucccaccaaagacaucucagaugcacugaaauacaguuuucaauaggaaagaacugccacacacauaaacuucuguacauguauaccgaguaaaagaguuucuuuuuacgucuuugggcuuucuuuuuccugugaugagcaugugcuuuauaacagagagcugggaaguugguuuuucuuuucucucugggacgcucgcauauaugguagcagccugugcagguuauuucuuuuucuuucuuucuuuuuuuuguaaagauuuauuuauuuuuuuaaaaagauuuguuuuuuguguuuuguuuuuuuguuuuucgagacaggguuucucuguguagcccuggcuguccuggaacucacucuguagaccaggcuggccucgaacucagaaauccgccugccucugccucccgagugcugggauuaaaggcgugcgccaccacgcccggcuuuaaaaagauuuuuguguguugacuuuauguguauaugaguacacuguagcuguacagaugguugugagccuucaugugguuguugggaauugaauuuuaggacuucugcucacuccagucccugcucacuccggcccaaaguuuauuuuuuauuauagauaaguacacuguugcugucuucagacacaccagaagaggguaucaggucucguuacagaugauagugagucaccaugugguugcugggaauugaacucagguccuucggaagagcagucagugcucuuaaccgcugagccaucucuccagcccccagguuaauuucuuucuaucuagaaguauugcuuauguguuagcuguaaaucguauuucauacuaaauagacuuuccuccuaaagagaaacaauuucacuuuaacauauuucaucuuauuggugccaaacaccugucgucucuggcugagcaucauugcauaccggcagagucacagcuaagugacuugagugcggaaagucccugaccauuacagaaaguugcuccuuuuauuugccauguguguucagggcauccucaugaaucacauuaaagaugccaaggauuggagaagacagaagccugucccugugaugcguucacagagugcggaaaggagcguucuguagcaucccuuuuggaaguugaugauacuaguugguuuuucagaaguguuuauccccagccuuaccccuaccauugucugaagaccaguguggcagcugcuguguuggcccauucugcguaaguggccccugggccuuuagacuuugcugaacacuucugggguuuucccagccaagcacaauaucuuauagaauguaaacauuauaagaaaaugguaguggacucuuuuccccaggagacuuacuauguaguaauugacagcacaauugcauuuuauaggaauuucuguuccgugcauuugaaugagccaaaaauaccaugucuguacauaauauaauuugaucacauguaaaucuuuaaauacuuggauucagagucuuuguuucuuguuuguugcuguauuuguuuuuguuauuauuguuuucagaugaaauuuuccugugucgcccuggagggccuggcacuuacugcaauccuccugccuuaccuuccuccacacugggaucagaguuuuguacuacauguccaacaaaagguuuuaauuaucaaaguuaacauuauuucaaaguugacuaacggaacuaguuauaaauuguauuaaagagucuucuacagaaagaccagaagccuagcuuagcuuaaaauagaaauaaauguucauuaucuuuuucuacuuacacccugcuagcaucagaacaucuguggguuuuguugacuguugugugauuaauuuaguauuuauuguuacuacaacuuaaaguuauuuugugggccguguguguuggcucagcugguaaaggugcuugccaccaagccugaugaccugcguucaauucccaguacacacaugguagaagaagagaacuaacuucuacguauuguccucuuaccuccacaugucuuccaugguacauguacacacacacacauacacacgcacuaaauuuaaauuuuagaaaggucguuuuaugaucuccugcagcuguucacccaagugcuuguuaaguggcaguaguaguguuacuggagucccuagcacuaacugcugaacucuggauccagcuucuugccuuugugaaaacaaaguagcaucaaauacauaaaaugcgaaaauggguuuguugacaguuaugucccaaaagugaagagaaagcuguucucaguuaggauacaauuaaaagccaggaaaggugcacauguagauguaaccaaaacuagaauuacuuaaaaaaaaaaaaaaaaaaaaaaaagccaggcgugguggugcacgccuuuaaucccagcacucaggaggcagaggcaggcagauuucugaguuugagaccagccuggucuacagagggaguuccaggacagccgggacugcacagagaaacccugucuugaaaaaaaaaauccuaauuucaagggcacaucacugcauuaguauuagugcuuaugauacugagauuuauaacaggaaaugcauauuugaucuuaguccccauuccugacaccaagcuccuaaaacuuaaaauguugagauuaauaaaggcaaagggagaaucuuuuguuagggaaaaaacccuuucuaaaauaccagagcuaaagguaacagacaagccccgagucuggggaaggagggacaguugccaagaagauaacuaagaggguuacagcucuuggcccuaacuguucuaccuccaguaaaaacaacgaggauguucggaugagguaggaggaugccacaaguuugggucuaggaugagcuucguaguacauuguagaccaagacugaacuauaagcauaaggucuuguuucaaagagaagaagggcuuacgauaggcuggauccaucacccguggcuagugguuuguuuaaucacucaugucuacuaaacccagguuuucugcaagagcagggagugcuguuaaccucugcgccuucucuucaaccccugaguuguuucuuuuguuaauaaacuagaacuacaguaaggaaacauuaccuaauagaggauccaacuugaggaggguguuguaggggccuccuguuuauacccagccaccaggguauaagccucaugagcugaucuucugacugagucugaagaugggaccaguccugugagucugaaccauuaauccuguauguagauaguguaagaauugaacuauuuccaaaaauagguagguaccagcaggaaacucacagauuugaugugggcagcagaguguguaaaaauagcaauugaguuuucccauuugcuacugaaaaggcucucugacaaugggugauuuguaaugacaaagugauguagggacuuacaacugaguccaaagugcugguauggaggacaucucaaaugaaggcaaacugcuagagaaugaaauacaugaggagacucggagcaaguacaauaagguggcuggagaguuccacuguuuuucugggaacuugacgcugcacaaguuuaaagagagauagagcaccucucagggucucgugagugaaaucugagaacugggcucuugaauuaaaugugaccuuaagagaagaucuauaggaauagcacugcugcagagcugcggccucacgagcugucuuuuguucacccuucuaggaaacuuauguuugaagauuuucgggccuggcuuucuaagguuuccggcauugaccuagaaccaaccauugacaugucgugugcgaaauacgaguucacugguaaggaggcuaaagcccagcugucuaaagauuuugaggcuuuaacuucaccaugacgggaagguagcaucaggguaccagcuagcuucggggucuuccuuguaaggacucagcucacacacagaaguaaccaucauaccacaaaggguaagguaaugguucucugugggugugugagagcuauugaacguauuugcagaaaaguucucauaccagccugcacacaguauuguaaaacccaaaaggugaugcuauaaauucuguccuaaggcuucuaaaaguucccaucuccuuuaacgcugguuuuccuucucuuauuuugaauuuagugaguggacauaggacaugaacacauaaauaguaauaguccugucgucaccugccuucccuccucagagcuuucuuucgccuuccaguuccccuucagagcucagaaaugugcacuggaauauguaugccuuuuuauauggaaggaaagguuacuuaguuuugucuugcuaaauuuugacucagguuugcuauccuguauggccucugggaagucuaaauugguaaagcguuuuggggguaaacguagugaugcaugugaaaagccacgguguuaucuucaguucucguucuucuuuaucguuuuguuuccuuugagacuuucgugauucagguuggccucagucuaacagagaccgucugccucuugaaugacaccacauccagcuuaaauagaagggucaagcauaccacaaauaauugugguauuuuacuugaaagacaguugcaguccugagauuccauaggccugaacacugcagucagucuuccuccgugagaguuucagagucggaaacucgacaggucuguguuguucccaucuaauucauaggccucguucacuaguuacuauucgauccuugaggcaaaaggacagcauccacuuguccugucugcugagccuccugcacucuacaauaaccuccugggcuccuagacuuccuggaccuugaugcaucuaaagacuuauagacaguuaucuguuaacaacuccuucagucuagguuuaccugguguuuccuuauaauugagugauucuccuugagacgugcauuuggaaggagugucauagcuaaugcugagcuuuucugaauccugcuggaugauucaaaguaugugucaucuucuuagugaugggaccugugaccuuggaggacuuacagggaggccagucucagauugccacucuuuccuccuauccguacacacuuugugccaggugcuuuugcuguuuguuuugcuguuaggauuaaacccagggucucaacuugcuaggcagaugcuacucugagcuguauccucagcccuucccuuaccuucccuucccucucucuucccucucucuucccuuucucuccuucucucucuccuuuuuuuuugaugggcaucuaagucaccuagguugccuuugaacccacccuguagcccagauuggccuuaaacuugauucucuugcucaaccucugcaguagcuaggauuguaaggcuuugcuaccaggccuuuaagaauuaugggacuggaagaauuaugggagacaaaccaagaaccuuggacaugcugcuuccagauuauguaacugucaugcuuuucaccaaacuuugguucaguucuuuucacacgguaauuuuacuauugcuaaauuacugcagguuaaguugcccugagguggcuugguucuguggguuaaaggcacuugccacuaaaucugacaaucuggguuacauuccugagaccuacaugguggaaggggaggaccagcuuccuauguuguccucuaauccacaugucccucgucugccacuaacaucaaaauaaauaaauguuuaaauuaaaaaaacaacaacaacaaaggaacguauauacccaggaacucuaagauucauuaaggcauucuuuggaauagccaagaaauacaaacaauuuaauaacaaauagaaaugcaauuaaagagaagguacauagugccucuauauaguauaauaacugcagccaauagaagugaugucagggguguauauugauauggaaagacucgcuuuguaauuuugaaaaacccagcccacaacccaccacuauagcauuaacauuucuucaaguaaaugcauguucuugaggggaaaauacuacaaaaguaugugggaaaauaguguuuguaacuguguuguagaucugucuggauucauugugcuuaaaacuuccuauacugucugagcuuuguugcuuccuuuacaaaggagaagugucauuuuaaaacugcaagccaguuaaagcuggagucagccuuacagaucugugucggggcugagugaguacagaagcagauagcagcugcugugugugcagagaucuaaaugacgcucugugugcuugugcuugcagaugcucugcucugccaugaugaugaacuggaggggcgccggaucgcuuucauucuguaccugguuccuucuugggacagggacuuggggggcacccuggaccuuuaugacacugaugguaagauggacguugaccacguccagauagccacuucuaauuccaaacauuugccucaggacaaccacucugacauaugaugugucaaaugagagagaaaccguguauuagcacagugacuaccacagguggaauuaaugcgagccugacaaccaccucuugaaguuacauuucaaguuaguucuccagagacaaagcugauccggaugagaagugggccuugcuccuguguacugaccacggaaggguuaaaaagcacaugugcguaugagucugcuaacagcacucugacaagaaaucaggucuuuugaggggguacucuccacagguugacuccaggaaaauaagaaccuaaucuggcucucaucagcaauagguagacaaugugguagaaucgcguaucaccuagcugaacgagcaaguuugagugacagguaggagggacuguuugagacugccgagaaccggaugaggcagccugaaagaguuaaugaugcuggaccuauucauggugucuucucucccgaugcagaacacuugcagccaaagcagauugucaagucucuuaucccuuccuggaacaaacugguuuucuuugaagugucuccaguauccuuucaccagguaaagaacguaaaagaaaccuacaguacacuagggaucaggggucuggcucucugaucacccguaucuaacugugucuccuucccauugaacucgcugucccagcccgauggguucaaacuaaugugccuugaucagugccuucauccgucauccuuuguguugaugugccaacggucuugcucuugcaggugucugaaguccugucugaagaaacaucacguuugucuauaaguggcugguuuuaugguccuucauuaaccaggccuccuaccuacuuugagcccccaaucccucgaaacccucacaucccacaagauguaagcauaaauuaugggaauucuuaccuugcguacauacuguagcauaucaguuguuuuucugucuuuacuugggaggaccaugagagcugacauguauuuugcagcauuagacaucaaaccaggggccuuacauauguuaaccaagaacucuuccaaugaacuauguacccagcauguuuuucugaucuuaaaauuggguuuugccagugcuggaacucgacuuggaacauccacuuuucguacauagauuuugacaauguuuuccaguacucuuuguuugauaggagaaacaugaaaagugagagcuguggacugguguaaggacagaagcuguagagacuaacgcaucuccucuaucugcugcuucucuuguaagcaugaaauuuuauaugaguggaucaacccugcuuaccuggaaauggauuaucaaaugcaaauucaagaagaauuugaagaaaggucugaaauucuccugaaggaguuucuuaagguaggccaccauacccugguuucuauguguugucugacauuucaucuugguaaaauugacugcaucaagauuuauuuuccuucuuaguucagauguuuauguauucucuucaaaugaaauacacaaaucaugauaguaggcauugcugucagguguaugcaugauauccccagaauucuaugaacucuuucuuuuaagguuuaucuuuuguuuuuaaauaaaaacaugaauguaugcacacaugcaugugggugcuuaaaugccagaagaaggcaucagauccccugccccugaaucaguuccagauggggguucucuguaaacagcacuguaaccacugcgcccucucgccuguauuccuccaggacuguauugcucaguguacacccgcgcacaugcacauuucuucccuaauagggacccugguaucuaguuuggguuuuuuucuuuucauuugguuagugugguacuuguuauuuuuaguaaauagauugcuaguggauuuuaauagauaguugaucuaauacugaauguuugaccaucaugaggcaacuugaggaggaagagagcugaagucagaagucauguccuggcucaggugucccugaccugagcagccggucucacuaggugucuguuguguuccugguuacaaugggaugagagccaccuugccuuacuuacuguugugagagcggagugaaauaacacauacugagagaguacgucaugaccacgguggauacguggacauacauucccaagggcucuuccuccgucaaaaaggaggagggguucuauaaacugacucugucagaauuucacagcugacauugaaugguacagaauucgaggggcauuaucuuguuacagaaauaauaguagcuaaaccacuguguguaacuccaucuccaggggacccauaggcaaugcacagauacauaaacauucaggcaaaauacccacaugcauauaauaauuuguuuuguuuuguuuuguuuuguuuguuguuuuugagacaggguuuugcuggcuguccuggaacucacucuguagaccaagguggccuugaacucagaaauccaccugucucugccucccaagugcugggauuaaagcucagaucccuagcacccacaugggcauguggguuuuuuugcuuaucuuaugggacuggagacaagaggguggaaucgcuggcuaccaaccuaauggggagaggaucaaggaaccacaagcugcagguucagugagggaccaguggaagaaauacuucucuggcuuauacccacgcaugcaugggugcauguauucauguguacauauucauauacaucacacguauauaugcaaauaaaaaucuuuaauaauaaauagacugacaauacuuggcucuuuuuagguacaggugccacagagaucuugugggaaagaggaaauauucaaauggcccucucuggaaucagccagcugauauccuacagagcugcuccuccugcuggaauagugagggacugcaggaggauuugcucacuucuuuuauuugcuucuuuuccagccugagaaauuugcagaggucugugaagccuuggagaaaggagauguggaauggaaaagccauggucccccaaacaaaagguagaggucgccaucacaggcgacuccaucuggauuuagcaucucccucucauccguguugcucauccccaguagcacacuugccuuaacguuuaguuccccaggcugugcuguagcagguccuagcagacacucacuaguaucauuaaguugugccaucauuuagggagaagggcucaaagcuaauggcccgcuuugauugcucgggcaaccugacguguggggcugaggggcuggccaucgcugcuuuccagguuuuaugagaaagcagaagaaaauaaccucccugacgugcugaaggaaugcaugggccuguuccgcucugaggcgcucuuccugcugcucuccaaccucacuggccugaagcuucacuucuuggccccuucagaagaugaugagacugaggagaaaggagagggggagacagccagugcugcugcuggcacugaagaagggacuagccgacgccccucggggccagagaauaaucagguggccgcuggcagucacagucaagagaacggugaacaggcagacccagaagcacaggaagaggaagcaaagaaaggugagcugguguuaggccccaccuuuauuuuuaccugagacuauuucacauuccacgauuuauccuugggugucagaaugacuguggucuaaggugucagacucaaaugauuuauccuuauccauauaaaaaguacuugcccagcucuccaggaucuugaguucuccuaggagauggcagaggucaaaucuauacucagaaaacaaagagagcucacccggugcugaaggcuuacauggcaucuugugucauucccucaggagcacgccccucgacugcugcuaguguucccagucugauaaaguauacuagaucuucuccucccaaaaauguucuuccugcauuccuucucaugcagauccgagcaguggcacuuccucagggacacuuuucuguaucacccucccacugaggcugcucagucauagucauucuuugucacaugaccccguuacagugcuguguccaugcugccacagucucugugaauucauacgugcaucaguccuguuguguguggaggagucauuuggaguuguuuuuguguuuggagucauccauccccuuuggcucuuaacagucuuucugucuucucuucuacauagcucucuaggcccugaagggagaguuugauaaagacaucccauuuaggucugaguauuccaaaaucucuguuucuccauauuguccaguugcaggucucugaguuagucuccaucuacugcaagaaggagcuucuccgauggcugaguaagaucuaugggucuagcauaaucucauuaagagucguuguuauguuccuuuagcagaacacuauuaauugguuuuucuuuagaccugugaucuauccagucuuggguuugggccaccaaugcggugucaggcaugggcuccaucuugugacguaggccuuaaauccagucaguguggugggucacccccacgauguuugugccacuguuaccccagcauaucucucaaacaguucaccuuuguaaaucacacagcauuuguggcugggucaaugguucccuuuucuuaucugauagcaugcaggguacccucuggcaauuaggagcagagcggcaauaaacauagaugagcaauauaucugaguaggauguagaguccucuggguacaugcccagcaggaguagugaucuugagcuagagccauucccagcuuccugaggaacugccacacugauuuucaugguggcuguacaaguuugcauucccaccuucaauaaauacguguuccccuuuuuccaaguccuugacaacauaagcuaucauuuguuuucuuuucucuuucuuucuuuuuuuuuuuuuggggggggggugguucaagacaggguuucucuguguagcccuggcuguccuggaacucacuuuguagaccaggcuggccucaaacucagaaaucugccugccucugccucccaggugcugggauuaaaggcaugcauggccauuuugaaugauauaagauagaaucucaaaaguacuuuuauuuuuaguuccuugaugacuaaggauguugaauauuuuuuaaggguuucucagccauuuguguuugacccuuugagauuaccuggcuuaguucuguaccuuggguuugguguauaaauguuuaaguuccaauaucaucuuguaaguuuuuccuuugaguuuuuaguguccuucccuucucuucugauuaguuuugguuugaaauaucuugucagauacuaaaauggcuucaccugcuuuuuuuuuuuuuuuuuuugaguccauuuguuuagaauaccuuuuucguccuuuuuuguucuaaggugauaucuauccuuaaugguauggucuguuucuuggaugcaucagaaagcuguauccucuuuucccauccauucuguuaguuugugucuccuuaggaggaauugagaccauugauguuaaaaguuauccaccaacaguguuuauugauucuugcuauuuauuuauuuauggugugggguuuuuucccacucuucugauugacuggucuuggauuauuuauuccuuguuuucuuguguguaauuaagcucuucagaccgaagguuuuuuucuagugccuucuauguaaauagugcugcuuaaauucaguuuuauuguggaauaucuuauuuuuuccaucuauggugauggauaguuuugcuggguauaguaaucugggcucgcaucuguggucucuuaagaguuuguagaacauccauucaggccuuucuagcuuuuagagucuccacugauaugucagguguuacucuaauuggccugcccuuacuuggucuucuggcugcuucaucuuuuucccuuguaguuuuuaauauuuuuucuuuuguucuauacauuugguguuuuaguuauuuugugucaugagggauuuuucuggucuuguuuauuuauugcucuauauguuuccugauguaaaugccuauaaauauccuucuuuacagugggaaauuuuucuucuaugauucugcugaaaauauucucugugucuuugaaccuggguuucuucuccuuccucuauuauuauuauguguagguuuggucuuuuccuagugccccagauuuucugguuguuuugugucuggguuuguuuguuuguuuuagauuuucuguaacauuucuugacccuuguccucaaagccugaacgacucuccuucauuuggugaggcuucucucugagguuuuuguuugacuuccuaaguuuuucaccuccaguuuuucagauugggguuuucuuuaauuauucucuuccaacuuucaugucuugaaccguucauuauuucaucccacuguuucuuuguguuuuuguagacaucauuaaaagauuuauucacauacucuuuaagguccuugaacauauucauaauucauaauugaagucaugugucaugugcuucagcugucucguaucucccagacccuacuguaguagaguuacuagguucuggugcaggcacuuuaucauggcucuccauguuuguguuucugucuaagcaacuguaguuaugauugaagugagucuagguguugauaucuuaguuccuauugcccucccuggauuuuaggaaaauguggugggggccauggguuucuugguagagagugcuucuacaggucagugggugcagagaggaauagagauaggccaagaaaaaaggcugaggaacuguaggaaugagcuagggcauccuuuccacacuaagaaguaaaguccccagggaguugaaggcguggugaaaggaggggcucuugcagguaggcugcagagacaaggaugaaggggcuaggggagcccugggucuguaccaagaguuggagucguuagggaauggagguagggugagaggagggaccccugaagcaugcugcugcaggcuuaggugagaagggagagcuuguaacaggacagggaagauagagaacaccuguggcaccgaggcccaugguagaaaggcuuucuaagugucugcagcugauauaggagcuaggcuaggagggaaagccgagagggucagcaggaaauagauaggcuaagacccugcuaagagguggaauccucaggaaauggagguagggugagaggaagggccccugcaagcgugcggcugcagggcuucaaaugagagaccagaaaagagagugaaaaccgacuuaccugagucccaucccagggugcucacuggggaucccaggcagaaagucuuucuagguaucugcagcugacacaaaggaauggggugggcuaggaggguucacagggaggagcuaagcugggucuauaacuaagagguaguagaggccccaggucuccaucuuauuuuaaccuuauaaaauguuuuggaauuuugugguucuuuuuguggcacugagaauggaacccaagauuuggccaugccaggcaagcauuguaccacugaacucugucccugacccuuagacauaaugaaauuuuguagugcucaaagcugggcaugauggaacacccauauccucaaggcuagucugggcuuuauaaagaucccagcucuuccaaauaggcagcaagaagggcuagacugcagcucuaugaucaagugccugucugccauuccuggccccucaguuugacccucagcaacaacaaaaaguuuuaguaaucagucuaucugucuaccuuccauguuuccugcuuugauggugacauaagaaaucucuuccuugcuuuaagauacauaaaaguaugcucaaaguuuauuuacugauucauuuugugauuaaaucucuacuuugucuaaaauguaaagaaacugaaacucggccaggugugguggcaggccccuuuaaccacagcauucauuuggcagaggcaggugacucucugaguuuauggccaacuuggucuacagagugagacuggggggcuggagggagaagagagagauacuaaaacucggcauucucccaacuaaauaguaagaccuuauaacuccuacaucuucucugccugacacaagaccuuaugguggguccuuguauucuagcauuuguaauaaaguuguaaaaaguuugccgggcauuauuuuguguuuucuuagaaucgagcguucccaugugccagggggagcugaggcguuggaagacuggccauuacacauuaguccacgacaacaccaagacugaauuugcccuggaccuguuucuguacuguggcugugaagguagggaggagcagggccauggaucaacuccuuaguccaggcaggcucuccgaagcgacucuccagcucagccaacucagaagugcuggccuguggccacaaucccagaauucuaaaggguguuggggauggugaauuuuaguuuccccaaacagaauuuauaucuggguauggaaagguuaauuccuuuaauuuccucuuucaauauucauuaguaagccuggguuucaguucagcugucugggaaauuagccauuuaauagagagagaauccaugauagcagaugcuaaaggccaauacagaaguuccagagccccaguucagcagucacucacucuggcagugggagcucagugcccuuugucuuucccucgucaggcugggagcccgaauauggcggcuuuaccuccuacauugcuaaaggugaagaugaagagguaaguaaguggcuuccuucugucaaguucuccuuucuaacucuugagaaaguucuguucuucagacaccaauuuauuuaccuguugguuuuguuucuuugcuuuguuuguuuguuugaggcaggaccucacucuacggcccaggcuggccucacccuuggcacaacacuccugccuccaucaagcaaaagcugauguuacaggugugagccaccacgacggcaagaaauacacauuuuaugaccucagccaguguucuuagcugauaaauccaugcuggccugccucgagguggcucugauuucacaagaauauaugggagcuugcaguaacucaguaaagcgaaaggaaauucagcacacacuguugugccuuacugagagccugaguuaagaggcucacacccaccacucuuucuagggaguuggaagcaaacacauuaggccaaaccguuuccggguuugugcuagugaggcagagcuuguugggaaaugucuagacagaaacacaccucuccuaauaaaaaacucuuugggaccuccuccccagccuaaagagucacuauggaaaccaccugcucugugaugacucccccgagcggagcggaaaacgagcucuggguucugacaucucucguguuucccguuacagcugcucauagugaauccagaaaacaacucuuuggcguuggucuacagagacagagaaacgcugagguuugugaaacacaucaaccaccgcagccuagagcagagcaaagccuucccaagcagaagcggcuucugggacuucgcauucaucuacuaugaguaacaagauggggcagagccagcuagcauucacuccaccagugccaggaacauggggucuucguggagugagggagaguggggcaugcuggguaacagcguccuccgagcaggcuguccuugcaggcugugugggugcacaccugugaugccagccucgggaggcagagaaaggggaccuucaguucccaaggucaguguggcuuacacggugagacccuguccccaagcaaaacaacucuuggucauccuuucagaaaauucaucuagaccucaugcuagagcuauguacucgucccuggguugcagaaaaaaauguuuucccccauugcaauucucuucguucuguaguaacugccuuggcgacuuucuaacuuuggugauuuuuuuuuuaauuuaugguguauauacaaaauuuagcagggucacuuuuuuuuggcuuagaguuugguuugguuugguuugguuucuuuugacaggguuguacuauguagcccaggcuagcucugaaguacugauucugccaccucaaccuccuaagugcuggaauugcaggcaugagccacugcaccaguuccugcaugugcaguccguggaauugagcauacugaagugcuccaaagcacccgucacugccaucuggaaaacacccagaccucauaggaaguggaaaugguuuucugucuucccauaggggagugcuacugcccuucuuugaugacuguucgccucaugagugaaucgugcagugggucucgcuuccugauuggcuuguuucacuuagcacagcguccucaaggccuaucaguguuuuucuucuucacuccuaaguaguuguagaaacuugcugagcccgagagcugugacacacggugcucccacugugggcugagcuccacccugacucugaggauaggguacccucggggagguaguguugcucuuuuggaagaggucugccugaaaccuaacauagcuccaggaauuccauagcugcuuacugcccuauguauuuccucucgucuacugccuuccagaccuggcaucguggcuucucugagucuagccucccagugacuaugcguuccuaaaugcuggaaggccggguguggaacuugcugccuuucccuuccuuuugaaagacccccgugcuaaaaggcagugucaggaggagaaguucaggaggagaagcccuccuuuugucucuggucuuuccccugaacugcuccauggggcuguggcacagcucuucccauugugggggugugcaugauggcugagagauguccucacaccaccccacaccacaucuauuugcugcuuucuugguuccugacuauccuugcagguuucaguguggacuuuacuuaucgguaggaaaaacgcuggaccuuuaaguaucuuauucacacuucucugacguccuaaaaguccauccaaaugcauucugucuuuuacauuggcuuucaauuuguuuuguuuacccagucaguaaaacacacuuuaacauucauauccuaguagauacuuacaaguuuuauauguuuugguauuaaucauaaaacaaaguaauuuuuaaauaaugacaugagaauauccagaccuaaacugaggggacauacuuuaaucccagcuuuuggaagguagaggcaagaggauuaagaguucaagacuauccucagccacacagcgaguuuaaggccagccugggcagcaguacaccuugccucaaaaacaaagauggagccaggagugggaagcacgcaucuuuauucuagcacucaggaggcagaggcaggcagaugugugaauucaaggccagccuggucuacaaagagaguuucaggacagucagagcuauauagugaaacccugauucaaaaauuaaaaacaaaagacucuccagaccuaguuugagaguugucuucccacgccaggcagugaccaaugacaggcuguugcccacgcauacuguuguagacuccaccgcacuuuaauccagaguagugcucaaguuggacuacgcauacuuuguugcuaacgguuacuuuugaagcuugccuuuucugaacugcugcagacuaaaggcaggcccacucccccacccaucccacccucacuccccaccccccauugaagugccugagugggaagaacucugaagggucccucugucuuugcagagccuccuggucugcaagaacaauagaaccuacagguugccuuucugcucuagugagcagcugcguuuuucaguugccaugugccgcauuguugauguaugggugagacagaugguguaugacagugagcccguacgucuacaguggagcugaaagaugccugaauuccaaaucacucaaagucaccgagaggcuagggagaacaggcagcugugcacacaacugucacucacaggccaccaccuuauguguucacucacaugaccugcucagagugugugcuguuaaagcgcuaacucccaugugcagacaacacagguggaaagcagugagaaugaagacaaucaauaaguguaugggccuguguguguguguguguguguuaguauuaacagaaaauucagaaagguuaaaaaugaaaauaacucaaaauauuuuuguacagcuauacaauauaaaguuauaagucaaaguuuaaaauaaaguucuauugcauaagcuaaggcuauugaagauggaguauuuuuaacgugucguccauguuggaaggcagaaaagcuuccacuuagucuguccaagaauacugucacguuugcacaagugaucuugccucaguuugcaauugcuucauucuugauccugauugcuugcugcuuugggcauggggcaagagagucaaaugugggcucucaauaccucuuguugguaaaagcuaugcugcuuucugugugaccaauggcaugucucucuuaauaaugagccucuaauucuuucuuguuuucuuauugauugguguuuucgagaagggucuauguauacccuagcucucuaauugcuaagauucuagaguaccacgguguccagcugugaacuuccaguucucauaacuccuuuuccuaaaggugauauucccuccaaagauaacaauacauaaacaaugcauguucauuguugggaauuuaaaaguguggaaaaacacauaggucagcugaaaccccuugccaccacccuuugacaacugugugcugccguaagcgugucagcauggccacccugcccuguauuaggaagcauggcuccucucugcccucucuucccucucuccuguuggguaaauacaagguuguaaggcacuuugucaggcugggcucagagggagccacuaaggccgccgcugcagacaagaaugaaaacaguuuucaguggcuccuuaagaauaaaaaggagcagccagagaugcguuuggagaucuguauuccagcuaaugcuaccccaacugauagacugccuuuagauuuguuuucccuuaauauaaauguuuacacauacauuugagugauaaaaaaaaauggaugucuguauuuuuuguuuuccccacaaaauaaaaguguuugugcauuucug

SEQ ID NO: 4649 - RNA, 30862 nt, Mus musculus
ccguaaagccuuaguucuugaacgaaugaaagggugacauaguguguggcguguacggggugcagcuuggcugacacgcuacagagaauccuggggagguacuggcuuagacaccgccaucccagacgccaagguaaggcuucaucuaacacuaauuuacagccgcaguccgaggacagacaaagaacgcaggccaaccaggcacgacgccacugcgcagucgcaggagcuaguugggacuugcguagcucugccgcugggaggguccgcgcaggcguagagagaguuggcgacaccgaucgcgcucuagucugcgcuuccggcgccgggccuguggcguuccgcaguccugcguguauuuaccuccuacuccucauccgcugcuaggcaaccggccggccaagcugcuugccuugcgccugcgucgggcaucugucuuccgccccuagcuggcgccaucaugcugcugccuguguucacucugaaacugcgccacaaaaucagcccccgcaugguggccauagggcgcuacgacgggacucacccgugcuuggcugccgccacccaagcgggcaagguaaccgcucccacccggacuccugccuccuccagaucccgccccucacgcugccccgcccccugcccgcauugccuggcaaccggucgccgcuguccuuggcuccagucccaucaaagugggauuucaaagaacagcuuuguagcagugacguuuuuuaucaccagguucucaguguugaacaguauugaggacagaucaggaaccuagggaaaagaagucucaagaaaaaggagcgcuuguccaggaguagcagcgauugcugacuccagauucaugcccagggccucugcuugccuccaggauucucuuccauauuugccucuuuacaguggaggaagcgggugggguggggacaacaacccaauguuaaauucagauuguaguuuugguccuugaucacguacauucagaucuuauccccauaaccuaaguguucauuaaaugguuauuaugagccacauacugagaaaggggugucagggucacagauaaaaaaaaaauucagauuuagacccaguuugcaaacaaaagaaauugugaaagugagauugaauucuuguuguuagacucagcagguaugccagguacacaauugcauuuguguaaggaguuuucaagacacugccauguguguuguauguuaccuuauaugcuacuucuaggguuccguagcaggaacauaaggauucguuuaaauggguuaugauuucauaaacugguauggugaaguaaaaugcugaacauucgucuugguaugugaugcuacuaguuaagaggcgcuaccaguccugagguagugcuacacauuuguuauuuuaucuguucaagagauugggaucauaaguucaaagcuagccugggcaacauaggaagacccugucucaaaauuaaaauuuuagaagaagggaguucuuuguccaauugucacuuggauaaaggcaugcacugcuaaguuugaugaccugaguucuguccuagggacacacaacauggagagagaucugacucuuguaaguuguugucaucugaccuucacaugugcuauagagccuggacacacacacauacccacacacacacacacacacacacacacacacacgaauauucaaauaguaauauuaaaaaggcugaugauguaacucagugguagaacgauugccuaacauacucaacagccuggguucagccuccugagcugcccuuaucccaggcacugacaaacauccaaaagaaguucgcauccacauaugcauaugugcauauacauguucguagaauggaguacugcaauauaagaggcaacgauaucccacugguguuaccuuaaccccuaauuugagguacaaucaugugcuggacacuuuuccuaacucugcagauacugcgauaaaugaaauuucaccucuagagcuuacauuugagagaguaagcagaguguauauguauaugauauaucaugucagaauauguaauaggauaugaacuguauaugguauagacacacacugauacauauauuuaaauuaugcaauacuauguaaugguauuuucuuucuucucagcacgggccaguagccuuugcuucuucucuugcuuugucucuggccugugcuugugugcaagcuuaagcagcugaguagcugucugccuguucagagccugggugaacugguuaauggcaggagguacuuugagccacucaaagaggauggcucuuugcugcugcaaccugauguagcugggccauuugacuaagcauguuagaucucuuuugggcuggauuuccuccccaaugccaaaguuguugggccuuuucucaaaggauugaccaccuuuuugacuuccuguuucuugaugauggcaggggccccggggccaccuucuuccccucuuccccuuggccuucuuuccuuggggcaucuugcuuggcuggaggagagagaaagaagagggaauugugggugaugaguccuguggaauacaucuuaaauucagucagagguggguuacucccucagcguuugccucucacugaguuuguugcacuggcauuuguugcaggcaggucaucuuugucgaucucggguuuuguggcuagguugauggcugccuucucugguauugugcagaggacuuugugucaucaugaaugcuagucaguaggugugcagcuucuuguuaggcaccagcucagcucagcuucaagucugaagcauugucuucaguagcagaagucccuuuguuuuauuuuuacuuuaugcauagcaguacaguuuacauauaaaauagcacuguaauagaauggucugauauagcucuaaauagaagugaaaaaggaaaaauuucagguuacaaugacaaaaaauccaaccaaaaaaagacuuuuucuagcugggucauuguaagaaauguauucagugacuagucccauccaguucccgcugcacugagggcagugaacucaggcaagucccaucauggccucaaaggauuaacaugguggauucuuggauucuucugaauguaaaaaaaugguucuugcuaauucaguauauagaaaguugagauuauucucucuccuucucucucucucucucucucucucucucacacacacacacacacacacacauuaauggaauugaaacuaggagaaauaugcauauucuguuucacgacugugucuuuuuaccuguauucuguccccaccccuuuuuuaaaaagauuuaucuauuucauguaugugaguacacuguagcugucuucagacacaccagaagagggcaucagaucccuuuacagaugguugugagucaccauguggcugcugggaauugaacucgggaccuuuggaagagcagucagugcacuuaaacacugagccaucucuccagcccuauucugcccuuucuuauagccuaauauuauucucuguugauccucuuucuaaauuuuagacuauacccacuucuaccugcuuguauguguauauauauauauauauauauauauauauauauauauacacauacauaauacgaucauacacuaggauccacguaugagggaaaacauacagucuuuucuuaaguuuggaucaccuugcuuaauguuauucuugaagaaauagaaagugcuuucuuaaaagaugaacacugaauuuucucuuggggguguuuuuucuccuacuguggagcuggggaaucagugucuuucuuagcuagcacaaugcccugucacucacaucuauuccuuuggaagcaauagucuguucauaggcuucucuggggacucuuucgacccuggcacuuuuuguugcuuuuggcauaaacuugacucuuccauuccagacucggggacacaugaguuacuucccuuccuguucuucucgugucuaauuucuagaagacuuuaagaaucccuucguucagagcuauuacaaaaugaagugugaugugacuccugccauucauggucuggucacaccagacuacuuguuugagccccgucacuugcaaucaggcagggcuuaccucuucugagcauaaguaaggccgaucaaguuuaguguuuauaagaacuucuaaaaugucacacagaugagaacaauuaaacagaaaucacuugcugcacacauuuucuucauguuuucugguuaguucuuuuaaacauauuuuauuuuauuuuaagauugauuuauuuaguacgcaguuaguacauaguguuuugccugcacguaugccuauaugccagaagagggcaccagaucucauuacaggugauuacgagccaccaugugguugcugggaauugaacucaggaccucuggaagagcagucaguacucuuuaacuucugagccaucucuccagcauccuugaauauauuauaaauuaaugaauuugugcaugggacugugugcauggcgcgguaguguguguuuggagcucagaggaagucaguccucugugagucaguucucuuccucugccgcucaggucuuugggaucaaaugcaggcuuccuggcaaacccuugcugcuuagcucucuugcuggccccaccuuuucuacaauauuauuugucuuaaacuaguuugccuagguuauaauuuaaaauuaauacaguguuuauccuaagugaaugaaauauuuaauaugaggaccuagggauuuccaguuaguguuucucauuccuucuucuguugugauuaucauuuaaagguuuuauuuguuugucuuaagauaauaaaaacacugggcauaguugugaacaccuuuaaucccggcacuugggaggcagagguagucugaucucugaguucgaggccagucuauuucgcaugagucccagggcagccagggcuacacagggaaauccugucucaagauaauaaaaguuuucucacugggggagcuggggcgguaacucagggguuaauaguuucacugcuuuugcagaaaacuggaguuugguuucagcacgacaucaucaccucaucaccaccugugacucuagcucuaggccacccaugccuucuuuuggcugcugugggugcccacacacguguguacauagaggcacagaagcaggcacauuagcaaaaguaaaaccguaagaagcagucucucuucuggagaagcuguacauccccuuuuccugccgcuccuuagacgccacagaccauucuaauacuuaagacacuccaccccaccccagcccccuaucuugggagcagugucacagcaccugggaagccauuuacugauuuaacuaacuccauuuucccaggcgaaacucagggaaguugagugcugggugaagucacucagaugacuguguuuaugauacucacagacacucacaacuguugaguuucugaccuuggggcuaauuuuaguucuuggucuuacuaguagagacuaaaacaauguucaagaauuugauuuguaugacauauuuuaagcuuguaaaacacauuaaacucauagaccauuuuaagggcugggaagggaauuuauuuggggcuggaguagaagauacugaggaagcgcuuguucugguucccgagaucaugugcugucuagcaucagcacugaagcucggaucagcuuccugugccuaacacuaggaacagguccacaugcucgcuugcacgguucuggugagagcacgugugccuuccccguaggcagcaguuagagcuucacuuccaccucagggcuaagaaccacuggauuuucauaauccacaaagguugaaaguggacuaacauagaacugugcgugccuaucuuuucuuggguuuugcuuuaguuuauuuguuugagacaggguuucucugugaguccuggaacucacguacaugauggaccaggcuggccucaaacucacagagaucugacugcuucugccucucgagugcugggaucaaaggugcgugcccccaggucuagccuugcauggauaucuuaagcuuuauagauuaaggugauugcuuguuauuguugguauuuucuaaccauuuuuuaauuuuuuaaaaaugugaaaaguaaggugugaauguggcauuuucggauguuuuagggaauuaauuguuuuguuuuucagguuuucauucauaacccucacacgcggagccagcauuucagugcuuccagaguguuccagagcccucuggagucugaugucucucugcucaacauuaaccagacggucagcugccuggguucgggagucuugaacccugagcuuggcuaugauacucuuuuaguggggacacagaccagucuuuuggcuuacgacaucuacaauaauucagauuuguucuacagagaggcaagucuacccuccuuuagccuucucggcccauugcucaguaaugcccacaaucuuguuuuuugcuuguuaguuuuugucagacaagaagguuuuuuuguuguuguuggugguggugguggcaguguugggguugaacuuagagccuugggugugcauacaaguuaaguguucugucucugagcugcuggaccagccuugucccuguguuugaagauguuugcugggauguuuucuuuuugguuguugaagcaggcaagcaguggggaacucagcuucacuucuguuuagggcauuuguagccuauuugugggguuaugguuguuaaacauuuggugacagcacguguaucugugacacuaucuguccagaucuuuuaggaauccagcaaacaguucuucuguggccuugcauuaagccccaaagcuugguggaaguccuuacuguagcccguggucuacaagcugcugcagacuuagugccugagcugucuacuacugucuacuauaggaaauauagggaagaaaucguuuuguaagucaccuauagacaaagaguauucgaauuuauucacaaggauuguguguguguguuuguguguaugugugcaguguguguguguauguguguuuguguguguguaguguguguguauauguggauguguguguguguguguguguguguguguguguguguguggauguguguguggaugugugcaguauguagugugugugugcaguguguguucagaucaggucucacuguguugccuaggcugcucuugagcuugugacccucuuucuucagucucccaagugcugggauuguagacguagaccaacuaugccuagcuauagaguuuguucauuuuuaaaaaguauauaugaguuaaaaaaauuggaaaaguucuuuuaaaaauauuuuuauuuuuugaaauuucucuacauuuaugcaguguaucuugaucauaucuucccuuuaucccuucagaccuccaugacacaaaucccuaccaccuuuauaacuccuuuuuuuuuuuuugguugucuauuuuuaaaugacacucagaguccaauuacugcuucaaauaugcacauugguauggggccuucuaccagagcauggcaacguaccagugaccacaccccaaagaaaagugucucucccucucccaccugcacagcugccaauagauucuaggcuaggggaagacaaauuuucuuacaaaauggaaucguaguauaugauaccccucaccccauauuaacaguauaauucagacuuuauacaguucaccuaaaauguuccauuaauuaguuuggaacuuugcaaaguuuuuggaacauucauuacaauuaguuuuaaauuuuuuuuuaucacuuccaaaagaaacuccauuccccaaagcaggaucuccauuaccccguaagcgucuggcuuuaggcagccuucaugaauauugagcuguguguguugugugauugacauguuucccaggcuagcucacccuguagcauguguuggugucucuacauucccuuuuauggcggauaaugugcuguuagacauagaugccgggguuuuuuauucacgaguuaaugggcagucuacucccuggcuauuuuggauggcuuuuucagucaggaauagguacuauaaguuuguaacccuagcacucaggaacugagugaggaggaccgugaguucgaagcuaggcuggacuacauaguaaguuuaauagcaugggugcuauuuauuguuuaccauuuaacuuuauguauugauucacugauccuuuggcaauuuaaauuucuuaggagggcugucuuuauuauauaucugugcacacaugcaauacuucuuuaguguauuuuagguaagcaugcaguauauuguguuccauccuucagaugagugcucuccuucccaucagccccuccagccgcaccccuuuguuucuucaguuccuaguuccuucucucuucuucucauguguaaucuaguggccuuucaugccuaucuauuucuuucuuuauaacuaauccuuucucuagauuuguguaacuuauauauguaacuaaugauauaguucucuccauauauauuuaauuucccauccuuaaaaguauauuggaugugguaguacaaaaaccauuucuaucuaaaaggguuacaauaaaucuuagcauuuggguguuuaaaggugcaugccuuggccacuggagaaucugccccugcagaagucagaaguccuugagagcccuggauuauccaaaccaugcguuguagcagcuuagugugagagcuggacucugcgugugcccaggaucuggacuuggucuugucugggccacagcaugggcucuagagaagcuuagccacccuuguaggagacagggcagagccagcugaguaucuggaggaagcacugauugccucagccccucaccacccccccaagugugccugcauaucccuaauuccuguuucuuuguucuuaggucucagauggggcaaaugccauugugcuggggacccugggagacauugccccaccucuugcaaucaucgguggaaacugugcucugcaggguuucgaucacgaaggaaaugaucucuuuuggacgguaugaggaaguaaacauuuugguauucaaagcauuucuacuuuuaauuuuuuagauguuuuuuuaaaguacugguugcauugaauaaucguuaaaaacaaucaaacaaacagacacccgaauggacuaauaggccugaagauauggcuccacuguuagaguacuuaaucuucagaacauauaaaaauguugagccuggcaccugagcuuguaauugcagcacuggggaagugaagacagggccauuccugggcuuuacugaucauccagucuaguccaguugggagcaucaggcaagugggagacccugucucaaauacaguggacagaguuccuaagggugucacccgagguugcucuugucuuccuaggcaucucacacauacacaugugcacccauacccacacagaauauaggauaugcacacauguauauauauacacauaaauaagauuuaaaaaucaggacaguauacuaacaauacggguaauauugagaauucacugguacuuuuuguaagccuuccauuuuugaggccaauauguuuggguuaaaugaaaaaugacuuaugaaugacuuucuguuuuguguucagguuacuggagacaaugugcauuccuuggcucugugugacuuugacggugaugggaagacagagguguguggcaaagcagcccugggugcucuguucagcugaauaaguuccuuuugacagugacguuggcuucucguggcuguuuuagaucugagcucacugguccuugccucuguguccucucuccccucucuuccucacuucuacguccgcucucuucucuccuuguucaucucuccccaucugcuuccuccuccucuuccccguccuccagugcucacugugugcaucucugagacccuggaggaggagacggccaaggcuggcgggaccucagucgcaucuguaaucuuauaaaccacuucugaugcuucggagcauuaacucauuuucaauuuuggcugauaaaaugauuucauuugaaauuauucugauaauuguagcuauauauuaauauaagaaauuacccuagaaaucagguccuuaagaaguugguauauauaccgugucuccugggcccuagcuuagccugcuuucuguggacacuggucuugggcucugagagacaggguuuuaugacuguacuauauuagaaauauggccgacuauguuugugucuuuccacaacuccagaauuuauuaaauaauaauaaguguacagggugccaagggguuuuguaggcagcaguuuucaggugacccugcuuuccuuguagccuugacugaggcaaacuggccucuuuauuccaguuguacuuaauugguauuagucuuagaucacauagagacagcccagaguaacuguauaugucuaguacuguacacauacauauacuuacauaacuguguguguauagcuguggguuacaguguggcuacagaggguuaaaggccugagaggcagggaagcuaucagcuucgaauagucucggucagccucugugagcaggggagcugaggucugcugcagcaguuucugccgcagcugcucccaccgugcugccgacuugccuguuggccgagucaggcuguggagucagagagcagcugcaguggagucaggcuguggaagugaaggucaggaccagggcuucagcgauggguaggcagauggcagucugaguagaccgcauuaauguugagaugucauuaagcuaaagacccucaaacagucaggagcaugacaaugcagagggccaccgccaugcaccauccuggugcuaagggcccaccucucuguaggguccaggugagggagcagcacccuuucuccaggcuaagauaauacccacagguuagccugccuuuccugauaguacaguaauacauccugugcucccacaguccuguuugaccccaggaaaacggcagcauuuuacuucuagaaagaagucuguguugccugggugggugcuccugggaagacugcacauucauguguuaccaaggugcauggucuuugagggcuuccgucacucagggaaggaacuuguccugcccugcccugcguagagccacauuuucucaagugaccaaacccauuacaacccccuugaguacuggguuucuaggggacuggaacuuguggguagcgaguaguguagcaaaguaucaaguagcaaaggaacagcuucuuuuucuuuuucuauuucacgaaacugcuguguuugcacauuaaacucugagacugcggugucccuuccuuuuccagcuucuuguuggaucugaagauuuugacauucgaguuuuuaaagaagaugagauuguggcagaaaugacagagacagagguaggaagugcugcugcagaguggugaccuuaggccagcagagagagcuuggggacugagucgcaggccagggugcagaguggugacuuuggaguaggcaggucagcauugcacucagaggcccuaacucugcugcuuaguuucagaagggcuuuuuaaucuaaauacaguugugguaaagagguucuugacuuuuuccggggagucugugucuauucacccaagauugagagggcagugauagacccaggaaaccaugccacucaaaucuggcuuggugaguuuagcugaguaucucacagcuguucugauuuuaagauagcaauggcugucauguccugccuggaggacugaguuccuuaauacagacuugugguuuugcaagguugcaggugaaguugagucuuacugaguagcugucucccguguugcuauuugcagauagucaccucucuguguccuauguauggcagucgguuugguuacgcccuuucuaauggcacaguuggaguuuaugacaaaacagcccgguacuggagaauuaaagugaguauaacuuagucuccccuguucggggugggguauauuccgacacagagagacuccuuuacugauuauuggaauucuuuuucaguccaaaaaccaugccaugagcauccaugcuuuugacauuaauucugauggagugugugaacugauaaccggguggucuaaugggaagguaaguuuaaguuaggaaaugucuguguaacucaaaguaacaucuauuuaugguauuggcugcacuacuuagauauaaaccagggucagucuuuccucauuaucucuucuugcugugaggcagauguguccuuucugccuugcaaacaguacuugggagaaaaucuccagagagccuuucucagucuccuuuuugaaggcaugagaauccuuccaucagauugaucguagauguguagguguagaccaguaaaacaauccaguaaccggcugugugaauagcucuuuuguagaguuaacaggaagaauccuguuagguuaucuguuucccaccuguaacuucaaaggaaaauccuuuggccuucuuuacucuuucagcuucaggucagaaucucuuaguguucuggcaagucaaggcugucuuguuagcuuuccaucucuaugggcaccgucuguaguaacuuccuccucugucaauguuggccugcccgggucuugugagcgcccgacucgccaccgccagcaaagcagacgccacaccaggauccuucugcacacguuuauugggagagcuugauugcagaggcaaaaagaccccaagcccagaacuggggcugcuuauauaggucuaggagaggcaugucucacacccggauugguuaugcuuacuaccucauuugcaugucucacaucugauugguuauauucucaaaaccucaucuuggcaaaaacuuuacugcauauguacacauugggugucuacccaaacuuaugcgugguggccagcgguagccagcgccacccugcaacagcacauguggcuucccacacccgggagaucagcuaauuccuucugcgcuccucuuacuuuaccuuuggccagcaccucagccuuccuuugaugcuauuucaaaagcccaugcugaacaguuguuagguuggcucugacuugucuauuugguuuuguccuuggcauggguauuaaacggcauaagagaaaaauaugucaucauuucuuacuaagaauuucaaaguguauucacugauuagauauguucagcuaggcugugguagcaacuaacacagccugggugcuuguaaccccgggggagcugauuucccauugcucugggaggcugcuuccuuacugauggcugucuucucacugugaccucacauagcaggaggggccgaggcaucucccaggguaggggauguuuuaaaaaauauuauuuauuuuucuguuuugagguaugguccuguuauuggcucaggaaacugcauaaaccacacuuccuuccaacccaccucucagcuucgaggguccuaggcgugcaccaccacaccuggcugggagcaucuuacaugagcacuaaucccacacgaggguaccauccaaugcccggugcuugugcuagaguuacagugcacagauugaagaccacauucuuggggaacagaaauuguuaugguugagucaagaauuuggaguuacuaccaagagucaggcguggugguauaugcuuauaauuucugcauuuaagagguagagggaggaagauguugaauucaaggucagccugggcuacagacugucucacaaaggcaaggaagaugagauaucuucagaugaguggaccuacaguucuauaguaaauguuuucaaauaacgguuuuuauuaccuaaucuguucaaaauuguagagauguuaagaaagucacgcaguuauccguauuuaacagaaacagcauagaaaagggacaugcacauaccugacugugcauguccacguggaguuucuaaguaaaugcuccuacccacuagcuguguggaagucuguuacucgcugaguuggagggccauccacuccuuccuuauuggauaagccaaaguguagaguguucacagaaauaaguuuaccaucuugcuuggugagcaaaggaacagucuuuguuuaccagacaccauggaagcucaguauggagccacaucauggguuucccugugaagaaacagguucagcuuggccugagucacaggggagggucaguguuugagagcucugaugaggcccagacauucagucuccguaggcucugcuagucauacucuucagguggacaggauguugucauaaguaacaugguugaauuauugagugggaugugccccagagaggggugagcugggagccuguauguuuggguugaaaagauaaagagaaugacuugcauugugucaggccagaguuucuguagaggccuuuggguaacacuuguguccuugccugcacagucauucaagggaaugucuuucaguauugguccugagaccucuuugcaagugaucagccaccugguuaugggagagcccaaagacgacuaaguaguucuuaugaggagaggauaagguuauuaggaaaggucguguaguugcugugcauggcaacacacacuuuuaaucccuucacuggaaggcaggaagaucugugugagcucauugccagccugaucuacuuagagaguucuaggacagccagggccacaguaaaacugucucaaaagaaaaagaaagaaaaaguuacuauaugguagaagauuuggauaauuauuuaaauguuagguaaauauauuuuacacguguauaaaucauaauaauaauguuuaagagacauugcaugcauuuauuuauggggaguggcaagugugccaugguacacauauggaggucagagggcagcuugaaggagucaguucaugccuaccaaguggguccugaggcucaaaccuaggccaucagacuagugccuccuacugagacauuuugccugacuauaaagauguaauuauauagcuugacucaaacccacuguauggccuuagcuguccuugaacuuaagacagaccuccugccuuagcuucuugauugcuggaguuagacauccacacaagugucagagcugaugucuauuguauaguucuuuuuuaaaaaagauuuauuuauuucauuuuuaugaguacacuguagcucucuucagacacaccagaagagggcaucggaucccauuacauaugguugugagccaccuugugguuguugggaauugaacucaggaccucuggaagagcaagcaaccaguucucuuaauugcugauccaucucuucagcuuuucucuguguguguuuaaaccacuuuacgguguuaauacuuucaggacuguaagccuugugagcugugggcaccguucuuacucuuguucugguuauugaucuccauaugaaaccaugaacagaaaguuaaaaaacguaagaacacauagugguaugugcaggauggacucugggcggaugggcacuggagcacauuccugugaucacgggcugggugugcuuuaugggcaucucucagcagaccuagguuuucacaagggacacugugggagggagggacagcgucugcuggaaaggagggagggacaucuauuucuaggaccucuagaucccuguggcccaacagccacaggcuucauggugcacucuugaaaagaaacuaauuauaugugugcaugccugugugcaaguguuucucugcgugugugugugucugaauguguugccuuauguagcccaggcuggcuucaaacauaauauguaacugaggaugacccugcaccaguccucccaagugcuaggauuauaggugugugucacugcaccuggcuggaugaaguagcuuuuuuauuuuugaaucagggucuauguagcccuugcuguccuggaacucuuuauguagaucaggguagccucaacucagagagauccuccugccucuggagugcuaggauuaaagcauguaccauuucaccuggcuuuggauuaauaacuuuuaaaaauuuguguugauuuuaugugcauugguuuugccugcauguauaucugugggagggugagaucuccuggaacuggaguuacagacaagggugagcuuccauguggaugcagggaauugaaucuggaagagcagccaguguucuuaacugcugagccaucucuccagccccauggacuaaguaaccuuuaaagcuaauauuuaucuuaaagcuuuuguugccauuguuuuuagcugugguguaagugacuuuuaugcugugccuucauuuuuagguugaugcucgcagugaccggacuggagaggucauauuuaaagacaacuucucuucugcuguugcuggugugguagagggagauuaccggauggauggccacguacaguuaaucugcugcucaguggauggggaaaguaaauugggauaagaaaaauccuugaaaagucaaaauuucaauuugaucagguuaaaaaugccugaaaaugaauucugcaguauuuuauuaagcuuuucuaacaaauucaccuuaguuaagaagaugaggauauagaauuuugguuuaucuggccaggucauugauggucugaaguagaaguggcuagcuaugcuuagggucuuguccuuucuucaguccgaggcuaccugccaggcacagcugagaugaaggggaaccuccuggacacaaguguggagcaggaccugauccgagagcugagucagaaaaagcagaaccuguugcuagaacuucgcaacuaugaggagagcaccaaggugcgaucuugucuaaaaugucuaaaauguuggggccagcgaggaugcucugcaggugugggacagugucggaguggccagggcugggcccucccaaccacccgaagaaaugcagauuccuucugcuuuuuggcuacugcuggaaugaagagccaugaaguuagacuugguggggguagccaguguuaccccagggcaugucagaggggggcaugaaagcugggcguggugguauacaaugucaucccagaacucgggggcuaagaggaggcuccugaguucuagcccgcaguacauagccagaccucaucucagaaaaaggagagagaagugcuggagagauggucuagcauuuaagaguguauacugagcuugcagaggucacacauuuggauccuagcccccacagguggcucacaguggccugugaccuuaggagauucuauacgcucuuuggacucgccaggcaucucacacacgcaugcacaacacauacucagcuaaguaaaaauaaguauaaaauguuuuuaaaaggagagagagagaugagaagaagacagacagacagaaggacagacagacacaaguauuuguaagggguaugaagagguauggaggagcacagaugaagaggcaggaggggguauugcucauaggaucagauacaacaaggaagcacaaacaaggugcgugggauucaagaguuguaaaggucagauuaguaagaggggcaggcagucuguccuguccugaagcugcauagccauauuauuuaacauggacuuaguugacugagugacuaagcugaaguuaggaggugucuuacaggcagaacugagcaguccccugaacgaggccgaugggcagaaaggcauaaucccagccaauaccaggcuccacacagcgcucucagucaauauggggaaugacuuacaagaugcgcaugcggaauuaggcauuuccacuuccaaugguaagauacuccguacagcugguccugguaggcacccgugcugucuugcaguaguccuaaaauguuguuuuccuucuccuuacagauacuaucauccgagcaguacuaauuuuugcagagggaauuuuugugggugaaagccaugugguccaccccagcauucacaaccuuuccagcucccuccggguaccaauuacaccucccaaagaugucccuguggaucugcaccugaaaaccuucguggguuacagaagcaggugacgcuuucugucccagucauguccauggagaugggcuugcuauuaccauugcccucugucagaccagggaagucacugaaggaucugccuucuagucaggauuuucccaugaccuuuucuuuccuuaauuuaaauucccuccaaagaaaauggaggcauguaagcuuaaaguagucguuuucaauuuuuaaucaggcgaucuuagggacacaaaagacguuaacagcauauuugagcuuuuggugaggcuccacgguaagauuuacaguuagcaugcuugagguccuggauuugaacaacuggauaauuauuuaaauauaguuggucacuaacacucuaagugggagacauuuggaugaggugcaguauuggagcugguggaaaacuccacuacacuuguugaagauaaaggccuuuuccuacugggugugcuggugcaggccugggaucccaucagucaggcugcagccggaugaucagaagguccaggccagucuggacuacaagacagcugaaggccuuacugagcaacuuagugaaacccugauuuuguuguuguuguuuguuuguuuuucaagacaggguuucucuguguagcccuggcuguccuggaacucacuuuguagaccaggcuggccucaaacucagaaaucugccugccucugccucccaagugcugggauuaaaggcgugcgccaccacugcccagccaaacccuguuuuguaaaaaaaacaaaaucuguugaucacuaaaaaucaaagacuuuuucucuucuuucagggcauuguaaagcccugguggugagugugugucuaugugggcagcggacauuauuuccagaucucaacucucucuguugcugcagaacucgaacccucaaacuuucccucugucuucaguguaaccuauagacaucuguugguggugacucaguaaugaguuuuguuuuuuuccccugggcccucacugugaaauagcauuguacugagccaggcaagguggugcauggaaucuugggaggcagaggcaagaggaccagggguuugaggccaaccugggcuaccugagacccuguccuaaaaaagcaggcggugggggaugcagacuaacacuauaccaaacauuccucuguguucauugcuugggcguagcacccaguuccauguguuugaacugacaagacagcugccccgauucaccauguaugcauugacaagcccagaugcagcuagcgagccugucagcuacgugaacuucaguguugccgagcgcacacagagggugaguccuguguucuuuugcucucaguuuguaguuugcaccugagaaucuaaugucaugcugguagcaacaaauuuuaagaacuauguaguauggaguuugcuuagguacuuuuaagcuucccuuaauuuuuuuguuaaugcaugcaugcacguguguguuuaugguugugugugugcaugccguggugcagugugagggucaccggacaauguuuggucguugauucucuuccuccgugcaucaaucagacugacacgguuugcugacugcgucaucgugcuggcucugguuaggaacuuacagggaaacauuacugguuuuaggcguggugggcauaggccugucugcaauuccagaacuucagaggcgagagggucgggcguuugagaauagccuggguuacgucagaaauuccaggauagccugggcuacauaagugagauacugucucauaaaaccaaaauaaagcagaacucaaaauuugcuuacaguuuucuucucugaacuuugaaagacacacacaaacacacacacauacacacaacacacacacacauacacacauauacacaacacacacacauaacacacacaacacacacacacaacacaacacacacacacacauuuuccuaaguaauccuuaguuacaauugaauucuuacuauucuuaauucuuucuuuucuuuugugaugauauuaauguaguugucaugccuuaguguuucaagagaagggaaguggagaugucuaggguagcagcauucauuuauauucccaguuccuugcaagaugaaggcagaaggaucacuugaacccaggaguuccugaccagccuugacugcauagugaaaagucucaaggggggaagauagaaaagguaggaucuggagaggagggcaguuuugacuuuuagcucaagugcuaccuuaacuaaauuucuaaugauuuugaggagugcccaucuaaugggaggggagcauugccuacuucauaaggagcccuaagagauuccaugacugguguaaaaugcuuuuuauagcuuaccacccauggcaguggacuguaccuuugguugagcuucagaacucuucuuuucuuauuaauccacuucuugcuugacuucucugagccccaguuuccccauacuuccagggagguucaggaagaggcacaugagacaugggaaagaccugugggagcuggagguggagauggcugcuucucacgucgaagaugaugagaaaggccaucauuaggagagggagccucguggucucuggcagggcaaagccaaaaauccaacaguugcugcuucagagagcguuccuggcauagccagugaugaugcuccccacacagucccaaucccagccccagagccagcccagccucagugaacuugacugcugugcugaugucccuugaacugaugcugacauggacacagcagcuugggaugaggcagcucaggagauguggcacugaugagcaggggcuuucaucagccagugcuucugguuguugauucaacacagcugugcauaguggucggcuccugaccaaggagcagguggagcagaacuuggagcaggccuacauuuucagggugaggaacagcaggggagcuacuuccagggcagagaagacagggugggacacuggcuucugaauucuuuuuuuuuuuuaaagauuuauuuauuuauuuauuauauguaaguacacuguagcugacuucagacaauccagaagagggcgucagaucuuguuacagaugguugugagccaccaugugguugcugggauuugaacuccagaccuucggaagagcagucgggugcucuuacccacugagccaucucaccagcccggcuucugaauucuugagaagguuuuaacuguauagauucucagaucacuaggcaggcccuucuagauagauagccucacgggugauucuuggaaguagauuguaaaccacuguaaagcguuagcaucaaaaguguagguaagcugcgucugaguaugcacauguauauuucacuaaaaaaugacauaugugggucagccccaugcagacagccccguccagguacagaaaagcugugagauagacaaguagcacucccuucaguccuuugugcaucacauguaagauuaugucuaaguaggaaggacuugugccugcucggggacccgugguaacugugaguguugcugaagaccaggaaggagggaaaggggagugugccuugcauguaguugccuguguauguaggggggcuggugggguauaaugucuuuuaaaaaaaccaaguaguaaaacuagagaaaggauucuuucacaaugacuguauuuuaaaaacugaagcacacuucauucuauuauuuuuaagauggucacguggcucaaccagaacuuucuguugccagaagacaguaacguucagaauuccccguuucacgucuguuucacaucguuacgcaaugguggccagcucuacauaaaaaugaaacaaaguggugaggugauguaugauguaugacacugugggcauaggguucuaccuaccauucacaugcaaaguacaacucccgcugucaagaucacagaagccagugucccagcccaguguguuggugucaugguugacacugggguucacucuggaaugcaaugcugugccuuguucuuggcuuuuauucuucuauaauuugaggagagcuggugucuuagugucauuuccuguuaccaugacaaaguacccugcagaaacaguggagaggagacaguauguccguuugucacaguugcagccuuagacugugacaguggagaggucgcaguagcagcagcugcccauguuuccugcacgguccaggagcagagaggaagaacugaggcagugccacuugcucucugcuuccucaguccaggccccagcccacgagacggugcugcccaucagggucuucacaccucaguuuacccaacuaagaaaauccccucacaggcaugccuacggcccaccaauccagaccuguaaacuuccuuuacgguugauucuggauugggucaaguugacaauuaaaaauaaccacgaggaagcaggcuguggcggcacacaggaggcagcggcagguagaucucuggguucaagccugggcuaugcaccuuuuucucuaaaaacaaaacaaaaaaauguaaaugaggaaaauaucuaauuaaaaaaaaaguuuauuagggacuaugaagaagagagucuccuggccaugaaugcgaaggaaagcagugaagaauauaaaggaggguuuggugguagaaaauugaaaggacaaauauuguaauuaaaauuagaauaauuaaaauugaaauuacaaaacuguaaaaauaauaaagugaggaaacacuucaucaaugugcaaaaaaaaaaaaguaaaagugaaaaucauaauaaaaagaucaugaugguugggagucuagagggcgcugcucuguaagccuggagaauggauccacuguagccaagauggccaugguuuuuauuuugaauaacuacauuuaugaagucuacagcaagcaaaaauaaaagucaguggcaggagagagcgcagcagccacuagagaacagaacaccaccaaacaggacuuuacaguguccagcagagauagcuggggaagccggacagagagcaaaacaagguacacaccguccagcagacuggggaaacugaggcagacagcuggcauuccugacugagcuuuccacccaggguggagcugcucacuguggcacuuccagcuucccauucccacugcaggcauuuugauaucaggacagaaaaacggcaggaaccgcuuacuguuuaccauguguuugcucuuggcugcuugcugguuuucuuuucuccugguugcaaagccacgugcaauggcgcaaccuauagucccagcaacuugggagguuagguuugaaugacacuuggcacaaaaucauuuuaacuguuugacuaauacuucauuuaguuuauaaggucacagaagugaccuuuagccaccugcaagcaauaaugacugggguuugcauuuuccugaaagcagccugaccucacacugucacaaccauguucucaagcauuguguggagcauggagacagucaggugcugacucucauccauccgugaggaugcuaaacuugcccauuuccccuggguagaucacugugaauacugacgauauugaucuagcuggugacaucauccagucgaucgcguccuuuuuugcuauugaagaccuucagguagaagcagauuucccuguguacuucgaggaacuacggaaagugcuggugaagguaagccacgagcgaagaugugugugugugugugugugcgcgcgcgcacaugcgcgcacacgcaagauuauuuagugauaaucacguccuaaagaauuuuguaaaaauguagaugagccucggugcgugaguuccuuagaggacuuguguaagaugaagccaccucuucaucccuuguuucuccugguuccggaggaugcucuuucaugcacgcaccacacugugacuuucuguuuaucuaaucugcagcguccauguugcucuugaguucauugcuuuccaaaaauucacauucaaaguugaaaaagaaaaguaaggauuaugguuggcuguaguguaaaacaccacuguuagggcgagggcuguagcugaguggugcccacaguucacuacucagccuuauacugcccccucccacggaagagacccgcagagaaaccagaaucucaccauuaucacugagaaucacuaaaaccuuaauauguauguugcucagaucuuuguugcugacauaggaaggucuaacccaguuagaccaucaucacugaaggcaguauagaccauuuguuaaaaggagaugaagcauagagguaguuaagauggcaugacugagcagggaggacgagggcucugucuguggcaggcagagucuucucugucuucccggcucucgggaggguggugaggcccuguuacuauucguguucuuggucuccagguggaugaguaucauucagugcaucaaaagcucagcgccgacauggcugauaauucuaaccucauccgaaguuugcuggucagagcggaggaugcucggcugaugagggacaugugaguauuuaccggagcuggcauaagugacuagucaaagugguaaagaguaggaacccucagaugcugcucgguggaguccaaauguauucaguuaccuuggaaaauaagauggcauuaucagugaagcugaaaauguauucugugacccagcaguuugcuuuuaguguaaggcuuagagaaacuugugcucguuuuauauauuuauacaacacucauaaaggcguuggguauaaaaauccuguaguugucugcuucccacuguuacaacaaaaugccaaagacggaauaauguauaaagaagaauuuucuauuuagcuuuuggaaguucaaaguccaaauaauguugcccuaguucugaugagggccuucccaauggcauuacccaaugguggggggucaucauggcaggagcacaagcaagagcaagaaacugccuagcaauacaggaagccaggcagacucgccuuuucuuucacagcaguucucuugagaagacuaacuaggaucuaaugagaucuaucuaaucccuuccaaaggccgcacccuuaaugaccuuggacuacacuguuuaaaagguccuacuacuuaauaguaacaugccgaggaccucugcagggcccacuuaaaccauaucgacaucauagcaaguccccagauggaaacccaaaguaacaucaagagugugauggauguguuaugaaauccaucaauagggcagugagucauggauggccacuacaugaaggacaccgagaaagcuuauaaacacaucacaggcugaaagaguacucaacgcccauguacagacugcuuccacuuauuuaguuggaagagugacaaaacugucugguuuaugaaguguacacugcuugaggcagauugacugcaucaaccuggaccagaccucagggagucuaaugcaggcaguucauugucaguauauuuaaaacaguacaauuuagggaaaggcuuuucuagucaguccaauucuaggugcacaauaaagguuaaggugugaccacauagaaacuccuuuacaaaguacaugugaccaugaggguggguuucauaucugaaaggccuagaaucuaguguggucucugaccaagacaucauagaggucagcaggucauaauguacauguaacaucuucugucaggauggguaauggucuaggagggcagagucugggauaaucauccuggggaauuugggggaggucugccucuauagcaaaaggggugaggucugccuccacagaccgcaaaaaggucaccaggucauuaacaagauccacucucagcuuucuugacugaggauacuccccugccugguuaacuuuccugggucuguuagugcuucucugugagcacagggucuucugugcuccuaacaacucccugcuuucccuucuccccagccccugucagauaccauucuacuuguuggcuagcaauuuuggcaguuauagauuucccauagaaauggcaucaugucguauuuuauuugucuuuuggggacuggcuucuuucauuuuccauugauccucaaacaguucaaccagguugcugcacauuacagaaugcccuucugucugaaggcugaguaguucauugccuacuaagcuguguuucucuuuuaugugcccaggggcuuccuuguguguguguguguguguguguguguguguguuagcuuugugaacagugcugcaguacacaugcagugcuaaucuuuuaaagacccugauuucaguucucguggucaguaagccagaggaggcugcuggaucauacuguauuucuguuuuaguauaguuuugugaggcuagccucaaacucacaguccuccugccucaguccuccuguguggggcuacagacaaauucuggagcaaaaguaacacuaguuuuguugccaucauguuaaacuuguuaauuguggaagaagugacauuaacauggugucauguuagccaagagugcaugguggacggcuucgaacucacuccaguccugccugcuucucagcagcggugugaggcuuccuucaucuggguaccagccacuucaagggcugauuuuuauuuuuguccagucuuuuuuuuuuuuuuuugagacaggguuucucuguauaguccuggcuguccuggaacucacuuaguagaccagguuggcuucgaacucagaaauccgccugccucugcuuccagagugcuggaauuaaagacaugcgccaccacgcccagcuuuguccagucuuuaaaacuguucuugugccagguugggguggcacacaccuuugaucccagcauuugggaagcagaggcaggaggaucucugugaguuccaggacagcuaagcuuaaaaagaaaaacccugucucaaaaauaaacaaaagcccccaaagaagaaaacaacaacugauccaacuguuaucucugaggcuuacugccuccaucugcuaaccuaggccuaauucuggaagcuuccauacaaucuuaucuaggccuagaauguuuucauccuuugagacuuacuguugaauaagcucacccuuucuagcucuuucugaauuuuuuuaaaaaaaauuauuuaucuuauguauucuguagcucuacacuacacauuguagcugucuuuggacauaacagaagaggacaucaguuaucauuacagaugguugugagccaccauguaguugcugggauuugaacucaggaccacugaagagcagucagugcccuuaaccacugagccaucucuccagcccaucccuaacccuucauguucuucucagacucauuuggacuucccaugcagacacacaguugugaauauuuuuuauuuguguaaauauaguugauauauagcuuguaauauagaaaaguuuucagaacuucccugacgguguugcuacugcuacaaucaagauguaggauguugauuccuuugggccgcugugucgcuacuuccucaucuccagggaccaucucuuacccugcacuuuccccuuugcccaauaccaucaugccacauacaagcuuuuaaguuggccuuuuuuuucucuuaccaucaugccuuugagauuuauccaugcuguuguacggcucagguuuguuuuuuguuuuuuccccuucuuuauugauggguaguaugccacacagaggggucaguuuaccccuucaccagcugguagaugccuguguucccagauuuuggugguuauauuuuuauaaugaguuuuuuagacaugaauuuuuacuucucuuggaauuauauaguaaagauguaaagaguuuuuuucuuuuccuuaaaaguauagagaaagcuaaagcugccuauguauuaagaaauugccaggguuucagagaaacuaccauuuuguauucagcauggcaugaguucagcauuuuuacuuaaaugauuuucauuguuguauaguaauauuuuguuguguuuuuaaauuuuucuuuugcauucauuuccuuuacuuuauaugggcagaggcaugagugugugugcaugcauguauagaggucacaggacaguuucuaucauguggguucuggggauugaacucacguuaucagguuugguagcaagcccccuuauccacugagccaucuuacagggccauguuucauuaaagcuuauaagauaugaagaugagucuguucucuagaaaucuuuuacuaguaggccuuucuacuuaacgaauuacugauuugaaacuugaaggacagacagccaccgccucgaugucuuuucccuacagaccaguucagagcuuaaguuucuaaaucuaaacaaaucauggaccaauuacucaaaaagaucacuuguuuucuauuuaucugggaaaaaagagaggguauguuuaaggaaacuuuuggauguuuucaaagcaguaauuagucuguauuagugagaauacaacuaaaaaugugccugccugcccugcccugcccugcccugcccugcccugcccugcccucgcccccucucuugccccacccucucccucccucccucccuuccuuccauucuuuugagcccaggcucucacuaguggcccaggcuggcuuugaacugugcgccaucaugcuuggcuauucuccuuuucagugagucagaggcuuguugaguguugaugccaggcuucuauugauuuacacaggaaaacaaugaagagucguuacauggagcucuaugaccuuaauaaagauuugcugaauggauacaagauucgcuguaacaaccacacagaacugcuaggaaaccugaaggcggugaaccaagcaauccaaagagcaggccgucugcgcgguaagucuuucccugguaccugauuugccuaugguauuuugaaaacaugagggucacagaagauuguggauacauuauaaaacucacacugaagcccaaagcagccuuccuucaacacuccagagcuggcccuggcuucuacuacucaacccaggacuuuaguuuucucuagacagauuuuugguuuuauuguucuguuuuuuaaagaaauaaagccuugcagggcaugguggcauacaccuuuaaucccagcacuuaagagguagaagaagcaggcagaucucuuguuaguauaggccagccugaccuacagaaugagucccaggacagccaaggcuacaugaagaaacccugucucaauaaauaaauaaauagccgggcgugguggcucacgccuuuaaucccagcacuugggaggcagaggcaggcggauuucugaguucgaggccagccuggucuacagagugaguuccaggacagccagggcuacacagagaaacccugucucgaaaaaccaaaauccaaaaaaaagaaaaaaaggaauaaaacccuaaauuccuuuucuaagaucuugcuguagcugcuaaagcagcaauuaucacccuguggggugugaccucucuggaggucacauaucagaaaauuacaauuuauaacaguagcaaaagugguuaugaguagcaaagaaauaauuuuaugguuggggguaaccacaacaugaagaauuaacuauaucacaggguugcagcauuaggaagguugagaaccacuguccuaaaggaaaacuuaguuuuauaauccaaaggaagaaaauaacuuuguaaguuagggacggaaaaaaacaaaacaaaacaaaaaaaaaccaacaacugaaaauaacuugggcaagcauccaucuuggaagcguagagaguugugggauaggccacaggaaauggaaaugcggccggagagcugcugauuccgcugcuucgaucaagcugccuuuguuaggagugcaagcugagucaucucuacaaaccuacuuugauucuggcuugggaugaccucuaaguuuuuuuguaauaaauucugucuuuccuagaagguagcaaguuuuuuuuguuuuuuuuguuuuuuuguuguuuuuguuuuuuuuucgagacagaguuucucuguauaacccuggcuguccuggaacucacuuuguagaccaggcuggccucgaacucagagauccaccugccucuaccucccgagugcugggauuaaagacgugagcuaccacacccugcaggagguagcaaguuagcuauguauauguauauguaauucuuuucuacccugguuuuaugcugucuucaaacuguccuuaccccccaccucuuuucuuucagacaggguuucucuguuuagcccuggcuauccuggaacucacucuguagaccaggcuggccuugaacucaaagaucugccugccucugccuccagaaugcugggauuaaaggcgugcgccaccaaccuggcuuggcuuugaaucucuaauuucccuuuuaaucauauuuugggaagcaccgacucaauguuuuuucucacacaguuggaaagccaaagaaccaggugaucagugcuugucgggaugcgauucgaagcaacaacaucaacacccucuucagaaucaugcgagugggcacugcuccuucauaggagacagggaaagaggaaggaagccccugcaaaaggucuagacacggagccuggcuggcucccgaucacagccugggcauccagcugcuaaggaugaaaccaugcuaacugauacagcuaaggacaaagcacuccggcugaaagccuccuucauugauaucagugguguugcugauuuguaucuuaaaauauaucaccauuucagaauuuaacuuguuuuuguacauaaaguuaguguaugaauuuauuccccccgaaauuguuacugaaauuuaaaauggaguaccuacuuuuucauuaaaaauaaaaggcacuggucuuccuu

SEQ ID NO: 4650 - RNA, 1834 nt, Mus musculus
agacagccaugaauggaaacuuuauuacuccaagaacuuuacauggacaucaccugccccgcaugugggcacacauauaaaaaguacaauuuauuauacaaauuaaaucccuugacucagguacuguguagucacuucccaggaucucucccgcugccauagguggguuucagggacagcagcugcacuugucugaacccccuuugcagaugcagccccgggcacacuuggcacagccugggggacagcagggacagcagccugaaaaaauuaggagauggacagaugagucauggcucuucacuucccgcccuccccccaacaccuuaggggaagcagcaggaaacccugggccaggagacugugggauaugagagcaagaagggaccucagagguccucuaggguccauuagagcucuagacagagggugggcuuuucaaaggucacagccaugacagaaacaagauuagaagccaggguucauuccuccaaaccaagacuuuauccuccuccucacugggcuggacagaaccaauaccaugcuccaaacaccauggauguccuuagagcugggugggcugcaguccuaaggagcuuugucccaugucuccuugggugucauaucauauccccccacccccacugagaaaaaggaucccugcacugcccucacgggcaccaucgagggauggggcuauucccacucgcaucuggcaguguccaggugaccauacucacuuuuacgacagguuuuacagcugcagguugugcauuugcaauuaucuccgcagaugcagaucccuccuaggagcgaggacagagaucaggugagcauggggcuacggcuacagaugcuccuuggugugcgugugggugugggggaguggcuagacaagaggguauugcuguugcugagcaucaccccaggacuguggauaggucagugguucuagugacaagucauggauggggaccgggagcaggaagggcagcauuggcucaaaccagguuuccugugacaaagaccccaagccccacucugggugggugaaagaaucugucauuuaaaaacacaggugguacagauguccauuuagcacuaacagacaaggccaaccccagacaaggacaaccaucaagggcaucauagccucuucuugacaaggccagauggaaaaccugaacggaaagcagaaaggaaagcagagaccccaggggccucuauaccuugcuuuuauuucauaaaagggacucacacuucuuuguuucucucaacucauccugucugucacauucaguuugagaacacucaaauuuucuguaucuuuuccaaauuuaggggacagaccucuacuguuaaggaugaaggauacauuugaaacucuuaggcgacaauuuucaaggcugagaacauacagggcuguuuugaaccccgauugaucucccaccuucugggcaacauucuucccagcaccaagcaacccagaauggcuuugaacacaggguccuccuccuccugcucagccuucugagugcuagcauguuccacuacaacugacuuuuacugacuggagagcacagcuaagccucuaagcauccaccccaccccaccaacccccggcuugcuaauuuuaaccuuuccauaggcuccauaguacaggagccacccagaguugaauaaccccgguuugcaaaggaggacacagaggucuauaaaaggggguaaaguuauaagauucccuaacagggcuuccuuacuuaccagacauacacgugcauuccccaggguccaugguccaggugugugagcagcuaagaaagggaggcugagg

SEQ ID NO: 4651 - RNA, 2665 nt, Mus musculus
ggugacuucuucaagcuuuuauuuauuuacacauauauuuuuuaaaaugucaugcuggggauuaaacguagggucucacauaugcuaagcaagcccucgaccuuacacuucauuccuagcccuuauucgucuaucuauuuauuguuaagacuaacaauaaguauauacccaggucagccugacuuucacaauccuggcugggccucugagugcuaagauuacaagccugggucacaucauucaaacuugacuuccuuuuucauuguugcuuguauuuuuuguuuguuugagacagggucucaccuuauagccaaagcuggacuggaacucacuauguagacuaggcugaccuugaacucacagaaauuuacgugccucugccucuugagugcucugauuaaaggaacuggcggauacauccagucuacgacguacuuccauuuucaaaaucuaaguccuagcgggaagugagaacugggcaggaauaaccguaccguggguuaguuaccuccaugaauuuacgggacuuggccagcggugacugccaacaacauccuggcuugaggcuggaguuacagcaaagacugcucuggggucagucuggaaagggagcacgggagcccagaaaucaauccgguucaaguucauagccagggcagccacagaaagugccaggaagggaaaggacacgguguuuaaucacacaauccauggacagccgugggcauccaguaaugccuggaaugagucaagaaggcauugccccaguuuucacuaagagcugcgaggacagccuguccuguuacaacccacccacagccuccguugaaaguauccgagucggccugccgggaagcuuccggcaccaguuuccuggcucugcagaugacacagacauuccagcuaugacuuccagucugauuucagcagacuuaagcaaguggggaaacaccauguaccuccaggggaagaaauuuuggcugccaucuccacccuuccccucagcauccacccguggguggaggugggucggguuacguggggcuuuccauccguguguuucagaacaccaccaucuggcccuuccuacuuggcaaacacccuggcaaagggcccugguccauauccucccagaauggacugcuuucguucucuugaauuccaccuccagcaaagacccccaccauuuuuuccugucacucgcugcccuccccccgccccccaagaguaagucuuagcacaaggcuugugucuauggucucuagucucuugacaacuggcuggugccuuaguggauucgaacccuacacucaucuugggcaagugacuaugugacugcgucuccguuuccacuuuucuacggugagaauaaugaacacuccaaccagcguuuguaaggaaaaacgacagcucuuacggugcccgcagcacgugacacgcaggggggcaggaguacaucaccaacagcaguuaagccagggguagggcugguuuuuguaaccgguucacacugccagcuaaguuuuccuguacgcagggucuccaagccccgcuuucacccagguuagcacacaagacaugcgcggaaacuguguccccguggcgugaucugggcggccagaggucucgucgcucagcaucgccucugcacccggccccucgggccccggggcaccgcaaagggcgcgcgcgggagcaagcagguguccuggaaccgguucccaccggaucgcagacccuuugcgcucagcuccuuugcucucagucccugagcccagagaaagggggugugacucagcgcgggggguggggggagggcgugugcaggcucugucccacgagcaaaaagagggccgcuugcagaauucgggucgugcgcaggcccaggggcgugugcuggccauaucccuugagccagaaaaagggcgugugcaggcggcgggggcgcgugcauggugccuuccacccgggcggagcuuuugcgcucgacccaauacucuccgcuauaaaggucgcgcuccgcgugcuucucuccaucacgcuccuagaacucuucaaaccgaucucucgucgaucuucaaccgccgccuccacucgccauggaccccaacugcuccugugccuccgguaagggggacugcugacgggauuucugggagagcuagacaggcuuuuuggccccuccuuuaguaauuacuuuaaggguacgaccggcuaccccuuccgaaugaauucugaagcacuccugcuccuuuaaacuaguccuugagauaguggcucgccuacccgggugauuugccucaccuuccuaggagaacagcguucagguacucccgggucccacucaaccgcgcucacugacugccuucuacuuuuagauggauccugcuccugcgcuggcgccugcaaaugcaaacaaugcaaauguacuuccugcaagaaaaguaaguuggaucuucucugccauuuccccgucacucuccuggggucccuagcccgccgcgccgcgccuucccucccgggagcguucagguggugugccucugacaagguuucucgcucacguucaacucuucucuccccacaggcugcugcuccugcugccccgugggcugugcgaagugcucccagggcugcaucugcaaagaggcuuccgacaagugca

SEQ ID NO: 4652 - RNA, 4064 nt, Mus musculus
gcucagcccuauuucuggcuuuccagggcugcuguggaccugguaucucugugucuucucugucccuacacugaguaggguuuggaucugucucuuuuccguggagucaucaagucuguaagccccuugugggcagggauccggcuccugguuuggcaauccuagaccucugcaggguucugggcuuucuaccuucuucgaacuggaggagccacgcccccaggaagaagccacgccccaggaagaagccacccauuucugguaugguugcugcagcugguguugugaaucaggccgacgagcagcgcauccucuuacccggcuauuucacgacaccaggguugcacccuacccauccucuccaggcaagcgccgugggaccacaggacacaggaacuuggggacaggguggguugggacaacugacugugaaaggugauguucaguaguccauagccucccuaucauaccucaccucauagucaccugggaagcuuuagacagaugccagggucugcccuccccuugcucagcccaagcccacaaaggcucugaggugugaucucagagccagcgauccugagagguucuaauccacgugcagcgaggaggaagcaggcgagcccagggcucagaguugaacugcuccccugugcuuggcugaccgugcaguggcaucugccggcccuccccagucccacuccuuuagauuugauguacaccacccaacugcugcuccugguaccaaaacacccagggcaaaagcagcuccucuuccuggcauccaaagcccuuccugucaaggauuccuacucagagacaucucuguccauggagcucucccaccccacccuccaaaaagaaaaaaaacugacuucauacacaaugcuaaugcuaucaucucugucuucaggacacgauaccccauugccacuuguaaauagcucuaugagcccccggguuccuuuuuucacaugcacacccugccugccugguccuaacacacaggccuuccugcuccguuggaagcccaagccaccuuuuguccagggccuuugcucuuccugccuaccucccccaccccaucccccacccccuuugcaguuccugcucacauauggguggccaagcucaagauuugcauccucagagagaccuaagaaaagcuuuauuuucuucauagcacguaucacuacguguauuuuggugauugcuugucugugcauugcugccugucucgcccucuagaaugugagcccccagaggacagggauuuguuuuggggagggugggggguugcucagcacagaaaaucauauguguuauuaccuaaugaucgagguggaauggauagaugaccccuucagccugcuaucccaccaauucucugucaccagccaacccaccucuuccucugucccugcccaccuuuucccucagcccccaucuccugugaggucccuuucucugcuggugcuucaugcucuaagcuuccaggcucagaaccuggucuauaugagaaacuuuuuggaggggccucuguggccaagaagauggcaggacuacuguuggguagcuaugaugugcccuccuguccuuguggcucagccagaggauauuguuucugaucugagucugucugguccuuggcuggccuugguacaguguggcucccaccuugcuguugugguggggagacuugcucagagacaccccuaaaacaaacagaauggaaacuccuugagguucaauuccaggacuacucagaguagggguccuauguccucucagaagcuggauucaggauguaugccauuccauuuucagggcagucauuuucagggucugugcuuuggcacaaggugucaaacagucaccaacuguccuacugauaagccccuuaagggacccagccuaaaccucuuucuacuccagagagugcaguggggcagcagguuuggggaagcagcccuacaucccuugcagcuaacaugagugcuuugcagaaaggaagaacuuaugugccaaggucauucagcaauuucauagccucuuacuccuggcugaaaaccagcccuggccucuucuaucccaagaucuuuaucaggaauuuuccguagcugccagggcacaguguguuggaaugguguggggaugcuggggagcugugauuuuugccagguagcuggcgauuuaaaacucagaagauaagaucuaccccaagggccauggaccugcugggggguggcgugggggaggcuuuacaaaucucaccaucccugccaagguagaaaacuggcccggaggaguccuuggccccugaguccuuacuucaagccuucagcccugcuggaagcuggcagaggaaagaaguguuuaugucuuccucugcccgccacuuaauguccaauagaggcaggaucugugccaugggaauccccaaagaccccuuguaagcucgucuccaccuggcuuagcucuccuugguucuagucuccauucauucccuguacaaccaacaagcacuuauugagcccgugucugaaacucugguugguugagauagucgcugaacaaucuauugugcgaggccccugccucuguggcugacuuccuuuccaagaaauuggagggaacacugccccuccaugaaagggagcacugaggucugagagcaucuccaugcuaguagggugacucugggacggucucuaacuggucucaacaccgucuuccuagcuagacacauuugcccuggucucucuagcccagaguaccaggggccagcugggucucuugaaagcacccaccagagugcaauuuccuguuggagguagcagggccuggaugccuuggggcagguccucuaggggauauggguagacucugagaaguagggccuggagugcuuuccucuaguuuccucuggaagauacuggagccugagccugaacagagucccaccaugaguagacagcagcccucugaccuucacccacccuaggucuccauaggaacaaagcagguaaaaggccuccuccaggaagccuucccugguuguccacaacaccuugacccuucuccagugguccacuccuccagcugucugcugaccucccagcuggucuggucuguuguagcuguagcuucccaugagcccuugcuccaccauggcuucucugagucccugggcuccugcugccacacagcauggggugcuggcuggucuguuggacagugacaagaguccucagaucuuauuuuaaauuccauaaacuuauuuuaaauuucauuaaaaaaaaaucuugugccacaugugguggcacacgccuuuaaucccaguacuugggagacagaggcagaaggaucucugugaguucgaagccagccuggucuacaaagugaauuagaggccagccaggacuauuacugucuggaaaaaaaaaaucuugcaaguuaauaauaauauucaaacaaaauuuaaccauacccaaggucaguacaacuuagugaacuucuauacaguuagaauuggcauagaaacagaagcuauagagcuucauguuaaauuuuacaccuuuagugucaaauguauuuuuugcaauuguccaccauccaaaucaaaaaauaaaaaacugugacggaguuagaacuaggaauacaucagcuuuuuguccccuuucuguguccugcucuuugugccauccuuccucauuccuuuauauucagccuuucuuaugcucuuucuucauguuauacuguacccacggguacuuuuguuuuuaugcauacauauauuuuuggcuagauuccacaggagggagagugugugguuuauuucugaaguuguaugaucucaccuaauauucauacugagacuguccauuuucccgaaaacauuuuaacuugauagccaaguagcaugcauauauauaauuuauacuuauauaacuuauguauacaugguuuauacauauacauaguuuuuuuuacccauucauuuguugauugucaaggucgauuccaaaucuuuguuauagucaauaaagcagcaagaagcaugu

SEQ ID NO: 4653 - RNA, 9141 nt, Mus musculus
cagagggcacccugacauggccgccgaagacccgcucccgcgccgcugucgggacucaggaugacgcaaccacggcggguugcaucagcccgcacccccgcgcuuagcccgccucuccgccgccuuucuccgggcgcugauugggccacguuggacacugaccucugucucagccaauggauggcagccacagagagcgcuaucugcggagcccuggcacggggcgcccauaaaagguacccgagacgggggcgcgugucccaaagacgccaagugucguuguguggucucagacggcugcgucgccgcccguucggcaucccugagcgcagucgagccgccagcgacgcagacauggagcccgagccacagcccgagccggucacgcugcuggugaagagucccaaucagcgccaccgcgacuuggagcugaguggcgaccgcaguuggagugugagucgccucaaggcccaccugagccgagucuaccccgagcgcccggugagugggaccccggggugccacgccugcaggguugccugaacucaccugucacacaccacagggcgcgagucuccuuccugcccaaccgucuccugugccccucugcucgcccuagcgcuugucaucucuucugggccuccaccaguccgcgcuugcccucuucuagccccucaucucuucaccucccauuacaccuaacucccaaggcugucacacaucugccccacgucccuguacccucuccucauccucccagggaaacaguaauuugaccuuaaugagucauuuccccauccgagucccagugacccuccacaaacuacuaggugacugacuggguguucccaguucggcuugcaucugauggguagaaauaagaaaaguaaauguugccaaacgagacuucuggguguaccgaggacagacaguauaugugccagauugggccauuggcuagaggguggggugcgugcccagucaccaacuucugaaggucccacgcccauaggcuagacauggcucuucuccugcagccuuccguugaccgccccucccugucgcgccgcacuuagucucggggaggagcccccuuaacuuucuagcgaaggaugacugagaaaggaagccagcagcuggaguagcccugagucugauuugacgacaaccgugggucaguuaggagacuuucuuguuccgugggguuccccaccccucccccucccccuuugguugacacaucugucaacagcucccuagccccgcccaccccuccggucccugccacgugacggaggcugugcgcuggaccuuccuguauuuacuuuguucucugauguuauguaaguguccacgaguacaguucuggauccgacaggagagggcaaucggguggcugcagauggggacuuugaacaguggccuuagagcuccaaccggcaguggcgcguggguuucaguuuguuuuuguuccgaguugucgggaaaguaaacaaggcuuuuccuuuuagaauuggcgaggaacuuuaucacuuuggguguaagcgucuaagccccuggaacuggucggggcaguguguaggaucuccgugguuguuuucaagaaaccagguguucuuguugggagguggcaguuaggugcauaaaugaugcuccugucgggucagguugcaucauuuguaaaagcuguuuugaggccuguuuuccucaggugaggaacauugggccccuuggauuugaagaccuaagcugguaaauaccaguaggucuccuggguguacaaaucuguaccuuacaaaaauaccgggaauggacgcaguggugcgcuucuguaauaugucacuggagaggccaaagcaggaggagcaugucuugcagacugggcuauacauagugugagucucucaguaauuaaagaagaaggcauguucaugguuuuuuuuuuuuuuuuuuuuuucuguaguaguacuuaucauugggugaugauaaaaguuuauaauaguuauuugcuuaacauuuuauuuucaaauuggccuuccaggugaggacagagggucaguuugguuuuuaccauuugcuggugguuggcuucacauuuagaacagcauuuugcaaauuggugugcacagcauuugucaguaaagcaguccaaacaacauggaacacagcauccaauauguguuuuagguguagugucaaaaguccuaauggauguugauaagaagaugaaggcuuccuaauagucugaggcuggccauaaacucuuguucuuucugccucuaccucaccaugugccaggcuugugggcaugugccaccaugccuagguggauacaguuuuccuggucuuuuggggagcagcguuuugagauagggccucucuagccagauuugcuugcagcucauucauaucccgggauggccucaaacuucugccucaguuacccuugugcugagagucuagauaugagcccagguuuuuuuaaaauuuaauuuaauuuuuauuucaggcuguuuggaaggaacaucuuaauuccaaguuuugcuuaguggguuauucuguugugcaggcuggugaccuguggggugguagccauuauuugaggccauugcuuuuaaggacauacuuuuaaaaauauggcuuaggagaaauuuaaaaauugauuuuagagaugagaauuauauaaaggcauauggacuccguguccuuaaagucacugguauagaggagaauauauggguuggacucuugauucuagcagcagguaauaucggguggcauggaagaagacugaccaaaaguaaauugaguuuucucuggcuuuagaguucauugcugccaaagcacgaaauacaauuuguguuuuuaguagcagaaagaaguuucccugugaauaagaaguaaaguguguggcauaguuuuuacgagcuaggggguuauuugccucccaaauuuauuugcauauuugagauuaaagucaagcacuuccuaaauaaacguuuuauauaugagaauuuuucuuaaaaaaaaaaaaaaaaaggucuucccgugguggcggggggaaaaaaacuuguucgaaucuaagcugaugugugcuuuucuuuccuuuuacaaucagcguccagaggaccagagguuaauuuauucugggaagcugcuguuggaucaccagugucuccaagauuugcuuccaaagguauuuguagcccuuagcucuugcuuugggguggggucgggcgcuuguguuugaagucaggcucugaggugucucuuguuacaucagcaggaaaagcgacauguuuugcaccuugugugcaaugugaagaaucccuccaaaaugccagaaaccagcacaaagguauggcaucuuuuuaugauaauagcuacuugugucucugauucucaagggagggagaaaggaagucgaguaaaaccgaagagagacuugaucgcaucuccccaaggcaugccaggucucagaggcugugcucucagcacacugagggcugagcagacugcuguuugcgugccaugugcaaaagcaaaggcaguccccugaccugagcuugcugugugcccagaacacagcgccagaauggcacgugaaagugggguuuauagaaaugaacacauuucccuaaggaacuuuguuuauuuucaagacagugucucucuauguagcccuggcuguccuggaacucgcucuguagaucaggcuggcuucagauucccaaagaucagccugccucugccuccugagugcugagguuacaggccugugucacacccaccuggcuaggaacaugaauuuuauaaggaguagagaaguaaacauauuuccuguagaaauuucugucaggaugacuuggguagggaaagaccacagucuucauuacaugaucucuaaagacuuugguuugacaauaaaacacauuugcuuuucuugacaguaguugcuuauaugugcacucuccauauucuagcgugguauuugacuuaaauuuguauuucacuuguauuucucacaacuucugaguaucacauggaaaauucucuuuccuuuacauugcugccuaguuauaugugcacauccugucugucacauugauuucuaggccuacuccuggguuuaacacuguacauuuuagcuucagugggaagcagucucaguaaugauagcugcauucagaagauuuucugagacuacaguagaaaaacauuuuuuauuuguaugugugucucgauacuggugucugcauagagagcuuuugcugggacuugaacccaggaccucacgcaggcaaggcaagagcucuaccacugggcuacauuccucaguccuaguaucuguauguucauuuugucagguugugggguggggauagggccauaagccacugguagcaaaguaauucuuuuagcuugauugcaaagaguugcaucaggcccuuuguucugacguuuauguuacuuaauuuagggugcugaauccacagagcagccggacaacucuaaucagacacagcauccuggggacuccucaagugaugguuuacggcaaagagaaguucuucggaaccuuucucccuccggaugggagaacaucucuaggugagugcccauuaagaacacgaguacuucauuugugucaagaacaugauuguacuucauuugugucaauuuaaaaauaaggcguauuuaagcugggcaucauggcgcacuccuuuaaucccaguacucaggaggcagaggcaggcacaucgcugaguucaaggccagccugaucucagaucgaguuccaggacagccaggacuuacacagagacaggggaguguggagcgaaaguacacagccccuuagcuucucagaugcuugcucccagcaagggaaggaaggcuggugcaugccuggcccagcacagaugugucugaaaguccaggccuguuccuuuggcucaugagcuugugcgaguccccugguuuucugagcugcacuugggcuuucucuguaaauuaggcuggaaucuuucuacaaggcugcuggauaucuaucaaccugcgcgggauaccagaugagcaguagacacagggaggguugucacggcacucagaacugccacaguguagauucuuaccccggggucagggaggacuugguaaggugacuugggcauuccccucuaaagcaugauccguggauuuaauccccagugagacuugagaggggaagcguuagucuguuugcuuggcuugcagaaagcaugcagcaacucucugccaauacaaugagaccccagggcaggacggggcucuuguuuuccaugggaucugaugagccacagcgcugcugcccucgacuucuagggugcaucauagagauggcuacugugaucucuguccugucucuuugacugucauugcugauuauaauuuacuauuaagcuugucauccuggacuaacucgacauguucuuuuguuugaaucugcguacaggccugaggcuguccagcagacuuuccaaggccuggggccuggcuucucuggcuacacaacguauggguggcugcagcucuccugguuccagcagaucuaugcaaggcaguacuacaugcaauagugaguccuacuguggguguggcugcugggaauggcaagaaaucccaucauugccauagugucaaauggagagagggguguguuuucaugacuucuagaacccugucuuuuguaguucuggauggaguaggguagaaacaauagcagcuucaagacgugucaauugauguagaauuaguuccagauaugcuuugcgguauagcucuucuuagaaaagacaucauauagaugugaugucuaggacugccuaaccugccgagagagccccgucuccaugacgcccugccuucagcugcaucugcuucuguuuuuauuuuagcuuagcugccacugcugcaucaggaacuuuugucccgacaccaagugcacaagagauaccuguggucucuacaccugcuccggcuccuauacacaaccaguuuccggcagaaaaccagccggccaaucagaaugcagcugcucaagcgguugucaaucccggagccaaucagaacuugcggaugaaugcacaagguggcccccugguggaggaagaugaugagauaaaccgagacugguuggauuggaccuauuccgcagcgacguuuucuguuuuccucagcauccuuuacuucuacuccucgcugagcagauuucucauggucaugggugccacuguagucauguaccuguaagcacaugggcugucucuuuacugaaaaugacacuauauugucacuugaguauagauagauucuuucagucugugacccuuaaaggagguguguuuacauuuuugucacucuggcacuuuuugguucaaggagcacuaacacagaaugcagaaauccuguguuagcaaaagaaaaauauuuucaucaucuggucgguggauaaaugaccugucaggcucaugaaguacaguacagagccacccugaagcauaagaggcuguauuuguuuccagaaggacagaguguccuuuaucaggucguagcugccuuucaggacaaaguacagacagcgucgucacagcuaugaagggccagugacccuucgcacacucuguuugcuccagcugccagcuggagauaauucugcaucuuucuccgggggacauuuggcagugucagaaggauuucccagcuagagggcugguguguuuaaguagaugacaggaagagaugcuucaaagucuccagcagugugcaggagagcucgccuggaggacagagccccagaaagcugggccuagaaggauaggucucugguuagaacggaaagaaggaaguuuuccuguagaguaaaauuggguuuuaucuuaguuuuucgaaauguaagaagcacaagcauucuuaauauuuugucuugaaaguugaauuuuguagauuuuuuuuccaguuaaagccuuuuaucaaacauuucuaugucuagaaucaaauauuucuaugaccaaauuaagguuguuaucauaugauauauauauauauauagagagagagagagagauacacacauacacauauauaugauuacagcagcuuuauauaugauuauaucucccaucucuuuuggguuugguuugcuuugaugcugugaggcuggaguugaacccuaggccgccccgcuucucuccaggcaagugggcacuuuccacuaaguuauagcuucagcuuuuuccuuucucuuuuuuuuuuuuuuuuuuuuuuuuugaggcagggucuugcugaguuggucaauagcauugaccucacucuguagccaaggcagaauugcuauuacuauuuacugccggugaauaaaacacacaccccugcuuuuaaggaccagaggccuaagagaaucuagggacuggcagacuggcugcacagguaguauuguguaagcuuuggggccuucagauucuuaugugaaucccacagugacuuagcugagaugugccuguuugugcuuucuucaaaggcaccacgucgggugguuuccguucagacagaggccaguucagaacuucccggaugauggugguccucgagaugcugccaaccaggaccccaacaauaaccuccagguacaggccucacugcccggcccgcucuaguccugagcuugcagacuuguaaacuagugguuugccauuuuuuaaggcuaaguauuuuauguuuuuuuuuaaaaguuauucuuauggcaacuauuuuuaagacuuucaauauucuauauaggcauauggcaauugggauuuuugcauauguaaugauggggggguugacccacauuuugagaauaagagauauguaacaguauacuuaacuauggaaacugcugguggguaguuauucaaauugacuggguacauaaccacaucucagaauagauuuucgucauaaggcagauuagugcaucauccugaaggguauacuuuauaacagaaauugccucuguagucugcuuuuagaacacugagaugccagauuggucuuuuagcucagggcauggcccaaauuagaggacugguuagcgugcagcaaaguuaauuacuauuugauaguaacugaaggccccuucucugacgcuggccaagggaaguguuugaacuauggaaggucaauugcagaugugcuauagaauuggagagguaccuccugcagccaagggcucauccccagggcuugucagccugcuaggcuuuauccggaccugacuucaggauagguguuccucuagacccuaaucauuuucucguugugucuuugccuauagggagguauggacccagaaauggaagaccccaaccgccuccccccagaccgcgaagugcuggacccugagcacaccagccccucguuuaugagcacagcauggcuagucuucaagacuuucuuugccucucuucuuccagaaggcccaccagcccuagccaacugauggcccuugugcucugucgcugguggcuuugacagcucggacuggaucgucuggcuccggcuccuuuuccuccccuggcguggacucgacagagucauugaaaacccacaggaugacaugugcuucugugccaagcaaaagcacaaacuaagacaugaagccgugguacaaacugaacagggccccucaugucguuauucugaagagcuuuaauguauacuguauguaguuucauaggcacuguaagcagaaggcccagggucgcauguucugccugagcaccuccccagaugugugugcaugugugcuguacauggaagucauagacgugugugcaugugugcucuacauggaagucauagaugcagaaacgguucugcugguucgauuugauuccuguuggaauguucaaauuacacuaaguguacuacuuuauauaaucagugaauugcuagacauguuagcaggacuuuucuaggagagacuuauguauaauugcuuuuuaaaaugcagugcuuuccuuuaaaccgaggguggcgacuuggcagagguaaaaccuuugccgaguuuucuguucaauaaaguuuugcuaugaaugacuguagcagagacucccauugucc

SEQ ID NO: 4654 - RNA, 9141 nt, Mus musculus
ggacaaugggagucucugcuacagucauucauagcaaaacuuuauugaacagaaaacucggcaaagguuuuaccucugccaagucgccacccucgguuuaaaggaaagcacugcauuuuaaaaagcaauuauacauaagucucuccuagaaaaguccugcuaacaugucuagcaauucacugauuauauaaaguaguacacuuaguguaauuugaacauuccaacaggaaucaaaucgaaccagcagaaccguuucugcaucuaugacuuccauguagagcacacaugcacacacgucuaugacuuccauguacagcacacaugcacacacaucuggggaggugcucaggcagaacaugcgacccugggccuucugcuuacagugccuaugaaacuacauacaguauacauuaaagcucuucagaauaacgacaugaggggcccuguucaguuuguaccacggcuucaugucuuaguuugugcuuuugcuuggcacagaagcacaugucauccuguggguuuucaaugacucugucgaguccacgccaggggaggaaaaggagccggagccagacgauccaguccgagcugucaaagccaccagcgacagagcacaagggccaucaguuggcuagggcuggugggccuucuggaagaagagaggcaaagaaagucuugaagacuagccaugcugugcucauaaacgaggggcuggugugcucaggguccagcacuucgcggucuggggggaggcgguuggggucuuccauuucuggguccauaccucccuauaggcaaagacacaacgagaaaaugauuagggucuagaggaacaccuauccugaagucagguccggauaaagccuagcaggcugacaagcccuggggaugagcccuuggcugcaggagguaccucuccaauucuauagcacaucugcaauugaccuuccauaguucaaacacuucccuuggccagcgucagagaaggggccuucaguuacuaucaaauaguaauuaacuuugcugcacgcuaaccaguccucuaauuugggccaugcccugagcuaaaagaccaaucuggcaucucaguguucuaaaagcagacuacagaggcaauuucuguuauaaaguauacccuucaggaugaugcacuaaucugccuuaugacgaaaaucuauucugagaugugguuauguacccagucaauuugaauaacuacccaccagcaguuuccauaguuaaguauacuguuacauaucucuuauucucaaaaugugggucaacccccccaucauuacauaugcaaaaaucccaauugccauaugccuauauagaauauugaaagucuuaaaaauaguugccauaagaauaacuuuuaaaaaaaaacauaaaauacuuagccuuaaaaaauggcaaaccacuaguuuacaagucugcaagcucaggacuagagcgggccgggcagugaggccuguaccuggagguuauuguugggguccugguuggcagcaucucgaggaccaccaucauccgggaaguucugaacuggccucugucugaacggaaaccacccgacguggugccuuugaagaaagcacaaacaggcacaucucagcuaagucacugugggauucacauaagaaucugaaggccccaaagcuuacacaauacuaccugugcagccagucugccagucccuagauucucuuaggccucugguccuuaaaagcagggguguguguuuuauucaccggcaguaaauaguaauagcaauucugccuuggcuacagagugaggucaaugcuauugaccaacucagcaagacccugccucaaaaaaaaaaaaaaaaaaaaaaaaagagaaaggaaaaagcugaagcuauaacuuaguggaaagugcccacuugccuggagagaagcggggcggccuaggguucaacuccagccucacagcaucaaagcaaaccaaacccaaaagagaugggagauauaaucauauauaaagcugcuguaaucauauauauguguauguguguaucucucucucucucucuauauauauauauauaucauaugauaacaaccuuaauuuggucauagaaauauuugauucuagacauagaaauguuugauaaaaggcuuuaacuggaaaaaaaaucuacaaaauucaacuuucaagacaaaauauuaagaaugcuugugcuucuuacauuucgaaaaacuaagauaaaacccaauuuuacucuacaggaaaacuuccuucuuuccguucuaaccagagaccuauccuucuaggcccagcuuucuggggcucuguccuccaggcgagcucuccugcacacugcuggagacuuugaagcaucucuuccugucaucuacuuaaacacaccagcccucuagcugggaaauccuucugacacugccaaaugucccccggagaaagaugcagaauuaucuccagcuggcagcuggagcaaacagagugugcgaagggucacuggcccuucauagcugugacgacgcugucuguacuuuguccugaaaggcagcuacgaccugauaaaggacacucuguccuucuggaaacaaauacagccucuuaugcuucaggguggcucuguacuguacuucaugagccugacaggucauuuauccaccgaccagaugaugaaaauauuuuucuuuugcuaacacaggauuucugcauucuguguuagugcuccuugaaccaaaaagugccagagugacaaaaauguaaacacaccuccuuuaagggucacagacugaaagaaucuaucuauacucaagugacaauauagugucauuuucaguaaagagacagcccaugugcuuacagguacaugacuacaguggcacccaugaccaugagaaaucugcucagcgaggaguagaaguaaaggaugcugaggaaaacagaaaacgucgcugcggaauagguccaauccaaccagucucgguuuaucucaucaucuuccuccaccagggggccaccuugugcauucauccgcaaguucugauuggcuccgggauugacaaccgcuugagcagcugcauucugauuggccggcugguuuucugccggaaacugguuguguauaggagccggagcagguguagagaccacagguaucucuugugcacuuggugucgggacaaaaguuccugaugcagcaguggcagcuaagcuaaaauaaaaacagaagcagaugcagcugaaggcagggcgucauggagacggggcucucucggcagguuaggcaguccuagacaucacaucuauaugaugucuuuucuaagaagagcuauaccgcaaagcauaucuggaacuaauucuacaucaauugacacgucuugaagcugcuauuguuucuacccuacuccauccagaacuacaaaagacaggguucuagaagucaugaaaacacaccccucucuccauuugacacuauggcaaugaugggauuucuugccauucccagcagccacacccacaguaggacucacuauugcauguaguacugccuugcauagaucugcuggaaccaggagagcugcagccacccauacguuguguagccagagaagccaggccccaggccuuggaaagucugcuggacagccucaggccuguacgcagauucaaacaaaagaacaugucgaguuaguccaggaugacaagcuuaauaguaaauuauaaucagcaaugacagucaaagagacaggacagagaucacaguagccaucucuaugaugcacccuagaagucgagggcagcagcgcuguggcucaucagaucccauggaaaacaagagccccguccugcccuggggucucauuguauuggcagagaguugcugcaugcuuucugcaagccaagcaaacagacuaacgcuuccccucucaagucucacuggggauuaaauccacggaucaugcuuuagaggggaaugcccaagucaccuuaccaaguccucccugaccccgggguaagaaucuacacuguggcaguucugagugccgugacaacccucccugugucuacugcucaucugguaucccgcgcagguugauagauauccagcagccuuguagaaagauuccagccuaauuuacagagaaagcccaagugcagcucagaaaaccaggggacucgcacaagcucaugagccaaaggaacaggccuggacuuucagacacaucugugcugggccaggcaugcaccagccuuccuucccuugcugggagcaagcaucugagaagcuaaggggcuguguacuuucgcuccacacuccccugucucuguguaaguccuggcuguccuggaacucgaucugagaucaggcuggccuugaacucagcgaugugccugccucugccuccugaguacugggauuaaaggagugcgccaugaugcccagcuuaaauacgccuuauuuuuaaauugacacaaaugaaguacaaucauguucuugacacaaaugaaguacucguguucuuaaugggcacucaccuagagauguucucccauccggagggagaaagguuccgaagaacuucucuuugccguaaaccaucacuugaggaguccccaggaugcugugucugauuagaguuguccggcugcucuguggauucagcacccuaaauuaaguaacauaaacgucagaacaaagggccugaugcaacucuuugcaaucaagcuaaaagaauuacuuugcuaccaguggcuuauggcccuauccccaccccacaaccugacaaaaugaacauacagauacuaggacugaggaauguagcccagugguagagcucuugccuugccugcgugagguccuggguucaagucccagcaaaagcucucuaugcagacaccaguaucgagacacacauacaaauaaaaaauguuuuucuacuguagucucagaaaaucuucugaaugcagcuaucauuacugagacugcuucccacugaagcuaaaauguacaguguuaaacccaggaguaggccuagaaaucaaugugacagacaggaugugcacauauaacuaggcagcaauguaaaggaaagagaauuuuccaugugauacucagaaguugugagaaauacaagugaaauacaaauuuaagucaaauaccacgcuagaauauggagagugcacauauaagcaacuacugucaagaaaagcaaauguguuuuauugucaaaccaaagucuuuagagaucauguaaugaagacuguggucuuucccuacccaagucauccugacagaaauuucuacaggaaauauguuuacuucucuacuccuuauaaaauucauguuccuagccaggugggugugacacaggccuguaaccucagcacucaggaggcagaggcaggcugaucuuugggaaucugaagccagccugaucuacagagcgaguuccaggacagccagggcuacauagagagacacugucuugaaaauaaacaaaguuccuuagggaaauguguucauuucuauaaaccccacuuucacgugccauucuggcgcuguguucugggcacacagcaagcucaggucaggggacugccuuugcuuuugcacauggcacgcaaacagcagucugcucagcccucagugugcugagagcacagccucugagaccuggcaugccuuggggagaugcgaucaagucucucuucgguuuuacucgacuuccuuucucccucccuugagaaucagagacacaaguagcuauuaucauaaaaagaugccauaccuuugugcugguuucuggcauuuuggagggauucuucacauugcacacaaggugcaaaacaugucgcuuuuccugcugauguaacaagagacaccucagagccugacuucaaacacaagcgcccgaccccaccccaaagcaagagcuaagggcuacaaauaccuuuggaagcaaaucuuggagacacuggugauccaacagcagcuucccagaauaaauuaaccucugguccucuggacgcugauuguaaaaggaaagaaaagcacacaucagcuuagauucgaacaaguuuuuuuccccccgccaccacgggaagaccuuuuuuuuuuuuuuuuuaagaaaaauucucauauauaaaacguuuauuuaggaagugcuugacuuuaaucucaaauaugcaaauaaauuugggaggcaaauaacccccuagcucguaaaaacuaugccacacacuuuacuucuuauucacagggaaacuucuuucugcuacuaaaaacacaaauuguauuucgugcuuuggcagcaaugaacucuaaagccagagaaaacucaauuuacuuuuggucagucuucuuccaugccacccgauauuaccugcugcuagaaucaagaguccaacccauauauucuccucuauaccagugacuuuaaggacacggaguccauaugccuuuauauaauucucaucucuaaaaucaauuuuuaaauuucuccuaagccauauuuuuaaaaguauguccuuaaaagcaauggccucaaauaauggcuaccaccccacaggucaccagccugcacaacagaauaacccacuaagcaaaacuuggaauuaagauguuccuuccaaacagccugaaauaaaaauuaaauuaaauuuuaaaaaaaccugggcucauaucuagacucucagcacaaggguaacugaggcagaaguuugaggccaucccgggauaugaaugagcugcaagcaaaucuggcuagagaggcccuaucucaaaacgcugcuccccaaaagaccaggaaaacuguauccaccuaggcaugguggcacaugcccacaagccuggcacauggugagguagaggcagaaagaacaagaguuuauggccagccucagacuauuaggaagccuucaucuucuuaucaacauccauuaggacuuuugacacuacaccuaaaacacauauuggaugcuguguuccauguuguuuggacugcuuuacugacaaaugcugugcacaccaauuugcaaaaugcuguucuaaaugugaagccaaccaccagcaaaugguaaaaaccaaacugacccucuguccucaccuggaaggccaauuugaaaauaaaauguuaagcaaauaacuauuauaaacuuuuaucaucacccaaugauaaguacuacuacagaaaaaaaaaaaaaaaaaaaaaaccaugaacaugccuucuucuuuaauuacugagagacucacacuauguauagcccagucugcaagacaugcuccuccugcuuuggccucuccagugacauauuacagaagcgcaccacugcguccauucccgguauuuuuguaagguacagauuuguacacccaggagaccuacugguauuuaccagcuuaggucuucaaauccaaggggcccaauguuccucaccugaggaaaacaggccucaaaacagcuuuuacaaaugaugcaaccugacccgacaggagcaucauuuaugcaccuaacugccaccucccaacaagaacaccugguuucuugaaaacaaccacggagauccuacacacugccccgaccaguuccaggggcuuagacgcuuacacccaaagugauaaaguuccucgccaauucuaaaaggaaaagccuuguuuacuuucccgacaacucggaacaaaaacaaacugaaacccacgcgccacugccgguuggagcucuaaggccacuguucaaaguccccaucugcagccacccgauugcccucuccugucggauccagaacuguacucguggacacuuacauaacaucagagaacaaaguaaauacaggaagguccagcgcacagccuccgucacguggcagggaccggaggggugggcggggcuagggagcuguugacagaugugucaaccaaagggggagggggagggguggggaaccccacggaacaagaaagucuccuaacugacccacgguugucgucaaaucagacucagggcuacuccagcugcuggcuuccuuucucagucauccuucgcuagaaaguuaagggggcuccuccccgagacuaagugcggcgcgacagggaggggcggucaacggaaggcugcaggagaagagccaugucuagccuaugggcgugggaccuucagaaguuggugacugggcacgcaccccacccucuagccaauggcccaaucuggcacauauacugucuguccucgguacacccagaagucucguuuggcaacauuuacuuuucuuauuucuacccaucagaugcaagccgaacugggaacacccagucagucaccuaguaguuuguggagggucacugggacucggauggggaaaugacucauuaaggucaaauuacuguuucccugggaggaugaggagaggguacagggacguggggcagaugugugacagccuugggaguuagguguaaugggaggugaagagaugaggggcuagaagagggcaagcgcggacugguggaggcccagaagagaugacaagcgcuagggcgagcagaggggcacaggagacgguugggcaggaaggagacucgcgcccuguggugugugacaggugaguucaggcaacccugcaggcguggcaccccggggucccacucaccgggcgcucgggguagacucggcucaggugggccuugaggcgacucacacuccaacugcggucgccacucagcuccaagucgcgguggcgcugauugggacucuucaccagcagcgugaccggcucgggcuguggcucgggcuccaugucugcgucgcuggcggcucgacugcgcucagggaugccgaacgggcggcgacgcagccgucugagaccacacaacgacacuuggcgucuuugggacacgcgcccccgucucggguaccuuuuaugggcgccccgugccagggcuccgcagauagcgcucucuguggcugccauccauuggcugagacagaggucaguguccaacguggcccaaucagcgcccggagaaaggcggcggagaggcgggcuaagcgcgggggugcgggcugaugcaacccgccgugguugcgucauccugagucccgacagcggcgcgggagcgggucuucggcggccaugucagggugcccucug

SEQ ID NO: 4655 - RNA, 14687 nt, Mus musculus
caccagcuccaagcugcugcagaacauccugcuaucaagcugugagcugaagagcuucagguauguggacuugcacuuucacugaggcucccgacuuaggguuuccauuguugggaggagacaccaugaccucagcagcucugauaaaggacaacauuuaauuggggcuggcuuauagguucagagguucaguccuuuauagucauggcagguaacauggcagcaugcaagcagauacggugcagaaggaucuaagaguucuacauccugauccucaggcagcagaaggagacugugugccacuuuaggcagagcuuaaacauaggagaccucaggagcccacucccacagugacacauucuccaacaaggccacaccuacuccaacaaagucacaccuccuaauagugcaacucccuaugggccaagcauucaaacacgagugugucuauggaagccaaaccuauucaaaucaccauagcccccuugccugccuguuccaccuguucccuagcucccagcccagaggaugcuggucccacaacugugcucaggucccagguuccuagagaugaugcagggguccuaaaugugaccuuaggaacacagccacacaacuaaaaauuuccucucuccacacucuguucuguuuuguuuucuucuggaauaguugcaaauagaaaguugcuaagcacuuagaaggcugagacaggaggaucugaaggucaaggguaacccagcugcaugggaaguuggagaccagcauggaaaucuugucucaaacacacacacaaacacacacacacacacacacacaaauacacacacacacacacaaauacacacacacaccccaaaacaaaacaaacaaaaaacuuauaggguugagaauuuaucccaaauaucucuguugacauuuuuauauuuucacuucucccuucccccucuucuccccucccuucccccucccucucuccuccuuuucuccucccccuuuuuucacuuuuaaccauuagaggugguucagugaaucucucaagagugaggguguuauuugccauaaucuaaagaaagugugaaccucaggaauuuaaacauugacuaccaguuacuaucuucuuuucuucuuucuuaaaaaaaaauuaaaaguguguguguguguguguguguguguguguguaaaugaaagagagauagagaaggaagaagggauggggagggagaaagaugguauuuacaaggucaauguugguaguuucuucuggccuuccaaaucagaucgccaaguucauacaguaggcaccuuuaccugcugaacagucguacauuguuuuguuguuguuguuguuuugagacagggucucaguagccaagcuuguccucaaacuauguagagcuggagauguccuugaacuccugucuuguucugccuccugagugucagaaugacaggcaugagcauucagggcuuugcacaagcuagacaagcacuguaccaauugagacacacccagccuuaaacacuacgcucucagucacagcuuacccucccagcuucucgucccauuaguaguguucauugcuaauuuugcuuuacccugcauguucugaacccagugcagaauaaaaugugcauucaaugucaauugucucucaguagcauguuugaccggaagcacccuccaaccuccugugucuagacacacucuggaaucuacaggcaggaaucuccuuaaguuugcaucugccuagcuuuagaguuugcguuuguaaugggaauaucaaccaggccauugcguauuccuucugaccuucuaucaaagacacacaaugcuugggucccuuugcugcagaugcuaacugugucaccugauaaagguggugucugccaaguuccuucgcuugcaaaagcacucuuucucuuuaggacugacacacaucuuauagggagauugcuucugauugucaauauucaguucuucagacuuucacccacacauuuuggcauccauugguaaauacugccugaguuaauuaccagagcaaagacugcaaaauggagcuuuuguuugguugaguuggcuuugauuuugaggcagggucucaauauguaacccagacuggccuugaacucuucauccucuugcccuggccuugacugcugggauuacuagaaugaaccacgaugcccaaagcaaaugggguuuucugaugauuggugcaacugauuacauccaggaacucucagcuggugagauggcucuguggguaagggggcuugcugccaagcuugaggaucugagguuagcccccaggagccacguggaggaagaagagaacuccccaaaguuguccucugaccuccauauacacacaccgugacaugugcuuauauauacacagacacaccuauguacuaaaauacauaaauaaaaucagaauuuucaaauaauagaaaaacuuggaaccccucccacucuguuuuccuuacuuucccuuaauauauuuuuauagauaaauaaaaauuuuaaguggaaggaaaguauuuaaaaaaaaaaaaagaagaaaagcucucaugaacuugggcagagugugauggugcgcaccuuuaauuuuagcacuuggaggcagaggcaggcugaucuuugugaguuagaggccagacugcucaacauagccaguucaagacagccagagauacaaaugagauagccugucucuaaaaacaaacaacaaacaaacaaaaccccuuuggagcugucagacagacuugagaacuauuguagugucagccaguuauuagcagggcauccaacugugacuaaggagggcuagaaagcccucagcuucugccuccagcuagguccuuauuuaauuaguccaggaugcagccauucgugaugcggaggacaggcgugcccuaagcacugauuccaagagccaccuccagccucuggcacuaauuucagaccuccugaggcucuuccugaccugccacucuuugguucccaacaggcugaccuucagccaagugagcacaaagagccucacccaucuggcauuuggucugggacacugccaccaucuggaagagcuggaguaaguugggaugccuggccaagggauggcugagaggacagcugagccucugguccggugcagaggcacuugaaucuguccuuccuggccaagccuagcaguccacagguugaaugcugugucccuuaucuugacuuuacccuugacccauggagucaaaauggcuggauuuuuccuuccucccucacuugguggcuuggaacuacacaucugucaaaaugggacuugacucugcccccaguugaugccagaaagcacaaagggacagaggaaucguuguaugguugcaugucccaagucuuaucuguagccuucaccuggcauccuucuuaucugacccagcugugacugccaccccucuugcagggaccauagagcuuagcccuuggggccagggguacuccuggggugggggcuaggcagaaagccuggccuauuaucuguaaucacaaucagccucuccagggccaagggacagguagagcagugucucuccaggguacuugccugaauggaaccuucuccuuggucccuacagcuucucuaacaacagucuccgugaggaggacacagagcuacugaugggagcccuucagggaaccugcagacugaagaagcugcaguaagugagggggagguagugaagaggaggaguguauguuaaugggggaggaguggaugggagcacauggagaggggagggagagaagauguucagggggaggagauuggguggaaguucauuggaaggaggaggagaagggagguucuugugugcaagggacuaaagaggaagauucaggggagggaaguaguaggaggaagggaggggaaaggaaaggagaaaggaaaggaaaggaaaggaaaggaaaggaaaggaaaggaaaggaaaggaaaggaaaggaaaggaaaggaaagggaaaaaggaaauuagagggaaaacaagaaaaauagggcagggaaauagucucuagacuauagggagggagggaagagggaggagggagggagggagggaagagggaggagggagggagggagggaagagggaggagggagggagggagggaagaggagggaaggaagggagguucauacagaggggucuacagaacauggcucagagccccugcaucucugucucccucccucugaaugcgccuuugagucucuggaucacacacacacacacacacacacacacacacacacacacacacacuuucacuucacugccuagcugagucauuagaaugcuugguuucuggaaacauaauccccagcucgaagcugccaaggcaagauuugguugaccuuuuuccuuuuuccuuuucuuuuuuaauagaaaacuacuaggcaacuuaacuucaggccuggcuggcuccaagggccaguuacuggucucuguugucccacccagcacccucugcagcuuucucuccucugauuuaguggaaagggagcacguguaucccugugaucagcgggagacuuaaaaaaugagcucggucauauagucaugugcccugccccuaaauucucaguugacucauuggcuaggugagaucaccuguucccuggacuuagguagcauuuuuagaugcuguuacagaagagaggauauaaacucuggguagaacucccuccugugucucuggcaucugcacaguuuucuuccuucuuuuaacauuacgugcgugcgugcgugcgugcgcgcauaugccauggugaacaugcagaggucagaggacagcuuuugggaauagcuugcuuuccacuaaaugggauucaaggaccaaauucagauccuuaggcuuggcacggagcaccuuucucuaccgagccgucuugccagccacaguuucuuaguaacuuaacucucuacuuuuauucuccuaguaauuugcaaucaucgaauucauagagaagccagaaacagcccaaccccccugcccccaaauagucccauucugcauacagacccaguucaggcacauucuugugaauacauuuaacugcguuuuuuucuguuuuaaaucuguuuuucugaugacccagaauacacccugguuauaaaaaagcuccaucauuucaaaaauauguaacaaagagggcgaaauccccuggagaugacgcugcuucagaaaauuucccacaacaggcaguuuguggacuguuuuccagauuuuucuccacacaugugcucacacaguugaacaguagccuguagugacauggcaugccucuagucugucccucuuagcucaucugcaggagaaccgugaggaugggcgggagacuuuaggaaaccuuggaccuuccagaacccacccgucuuuccauggagccauugcuuggguaccacuagguauucuuggcuuguucagccuucuagaaccuucccaaagcuuuauaugagugguuaaagacccaauaaggucauuggcuuauucaccugugugacccccaagccuuggccagggcuagggguuggugguucuguagggagaauuguccucccaucacucucugucuugagucccagacacucaggcugcuccuuaccgcguccuuccucauugucugaaagaaggggauggguccucaguguacagaagccagaccugucaguuccaugucuucugccacuggcggcucuccucaaacccagccagcuucuucuggcuguccucacacccuccucagguuaggggagaggacccugcuaagagccacgcccuucaggcagauaggcucuugauaggcugcugauggccuuugcuggcugaggcugcgucauuucagcacuguccuuaagaaccauaucccuaggaaacggaggcaguuggccaaguccugcugccacgucgccaugcuggcuugggcacacguuucaccgcucuaggcuaagucgucuuucugagcuuugauuuccugggauuaugaggauuaagugaaauaauaauacuuggugagugcugugagcaggggcuggccgcauucacucuguagaagccuuggcuaagacugucauuuguuucucuucaguguucaggcuggcgaccuugggaucaccagccaguggggaacacauagcuagggcccuggaaagggguccuaaguuuuagguuuuauucucacugcugccgcugcugcuuccucuuaaaaccuugaguagguucccuuccccucugagccucaguguuccucaucuguaaaauggacaugacagugcacccacauuucaagauggccucagcccagucuuuggccccugucacaugaucucuguuacugcucagcuccaguuuagguaugugguugagaacacagaaccgcuggccaugcgacucaauaguucaugcacaauguauaggugccaauuugcuuuucacaauuuacacuggaggacuguggguaugcucaguguagaggccucacgaguccagcuggacaaggccuuagucugcagcccaggcaugcagaguucaucuggccuccucucucuagccuuaguuucuuaccauugggagccuccucucuggccuugcucauucaaggacuaagccgaaugacucuacuacaggaccuuuggugaguaauuaggggaacauuagauaccuccuucggaaccugugcugguuuccuuuggggacaucccuggccccuuugggcuggugccugcuguucuugcuuccuagagccaccagcuuccuggauacaaaaaugauauagcugggugggguucgugcccuauagaagcccuucauaugcauaggauucucugcagauuccuguuaagauaagaauuagacugaguccuggugcccagauccuguguuuccagugagcaccccucaauggcggugguuuuaagggccagagacuacacuuuguggagugaggggcuagacuuaaucuccccuguauuaucacccccugccuacuugacaagagaaugccacacucucuuaugaugugguuuaccgcaaacacuaaauauuguggcuaaaacaagccccgguggugccacaggcauuugguuccaucagaggcccagccugacucuggcaggaccugugguuaacgcacagaagggcacagaggauccaaaaucaacuggcuucaaggcaguuugcuacaauuucauguacaaaagaaagcaauccccagaacaagaauacaaacgauuucucuggguaauuuaguuuacuuuuaguuuagcuuagcucuugccucucauacaggcaagaccauuccaagaguagaaaaggcaacaguaauaauuaugagggugguggugguggugguggugguggugguggugguggugguggugguagccguggugguagccguguuaaugaugacaggaaucccccuauuuuagcucagaugccuuaacuggggaacccauuugccauccuaggaaacucuguugcuggcguccaggcaaacaggaauuauaauaacuguuucaggccgggggcuugaagcaucaugucugccuugccugcaagucacugugagccucugcggcuccauuucuuagccgggacacugggagaagucaauacuacucugcuuacuuuccucuagaggaaacucauaugugaguggcauacgaguuucuggacgaauauagguuuaucagucuggagggugccuuucuucuccuccgagucugcacucugcuucuccggggugagcaggaauggcauuggugacaguggcugcugccuucugacacucuucaggguugcugacagcuuggaggagcuggaacaaguugccaucccuucccccagaucccaugcaacuuuggcaggaaaaacugaagggguuggggugucucuucaaguacucccuucauuucuuacucucaugccuucacacacuuccacacugcauaagcaacuccaggggagauccuuggacucuccuagaugauaugcaagagucaggaacaauucuaggaagacagcagggagaauauccuaagcaggcaccaagaguugggaguccuauccaaacaugggaugaugagacucacgugcgaaccagaaggggugugugcaagaugagaugggagacaggaggcagccugauaguuuuucaucuuugcuuuucuccccaagcuugagucacaaccagaucggagauguggguacccagugcuuagcugccaucuugccaaaacugccagaacucaggaaauuugagugagucucagcccuaccgagaaaagccugcagggacucuacccugcuucugggagaugggagacaggaggcagccugauaguuuuucaucuuugcuuuucuccccaagcuugagucacaaccagaucggagauguggguacccagugcuuagcugccaucuugccaaaacuuccagaacucaggaaauuuaagugagucucagcccuaccgagaaaagccugaagggacucuacccugcuucugggagaugggagacaggaggcagccugauaguuuuucaucuuugcuuuucucccccaagcuugagucacaaccagaucggacauguggguacccagugcuuagcugccaucuugccaaaacuuccagaacucaggaaauuugagugagucucagcccugcagagaaaagccugcagggacucuacacugcuucugggagacaggagacaggaggcagccugauaguuuuucaucuuugcuuuucuccccaagcuugagucgcaaccagaucggagauguggguacccagugcuuagcugccaucuugccaaaacuuccagaacucaggaaguuugagugagucucagcccuaccgagaaaagccugcagggacucuacccugcuucugggagacacugggccagcaauggaaaagggaagcucucccagucuugguggcaagaauugucaucuccuauguccucugggucuuuguguuccaucaggagggaggcguggcugcaucucuuaugcaaaugcaguggggagggaugagggaagagaagguccaauaagcuccccuuccacagccucucagggaacaggauuggcccagcugggggagugcagcuggugaagucucucacccauuucgagcacuuggaggagaucaagugagucucuauccaggugggaucccccuggaccucuuguuccuuuagaaccgggcagaaugggauccugagcaggcugucaacacugggcacucuauccuaucuucuuuuagacugggcaacaaugcucugggggagcccacagcccuggagcuggcucagagauugcccccacaacucaggguccuguggugaguguucccccugccaacuuagcauacagagcaguggagaggggacccaggagaagugggaucuaagcaggccagggguugagcagcuuagccuuagauuagcauggcccacucccugcugccacuccucauuccccagauuaagcuuaguguugacccuaucccuugccucugggagccccuggccaaguuucugccccuucagagccucaguuuccucguuuguaaaagaugucaccaacccaagcguuccugcuugagaacaagucucugguguuugaauaaaaugucagcaaaaggccaugugcaaaagcuacaagagcauugucccaucuucuguuaagucaaguugguggcuuccugagucccauccagcccugggucugggauucucugagacaggaaccauauucuagaaagagagcuaagaccaaaaacagggugaaaaucuuaacuuccuaguagaagaagaagucaagccuugaacuuaguguaccagacccauaaguugggguccuuggcaucuacuggguccuuuguggcccuuagggucaaaggccagcuaagguugaugcucuagucugaggcacaacuccaagaauaugaggcuuaaggaaggcucccaacccccaaagcuggccgaggcuccucucaccuugcccuuucuacagccugccauccagucaucuggguccagagggggcccugggccuggcccaggcccuggagcaaugcccacacauagaagaggucaggugaggugggguccuuccugggcggagggacaggcugggagggucuggggaaguucugacuggugucuaaccugucccacagcuuggcagagaauaaccuggcuggaggugucccacguuucuccaagaggcucccacugcuuagacaaauugagugaguagccuucccugauugucuggggccuugcagaaggaccaugagucucuuccagugaagucuuauucccaagagagccccugaagagaugggacuuagggaugggggaaagauaauuuucuaagacuugcccccuagcccuggccaggucacucuggucccuccugguuucauuauggggaaagggcacuugcugguucuggucccugucucagaggcucaccccuauuccaucccagccuggaguucugcaagauugaagaccaagcugccaggcaccuugcugccaaccucacacucuucccagcccuggagaaacucuugugagugcuuggaugggcucugggucgggaagaaaggaugccaggggguccuggcccugccuacuaugagcuacugcugucccacucucucugccaacccucacuucuggagauucgaagcccuuucuugccucauaaucuuaccccaugcgcuccagcgacauagggcagagcuaguucaucuggaaugggaagggagaucggucacuuggucugcaaaggauuuuugucuuagaccuucccucuggggggcuuuuauaagccuuuaccuguaacuaguuguucuuuuuuauuuuuuuuaauaagauuuauuuauuuauuuuauguaugugaguacacuguagcuguacagaugauugugagccuucaugugguuguugggaauugaauuuuuaggaucccugcucccucuggucaacccugaucacucagucccugcuugcucuagcccaaagauuuauuauuauacauaaguacacuauagcugacuucagacacaccagaagagggcaucagaucucauuacagaugguugugagccaccaugugguugcuaggauuugaacuuaggaucuucggaggagcagucagugcucuuaaccacugagccaucucuccagccuauaacuaauugugcuaaagcagaagauagaaacugguagaagccacccccucacacacuggcuaugaccccuuuggccaacccacugccucagaccucagaccguggcaguacugucaaaucauuaaaccugacugcugggacuugaggcccugggcauagagaagaaaauucuaacucucaaaguacagcgcacagagugcaagaggauuucuaggucugcauccuaaauaguuuggggaguugguuuuguuuuggguuuuuuuguguuggguuuuuuuguuuuggguuuuuuuuguuuuuguuuuuuuguuuguuuguuuguuuuuuccgagacagggguucucuguguagcccuggcuguccuggaacucacucuguagaccaggcuagccucgaacucagaaauccgccugccucugccucccaagugcugggauuaaaggcgugcgccaccacgagccgguuuguuuguuuguuuguuuuucugucucggggacagaaccaagccucaugcccaucaggugaguauuaggcuauggagcuaagcccucagucuucaagguucuuaaucccccuucugccacaggccagcacucgcugaucuugagccaucccuuuauaaccagugaccggggacccucccuuuugagccacugggaauaaagcaaagcaccgaguccccugggaaggacauggugcugucuucucucuucgacacuuucccuauagaucccuucgcagggagacuucucgaacaguagagacauaugcuuucauugaagauuaauuuccuaaagcaaaaacaacguuggcggagguuuuuaaauuaugacacacauuaucacaugggaagugggcaucgaagcgagguguuggcuuggcguaccuugcgucauauugugguuucugaggaacaugaugcucuggaagaggguggggguggacagggaggaaggaaccaccuguacccugagaauucuucagggcuggguacucaagcaccuggcugaguaacuaacacuucuugugcacaacacugcuggcaccuagcauuaacuacugcacuccuuccacucagugcccucccaccucugagcuucucccccaccuccccccaccuugcaggcuguccgggaaucuccuuggagaugagguggcugcugaguuggcccagguccugccgcagaugggacagcugaagaaagugaaguaugauuauacccuugugugggguggggggugguacagaagggacccucauccugaacaagcccagagguuacuggaauauuccugccucccagaaauuuguccagggucuuggaacacuguccuaaacuggcucugaggcccuaccaagcuuagugcuucccaugcucuagccuuuagacuuucuacugucccagugggagucagagaccucugcuaagugcugguaguaggggggaaaggugacuuugucuugccugggauaggacauggagaaggaacacccccuccccugccuccagccucacgcuugccucuauuucccucuugcccugccacuguccacugcaaagcuuggaguggaaccggaucacagcacguggagcccaacuccuggcucaagggcugguccagggauccugcgucccagucauucgguaacaaaggguugggucuuguaguggaaggccacacagaucccucaacuuaaagcaaccuccuauggggagaaacagagccuggguugaggauuauccacgagggacuuggacuauuccaucaggaaucuggcagccagcagaccugaaucaaaucccaguuacaccauuugccaacuguguuaacuuugcaucugugacuuuaugucucugagccucaucuguaucuaccugggagggugguguggaugaaaggacuggauagggcagagucugucugggacauagcuagcugacucucagugggaaggggguaucauacuaaggucgcuacccugguauauacgaccuccacugggugacauaaugucuucuccuuuaggccaugaucucagagcccuguagggagguuaggagcagagacaagaggaugagggaacaacucuagagcugagguccaugucuuugcccacagccucuggaacaaccccauucuuaacgauguggcccagagucugcagagccaggaacccaggcuggacuucuccaucacugaccagcagacucuuugaggaacccaacggacuucucaagacuuaugaguccaguccagugacagccacaucacccaccaggagagggggcucagaagaaccucuguuggugcccagcauccuacgaaugccccaggaggaaagaacacauuuuuccugucacgaucccuagggagcgcauucuuagggacugagagcuuuguuugaccaaaagagggccauauaucauauaucauacaugacauauguuaccaauggggcauugacauuaugagaguauuaugagguuauauauacaggaaaggcuguguauggugcacuaugaccccuugacaugggaaggucauacucagaguaggucaaauguagaauuacauggaacuuguggcaugacaccuggucauagccucuuagcacuguaauuggaaauacacaugaucaggaauccacuuaugacaugauguccauaucacaugacacacaacuugacaggggaccacagauaaguccaagaccuaauuuauuauuauuuuaaaaaacaugaaguuaggcuaaugguauaggcuauguuauaugaacagccuuuuagcuguucaggaaucugaggcagacagaucgcaaguucaaggucaaucuagguaauuuaguaagauccugucucaaaaggucagaaagggcuggggauauggcucaaugcuagagugcuuccuagcauguguaaagcccuaagcucaaugcucggugcuuuuuuuuuuuuuaaguauuuauaagcaccuucuggagaaacuuuuugucuugugcuaggagagggaguuaagaauugaguggcccaaugguccggggucugggacaugccaaggacuuagcaugaaguccccuccugccagagccucaagucucucuucuguuaaucguguucuuccaaggacuuccagcccaggcuuaggaguuaaccugaccuugggagaguucgcacucaucucuucuuuccugguuuaagggacaaagccgagcuacagguuuagggauaaguacuuccaggauaauaggcaagaccacuaggucuagccuacccacuaccucagcaggauucagaaaccacuugaaacuccaugguguuuugcuuuguuuugcaacuuccaaaggcuaaacucacaacacuccauaucaaaugaucaauaaacgcagauguaacuggugucugauguaaacgccu

SEQ ID NO: 4656 - RNA, 28597 nt, Mus musculus
auuguuacacucacguauuuauagggaagaagaaaagucuauauauacauggucagcacagagggaaucuuuccuucaaguauuuuuggucccugguuaaucugauccccaggagagaccugccaagguacacagaugacuguguucugagggucaaaguggguuuuccuucucucucugcucauccugcuuuccuugguuggccugcuuugccacagaggugguguuucaauuacaggcuucuacaccauuuaggcacaaugaacuacgguaaaaaggccaccagaaacaccaaaagcagacgucacaguuggguguagcggcacucgccagugauccuagcacucaggaagcugaaaugaaaggaugguaaguuuguaagccagcuugggcuacacaguagacucugucaaaaagaaaagaaccccaggacugcucaacaccaucagcuucacguggugggagagcuggaagccgguguggugcacagcaagagcuggcuugacagggcuaaaaauuaaaguuagcggacaguuuuaaacucugcaacccugccaucuuuucaacauccaccgagaccaugaagcacacucguuggucuggaaagucaagccaugugaugcucaggacuuugaugucuuggucugccucccgaaacagcucaggguugcucuagauacagguacgugcugcggggauggcagcacagucaucggaacagugacaacaagaggcagaaggugcuugcaguuuuaccuaaacgucuuguuugucaggagggagcugacaggccugcacugacagucaggaaagauuaggacugggaggcucugcaagggauggcagcgcucacaggcaucagcgaugggcgaaggaaacccaccaucugcugguaggcacccgugucaauacuggaaggggagaggaagggcuggcugagauccagggcccucucugcccacguuaaaucugaggagcuuccucugccugccugccagugugucagugccaacacacccagugucucucgcucgcucgcuggcucgcuugucucacacccauaggaagggaaaaaacaauggaugcugggaccagcgacgagagagcaccucucaggcucguucugaagcagggcacacagaauuccuaaguccugcaucccuguucccuccucccccuucccucccuucauccuccaugagacagaaacaggccagagccugcugcuuuuggcugcucauggcccaggcgcuguuguguguguguugagggggcugggggggaaggcacacuggagaaaggaaaagcacugagcagcaccucagacuggcuaaaagcagcuucgcagucagaagcuacaacuguaugugcaaacagcagugcuucgguggaguagagugcaggcauaacaggcaggcaugucccacuaguuugcagucugaggauuccagaaacugcuaggcauuacucaucucuuuagcauagcuaucagcaguuauaguuucuggcuaugauucaguaaguuugcuucucuaacguuuagaaucuuaaacuaaaucuuuuauuucaaaaacaaaaucaaaacauuuuuucagagagagaaggugggcagaggauggucauguucucguggucagcuccuuccuaccuccucaggcuggauggagaggggaggacauggaagagucucugcucaagggcugucguuggcucacagccuugugggugaggcuugagauuuuuacuuaagucacacaacacccaggaaggguuaguucuaggggacagcuccaugucaccagcuggucagccccuuucucuaugcccacacacaacaugguagaaccaagaaacccauucaucuacaacaacauaugaagcuaacgcugcccuugcuuccugugcugcuagguaaggagauaaacaagacagcaacaagguacaccaaacccuggcaggccagcugcugccuguccuugcacuguccgugacauuucugagacaagccugaaccccgacuccucauaucaaugggacagguuuggucaucugcacaggaguauaaagagaaaucaagccgaguuugagccacaaguggacugagacacauuucugaguuagguuaaaaugucacaugugcacaggaagcaggugaguaaguuuucugagggaggugaugccgaggcagaacuggcauccaacccucugagaugcucccugugguaauaucaggagcuagggugccucgaggaagguguugguucggaagauggaggagacgaucuucccuguagcauugauggugccuucacugucugaacuggauucggagucacugcucccagaguaggcgcccaagccagggaggaugccgaugcacacagcagccgacgggcaguggauggagggagguccgcucagagaagagcuuccaagagacaugcaggacggggccucugcaaaaggaggacagcaaguuaaccaucaccuuccuaaugcugaagggccauucccagccugaacacaaugcuggggcuuucuauaaaaaagccccuuugcugcagaacaacucuaugcaaucuugggagacucuggacaucuuuguguuacagucaaagaagcggacagaagagaguacacaguugggacuugaaagacugcccacacucucuugccacccacuaguucugagauggggaacaaaccuuauagucaccuauuauaguuagauuccugucuucacaagucauggcauuacagcaagugggacucaggucugaugucuuccuuagccacucuuguggcccucaacaggaggcuagaucaagagaccaccugugagugauacuaccgauucugugaugccacacugaagagaccagugaccaacuggcagacacgagccaugcagcucugcucuuuauuaaggcaauuuccuaccccugggagaggagcaccucagaaacugaucucaccacuuuuacuuuuuaguucguuuaugcaagacccccugaaggaaauauuuuaaagcuauauacaaugccaccaaguaucugggcucuuuucuucccaggauaugcacagugauucugcuacuccaaagacaaaagccuucaucgacaacauggagaacaacaauuagaggccaagugaagaggccugaagagaugauucagagauuaaaagcacauacugugccguugaagaggacaugaguucaguucccagcacugugucagcuaguucauaaccuguaacuaccuuuaacuccugcuuggagggccuggcagcccucugauggccuucauggcacagcauucaugcacacacacccagacacauacagauacauaaauacauacuuaagaaccaagauguuuuuaaaagucaaacaaaccuaaacugagaauggcgcuccauucuuuccucccucugaauguuuccagccucauuugaucacuguaacaacuuguauguggguguucucccugcuuacugaugaggggagucaaguaaguuguaagaauucaggcuagaguauaaaacacuaacccaaaucugcaccagaagaugcuguacaaagugaugcccaagcucagaggucggaagucacugcccggaccgaaggacguuccuuuugcggacugccuucuacaaaccaaaccacacgugugcagauacucaagagaaugaggaagggacacugaauccagagcuacugagaugcuaaggccauugguugucuaagacacagauuucagcuaagggggucugcuccucucuagcagggaagggagaaacugcuggagguaagugugcuccauaucucaaaaggcaaagugagcagugucugggagacaucggcuacagugcaggggaggcaguggugaagaauacgcccaacaaucaucacaaagcuaacaacuuuuaagauguaaagagcucuucuaaucuguuaaaaacaaaaagcaaagccaguaagcagcgcuccuccacagcuccuccugaguuccugcccugacuuccuacaguaauggacuuagaacugcaaguagaagacaaaccuuuuccuccuccaagcugccuugguugggaaccagacagacagagaagcaaacuaggacaguaggcaagaggcaaagaauaaagacuccugggcuuucuuggggccacagcucaguguacugaacaucccuuuucuaaauaauuauauacauacauuacugacucagacauuguuuuuaaaauggcaaauacuaaaauugaaagggcauucuggccauuucaaucaaguagaauagucccacccaccugugucacccacugcacccuuccaauaaaggacgagcacaacagaagccuccacacugcugaagggacagggugcccacuccacagaguacccuugagaggugacccacaaccacaaccacugugggacacacuggguauagcacaaaguaggccagaauuuauuaugggaguuacugucauucuacaguucccuugcaaaugguuaauuuggggggagggaggguaaugguaagaaucugaugguuuuaauauuugagacacgacaagaaguuguuaauucauucucccaguguuuguuguguuaauaugcaccacacagaaugcuuucagaggcagagaauaacauaaucaaguucagagugcuaggagggcuguagcuagcuaugggaggacagagcugaggacagagcugucacaggaaccagggccacugugaccccgaaucgcuuacgugaaaggaccagaaccuccaauuaucuaggaaguuucaagagagaaaagacugcaacucugacaaauuucauuccaaaagcaguuacggcccaaagaacaaagcgcugcccucugagcucaccauuugggggauauuuccugccaacuccggccucugcuggaccacauugucauaucaacucagcauagaaaauuaugaauagugaaauguucuuggaaugcaggcagauggagagacuacacaggccaccuuguacguuugcuggcucugcuuaagcuaauuuucaguggaggagcugaauuucugucagggccaaggcuuccuucaggaagaccaaggcaaagccuucccaugcagaggcaagacugaagcaagccucaaggauagccagucuccucuagggucucuccuagaaaaggaagguauuucuugccuagcuugccuaagaauguagggacaagaaggcauuuagaaugugcgcaauaggucuggaugaacacaugugaaauauacaaugguguuccucuguggaaaugaaaggguagaaaagggugugggaaggggcucuucacugaagauccuuuuuagagguacagcuacuaccccuggaacuguggagaaacaaccuuaaagcauccauuauuugucugaaaaagaaguaaaugaaagcucuguuucauagauggccaacugaguugaaugagauccucaaucccacagugcaccuaaagcaaacucuugaacuccucagcccagcucuagaacacuccacuccucuccuuacagcuucaugcggccuaauacagaggccgaccucaccacauaagaagucaccaccuucaaggaaaauaagacuccugauuccauuaggcucacagcaauccaaccaucaguaaaagcugggcauucugucuaccacaggugaaaucaagaaacuugacauuuggcaagacagagaaaaaccuuuugugagcagaggucaucugaccagggcuuauaagcacuccagggagaacucgauuguuaccuacaaugcuacugguuuguaacccaccacuuuuguaggguggcugacauauucaugguaggaauuuuccugcuuauuuuaaaacaguuuggcauuaaguuaaggcaggcuuguuuaaagagaaauaaugcaucccuuuacauaagaugcacucuuccuacaguucucauccaucacugguagaaugaaggggccacacccaccuugagccuugucaucugggucggggucugguuucagucucuucacacuauugccacucucugagcuguaacagaaaacauggugauuugagucuuuugaguuuuagcgcucaacacggagaaucagggcaccgaagcauuuaugagagucugcggcagucucaaggagcugggaugacugaaagaaaaagccuucauuucacuuccuagccuuuucuuaaauauaaaaucugcuagaaagagaacuuaaccuccaaacaaaccgaaggacacagcaugcacacuucgccuuugucuucuuuaccauucaacugauggauuucaagaguacuuacacauuucacaaugacaaaagauaaauuacgaaaggaaauaguuuugagaacauccagagauaucccaaagauuuucacuaaaacagaagaauacauuucaauggagaaagacauuauaccagaggaaaagacggugauguaagccuaaacagguaucuguuuacauaugggccagagucuaauuuguggcaugaaacacaguaagguccuguggccaucauaguacauagaagagagcaaauauagcacaagauuuaaaggucccuuuugugggagggggcugugcuagugagagcgugcccacagcuccucaauagcaggcaagggcuuuaguacagaacugaagcccuggccagagguccucuguuuacagaauuuuuaaggaguuaaaauagcuauuuaguuuugcuaaguaugccugccuguuauaguucaagaucuaucacuaaaaugauagaaacaaaguauauauaauagaaagaaaaaauauuuuaaagucauuuucacuuuuuuccucaaaagcaagaauauaaaaaaauuuuuuuuaaguaaaagggaugcugaggauguaguucaguuguuaagacuguggccaauaccugaggaaagcucuggguacagccccccaaaauagcauaaacuaagcaugggacacacccuguaaucccaguacuuagguggagcaggaggaucagaaguccaaggucaucuuuggcuguacagugaguuugagaccagacuacaauacacacacccugcucuauaaauaaauaaguaaauaaacaaagagcaaaaauaagaagucagcauuaagaugguagaaauuauauuuuaaaaucuaaauacagaccauacaaacuaguaaaaacuagauuaaguaaacacauuuuaaagcaggcauuuaaagguacuuauuuaaaaacuuaaaacaacccgccuauaacuuaauacccagaaagauuauaaauggaagugcuguagcccccucacccccacccccagaagcauggauaaaaagaggaccacagcagccgggcauggugguguaugccuugaaucccaggacuuggaagacagagguagguggaucucugugaguuugcggccagccucaucuacagaguggaguuccaggacagacagggccacacagagaaacccugucucgaaagacaaaagaaaaaaaggaaggaaggaucaaggcaaauacuagcaucaaacaggcuggggcgcucugaccacuauuccucacuaucagccuaacuacagcuagcuaaaacccugaggucuuagucacugcucuguuguggagagacaccaugaccaaagcaacucuuacaagaaagcacuuaacugcggccuugcuuacaguuucagagguuugguccguuaucaucauggcaaggagcacaccagcuuuauggcgcuacagcaguagccgaaagcuacauccugauucauaggcagagagagucagacccaacacagauucuccucaaagucccuuagaacauuaacuccaggaacaagugacauagccuauagcccugccaaagaaccaggauugcuaggcaugguggagcacaccugggauacuagcacaagagcagucuagucuacagagcaagauccaggccagccagggcuacacagggagauuccaucuuuaaaauaaaaauuaggauauacaaaccacaauaccacaacacaauuaaguuaggauuaguaaggaaaaacuaagaaccguauuucauagccucuaagaugcuaggauuauaacguauuaaucguguguguguguguguguuacuaaacuagaauuggugugaagccuaggaguccacauuacugacauuaauaaaccaaggcagagaagcucagaaacuccugccccaagaggcuaaugugucaccuugcuuugaaagcaacauuaagugaugcauuuugaaaacccaagagagacucuauacagaucaccaaauaagcuaacagauccuuuccuaaguaugauauaaagacugaucaagggagacagcugaaacaccauuuggcagugcaagaguaccuaagagguaacugcccaccuggagacucaucaaacuggcccaggucugacuccugagagcugguggacuuugggaggcuuacaugggguguuuaaagauucaugguuuguuaaggcuucuucucugaccacaauccucccccugcugcugcuguaccacgaugacauuuuacaugugcucaguguuccuaggaacaucugcagcagauagaggaugugccaaaccacaaggcugcaucaauacacucuauucaaaauauguggcugguugccaauacaccauauugauuuuccuaauagacugcacuuuacagcauuuugcccacggucugguuggucaagcugauucaaucacuuuggugccauuucaggauuugaaaagggaagagcaaacaugacaaagaacuuaucagaaucuccagcagugcuacucccacgucagucagagugagcgguaggcaggucucuaaccugucacagcugccccauucucucaaugccucugcagcagcuguucucugggucucuucucccuugccuguccagagucccggugcccuacccugucaacaucuuucuaagcccuucucuagcuucaggaagcacacuuccagcugugcuccuccgagaugcuguuaccccaucaccagcagcaauccugaggcaucugcugccucgucugccuacagauacaaagcucagcaccgaacucuugcuuuauuacugacaacuguggacagaaguucuucaacucuccagcugucuuuccaucuguaaaacgggucagaauaaccaauacucugaggaacgggggagagcaauuugugaggccauuagaggaaaucuaaccuccagcaggugcucagggaaaaggagcuguaugucagcugaaugagugauccaaucaggcuaggagcaaaggcuaccgggacacuaaaucuggcaggggagagagaaaggcaagcacacuggagcauugucccagcaacaugcugaauaaccacuugcucugggcaccauugcaaguggcauuucagacuauguggccagaggagauuuucaccaugggcacacgcucgcugaccucuuauguuucacagcuccugccaacagcuuugccugggagaacuuguucuugguuucuauggguuucacggccagcuucuucucuacuucuuuauuuucugcagaaauuccaaccuuguugagauuacugugaguuacagguuaagggucagauuaaccaaaggaagaaaugcuccagagcgaaaguaaauccagaggacaacaaauauaauccauuggccccucggcagaacuuaaaugugacuuggccucccaaaugguugggaucuagaucuaaagcaccagauccuguauguauguauguguguguacauguguguguguacaugugugugugaaugaaggcacguguguaucacugcguucaugugugaaggucaggucuuaguaauuugcugccucacacucaugaaugcaccugcacccagcccugccuaugcuuuugaacacggccucuggacucccguucuaugucuguagcauuuaugaucuucucacugaaguguucugaugugcuguaccagcaggacaagcugcugcuuaugguucucaucugagugucaccaacagucaugaggacauucugcaaaacugcauuucaccuuucaaaggugagacuuaguuacuuauuucuaaggaagucauaauaacuucucaauuuccuuuauauuccuuaagaucuuuguuaugugacugccaagacaguucagggaguaaaggacuugccacaauacuugaguucaauccccagaacacacaugguagaaggaagaaaagacuccuauaaaauguucuaacuuuccacaugcauauucucucucucucucucucucucucucucucucacacacacacacacacacacacacacacagagagacagagagagacagagacauacauagacacaaagacagagagugagacagacagacagacacagagacagagaaacagagagagaaacagagacagagacacacacagagagaggcucagagagagacagacagguuugaccuguuggugaaggucuauauuccagcuacuugagaguguuaagcccuacucuggauuauagaggggucaagccagccacagcugugucaaccuauccuguuauucugcuguccucugggcagaaggcagagggucagaagagucaguuuuaaguuuguagcugagcagggcagugguggcguacgccuuuaaucccagcacuugggaggcagaggcaggcagauuucugaguucgaggccagcuuggucuacaaagugaguucuaggacagccagggcuauacagagaaacccugucucaaaaaaaccaagaaaaaaaauuguuuacagcuaaaacugagggguaacuuugcaucaacucucagcaugcacuugaaccaaagccugcagccaguacuuaugcucccagcucugacugacauuccaucccagagcuuuuaacuuuccuuucucacaauaaaaaguagaaaaaaggcuaggauauagcucagugcuagcgaggcugccuagcauauguaagguccuaggcucacuccccaguaccacuaaaggcagaaaauccuuaagcagggcacuugucacaucauggucaucaccagcucacaggcugucaccccugcuguucucuccgcuagcauauguuccuuccguuuuaggcucuuccucauaacuuccuaagcggguaaauaucugacagcuguuaggaugcagcagugccuuacugcacaacagugacaucuagugcccaagacacccaagaagaagccauugaaagauggagaaacagagauuaccucaucacacacaccaggcuggguggcaaaugucuuuaccacugaaccaccuugccaccccucaaucuucauuuucuuaaaauuacauguaaacacacacucagggaugcauguuucccacaaguguacagagguaagacggccccuugcaggagucaguucucuauuuuaccauaugggucccagagaucaaauucaagucaucaucuugucagccccaaacgcuccuuuuuauugggauggugagaggguaggagggggguugaaacaagagacuuaauuuuccuaguaaaaaaugucaaagucauuaguacauugcaguuucuacuuauaacuuugucacuaaggcacagaguaucuggccacacugcugcccacacuacuguuuaguggaccuacuguauauacacucugcaggaaaauacuagcuaguacaaacagaaaauccuacuaucaaaccagccauagugacagacaccuuuaaucuaagcucuggggagaaagaggcagguggaccucugucccugagucuaaccuugucuacauaguaaauuccaagccagccaggaugcacacugacuguccuaccaucaauuaccaauucacugaugaagcauguucaaacagaacagugaguuuacucaacuuacaaagcuuaaaauauccaaauaggcuuccuuguagauggguaaaaguuaggauggacuaucaauagcuccugugggcuauauacucauuuauuuauauauuuauugagaauuuacaauauuccaggcaccaggaaaaaaaaauucagucauucugguuguuacagaacuuauuuuacaucuuagcaguaaagagauaaaaagagccaggcaaacaaaugaacauguacccuauuuaaaacaaaaugauggggcuuggguagcucaauagaguacgugcuuagaauguauaaauucccagauaacacuacauguaauaccauuuggugguaaacaggauguaaugguacagcaaucagaagcugcaaccauacaaagugcuugaggaaaggcauacagagcugaguccuaagccaugaaaugcuagccuugggaaaucugagggaagggcauuucagguugaggaaaccaugaauuugaggccuugcaauagaauccauuugaugugcaaggagggcagaggcuagaguagaguaaacgucaggaagaguggcuacagaacaccaggccaggagauuuaucauaagucaugcagagcucugcagagacugaugaacgaaugcagacuugagccaggcaugguggugcacaucuuuagucccagcacucaggaggcagaggaaggugaucucucugauuucaaggcuagccuggucuacaaagugaguucuagucuagucagagcuaaacagugagaucuugucucaaaaagaggucuacuuuagacuaacugccacagggaggaaaaaaaaucacuggaguauuucaaaguuacaugcugccagauaacuuuuacaauuucccauuaugcccaaagaacagauuguuagggcaaagagaaauggaaaccaauuaguaguaacccuagcaauacagaagaaagucuagagugaugagaaagacaacaagauuuagagagguuuggagaacgcuucguacguacuuuuggcuaaggcagaguagaggagacagggaaggugggaaaggcuauaauagagggaagcaugacuggggucaauguggcaugaacugacgacuguucaucaucuaaguaagacgugcaggagccuaguaagacauucaaaggcacaugguauucauuuguaacuuuagcacucaagaagcaagagucuuuaaggccaaccuagucuaugcagugagaccaucucaggaaaaugggaaaguuauacaaguagauguuuccaacaaggcacuauuaagucaaaguaaaaugacuguccuuguucccugagcccacuucgggaguaguucgcaguguaugggaggauagucuaaucuugcuaaaaccagaagaguaagcagaguguuucugaacaggcccuuuuaggucuggggagaaggcucaguaacugucugggcuagcauggggaccuaaguuccaauccugagcaugacuguccaaaccaggcaugguggagacaggcagacccuaggaguuuacuggccaggcagcuuagcuggcauagcagggcucagguucacagagagccuauccaagggccuaaagcagugggagagagggccacuggaugagauucucuuugacuucaguaagcaugcacugugugcacauacauagaaaagaccagaaacaugacuuuuuaaaucucacgugauaaugucuccccagugagauuggcuacaacgcccaucuaagucuaauucuacaaggcaagaauaccccgcuacugacugugagaauuuaugccuggcuaauccugaaaaacauggaauuuugauuacaauagauaugcacauacaacacaccccacuagucacagccaaucaaucacucagaaucagagacaucagugcugacaaacuguaagggccagguggaaggccucuuuauacuccugaggaaagcgaggcauuucucucuaagcacaaaggauauucuguacuccuucaguuccucuaguucuucuucucgccgcugcuucucuaucagcuccugcugccgagaaaccucaucaaggaaguuggucucaucuucgucuaacccucuuaccauguuuucugaggaaauaagugaacaagaagcacuaaggagacugagacaaacaaccuucucugaccuucccuccccacacguuuauucuguguucggugcgugugcacaugcuccagggcacacacgugacggcuaagggauagcccuugggagucgauucucuccuuccaacugugggaucuggggaucaacgcagguuguuagcucacacaaccagcacugguacucaugaaccauacugcuggccguuuuccuuuuuaaacaagcagcagauucuuugggcaauuacaaggaagaauuauuaaacaccauaauuuuaauaaauagcauggcaucaagucaaagcauuucucacauuacuagaaauuagcacagaauucaaaucauaucuuaagcucuaagucagaaggaaggcagaagauggucuuuuauccacugaauugagcuccuggaggcuggauaaucaagauauucuauugcuaguaacaaagaugguuucacgaggcuaaaguacaucaaaaggcucagugagucccucaaacguccauuuucagaagcuuacugaauuugaauugcuccucauacuccugcugcuuccugucuuucuguuccugcagccguucguacagagaccgagggucauacgccuccucuggacauucugaaagggacacgggauaaaggagacacagaauuuagguuguuucauauuauuuuggaaucacaaagaguuggaaaaauaguuaagucucuauauaucugagggugaaaauaacacaaagucuaguuucccuuugcaccucauacagaagggggcaggcgguuuucaaagacaacuauuaaugucacguuacuaacuggaugggcagccaguucaaaccuauuagcagcaucucaguucaaacugccccuccacuuguagcaagcaagcaacuagcagaaucuccuggcaggcgcuaugguggggggaggaggguaaauacggaguacugguucugcuguggagaauucauauagcuuacuucacccugggagccucuagugaggacaguuaucaccuucuuggcagaguuuuugcgaagauuaaagaguuaaaugaggggcuggagcgcugguucagugguuaaggguacuugcugcucuuccagaggauuugaguucaauucccagcaaccacaugguggcccacaacugucuuuaacuccaguucuagggcaucugacacccucauacagacacacaugcaggcaaaacaccaauacauauaaaaacaaauuauuguuuuuuagaaaaagguuaaaugaaugauguccaacucuaggucuaucuacguaccuuuugggucuucugguuuucgcacuuucucccauucuucuugccuccuuuugcgccgcucaucuagcucugccucagacacaaaccucuuuuugaugacaagguuacuaucguccucuccauccauaaugguacagucuacagaaaaaaaaaaaaaaaaaaaaucaaaggagaacuacaauucaaauccuuaggagcaggguagggauguagcucggcugguacaaugcuugccuagcaucccugcaccacauacaccggugugauagugcacaccuauguucggcacuggagacgugggguuuauucuggcuuaucagacagcacacaucugugcuauccacagucacugagagauucuaggaucacucugacauugcguuccacagcaugucacacggaagcuauuucccugucgcagcacucuagacaaaugggccuucugggcuccacaccuguucucagcucacauccugcuucacagcuauaagauuugccaccuucuuucagcugccaucucacugccuugauuuaccuguucuugcuuccaaagcagauucuaauggagacucucagguacucaaggcgcuuuagcagucaagucccgucuaugaaggagggagguggcagaucuaggacaacaagacacgaguguaaagaguggaagcagaagagccaggcccaccugacguucagcccaacgcucuccacaguaagcagcugcugccaucgacccugccugucgucccugugaagcaguggcccucuuuaccccuacaggcccgagcccuuaaugcauauacugauguagaagacaccaaacuuccucucuucuuuuucuucaacucuucggagaagcaggaagaaggaaauaaagauggggacgucuuuuccuuuuaaaagucaacauuuuggagcugggguguaacucagugccauagcacuugccuaggauguacaaaccuuggguugcuggcuuuuuauuuuuuuucugaagaauuacgguuaaucgucuacucagacauauucuguguucgcuacaauauuaccaaagaggcacgaaugcaacccaacccaaugucuauuccuagauaaccuuugacaacccaucuaacaguucauuagaaacuaagucuggggcuaaagagagggcucagugauuaagagcucugacuuccuccuaguucaauucccagucccuacauuuuagcuuaaaacugucuauaaugcuagccccaggugauacacuccuucuucuggcuuuggugcauacauauuaccauauguaugccacagacauacauguaggcaaaauacccauacauaaaaaaauaaauaauuuuuaaaaaagucugcagccucaaaaagcaacuaacaauuuaaagcgcuucgccuguguuauguacuuuuugcauguuaucgaguuucucugcauauagagcccaugagaaagacucuucacagaugaagcugacccccaggcucagugagcugcucaaagcauauaggcagcaaguggcagagguaaggaucaaguccaaacagccgggcaugguggcacacgccuuuaauccuaucacuuggggggcagaagcagguggauuucugaguucuaggccagccuggucuacagagugaguuccaggacagccagggcuacacagagaaaccgucucgaaaaaccaaaaaaaaaaaaaaaaagaaaagaaaagaaaggaucaaguucaagucugacaucuaauuuucauauucucagcuaggugugauagcacaugacuguaaacccuaugcucaugaagacuggaggaggaucauaaguucaagaugagccuagaauacacagcaauauucaaggccagccugcacuaacuacauaaugauaccuuaagaaaucacauuugcauccaucuccuccuccuccuccuccuccuccuccuccuccuccuccuccuccuccuccucaaccacguggucucagauaaacaaagacauggcuggacaugguaaccaaucccugcagucucagcccucggaaaguuagggcaagaaaagugggcuagaggcccaucuggcaugugccacgcagugagaccuuauuucaaaagccuaagggcuggggucuuacuuuucucuugcugugaaaacacaacgugauugaagcaacugauagaaggcagguuuuaauuuggggaucaaguuuccagggaguuagagcccaucaccaucagggugaggagcauggcaacaggcaggcagccaggcacggcgcugaggcaguagcugagagaucuuacaucuugauccauaaacacaaggcagacagcgagguaacugggaaugcagaggggcuuuaaccucaaagcucacuuccagugaccuccuucaaacaggccucaccuaauccuucccaaacaguucaaccaacuaggcguucaaauaugcgccuagagagacagaccauucucauucaaacuacuauguugggaaugcaggcucuggguucacucuucagccuggggagaaacacacgagaaaacaagggcacaucaauuucagcuauauuuucaaauuccagugcccagaaugcaaaguuuuuguuugguaaagauauuaaaaaaaaaaaaaaaaaaaaaaaaaaggaauuagggcauuaaaaccaaacauucaaaacagaagaaaucaucucagccugaauccauccuacuguugagguuuaguuccaugugaaaaaugagaacuguugacaaucacuagaaagaaaacuaagucaccugagagaaggcuuuaccccaccuggcccacagugcacuucuucagauauagggaugugguaccgcucgaugccugcagccagguacucaggacaaaagcaggauuaccuugucucugugacuuagcagaauuccucaagcucuuuggagcaauuucuaaggagaaagagccaacagcuuaugaaauguccccagcaaagaaugugagccaugcaggcacuggggaaaugggagucacgcuggacccuugcuuucuccuuucuaccauuugcuguacgucucccuucccacccuguaucaagugucuacuuuccucccccuacuccuauuuccucccccuacuccuaguaaauaacucacgacaggacaggcccucacagccuccuccuggcaucagaauccaucacacacaucaaaaacagcaucagcaauuccuauuuuagaccuucaagacaggcccccgugcuccauuuccagggaaccagcucccucuccacuuuacaguucuugcucugaaauuucuguuccuauggaauccacacauaaauuuugagaugacaaaaggugacucuucuccaacacaacaaggcuuuauuauaaaaagguaauccuacucuaaacuugcugcuuuucaaaggaaaacauccaguauucuaaucuuacaagauggauauaaacgugcuucaaagcaguggaacuugccuggcuugguggcacauguaugccuguaauccuagcacaagagacagauauaggaggaucaagaguucaaggccacucuugaauaccugagacauaucucaaaaaacaggccagcaaaugccucagagaguaaccacgugugcugccaagccugaugacccgaguguaacucccagaauccacauggugggaggaaaaggagacuccuuccugcaagcuguccucugacacaguuacaaagaagugaugaaugaccagccaaacucugaguacucuguauaaugcucacaguauuucuucucuaaaaacuauucgggucucuugagaauuacaaucuucuuucagucaauaacuacagccauauagguuggguauggcagcucaugucuguaaucccagcaauagggaggcugaggcaggaagauuguuaaauucuaggccagcuugagcuauauaaugauuuuguuucaaaauaauacugcaagacaagcuagcuuaaccuuauacaucuuucaguauaagauugcucaauucaacuaaucuauagcaagugccuucuguuguguucuucuuauuaaggugggcacaggcaaugacaaagaccaugggcucuaacagcaaaagacucaaguucagaaucuggcucugucagaauuagaacuugguaugacacugggcuagucacuuaauucuucugagucuugacugacauccuuauccccagaucacacucacccaaagugaccaagacagcucuguacaacauaaaguuuuugugugagaaaauaagacaauucaugcaaagcacuuggcacaguauuuggcacauuucaaaaugcuuugaaaggcuucuuaucacuauagagaauuauguuaagcucugagauggguacagugguaaaagaaauuguacacuuaaggaaugggaagaaaucagucauaaacaaauaugaccuuuuagguaggaauggaaccacaucaaacugagaacuuagaaaacacauaaaccuuuaauguauacauauaucauucucuccacauguaaguugguaauucuauuuauccaacacugggcuagacuuuaugaaguacacaaaggaguaaggucaacacucuuauacguaacccagauaacaugguacauaauaaaccgcuaaagugaacaguaugggcggaauuagauacugcaggacacacauacagauguaccguuucccaggcucaagacuugggcaugcaccuagauuccuuuuccuucuuuauacuuuuacauuccaccugucaccuaguucuguugucucuaccucuggaugagguuuccuuaauccacccucuuauuuugugggaaguggaccccuuccuuucuauuuuguuuuuggaggcuccaucuggcauacuucaaaaauauuccacagguaguuucuauucagccuccauucagauaauuuuucccauuaccaaucuaaagguaaaucugccuguuacugucuguccuacauaaaguaccaguaucaucaccacacacacacacacacacacacaccacacacacucacacacacacacacaccacacacacuuacccucacacaccacacacaccacacacacucacacauacacacacacacacacacucacacacaccaguacaaacuagaaaaaaaucaaaauguuaaauggcacugccauaaauacuucuugugugugaaauuaccuugugguugaaagucacuccugucaggguaaagucuauguucauuugagugcucccaucuacugccgugcucacucaccccaucuuccugaucuaacuuacagcuacaauuccuccacauggcaccggaaagcacacugcacaucucacaaccuggccugccucucugcaggcuuuguugccucuaccuugcuucauuuucaaaccucaugugaaccuuucugcucagacucaggaugaagauccccaccucuaagaagcuucccauguccuucuggagcagcagcugcauauuucucuccugugcuccuguuacauacauuugaaccuguagauagcacucaguaacuaugagugcugccaaucaagacaguguggaacauaugucaggucuguaauaaauauuuacuaaauaaacuaaccacuaggaggagcuaaagaaucugagcaggaaaaaguguauucaaugaauauccccaaauacuguccaguguuaaguuaggcaacagugaccacuacaaagauuuauugcaguuuccgugucucaaggaauucuuguucaagcacaaguuaagugugggcaacaggaaaacagaaccaaaauugaaacaucuuucuuuguuacacaacugaacccaucuuucaaaagagaauucuugcugguuuucuuuaacucagugguucucaaccugugggcugugaccccauuuaacaaaccuuauuuccaaaaaauuuacauuacaauucauaacaguaucaaaacuagauaugaaguaacaacaaaaaacuuuuaugacuggggucaccacaacaggaagaauuguacuggaggcccacagcauuaggaaggcuccucaucuuaacuacagaauuaugggauuuaaauuacacugacuuuuaauucuuauugcuuagccaaauuuucauaagucuauacuuccccccuuuguucgcuacaauaaauaaagauaaaauacaagcagacaagaagcccaggauuagggggaucuaagcaucaggaccgacacaggacugagaggauuuacauggaaggccuauuuuguccuuccuauguucaacucuaggaagauuaaauacaccaggcgugguggcgcacaccuucaguaccagcaugcacucagagggcagaggcagaaggaucucucuaaguucuaggucagcacucucugcaugacgaauucuaggacagucaaggcuacugugagaugcugugagggguggaggguaagagacagacagacacacugacugauuaaaaugagcuuuucuuuccuuguccagcuguuucaagguaucugaaaaaugaguucaacuaugaaaccaaauacucccccccccccccccagugcugauggucaaaccuagaguaacucacaagcuagguaaaugcucuauugcugaacuacauacucagcccaacauucuuuuuuuuuuuuaaaaagaaacauucaacauucuucaauauggauuuuuuagaaauaaaaaucacucuguuuaaacuuaagcaaguuucaaggauugaaaaguuugaggccaaccugguuuauuauacagugagacuucugucuccaaaaagagccauggcuuacaaacucauuuaacagccaaaaaacaaagaucuuaugcuucaaggcaggguaaccuguuacacacugcaguacuguguuucuacuggagucaguauuuccuuuccaggcuggggagacaaaacagggugucucauagcagauugugcaaggucuaaaagugcccaacuuacaaagugaucaucauccuagaacugaaagcuuagugcacggaacuuguaacuagugcugugaugcagauuaaugggcucuguuuuccuauggaguugaauuaugugauggcagacuacguuaacaucuggcuggccaccguacccuucuaaaaucagacccuaccuguagagauacacucaaggaaucacaugucugugcuauacgcuuuauaggguagcagaaauaagccagcccauuuucuuuugacaguugacugcuucccacuauuuucauccuaaugaguaagucucuguacuucaaauacaagugagacggagaggacucagugguugagagcauuugcugugcagccuugaggaccacaguuuggaucucagcuuucaaguaacaagccacaagucaagcacacuucuguaaaccgagcucugacaggguggaaacaagaggcuagcugugacuugcuggcuuguaaccaaucugcaaaaaccuaaguuccagguugagagaaaaagagagacggagacagagauagacagacagacagacagagacagacugacucugccucaaaggaauagacaagagaauaacagaugauauacccaacacccucuuaugcccuucacguucauggagagacaaguauaaaggugcgugaaugucagcacacauuaaccacucacacccacaccuagauuugcuagauaguccaauuaaccucccaaaagacuacuuucuagccagaagacacugcuaccaagcacuaguaauuuagaucaagucaacuuucccugucauaaaacuuguuucaagaaugacuuaauaaagaacucuguuaauacuuauuauggauaaagcaaucagcaagaaaaguaacauuaaucuucuaacacugaaacuucuauacuacagaaguaaagagaucuaaugaaucaaugagauuauaacauaagcaucuuaaucuuuaguuaagguuuguguuauaaagagcaguuuguaguaaauuugaagcaucgaagaaauaugcaauuauauguuaaguauuuauuauguuuacacaaacauacacacacucucauacucacacaaaaucuuuccacagcacacggaggcaaucucuccuuacacccauccaauucaucuuccuacacuaaaggaaaagggacacuaacuuacacauccgcucccuuagcuggcgcucagcucucuacccuuuaccucuuaggacagacacagucccucaccguaauuuaguuguauuuugcuaugugcuaugacaggagagcgcaaaacaacuacuucaccuggaacucggggaagaaagaaaagcagcaggauguuuuaguugucagcaccucaaaacuggaaagaaaacgcaagaaaaauuaacaauuucagcauuaguauucaacauggugccucucuugagaaacgcucaaagauagcuugaauuguaaacuauugugccauaugguugccuuuagacccaacucacacaccaaacccuaccccaucuucuaacacccauccuaacacggcucagcagcacaaucaaacugaauaaggaauuguccuaugugaugcuagaagccaaagguuaaccaaggcagcuuuuaaaagcuguuuuauguuuuguuuuggguuuuugagacagucucacuauguaacuuuggcuggacuggaacuugaaauauagaccaggcuggcuucaaacucagagauucucccuaucucugaauagaggcucaucacuccccacccaaaacaguucguuuuuugggggguggggggaagggggcuugggguuugauuuguuuuguuuuguuuuuuugaaggcaaaucuucuuaugacacagugcuaguuaggcacuaaauaggacuacagucaaugcagcaauguaaugauguggcacacaagcaauuuaaggaaaaguaggacacaguuauugcuacaggaauugaagcugagcuuuaagcucugccccacuuuuucuugguuuucuguguagcccuggcuguccuagaacucacucuguagaccaaguuggccucaaacucagagauccaccugcuucuccuccagaguguugggcuuaaaggugcaugucagcaagcccagcuuaagcacuaagcucuuauaagaggacuagaaagggaagccucauucuuauagcugcugugacacugcaugguggaaauauuagaaauucuacauaagcuggacauguagcugcagcaguaauaauacauaauaauagcugaaagaagggcuggugagauggcucaguggguaagagcacccgacugcucuuccgaagauccggaguucaaaucccagcaaccacaugguggcucacaaccauccguaaagaaaucugacucccucuucuggagugucugaagacagcuacaguguacuuacauauaaucaauaaauaaaucuuuaaaaaaauaaaaaaaauaaagagauacuaugccggguggugguggcacaaaaaaaaaaaaaaaaaaaauucuauuuagccgggcagugguggcacaugccuuuaaucucagcacuugggaggcagaggcagauggauuucuuaguucgaggccagccuggucuacacagugaguuccaggacagccagggcuacacagagaaacccugucucaggaaaaaaaaaaaaaagccaauagcugaaagauaggccaauggguaaaaugcuugccaaacaagcaggaaaagcucaguuugaagcuucagaccccaagugcaggacaugucaggucacgccuagaauacuaguguuccuggagaugggauaggaagaccagaaaacccccagaaacucgugggccggcuagccagacauaugugcuaguaaacagcuaaagacuguuucaaacacgguggaagucaaggucuggagggauggcccagcagucaagagagcuugcugcaucuccagaggauagauucaguugcaggcauaauacagguacagaauugccuguaucucuagcaccagggaaucuggugcccucuuaugauucccucauauaccagagcgagcgcacgcaugcacgcacgcacucacgcacgcgcaaaucuaaaauacgucuuaaaaggaaaaaaaaaguaggagaaccaacaccugaaguuauccucugauacaacauguaauauugcguguaaaucugcucauacacacauacaaauauguacauacacauaucaaagacaucacauacaaaaguaacuaaaugauaacuguuaaaccaaaaagaugguggaaacuuuggauaaaaucuagaaggugacaaccagaaauuaagcccaugacucaaguagaugcuuucauccugaggacuucucugaccugaacaauucacucuagcaguacuauggagaggcaacagaagaaucaagggcagcccacagggugugcucauaacccuucccucccuauuggaaaccgggacccaagaauuacacguugaaagggaagggagauaagaaugaaaacuuugggaauaauggacaagaaaaacaucuaugggaauuaaauacacggauuacacaacaaauauacuuacgauauuuaaaauaaaaaccaagccuugaaauuaacagcaaaaauaugaaacuucuuuuuaaagugauaaaaguaaacaaaaacuucaggagcuaaaccuacaguguuuaagaggggacgugguggcacacaccuuuauucccagcacuggaaaggcagaggcagucagaucucugugaguuccaggauagccugguuuauauagccaguuuuaggagacccagggcuaacuagggagauuaugucucaaaagacaaacacaccccccccccaaagauuacaguuuaauaacagaguuggaucagaagagaauuaaugaagaaacugcccagccuggaaaucuugaguucuaggccaccuuggguagcauaacaagacccugccaaaaaaaaaaaaaauaaaaaaaauaaaaaaagcaaacaaaaacagcuacuggauacaagagugaaaauguguguggaagacagucgaacgcaucaauauauaugugacuagaacuuuacaggauaaaucauuauuucaaugucaaaaaggcuaauucauauugccaaauauagcauacaccuguaauuucaacaccugagagaaaaaaaggaaacaaaacaggagcuuaagguuauuuuuccauacacaucaaacccaaggccagacugucuacaagagacugucugaaaacaaccaaaaaaaaaaaaaagaucaaauaccaagauaauuggaaaaaaaaagcaacucaugguuugaagcaucauaauugaaacugcaaaacaaaggugaaaacacuuagaagcacuucuagagggaaacugaucacauucaagaaggaagacgugucaauaaggugaacacacuaaaacugauuaauccugcuucccuaaaagcauauuacacuauauccaagcuuacaguugaaucacacuguucaauuauuucacugucaauuucugaagcugaagauugccuuuaagcaaacguacggugacaacgaaggaugaaaccagguaaaugcuccccacauaauucuuccuuuuuuaagacuucaacuucagagauaauugggccauccgacuuucagacccuuacauauuauucauagcucaucuuaggcuccaacugaaacacaggagcugccuuuauuucaacucagcuccuucugucauagaaaguucuacagauuccuuucaaauaucucagaagcaguacccgccaaaccauuuugcuugguaguuuauacucugcuuuguuuucuggcagucuugcuaaggaagccaggccugucuccaacugacagucccccacacccacacacagccucgugguccuaggauuacagguacaagccacuacacggagcuccuccaaaccauuuuuaugaugucucuggggacacuucaauaaaucaauucacuuaaccaacgaaacuugcuacacagguugacaagucgcugcaaauccuacagagguucauauuagacuuugugggguccacucuagacuuaaacaaucagacugacccaagggugcagcacaggguuugcauuuuaaaaccaagggccacagaccuuguguucccccaagaagccauuuccaugaccaauaguucucccuuucccucugcguggacuggcauuccaagggcaccaacucucaaagaagacauuucaacgaccgguuguguucuaauaaaauaagcacacagccuuguuuccuacuagaagagaaugagcgaggcgcugcaacggggaaauuuauuauguacccauccugcaacuacacacuucgggauucaacgaugcucaagucggcauuccacguuuucuaaggagcgaggagcugcuccgaauggaaccgaggcagcagcucacuuuaggccugauggcuccagcuaaccgcaaagugcugaaagaagacaaggggcccggcagcucgggcgcguaagaaagagucggaaccucccaccacgaccgccacgccgucccgcagacucccgcggcuccgcuccggagugggcaccgcaaacucccaagccgggcgacucaggacaccgcacuagaaaggaccgcgggcuggagacaaaccugggcucuaauccuaacucuggcuuggaguucacccucuccacggccgagaagccugguuucgccucccggcgcggacccaggccgcacucaccuacgagagcgcgggaggcgagccgcccucaccuccgcggcgccuaccguaaaccgucgccgccaaggccacucucgcucuuaaaaaacuagaaaagaaaccaagaaaagaacgacggcuuaaaggaagaaaacacacuucgcuauuguauuccuuuugacccuucggggcuuccuguuccuuacagccacaacacauuuccaccccgcuuccggcggcauaguccaaucaacagcucucucccuccccgagcgccucguggaaauccggugcuccaagaccguauggagcgaucugauugggucguucgcccuucggcaaggggauuagcugguucauuccaggcuggcgggccgacccgcgagaucacgugacacaaaucuugacugaugauuggcugucugagagagagggcuugccacugaggaaggggcguuuccuaggggacugagggagggcccgggcggugugaagcgggggugggccccugcgcguaauggca

SEQ ID NO: 4657 - RNA, 58361 nt, Mus musculus
cugaggaaggggcguuuccuaggggacugagggagggcccgggcggugugaagcgggggugggccccugcgcguaauggcagugccguguccccgcguccaucuuuaccgcucucuuggaccugucacaaaggagucgcgccgcugucgcuguccccucccuccggugggcccaggagcuagugcaagucagugccacagcccgaccgcgcugcucugggaagccccuuggggacguggccggggagggagcuugagggcuagcgacgccugugaaggaaggggacagccgcugaagccugggucggagagacuggacuggggccguggccgucuccgggcaggggucuuggagaggguggcguuggucagagccugggaagcagccggcacacucuccuccgaggcccgcgcuggaggcgccugaaagcgguuccuggaagaggguguuccccuuuaggggaucuugacugaaggagguccuggggucacccucccgaggagacuggcuaaggugagaagcagguaccuccuggggaggcuccggacgcggagagacccucguucgggcuccucggaaccgaaggggccgaggggcgcacgucgugggcagggauuccuucuggggaguuuugcguugcagugggaagccgacuuccccugggauggucugguguugccuugggguggagaguucgacgugaagcgaggcuggggagaguucuucgccuuagagagaggcuggaggcgggagccagaccuagcggauucuccuacucuccaggccugagcuaaauauuaaguaaaaaacccuuggggagggcaguccuuuccguuggaaagcccuagaucgggaugguaagcggaaacggggauagucgggguucuucccucacucuggagucugacuaggugucccagaguaaggauucugcugccucuggccuucgcgccagagugggacaggggagucaucccaccagcagcacccccaagcgagccuccaaauuuggcauuacuuccugccgggcccgcugucugccucacuuucccuguucuuacagagggagaccuaguuagagcuacugggcugaaacucuugagauucugucuugcgcagauguccgaguaagguuucguccccuggagugauguacuuugaacuuuuuuaaaguuggcagugucuguuaccgucugaguagagucgugcagucucccaggcuccucacuuaacccaucugcuuguccuuccuuaguugaagugacuugacaucuuagaguuucuucuguaaaauaaucaacgcuguguguguggaaguaagguaguguaauguauuguuguugaggaacaauguguuuucuaaucuggaaaauuguugauguaagagacuagcauaaauacuggucuugauuaccuauagagcucugagaaccauguaucacugagugaaauguuagucuaaacccugccugcuuccuagacaugaagagguuuccagcuuuuguuuagagaguuuuaauuuacuuuccacuucuaauagugcugggaggaauuagcauuuccuuugaguaguuuuucuuuuaaguaguuuguucuaaauauuguaggcucacuuuuucuuguaucuguucuuuggccuuugaauggcuacagguagugaagacuaggcagcaucccucaccacuuguaauuuguaaaugagccuguaguuuuguuuuguuuuucuuuccaugaauucugccuugugguaccuccagaguaauagcuuacaaggcacuuuucaguuuucauuuuauguagagucugcauuucuugagacgauaacuugcuguguagaccccugucauuacaagacuacaguauuaaaauaguuaccucugucaguaugugacacuucaauaacuuuagguuaguggcacuuguuagaguugcauuguuagagcugaugucccaaaauuuuagggauuuccuuguggguuuuuguuguuguuguuuugaacuaggguuuuuguuauugucuuuuuaaaguaggcaaguaggcuuauuuguuuguuuguuuuuaaguugaccugaauuuccuguauuuuaaucuuauguuuccugauuguuuguuggucuuuuguuuuacuuucuguggugguuuugugagcuucuugauuucccaggaugcauggugcccagggcuucuguuuaauaucuuugcaaguucugcguuuugcuguuuguauaagcccuuuauuuuuucuagauacaguauuuuuaagcuauugauuauagaaaguauuccaucauggucuauguagacuuuuuaugcuuugucagcaaaauaacuucuuuuaguaaauauuaaggggaacuugauacuuauaaaugcuuagcauuguauauaauaguguguuguuuuucuguacugaauaggggagaaacaacguucucaguuccaaaguaugguuagcaaguuuaguaacagaaacuguuucugaagugaauuuacaacaaucuguuuaaacucacauguugaaacuaguauucaaggauauuuaaccaaauaaugaaauaaucucucucuuccuuugagauaguauuuacuauauaguauaguauuuuacuauauauuccuaagcacaccugaaaccugcaguccucuugucucaacuuccauuuaggucgggcuguagguguauacuauacccagguuuguuuuuuauuucuuguguuuagagacaaggucuccuuauauaacccugacuggccuggaacucagaucaccugccucugucuccagagcgcuggaauuaaagguguguuccacuauguccugugaaguggauuuuaugauugagaaucaccuugaagguuuuagaauacagcuuuuuuuuaauacucuaaaaucuguguagcuuaaaaaauuauuaggagccgggugugguggcgcacgccuuuaaucccagcacuugggaggcagaggcaggcggauuucugaguucgaggccagccuggucuacaaagugaguuccaggacagccagggcuauccagagaaacccuaucucgaaaaaccauaaaaaaaaaauuauuaggaauucuagccgggugugguggcgcacgccuuuaaucccagcacuggggaggcagaggcaggcggauuucugaguucgaggccagccuggucuacaaagugaguuccaggacauccaggguuauacagagaaacccugucucgaaaaaccaaaaaaaaaaaaaaaaaaaggaauucuauaaaaucuuuucugcaaaacaaauuuuaaaagaauuuuauuuaggguauuggugguggcccaugccuuuaaucccaguacuugggaagcagagacagguagaucuuugugaguucuuggacagccuagucuacagagugaguuccagugagaccagggcuacagagagaaacccugucuugaaaaaacaaaagcaaaggauuuuauuuuuaauauuuuaauuauguguguguaggaaggggacuauggcacaugugcgcaggugccuccagaagcuagaggcggugauccucuggagcuggaguuuuagggcuugugagcuuauuagugcuaggaacagagcuugggugcucuuuaccacugagccaucucuccagcccuauuaggaauucuugaagaugaggaucuccauuacaaaacacuaauggaaaauuuucucuacuuuauggucauauccuuguaaaauguaaaauuuguuuuggguccuaaguguaaaggggaagucaacaggcaucacaaaugaccaacugaaccaguaaucaauuucagccuccuccucauccuccucguccuccucguccuccuccuccuccuucuucuuuuucuucucuuccucuucuuccuccuccuucuucaagccuuuggcauuuuuaaggcaucugccauuggauggauuuuuuuuccugguauuuaaauuuaaaaauugaaagcagaacagagagggaguaaugaaugccaaaaccugggccacagcccuuaggaaacuuuuauaacuuuuaguaggauaaaagaacuaaaauuuucuccucuaguaggaguuagaagcacuggugagcugcccaccaugagugcuggguucucugcaagagcagggugcacucugccacugagccaccuuccagauugcuuacuugccuuuuuugucugaguuuuugagaacuagaaaacauuuaaauagaaagaaauugguauacuccuagauuuuuguaagguuuuaucucuacguaugacucucuuacugcuugaaauuacaguauccagacauaauuucauggguccuauacacuucaauuagaaagucuaaaauuucuuccucagcaaguguauuaucacucuguaguuuauguuucagagcugguuuuuucuuacuucugccuccuaaagaauuaaguuuccucuccuuuguucacugaaugcaguauucucagacuaugaguccuacuccacccuccucaugggaaacacaacuccuuuauucaguuuuuauugcuccaucauuguucauaguuacagaugccgauguacuacauauuaauaacuuccaaguuaguuuuaaggcuuaauaaaauaauguauuuguugccccagacuuaaagcaauuaggauuuacugcaauuggacaggggagaugacucagugggcaaacauauuugcucauagacgccugaagaucugaguucaaauccccauaacccauguaaaaccuuguacagugggaugaaucuguagcccagugcucuuacagggagaugggaggcaaaauugguagggucuucagaaguuggcuagccugguauacagagaaauacuacuucaaacaagauaggaggcaaggaccaacgccuaagguuguccuggcccuuacacauacauauaacauaugucuguaaucacauaucaacacucacagauuuucuuuuuucaacaaaaaaauuuauuguagucuuuaguaccuuuuuucccuaagguggucuguccugagacacuugguaccaacgcaagacuucucaucuaucagguacagaauauggauuccugcaggauucagaaagggcuuaauuuggggggagggggcuuacaacauccauauugccucaaaauaaucuggguuuccaguuuuaccaauuuaauuuuuaaacuuuguguuaaccucucacugugauuuuuuuuuuuucuuuuuuugagacaagguuucucuaugucgucuugucuguccuggaacuccucuguagaccaggcuggcccggccucuaacucacagagauccaccugcuucugccuccugggggugcuggaauuaaaggcuugcacugccaccuccuggaaugauuuuuaauuucucaauuuuuuaaaaauuagcuuuuguugucugugugugccugaugugaauguguguguggaucagagaaugacuuuguucucuccuuccacccuuccauggauuccagcgauugaacucagguggccaggcuuccguggggggagcgccuuuacccacuggcccugcacuccaaaauuugagaugguguugcaaugcaguugcuagugcuaaauuacagucuucuaagacaugcccauacagagacacgucagugugaucaggcacuagaaagugcuggggccggcagccuccuucuagaggcccucauguguuagccauagacuuggucagggagcuaagcauggugucuagugcuauccuucaucccuaaccccagcgcccuuugccaagaacacagggacauuuuuucaucuuuguucacauuuacugaauggugccaucauaauuuuuaaacguauuuucuguuuuguaaauauuuuaacuuaacuuuaguuuuauauauuuuagaauacauucacccagguauuuauggcucuaccuauuaaagcugcuggguauacaagugcauaugcaaucagguguuuuagacaccauuuuaaacagguauuauuaacgacgauuuugccauuugugccacuuauguuuguuuccuuuucuugauagcauagaguuuuuucaauagaaaaaguuauuuuccuuaaaacuuauguguauuuggauaauacagcaacaugcuuccuguuauugggccugcugaggguaaguaaucaagacuauuucauuuuuuuuuccccucuucugcagccaucauuggcacuuucuaacucaguucuuucuuagaauuuccuuuugggguauaagguaguuuuuuuucauccuuaagacucauagaagaauauuuacuguuugguugguucuuuuuauuucuauuagucugaaaauuccuugcucuagucaagaccuaaauuuuauuuuaauuauuuuuauauauauuuuuggcuguguauauauauguguaguaugugugcauguguguauuauguguuuucauguagcugaucauguguuugcacacggacaagaaaaccagaaguugucauugucguccucaguugcuuaaggcagggucugaacacagagugcgucuauucagcuagucuggcuagccagcuugcugugggggucccaucugccucuaaagugcugggauugauugcaggaugucugccaugggugcccagcauuuaugugagugauaaggauccaaacuccagucuucauccuuucacaaguacuuuacccauagagucauccucccugucacagguuuuuugugguuguugugguuguuggauauuuugguuugcuuugguuugguuugguuuuucaagacggaguuucucuguguaacccuggcuguccuggaccagcugggccucgaacucagagaucugcugccucugucucuugacugcugggauuaaaggugugcaccacuauaugcugcuaguuuuauuuuugauucauguuucaaacccugaaagguuuugucuuuucuccuuuguaaugggucaggucaggacuguguucugucaaucuuucugccauagucucaccuacuucuugcuauaaguuuuuggcacuaauguugcugcuauuguauuagaaucuuucaacauuuuaggugaaaauuuuccagguacucuuucaguucagggagaugaccuaauuuuuuccaaagauguucuuucuuaaaccaaccucagcacauaagaggagaaucauccugugcuugcccuggccacuugaagguuacagucuagggcaugauaguccccuguauaacccaagucucaaaugcucagcacuacuaucacacaauuuuggauucuugagucaugugaaaaauaccuuaucaaggcugccuuuccuucuggguguaaaaugaaauuccaaucaaauacaaucagcucuugauaugcaagggagauuggcuccucaggucuccuauagauaccagaauuuauagaugcucagcccacuuauauaagauggcauaauauuugcguauaaccuacaugccccuucucuguaacuuguacauguuuagcacauucaauucuuaguuuugucaauuugacacaauccagaaccacuccgguguccgugagggacuguccagauuaagugggucaguggacauggcuguggguaacuuuauuaugugcgaagaccuagccuauaaguguguggcaccauucuuugggcuugggggaaagugagcugucauggauuuauacauccauugcuauguguuccugaugugauaugacuaauuuccucaagauccuagcucugugauguccuugcuaugauggacuagcaugaacugugagcugaaauaaaucuuuucucccccagcuugcuuuugcuggggcauuuuuucccagcaacaggaagaaaauguuuuuuuuuuuuuucaccuguaguucguggacccuagugucuguagggcccauggagcuggagggcuucugcaggcuuuugcucuucuccuccaacaaaacagcaaaugcuuuagaccuuaaacuaaauaauuaaaaaaucuuuagaaacuaguuuggagagauugcucagugguuaaaagcauuggcuucucuuucagaggaccuggauucaauucccagcaccuacauaguggcucgaagccaucuggaacuaucuucuucuggccucugauacagauacaugcaggcaaagcacccauacacauaaaauaaaacaaaauaaucaaaaacaaacaaaaacuuuagguaccuuuuguuucagccuggcauguaugcugucaaaauaauaucugcauuucuuaucuuauuaccacuaaauaaucagucuuguuaguuuuccuccaccuaaccucaauaauuaauaaagaaaucuugcuuuuuuuaaaaaaaaaccuuauuucuggguaauguuucccauauuuuucuuuuccucugugguuacugcaaguacccugcuggaaauguacccuaccuugacagaguuugaagacacugauauauguguuugacaaaacucagcauuuagauacuuaagguuugcaugauauauaaauuuagcuucuaaaaaacauugaggucuaauuagugauagguaugcugauggagggcagugguuacucuauacaguuaauacauuuuugcaagauguagaugguuugguaaagauauaauggacaaauuuguaauaaaacaaauacaaaaugugaauuguaggcuaaguggcauauauauagauaaucuauauauagauacucacuguuuauagugaauuaguuccuuugcuguaugcuugaaaguuuucaucauaaaauguugguugaggacacuaaaagaugauaccagaagcuacuguuugagacauacuguauugagagaaaauccaaaaacauuuucuaaugagagaaaaaucacugaaacaauauguaacuugaccuugcaugcuguuugguuuagccuugaggguaaagggcuaaagaccacccuauaucuuguaacacuguuuuggaaugaugaggugcuuuggaccugaugacuuguuuucuguucuuaugaucauucauuuaaccagcauacauucccauuaccgacagcauacauaauccugaagucuucucagggaaaaggaaggucuuacaucagugaugagcuuaauaacuaaauguaagcaaguauuugaagagaugaagcacugauuccugaaccauuuguuagagaggguuagaucaguuggcuaaaaccucugugugugugugggguggggguaagaguagaggauuguggugguuuguuguuguuguuguuguuguucuuguuuucuggcagugagacagugaauaccggacucucacuaauuucacaugaaauuuacaaagaucuacggaguuuguuggcuucucuuucuuuuucuuuuucucaaaggaauuuugaaaacuuuaaaugcuauauugucuauaaucuugcagcaaaaugguaguuaagagugaugguuuaaguuguugccauuaagauggcgagagagaucuacuaagcacugguauucaguaauaagaguucuuuuugauucaguugaggcuugucccagucacagauacaauaguuguuuuuguuuauguuugguuuuaaaauugauuucaugagauaauggugagaagacaauguugaaauuuauaggcauuaaaagguauugccuuuauauaaucucgucuucaacucuggauaauaguacccauaaucaggcuacaauucuuccuaugguauauuuaauggaaaauacuauauggaacuauuuuuaguuuuucauccaguuguuguuuaaguguuucauuauggaauuuucauaaugcagacuugagcccuuucuuaccccccacaauuuuguaguuaugacaguuuuuaaaugacuauuuugacugucaucuccaaacauccaaaaauaauguuaauuuuucuggaaaggaauauugacauauuugcucucacaagagucaccauuuuguauuuaguguaucugauaauucauucaguagauggcagguucugugguagguacuaauagugauuuccagacuuggcugccaucagaaccaccuagggagcuuuuaagcagucacaggcgugggcugcauccuggaaagcauuuugagucuuuggaguuauuaugagguaauaauugcuccuucuucccucuuguaaagugcauccauggucagauuccuuggagggagugcccgugaggauagcagaacugagacuuguacccagggcggucugauugucauguccauguacugcgcuugugcuguagguggccccugguggccuguguaaaauauguagcugaggguacugucuucaaacaguggucuuugggaagauaacacauuuucuuuaaaggcaaaacaaaguuguuugaaguguaauuguuuagccuuaguagccaaacaauaaguagucagaacuucuuuccuauggaaauaugucucaaguagcuucuaagaaagaagcuaagcauuugcaauacugaaggaaacuaaggaguuuauacuuugcauaugcauguaccauggcuauaagccuaaagaauauggccauuucaugaauuuuuuaagcuaacugcucuucucuuuucuuuguauguuucaugagugaugaacacuguauaacacuucauggcuccuaccaccugccucacaccuggucauuacagcuuuaugcuaagaaaaagucucuagcugguguagugguguacacuuuuaauucuagcauuuuggaggcagaggcaggaggccagccugaguuccagaaaagccaaagcuacauagugagaacugcuuugaaaaaauaaaaacaaaauaaagaaaaggaaagaaagaaaaguguuaaaaucucuaguguuaaaaucauugaaacuuuaaaaaaauauccauuucacuagacugcauuaugcccaugaucaaagcuacuuggagacugagcaggaggaucacuugagccaggaguucaaugccaaauugggucuggacaucuuagugaauucuuaaaaauaauaugccgggcaaugguggcgcacgccuuuaaucccagcacucgggaggcagaggcaggcggauuucugaguucgaggccuacagagugaguuccaggacagccagggcuauacagagaaacccugucucgaaaaaaccaaaaaaauuuuuaaaaaauuaaaaauacaaaacccuacacugccuacuccuccaaccccccaaaaauauauccugcuuaacaaacuuacaguaaacauaauuuucugggauauuuaaggaaauagcucuuuugggagacauugacccaaaguaugcuugacuucaaauucagaaauagaaaagaaaaaaaaaaaaaccuuuaauuuuccccuugucacuucaaacuuagucagguuuuaaaaauaucugcauguguggaauaucuccuaaucacuuugaaauuauaagaauuauugaaauuuuuaaaaauuuacguuaaggaaguaauuuaugcaagccuuaggaaaauaguuuuagguagaaugaacucuaagauuugagaugcaguaagcugccuucaucacaggcacuuuugacauuguuuuuuucucuuuaaagauuuacuuauuguugcauguguuuacuugcacgaguuugugugcaccguguaacuugcaaaaacucuuggaaaccaggcuccaaggaacuggaguugcaggugguuaugagcagcugugugugcgcugggaaccaaacauggcuccucugggagaacaguaggagcucuuaaccuucagcccauuucuccugccccugaauauuguucuuguaaauuaugcuaaauaacuuuaugucugaugccaucaaacuguaauuuuuauaggacuuauucggucuccuucaggucuuuguuuccuggacuuaagcuuacuuugacauucugagaucauuuuaaguuauuuuuagugccagauuguccauugcucaggcaugguuuccccacuuaauguuucugguuagacugaggguguuauuuguaucuuguguccguucuuccuuccauacugaugguguguaaagacccuggagcacuagggacgcccaugaaaucuuuccugcucuggcagcauggagcacauucaugggcucugaccauucugagaaaacaguuuagaauuaguucuucuauggggaugaugccuuuucuuaaagaacaccuguguugaaucaucuuggaccacucucuuccaacaucccaaaaugcuaauagaucuagcaacagauguuuauacuauaauguguuaaaaaaaaaaaacuagcuuuuuaaaaaguuaaaguuucuuuaggucuuuucuucuugccugccuuucuucccuuccucccucccuuccugccuuucuuccuucuuuucuucgacuaccccucacucucucccuuccuuccuuccuuccuuccuuccuucucuacuuccuccuuccuuccuuccuuccuuccuuccuuccuuccuuccuuucuuuuuuucaagaaaggguuuuucuguauagcccuggcuuuccuggaacucacuguagaccaggcugucucuacagugcugggauuaaagauacaugccaccauuacccugcuagcugaaguauauuucuauaaauugguaagguagcucuguguauauugcauaggaaguuacugagcuugguaucucacacuaguaacccagcauucaggaggcacaugaaagaggauugcugcaaguccaggccagcccaaccugcaugcugaauuuaaacuggccugggcuacagagaugcugucaaaaaaaaaaaaaaaaaauccaaagaauagcauuuauagcuucagacagaaaggaaaaacuaauuuucgagugccuaauaauugguauaaaagcaagcagauguguaacaaagguuacuagacaagaagagccaaacaugugugcauucaagcucacacauguaagagucuugcuauauaaucuacaaugaccuuuaaaaacucauaaucuuccugcuucagccuccugauugcuagaauuugcaaguaugugcugcuaggccuagcauagagcaugaguccuuaaaugucacuaggucuuuuucagaaaucagcauaguuaauaaauaaauauuaauauuuauaaauauaucuaacaaauauuuguauauuauacucauuauuuauaaauauauugucauuuauauguauguuauauuuauauauuuauagauauauuuuuauauuauauauuauauuuauauaaaauguuuauauaaguauauauaaacaaaauuuauaaaccuuuuaacuguguaaaguuauuucuuguuucuuucucuguucuuuaagcacagaaaacucuugauuaucuauucucuggaggaggaauugugcccuggccuucagaguaauaggaauguuaugcaacuuuuucuguguuuuauguuaaaaaguccauuuccagcugaguccuuaugucauguucuuaccuauuuauucaguacauccuuuuuaaguacaagcuucaaauuuuagaggcagccucacugguuugagggaaacagccugagggcaguaauaucucucuauucccauacuuccauucuccucugguacuuugugaaauuauguacaccucugugugugugugugugugugugugugugugugugugugugugugauguuacauguauacacauguauacauuacaaguuaccugcccuagauuuuuuuuuuuuuuuuuuaguuuuuuaaguuuuuuucgagacaggguuucucuguguagcccuggcuguccuggaacucacucuguagaccaggcuggccucgaacucagaaaucugccugccucugccucccaagugcugagauuaaaggugugcgccaccaagccuggcgcuagauuuuuuuuuuuuuuuaaccucuaauaaaaugcccucaaaccuuaaagaaaaaaauucucaucuuuuguuuuugauuuuguuuuauuuuucccgaaacaggacuucucuguguagcccuggcuguucuggaacuugaucuguagaccaggcuggccucaaacucagagaucugccugucucggcuuccuaaaucuugggauuaaagggguguuccaccacaaccagccuuuuguugggguuuuuauuuuguuuuguuuuuacuuuuagcuaccauccuuuuuucugucuccuacuuccaagucuuuuuuuccacaaccuaaguacauguucucagaucaaugaagagcuauuucuaucauuuaugaugguaagcacacugugugggaugaaacuaaccaaccaucuaugggcucacugagacugugccuucccuguuuuuauccuucuagucccagcccuggugcuuggcaaaaagugcuuagaauguuuucaguuguaaagaauguaacauuucguuaugaauucacaauuuucuaaacagucuugcuuauguaauagaaaaauuuugucuacaaccacuugcaugauuucuauaaauauucucauucucucucccucucccuccucaccucccgaguguguguguguguguguguguguuacaugugcauauucccucugugaguauguagaggccagaacagaauaugggaugucuuucucuguuauuagacgcguucucacgaccggccaggaagaacaccacagaccagaaucuucugcggcaaagcuuuauucuuacaucuucaggaaaagagagcaagaagcaagagagagagaaaagcaagagagagagaaaagcaagagagcgaaaaagcaagagagagagaaaacgaaaaccccgucccucuuaaggagcauucuccuucgccucggacgugucacucccugauuggcugcagcccaucggccgaguugacgucacggggaaggcagagcacaaguagucauaagauacccuuggcacaugcgcagauuauuuguuuaccacuuagaacacaggaugucagcgccaucuuguaacggcgaaugugggggcggcucccaacaucucccccuuuuucuuuuaauaagagcaaauaggccacccauauuaaugagaguggagauagaggucaaauccccaguguguagguaaaggagccauguacaggauuagcucuuaggcuuacaggcuuuuacccagagcaacccugaccugcucccgugucguuuugccugggggaagggaacuaggacacugaaccuucaugaaagaugacaugucucccuagaauaggcucauauaugccgcagagccuuuccauugcagugcuuagccuugcaacucucucgggcugcugaagcacacucacucuaucccgugcaaugagucuagccucaugggauauaagagcugaguggccagcgaccuauugccuaagcauagauaaccauauaucagggggagcuccauguucuaguccugcaagcgccugggcaauaaccaccuugucucuccuaguuuaggccuuaagcuuacagaccaaucaaagaagcaacacuaauccacagcaaaguguaucuccaaauaauauuaaucccacccauuuuuuaaagaaagaaaaugcugaggagauccaauuggguaauccuuuggucagggacagguccaagcgcguggaguugaccugaaugauggcaagccucgaagggucuguucaaauucagccauccaauucuguaacauauacugaaaaagacuuuuugacaaauuagcugcccuaguaaauuuaacauacugaauggaaauaacacacaaucccggaaacuuuuguucacaucccugcugaguuauuugucauaauacaucuaguuguaucuggacaagaucuaugaguugauuaaccagcaugagaccucccuguaucuugacauuagcugaggccuguucaucuaugacuguagucacugaggcugacaaaguguuaauggugucagucaucuggaccuguccagacagaaccaaggcugucugaauuaaggccaaacccaguucccaguuagugguaaaaaggcaggagaauacuugagcauuauacaucaccgucauugggaguggaaaugucgacauuaucccccaacgcugcucucucuuuauuauugacgcccuggacaucaccaagacgagggacauuaguauucccuuggucagucuggauuuuucgggugagucuuucugguaaccaaaauggguugucuucauucugugggaaaacacagauagcuccccuggaucuuaucaagauaggauccgggccauaccauuuauuaucaaggacauuuuuccauuuaaccaucucauuuggccuaucuggcucuguacaaugacguucagccgcaguauggccaugagcaucaauauuuaaaaaauugaguauaaagagugccaaagacaccgacacucuuggugcucgggguacagucuccucaaaaguuccccucuucuguuuuauaagauagguuuugagggugcgaugcgcacgcucaacaauacccuguccuugaggguuguauggaaguccagucagguggguuacguccaucugacggcagaacugcugaaauuuuugcgacguauaagcugguccauuaucagucuuaaggaguuuggguuucccccaagcacuccaugccucaagacaauguugaaucacaugugaggcuuuuucuccaguuaacggagaagcaaacaugaugccagaacaugugucaauggacacauggagauauugaaguuuuccaaaggaagaaacauguguaacauccauuugccagaccuguagaggucgaauaccgcguggguuaauucccacaugaggaacuggcaagaacucacagcagcuuugacauugaguaacaaugucacgggcuucuuuucuugucaaggagaaacgacugcguaauguuucagccgucacaugaaaauuauuaugaaaauuucuugcagccucuaccggggaugauagggcagcagccaccacuuuaguggccuuaucugccaaaucauuucccagagccauggggccagguaggccugaaugggcucuaacaugaguaauauaaacaggagaucuucuagauaacaaaacuaauuguaucugcugaaaaauauuggcaacucuacuggaaggcuuaaucacuccagccacuucuaaaagauuuacugcauuuaccacauaacaggaaucugacacaauauuaagggguucuaaaaagguuuuuaaaacuucuaagaccacuaaacauucuaccacuugaggugaauuuucauuauauuguuuggauaccacuuuaccauuagccacauaggcaccuaugccaguuuuugauccaucaguauauaccacaaucccauuuuuaaguggguuucuuacuguuauuuguggaaacacaacagauugauuuugggcaaacuguaagauuggauguuuuggauaaugguuaucuauuuuuccugaaaaggagguaacuaaaacugcccaaucauuagaugcggcugccaagguuugaaccugugcagcgguauaagguacaauuaaaagauauggacuuugcccaaagugggugauugcugcuuuuaggccuuuaagggcaagcugugcaauugcaucaggauaccaaucuauuauuuuagcuggggauacguuuggauggauccacaacaauggcccauuuugccacaaaacugcaguuggcaauugugcugucuuaaagacacacaaacugaaaggcugcgaauccucaauacguuguaauugugcauucuguaaggccuuuuccaccuuuuguaaggccugguuagcagcuagaguaagaguccuaggggaggagauaugaggaucuccuucuaaaauacuaaacaaaggccuuaauucagcggaaggaaucuuuaaaaaaggucugagccaauuaauaucucccaacagcuuuugaaaaucauuuaagguauggaggugaucucuucuuaucucuaccuuuuggggcacaaucuuauccggggacaccacagagcccaagaauuguccuguaucagaaauuuggaccuuuucuguggcuaucuguagaccccacugacuuaaaguuuuaaguagaaaaggauaugccuuuuguagcaugguaaggucuuuauggcacaggaggaugucauccauguaaaggagcaaaauuaaagaggggaacuguucccucauuggcaaaagagcuuuuugcacauaaagcuggcacauuguaggacuauuggacauucccugugguaagaccuuccauugauaccucuuaucagguuuagcagaauaagcucucugacccguuaacaagucaaaaguccaaucucucugcucuggaguuaaagcagcagcguuugcucgguccugcgccugugcagccucucgccacagagaucuccauuccaaauauuugcccacauuagggagagcggcuuuugcaaucauuugccagucggcaggaguuagugccaugccagcgagccugucuaacugcaccaagguaaaguuagcauugauuccauauuuacggaccgacucagcaauuucuuuaaucuguacguauucuaccggagcguggacacgcccacccucggcuccuucaaagacuggaaaugccuguuguauuuuccuuuguuccucucggggaaugaaugagucugcgcacugccucucugcgcacugccucucugcgcauugcugacgcacuacgggcugacgcacuacgcagggcggggacuccgcauagggcgggagugcaccugguagccgauugcccugaggccaauuagcaaacuggccuucgccagccgcuuuuggcuuuuuucuugaccgauuagcuggcugguaaugggcugcuucuuccucccagucuguuuccucagaggaggauucuucaucugcuucagaacuacuaagagcuggcuuccugagcucaucuagugacgaguaucuccuagagaucucugcuaauugaucuuucuucuuuucccuuuuuccucuuuuucuucuaaucucucuccagguauuccuaccuaaccuuaacuuuuccucggguucaagacccuuggaaaggccuguauacuuaccguuucuccuuguuccuacucucucucuccgcuuuacuucugauagacuguccugaauuuccucuagaauuuuuagcccugccuuaagcacuauauaacaugugaaaaggaacaaaagggcuccuaacacuagaaaaaauucaaggccaaacauacucacugguacucucguuccccagcugaaaaguucugaauucauacaguugaauccuucuuaacagucugcuuuacgggaaccuuuaucaccgucguuccccagcugaugaguucugaauucggcaguugaauccuucucaacagucugcuuuacgggaaccuuuaucaccgucguuccccagcugaugaguucugaauucggcaguugaauccuucucaacagucuguguuacgggaaccuuauaaccuugauucgcaguucugguucuggaaugaaguaucccuccugcgccaguccggaguuuuuucucgucccggauuuucucgucccggaauucggcaccaauuguuauuagacgcguucucacgaccggccaggaagaacaccacagaccagaaucuucugcggcaaagcuuuauucuuacaucuucaggaaaagagagcaagaagcaagagagagagaaaagcaagagagagagaaaagcaagagagcgaaaaagcaagagagagagaaaacgaaaaccccgucccucuuaaggagcauucuccuucgccucggacgugucacucccugauuggcugcagcccaucggccgaguugacgucacggggaaggcagagcacaaguagucauaagauacccuuggcacaugcgcagauuauuuguuuaccacuuagaacacaggaugucagcgccaucuuguaacggcgaaugugggggcggcucccaacauuucucuauuguucuuugucuuacuuucuugaaauagaaucuuuuacugaaccagaagcuggccaucuuagcuagucuggcuuuuugggaucuaccaggaucuggcucccaaugcuguguugcaagcacauacugcccugaccaaucuuuuaugugagugcuagagaucugaacuugggucuuaccuacugagccauuuccccaaccuugacuucuguaaauucuugagugauccuccuuuaaaaaucaguauaguuuccaucauuucagagaaacauucuuuuauuauuagacagcagcuaugauauuaguaucauaacuuuuucaacaacagacaucuguaauuagauauuuuauuugaaacauaauaaauugucccauauguuuaaauaaaggauaugauucauuuuuuaaucacagaaggagccuuugaaaauguuccacaaauuugccaaauguauuucuguagagauaagaacuacauacauguuuuuuaaacauugauuagaacuccuauggcuuauaaggcuaugguuuagcaaucaacuuuauaauguaaugacugauaaaaaggagcuguuggugcugguaagaugacuuaguaggugaaggacuuucugugcaagucuggugaccugaauucagugcccaggacccacaugauuaggagagaauugacuucugaacauuuuccuauggccuccuuaugaugccguagcauggacuuuuucauauccacacacgucauacacauacugaacaaucuuuuuuuuuuuaaucuaaaaggaaauguuguuguuaguucuguuauccaaagauaucuuuacauuggggaccuauaaggauauccaagggugauuauucacuguaaucugaaugccauugaaaccacacuagcaauuugagugauugaguagucaagaccuucuguuaauuuucuuucucuuuuccucucuuguagaacugccaguguauggccagcauucccagugguugauaauguuggaaaugagcugcuugaccuucuccagcauucaguuguuaaaaaugaauagaaugcaaguucaguuccacauuaugaaaacaguacucggaaaauugaaaacuaucuagaugauugucuuugguugggcuguguucuuagcaagcagaagccuuggucagggucugcugcugacucuugaggagcacauagcccaccuauuggggacuacaggugccacugcuacuauggguaauuccugcaucugccgagaugacaguggagcagaagacaauguugacacccaccagcaacaggcugagaacaguacagucccuacugcugauaguaggagccaaccucgggacccuguccggccuccaaggagaggccgaggaccucaugagccaaggagaaagaaacaaaauguggauggguuagugcuggacacacuggcgguaauacggacucuuguagauaaguaaguaucugacuuacugucgacuccagugucauggaaaguguucugccaggaaccaccgcuuuuggacuccuuccacucaguuaggauauauuuuccaagccuugugcucauaggccaagagagaauacuuauuucuucucugauaguggauuaaauaagauuugauauuuuuacuugcuaucaucuacuccugucuggaacauuuuggacaguucuguacagaaaacuuggauuuaauuuucugacugaaaauaugaucuuuaugagggaguacaguaacuauggagugagucuguauuaauuacuugcuuaaguaggaaauaaggaaguguuuucuugaagauuaauuacuauguuugccuauuuguucugcugaccauauauucaagaugaguagucuuaucaagagcauggcaugcaacuucuguaggcaauuaaggacaaugggcaacaaaaguuuaaccucuccuauuuuauuauuucuuguuuagccaguuagauccauuuggggaaauuguaaguugaaacgacagggcacaccugggccuguguucucuuucuccugcuuuguuuaaaacaaaaucucgguuugaaugacagugaaauuaaaggguuuugcucagacugaaaaaaguccaguguaagguuauuuaauaagugcauaaauuuuagaccaugauggaccuagauucagauuuuggcccauuacuaauuuuaugacauucagcaagguacuuuucuaauccuuuuuuuaauaagaauuuuuauucuuguguuauuuguauaaauggucuaguggggugcuuuauauaaaaaaaagaaggaaaaagaaaugcucaaggcauagcagucauuuuauaaaguucuuuuuacuuuauauccugcuaggaaauuuauagguauuuaauauucacauuaauaaaaguacagguuuuuuuuuguccucuaaaacugguaagaaaagaacucuuguaaaccuaaaguuuacaaacaaagccuuagagcuauauuagccucuucugcucaaugcugaaguauuuguugaucuccaagaauaauaauuuuggggguuagugauauuucccaguggcuagaguacuugccuaauauccauguagcgcuuuaccagguccaaccucuuuaaaauguuauccuucauccuacagaauuauaauggaaaauuauccuuuccaaacaaggaaggaaaccacaacauuaauuaggcacauugaaauauuaggugcagaguagaagugucccaccauugaacuuaucaccauugcuuuuuguauuuguuaauguuaaguuaccccugcugaccuugaccuuaguauguagcccaagcagagccugaacuugcaauccuuuugucuuagccuccagaguagcugggauuacagguaugacccagcuuuauaguuuaauuuuauuauauuuuauuauuguuuuucuuuuuuguaugaugugugaauauacaugagugugcacaugaagucauguguaugagugcaggcauaugcuugcuauagauauaggugagguggucagaggacagcccuaguuauuuguccucacauucuaccuuguuugagaccugucucuuuuguuguucucacugccagcaccagguuagcuagccugcagacucaaggacuucuaucucugccucucaucuuacuguagaacugugggacugcagacuugcauuauugcaccagacuuuuauguggguuaucuagggagucaaaaucagguccucacacuucugcuuuaaccacagagcuaucuucccagucuuguggcuugauuucagaagauacuaaaggauaauuuauaacuuagaaagcuuuuaaauuguuaagcugaaauaugaccgagaacuaugaaggacaggacaaagggauguagcaagaacauaucuaaaucuguuccagaugcaaauguggcaguuaccaaauagucuucucauugucuucucuugauugcuuacuccagaaggaaugcaacugagaggagaaggcagcaggccccagugccauaguggagaggugcuauggaagaguuuuuuaugcuguuggugucuaguucucuacagcuucauuugaaauaaauugccuaauugcagcaugccuuuauacccagcuuucuuguuguugugacuguuuaauuuuaauccuuuguauuuuguucuucaguucugaaaauuucucugccauuuuuaaaaaaaauauuuuugguauucaguauuugguauuggaacccuucaauauuuuuucccauguguauaugcccccugcucccuuuuugagagagucuuggcauguaguguaagcugaccucaaacuuaagauuuuccuccugccucggccuccugaaugccagaggacaggcaugcauguguucucaucuaaugcauucaguuucucuuuaugcauauuuggauuuuuuuuuauguuugcuucuugguuuuguuuggcucuuuuguuuuggugucuuuuuguuuuuguuuuuguuuguucaagucaggguuucucuguguugccuuggcugucuuggaacucuuucuguagaccaggcuggccuccaacuuaaaaccaccaccuagcucacauccuucuuauagguguuccugcaaauauauuuaucuuaaaguucucuuauuugcauauuuugaguaaugacucagauuguuagugaccagauuccucuguugccucucuuuucugagacaaggucucacuguguaggccagaccggccacagucugagaucuuccuucuucagccucauaaacugcucgauuacaggccaaugccaucauuccuuccgaguuuuuacucacuuuucuauaugccuuuaugccaugcauacucaaaggggcuagcauguucccccagucuccaaauaaaccuuauugaaacccuguaaauagcuaaggcccgcagcauaaguuuuguuuugccgaguuuuaaauaggucacaggagacuuguacuuuauuuaucccacuuguagcucagauugucaucuuucuuucuuuuaaauauuuauuuaucuuguuuuauguggauggcuauuuugccugcaugugcggagcauguaccacauccaugucuggugugauggaucccuuggaacuggaguuacagacaguugugagcugccauguggguccugggaauugaacccuggucuucuagaggagaagccucuuaacagaagagccaucuguccugcuccuguccaucuaacuuucuuaacuccuuuucuugagagggaucuguuccccagauguacuuugugcaaguuucucacccuuccauagaugaaguuuuuuguccuauuaccuagcugagcugagcauccccaguccuccauccaguucccaaccuacagcucagagauccucuggcuuacuuuccaucugccaugagaagugucugcucuguuugugcuucuugggacauuuaucuucuuuggguacagggaugucuuuguagucauuguguaccuccucauagaauuacaauacuccucuuccuuguuugcugucucuguugcauucuaucauuuuucucuucuuccuuaauuuuaucuucuauaucacccaccauaucaguagauaaucaauuguucuugugguccaguuucaagcuuagguuugcuugcaucuguauugauagaguaucuauagagaaagguuugggguuggauuuuuaaauguacauaauuauacaaaccuuuaaauuuuuuucauucaacauuauguuugaggccauauauaaaucuacaccucuucuggcugcuacagaguauugcuuuauaugcuugaaagucuugaaaauaccauguuuugucauauuuucauaugguaauagguacuuaagcaaauagucugauaaauagcaaaaaugugcacugauguauagauauaugcaaaaguuucucuaaagauguucuauauaugcauauuugacuuuauuauugacauauuauucuuuaagaauguauacaauaguuauauuguuuuuaauuuuucuuucucccucucucucucucucucucucucucuuucucucucucuuuuucuuccuuccuuccucccuuccuuccuuccuuccuuucuuccuuucucuuuugagacaggagcuucugucucuauauguaacucaggcuggccuuuaacucaggauccuucuguuucagccuccuaaguacugauauuacaagcaugugcuaccaugcuccaccuaaaacauguguauccaugucugaguguggagagagagagagagagagagagagaguguguguguguguguguguguguguguguguguguguguguguguguguguguguguauuggugcuccugggacaugauguacauguagaagucagagaaaaacuuuaggagucuccuguuauaagaucugagaguggaacucaggucuucagguuugcucagcagacaccguuacccucugagcaaucucacugcuccuaaaacaucuuuuaaauaauaauuaacucaucuugugaauagacaugggaguaugccaaacaauaagcaccuaaugagcaucugagaugaacacaguacugccauaucucaaaguuauucuaagcauuacaugaaguaaaacaguaguuuuuauguuuguuggcuugauuuuuccauaguaggaaacagaaaucuggagcuguagagacggcuuaguggucagcugcucacugcacagcaugaggaccauugccuagcaagcugagcaaccgaguucugaaccuccagcacccaugcaaaagcaguugcaucuauaguccagcacugggggagugcagacagggggcucccagaguguucacuggccauccaguauagcugcaauaggauccauguucagugagagaucgugccuaccugaaaauuaagguggagaguaauagaggacauugaccuuugccuacacacacacacacacacacacacacacacacacguuugcacacuugaccacacaguaaggaaacagaaauccauaacucauaaacuaaaagugagucucuaagcaauuugaaauaccauuguuugguggacaacaucagugaagcuucccugaaccaccucuuuagaauuccugggugacugugaaaacccauuaacacauuuaauugcuuuuuagaggcguuauuaaauaauuccacuugcuacauuuuuguauucuucuauuaucauuuuccgaaguuuaaacaaauagugauauuguuucagaauaagucuucuaagugcaguguaucuguaggugcuccauucccuaaguccucaguggaguugccaucucccauccuaccaccucauuaagguaaguguaagggagaugcuguuggcauuccugucgcaugucagcuggcaccaggccuugagaaauaaagcugagaacucuaguccccaguuugaguauuguccuuucaccucaggucacagagugggucgugugugacccucccugcuccuguugcaugggagccaucacaguuagggaaaaagaacauagggcaacugguuguucuucugguuguagcuauggcugccuccuccaucucuuucuuuaccauucauucauguugauuucuucugucuguuucugcucauacuuccaguuugacuuuuauuuggcauuaccuaaguauaauguuuugaauguuuguuuuucagugaucaggaaccuccuuauucaaugauuacauuacaugaaauggcagaaacagguauuuuaaauuuuuuuauuuuuaauacuuucugaugaauuaauaacaaugaaaaguguauggccagcuuuuugaagauagaagaucucaaaaaugcccauauguacuauagaaaagguccuggcuguauggaaauuuccugugaaaguguaauagguaccauauaacacguccucaguauugaacugcacgucucagugaugguuguaucucaucugaaauuaggagauaagaaaauuuauuuuauugaugggucuuuugacuguacuuguuuuugaauggggagaauacuuguuuguccuuuagcacccuacacauguauccuucuaaauuagagccaagugcuggcuuuacuuaauuccuuuaugacaaaugagauguucaaaucuauuuuagucaucaucugaaaauccaggccauagcuuagauuuucuccaaauaaagaugcccuccagucaucagacaccuguaacagaguuuuggcuccauugugaugacuagagcuuuauggcuauacuugugucauccucuaguuucuuaaagccacagcauaaaggccuaaaguguuuguaaguccuuuuuauguuuucauguuucuaaaauagcgauuccauuauauaaucuucuugguuuacccuuagaugaaggaugguuggauguuguccagucuuuaauuagaguuauuccauuggaagauccauugggaccagcuguuauaaccuuguuacuagacgaauguccauugcccacuaaaguaaguuaaacugaucuuuauggaacugucaugaaugucaucugugaacaggacgaauaaucacugaagcauuugauguacucuauguacuugagaucugcuuuauugaguaguaacaugaacauuuuuauuacuaaugaaguguuauauccucuaucaauagguuuuaguuuaacauuuuuuaauguuuaaaguaaaggacuggagagauggcucagcggcuaagagcacugaaugcucuuccagagguccugaguucaauucccagcaaccacaugguggcucacaacuaucuugauggagauucaaugcccucuucuggugugucugaagacagugacaguguacgcacauacaugaaauaaauagaucuuaaaguagaaacguuugcuuuugcgaggacagucuucauuugaaaacuagaagaaaaugaacugauuuuaucugagcaacuugcuuauaacaaagauuuucuguuacgaggaacagugcugugcugaaagcuugagucucacucaagcacuuagaaguccauagccuagcuuaugcucuaacuaggacacagauuuuuuuuuuuuuaaagauuuaguuuuauuucuuugaguaugucucagacacaccacaagagggcaucaacucucauuacugaugguuguuggcuaccauauaguugcugggaauugagcucaggaccucugaaagagcagucagugcucuuaaccgcugagccaucucuccaaccuuaggacacagauauuaaacuuucauugcuuugcccucuaccuucaucaggcaggcugcuuccaugcauacauuuugcuuugcuuugcuuugcuuugcuuugcuuugcuuugcuuugcuuugcuuugcuuugcuuugcuuugcuuugcuuugcuuugcuuugcuuugcuuugcuuugcuuguagccuucacagucgcguaacuuguaggccaagcuguccucaaacucauagaaaucugcuugagugcugggauuaaaagcacguacuauaacacccauacauacuuuuaaaaaugugaauucugauagcuuuuauuuguauguugaaguuucagauacucuaugauagaaaaacaugaacagagagaaauaucuuuagccuagucauuaucagcuugggcauuaccuaacuuaaucaucuuuaauuugccucaaaaauuguugggauuuguucuugcuugauacagcuuuuuguaagccaagcaugguaggucguauaugccuguaaucccagcacucagcagguagaagcaggaauaccggagucuauagcaagucuuggugcuuugguuacauugcaaguuuaaggcagccucgacuacauggaacccugucuuaaaagaaaaaauggguaugguggcucaaugccuacagugccagcauuugcaaagcugauguagaggauuguauaagcucaggaccagccuggacuguaugccaaccugggcuagacuaagcccuugacuugggggugggggaguaacuuuuuauuuccacauuauuaggucauaagauauuuugguuuaucuuuuaggguuuguuguuuuaaguaagauucagugugugguuucuuuuugagacaggguuuuacuguguaacauagccuuguguaacccaguuuagccuugacuuuacaauuuucaugcccucagccuccugaguucagacauuuuagguauguucuaccaugaccaaguuauugugcuuaauguuugaaauuugaauggguuuagucugguuaaugauucacauauguauguauuaaaauugacuugauguuacauaccuguaauuccagcacucuggaggcugaggcaggaggauugcuacaauucaaggccaaccuaggcuacauaguuccaggauagccuugguaaauacagcuacauguauaacuguauauaucaagacucuaucucaaaaaacaaaaguaugaaauauguauuggcuauaacugguacauuuugaaugaaauggaaucuggcauugagaaaacuuaagguuuaucagauacuuccuauuaauaauaauaucauuauuaaugaaauaauuuuaugggaucauucuaaguuuauugaauaccuuuuuauagcuuuguuuccaggaauucuuuugggaaaauaaccugcagaguauauauucaccaaaucuauuuccaacuuuuuuaauaggaugcacuccagaaauugaccgaaauucucaauuuaaauggagagguagcaugccaggacucaggccacccugccaaacauaggaauacauccgcagucuugggcuguuuggcugagaaacuagcagguaacuccagcacaugcuuucugguuugacauugagacaacugcacuacagaccguugaccaaaccuguuagagcagaaagaaggaaagaagcugaauaugguggcacaagccuauaaccacagcacuuuaagacaagaggguuaaaaguucaaguccccaccccacacaguaaguauguuagaggccagucaaaacuguggggagcucuuuccuuucuguucucccucucucuuguuuggucucucuggcucucugucugugucucugccucucuuucucucucaugucuuucacuucaagucugccauucacucuccuccuuccccaauaaaccucuuggccuaaaaacaaaaccaaaccaaacugugggggacccuuuuucaaaacaaacaaaaaaggaaugaacagaaauggacuaaaaggaagacaauuacucaaaagacucaguuucaguuaaguguaaucuaauuuagcuuuguugauucuuuuucagagaaauuuaagauaaauuuguuguauugauuugcuuaagacaggggaaaggcuaaauuuagaauaauaaauaauuauuauauguauuucuaauaauuaauauuguccacuuuaggacuaugaacagcaaauugcaugaaaauaucucagccaguuacuuuauauauaguaaaagaaugaugaauucaaaaucagaacacaugggugcugguccagacuauuauggcucucuaggagccugaccuagcuagucucuuuauggugaacucaguugcuacacugaaaagaugaugguaguaggaacaaccugagaaaggaagccuugguaaugugugucagagaauggaacucaauuugguugucacuaguuaccaauuuaaaauagcaugacacuuuuaaucauguccaguguuugcuguguuuguuuagguccugcaagcauagguuuacuuagcccaggaauacuggaauauuugcuacagugucugguaaguaagacaucaaagcugauuauucucauuuauauagaauuguauguuuuucucaaguuauagcauagucccugaugcagaggauaggaucaguuuuaaacuuuauguacagguuuugcuggguuuuuauuuaacaccgccuauguuuagagacagaaagaaagaagacacauaacacggaggggguaaaaauuuaugaguugcucuaguuuuaaauuuagucauaagauagcugcuaggacuuuuggacuuuuuagguguccuuacaaucuaccaaacaauaauggagaacaccccagguuggguucaugugugagagugcccucacgcacacaucacacacacacacagagacagacagacacacacacacacacacacacacacacacacacacacacacacacacacaguggaaacaaaauuacagcauuccaacagcaguccagguuaccagcaguguguaugaaucuauauucacccaccuuugccuuuccugcuaccacaauuaaaacugccauugguaaacuguuugauguaucaccaugaggucugugguuugcugaagcugucuucuuaucacucacagcacuugacagcaguuuugacuagccuguguuuucuagguuauuuuuugcaagccuaguaagaauuagccuuuuuuuaaaacucuagucuaagcuggguggugguggcaugcaccuuuaguuccagcacuuagaaagcagcagcuaguggaucucuugaguucaagaucagccuggucuacacagccuggaacuccagaguaaguucuaggauagccagagcuacacggagaaauccagucuuggaaaacaaaaacaaauaaacaaaaacucuuuaaaaaaaaaaaaccaaaaccccauuuagucuaaaagacuuaauuugucuaguuuauuuauaaauaaauuagccuacacaauauguacuuaaaguaacccuuacaauguucugagugagcacucggagauacaaaguaguaggacagucauuuccccaucacagaggucacuauaggguaaaggaauagaaccauucaaacaacaguuaacuucuacuuuaugacaggaugugaucaagagcaaaauuacuuccuccaggcugagcacuauaagaguuuugagaagaugaagaggggugggggaguggaugugauugggugacaagggaccugugguaaucaugaaagacagacuuccugaugaagguggggccuacuuagcuagcucaugacacaaggcuaagauuagaaacucacagugaguuucuuggcuaaagcagcauagauagaagccuaguaaaagaguuaucugaucagagaaggcaguguucacagacaggaggacaugaacagggauauccagguagaaagguuugaaacugauaaagcaggcaggauguggcaaggguaaagaugcuaaagaggcuuuauagcagggagaacagugguucuaugcgcuuugcugaacuuaggcaggcaccacagaaaugcaugggaauacacugggguuccagaauucucuggaggcucccagcauagcuaggggacggcaagaagaggagauacuaaacauguaggccuuucuuuaagugcaaacacacaugcuguaaacucaaauauaagucaagagcacuugucacucuccugucaucacgagcuccuguagaauuuccugcaggaacuagauuaaaacuaagauguuacuggucauggcagcaccugacuuuaauccuagcuaugaguuucacgccagccugguauacauagcaaguucuaggacaaccagagcuauauaguagaccgugucucaaaaacaaaacaaaacaaaacaaaaacaaaaacuaagauguucauugauaaugucauuauuuauaaaccuggagcugcuauuauucuuuucaggguucuaaaggucauuuuuagauacaauucuaguuuucuuuuuggcuuguuuuaaugaauguaagcaucaaugguguuuuaguuaacaaagcccuaacacaaugugauacugcugaaauauccauaucuaccaauuaaugacuuaaaaaaauagauuaagagacucuucucuugauucuccauuagccaaauggccaagugagaguuugaauaaaagcgacuuuucugcuguuccaaauauauagacugccaucuauuaaauagaacaugaaauugauaccguacugccucugcaggggguaacuuuuguuuuuaucuuuuguugucuuucagaaguuacagucccaccccacagucaugcuuuuugcacugauugcacuggaaaaguuugcccagacaaguagguauagugacuucuugcacuaaugaucuuuguugguuauuaaaaaaaugagccugcacuuugaacuccaucaaauguacacacuuucuuguuuuaagaccagcuaaauauaucaagaacaaaacuaaagauuguucucagcuaagauuccaagcauggugauuaucacuacuuucauaacuaaaacuuuaguaaugggaguuggagagaaggcuuagcaauuagaguacuugcuaugcaaucaugaagaccugaguuuggaucccaacacuuaguaagaagccaggcauccuaugcguaccaguaaccucagcucugaggcaaagacaaagacaagaggauugcucaggcuggcuggcuuccagcccagucaagaaaaugcaagcccccaguucaagaagugauccugccaaaggaauuuuguagacacaguacccucuucuggcuuccaugcaugccucacaugugugcauauauucacaggcauaaacacguacauaaacaacacacacaaaauuuuaaaacauaauggagugauguguugaguuuagagagaugauuaagggcacuugaugcucuucaagagacuggacuuugaggccgagcggugguggcacaugccuuuaaucccagcacucgggaggcagaggcagguggauuucugaguucgaggccagccuggucuacacagugaguuccaggacauccagggcuacacagggaaacccugucucgaaaaaccaaaaagaaaauaaucuuaagcuggauguuaugaugcaugucuuuaaucccaggacucaguauacaaacucaaguuacucucuaaguucaaggccagccuggucuauacagugaguuucagaacagccagagcuacauagagagacugugucucaaaaacaaaacaaaacaaaauaauaaauaaauaaauaaaucuuuaaaaaauagcauugagauugccagacaguagcuacaguucuuuggcuauguuaucccuggaaggaaacauugguagaaauuuaauccccaaauucucuauugucugccucacuccguaccaccacuaaccuacuacacauccucauccuccucuuucauuguuauuuacauauuucauguuuccaaacaggugagaauaaauugacuaucucugaauccaguaucagugaccgacuggucacauuggagcugugggcugaugauccugauuaucugaaacgucaaguuggcuucugugcccaguggagcuuagacaaucucuguaaguggagauuuuccuuauuaaaaaugguuucuacuucuauauagaauauuuuuauuuuauuuauguugagcuggggguggguauacauguguguugagauuagagaucaaauuucaggaguugguucucuuuuuccaucauauggguuucagcucauuagacaagcgcccuuaccugcugagccaucucaccagccaaaaucuguuuacauuucuaagucccugucuucaguaggaucauaagcuucuuaauaagcuucucuauacccuaauagaaaaguaucccaggcaccuuucagaugagaguuaacuggaaugcuucgaauuucagcauucuuggguucauagaccuuuaacuauauagcucugucuaagacuuuucuaacacacacuuuccuuacuccccuccaacuaggcucugguagcuccaacucuggcccuguucauauuuguacuuucuucucugucuucuuuuuauguguguguaugugguguuuuuauugucacguuacaacgugucugacauaaacgaccuaaugggaagaaugacuuauucugguuccuaguuucagaggucucaguggcaggaaggaagaagaaauagcccagucagggaggcaaggauauaaaaaggacagaauaccuauuuauuuauuauuuaauuuaauguucagggcucgggauagagucuagagccuugcucaugcuaggaaacauucccagcccacuuaccuuccuuguccucuccucuuucccucagauggucuucaaaugcaaauuaauucuuacuuagacuguggcaguuauuuuuaacuuuuucucuuuuucucuuccaagggcuauuagaauacaaaccacauuuauuuaucauugccuagcucuauugcuagcucugugcuaaagcaguugaacacaaaaagucuaauucuugcucuaacaugaaauuuagcauguauagugcuaguuaaagacuaauuuugaguaaaugcaaucuggaagcuaggcaugaugacacauagguacaguuucagcauuugagaggcagaggcaggagacgggagcucagggucacccccagcuacauagugaguuuaaaccaagcuacauuugauccuggcucagaaaacaaaucaaccaauggucccgguauggcaggucacacucuuaauuuaguacugggagauggaggcauguagaccucuaucaguucaagaauggccuggucuacauggcaaguuguaggccaguuagggcuauagaaugagaccuguaauuugaauuuugcuaugcaaaccauaauagacacagggacuagaaacaccgcauucaaagugcugcccuuuuuggcauuugcauagaccauguaacagcaaagcucagaugcuaggcccuaccaguuuuucauuccuugacaaguauggcagcucgagaugacaguagcuuuuucccuuuuucuaaaccauuacagccugcccuaggaaacaugaccacuuuuucuuuugcaguuuuaaaagaagguagacaacuaaccuacgagaaaguggacuugaauaacauuagggccaugcugaacagcaaugaugucagcgaguacuugaagaucucaccucacggcuuggagguaaagcuuucacagaccuucugagggcuaaaauuacucuguucccacuuuucauacccugcuucagaacaaaagcagugucuaacggaaugggcagaaacuuuucuuauacccaaggagugauuagagguaaaagugguagggauaggaaugcuuccagaugguauccacucuucccucucacguguuauugcuucugcuguagcacugcagugcuuguugacuggcuuacuuaugucuggauuguugguuuguagugcucacuauugcuaaauaaauguccuacuacugaguuacaguccuagcuaaguauaucuguuuuuaaaccuuaaaaaaaaauaaaacuuuaucugauguauauugauguuuugccugcauguaugucuauguaccauuugcuugccuggugccuauggaggccggaggaagauaacagguccccuggaucuggaguuacaggaguuuucgagccaccauguuggugcuaggaaucaaacccauguccuuuggaaggccagugcucuugacugaugagacagcucucuaguucuaaucuguuuuuaaucuuugccauuuuauuuaacuaaaaguacaaagacaaguguuucccaaagaagccauuccuuuuguaaaugucuagguagccauacuacuacuagaccugcuguuuuccuuucuccuguugaauauugccaacuuugugaugcaaguugguggaaauacguaggugcacauauaggaaaguaccacagaucuuagcuuuucaggauugaaguacaguuugaacagugguugccaaaugauuauauguagguacccugucuuuacccuuuuccaucuuuaucuuaugaaggcaaugucugugcauguguaaacauucugaccucaaagcaagcuuucuuaagaacugaaaaccaaagccaggugcuuugacuacuuauaguugcagccauaaugaaauucuacacugaaauaauaauaggguuguuucacucaguuuuaugcuuuuauaaaucacugaagauggacagugguaucccaccaggagcuuaaauaaggaaaauuccauccauccuucccuaugccaauuacuugguagucuucagacacugaugaauugauguguacuccuugguucuuccaggcucgcugugacgccuccuccuuugagaguguacgcugcacuuuuuguguggacacuggggugugguacuaugaaguaacaguggucacuucuggugucaugcagauuggcugggcuacucgagacagcaaguuucucaaccacgugaguaccuggggucauucaaaggaagcagcagcagcuucuggaggcuagguuagagauacucagucagaugugcuuacauuucagguaggcuugcucaguaacuaggugcugccagauucuugacagugacucacugcaccguuuaaagugggaaacaagugaaauguccucagccucugggguuuucacuugaauuuuagauucaucuuaauuuccuaccuagagaguugucuuuauggcuuuacuguaguccuuaccaaaucugggacccaguuaucacauugugacaacagauaauuuuuuuguuucuuuuguuucuuguuuuguuuuguuuuugagacaggguuucucaguauagcacuggcuguccugguacucgaucuauagauuaggcugacuuccaauucaaagauccaccagccucugccuucugaguacagggauuaaaggugugcacuaccaccaccaggcugccaacagaugauuuuuaccuugagauuaaguuuuggaaaccuuguagggggccagaaagauuacucagcaguuacgagugcuuucugcucaucccagaggaccugaguuugguuccuacuguccacauaagguugcugacaaucacuuguaacuucaguuccaggaaauccaacaacccuuucuugccucagugggcuccacacauauguggcacacauacacacacacauacacuaauggacacauaaauaacauuuuaaaugcaucuuuaaaaaaggaaggagccuuguacaaauucucuuuccauagcauuaacuauugacucacuuuucuuauuugacuuuuaccuuguaacuaaugggcacauuuacuucaguauuuaucuucuguuauagaaagugcugaaguaaagagaagucugggacaccacugagugugggagugucacaggucuuuccuuaagauggauaguuuccuguuuggagauaaagucuugcuaaccuaggucauuauauggcccaaaccucaaacucaugguacuccuacuccagccucccuaguacaggcauuauaggccuauaucaccacaccuguccagacauaccuuucaauaccuaaacuaaaugguuuucuucuguuggucaaauuauaagauauuugagcuuucuucucuguggaaacaucagaugguaguggugccggugcagcaggaagggcccucaguccuugggagaccuagccagcuuccucgaaggauucggcaacuaagguugaaucaugguugacaccacaggacuuuuggagguuaaagcuaaagacaaggagugauccccagcagcaggucaagaacgugaauguuuagucccuagaagagaucuaccuguucuuccugcccacuaaggaaucugacuuuuccugggagcaucccuaaaggguaagguucuaaaguuauugccagugcagaaacagacuugggcuggacagcagaccaguuucaaggcuuuuuucacuauugggaacuacacuggccaugaggcucuuggcaauaaguacuuuaagcagagagccacugcagucugagggaccaucaucuuagccaagcauucugucaucccuguguggagagaaugcuaccaugggaacaaaauuuggaagcuccacauuaucccaugcaaggggauaggccacuguggcucgguacuggaaugucucaucggggcagaggcacugacaucaucucuguuccugugccaaggccaccuuugaugcccuaaagagacucuucaccaagucuccuuaucaggaauucacuaaccaucuugugaaaacccacaccagagucuccauucagagcacccaaucuucagcuuuggcuaccacaugggguauucuaguuuuuuauaccagaaaaauaaagugaauuaagucugaaaaaaaaagcuguuugaaaucaauucagcuuuguccaggaauauuuuuuaaaaccccuagaguagaaauaaaauaguuguuaagaagaaaacuaaugagcaaggcaaggcaggucugaacucuugcuuguguagaccccaaucugcugguguuuuucuuugggaaccuguaguguuuggaagccagagauuguuuuuaacugcuguguaguuggaagauacuagguuuggagaacaacuccauugucuuguuccaaggccagccugaucuacaaagugaguuccaggacagccaaggcuauacagagaaagucugucucgaaaaaccaaaccaaacaaacaaacaaaaacuaauuuaucaauuauaugaauaauggcugccuguuacaaauagaauccuaaaagugauuucuuucuuucuuuccuuuuuuuuuuuuuuaaaacacuaaaaaaaugaucuugaaggccaaagggaugguucggaugauucagagcuuaagagcacuucugcucuuccagagguucugaguucaauucccagggugucucacaaccaucuguaauaagaucuggugcccucuccuggcauacaugcagacauacaggcagaauauuauacacuaaauaaauuaaauaaauaaaucuuuuuuuuaaauaaauaaauaaaucuuuuuuuuuuacaagaaaucuugagucggaugugguagugcacaccccaaaucccagcacuggccgaggcaggcagaucucugagucuacagagugaguuccaggagaaccaaggauauacagagaagcccugucuugcaaaaauaaacaagcagcagcaguagcaauaauaaucuugagcgaggcaugaugguguaagucuuccagccuaagcuacguuauaagacccugucucaaaaggacaaaagaaaaugaaaaacgaacaaaacccuucuuuugagucugucaucuaauuucuacaacccuuucuuaagguggcuuuuuucucacauaaacauuucaaaaaugagagaaauugggccugagaaaggaaaucaagaauaagucuugggaauucaauaccauucuuauuuuacaacagaucuuuacuuucuuccuaaaaaaugaggagaauuuggaagaguuacucaguuucuucacuugaaagaugauaaagucguuuacaacuaaagugaaguaggguggaacaguugcagcccuucucucugugguuugcuauuggaauguuuuagcagucacacuaauaacaaggaugguuacucuuuuuuuuuuuuuuuuugagaucauugaagcuuguggcuaaaacuauaaaugguagauauuuggcaccugaaauuaaaacuaaaaagaauguuuucuugcccucuaaauuuucucucucugugggggaggggugucuaugugcauguuaguuuguguacauuguugcugguacauuuggaggccagaggaagacauuuuaaauucuggaaguaaaaacaauuuuauauggacauuuuuuuuacuauaaagaagucuaugaagucuggagagauggcucagugguugagagcucuugaugcucuuucaaaggaccuaagcucaguucccagcuaagggagcucacaaccaccuguaacuccauuccaggaaaucugaugcccuuuucuggcucuguggguaccccacacacacacauacacacauauacacaugaauguguguauacauacauacauaugugcauguaugcauguacauaaauaauuuaauagaauaaaccucaaaaaggcaggggugcuagagagaaggcucaacuguuaggaacauuugcuguucuuccagagaacccagguuugacucccagcacccacauggcaggucacaaucaucucuaauuccauuucauggacccugugcccuccucuggucuccaagggcaucuggaaugcaugcuaucacauauauaacauauaccuauaaucccagcacuugggaaucagaggcaggaggauuaccaucaguccaacacaaaguuggucuagauagugaauucuaggccagccaggacuagguaguaaaacaguuucaaaaaauaaauuacagauguuuaaggauguguuuaccugaauuaaauacaaugcaauauauacauguauuguauuccaauaauauguguguuuuuagauaggcauuaaaaguacaugaggccaugauaguagcaccuguagcauuguagaggcugaggcuacagagugagagagaauccaacucaaccugaaaagaaggaggaaauuagaguuaccuaaagguaccuaauggauagcucauuccuuacauugccauagcaucuuuaagaugagccuguaagacacagaaagaaaaggaaugacuuggaagccuguugggggcuuccagacuauaaaguacuaggaaguaaauuguaaggcauuguuagaaucuagaaaaagaaaguaaaaucaccgguguuuggagaggcuacucucuagaaugcagccagcacuguugccacaaguaagcccuacccaucccucugggauaguggggagacucugaugggaggagccucuuggagccuagugaaucuuaguucacuugcagcacaggacacugucuucaugauaugcugaauaauagaaagguuugaggauauugggcaucacggaaaaaaaggacuuucuacugcaugagaaaaggauucaaacuaccccaucagugacaagcuguaauaaacuucucuuaauaauugcuaugugacuaagaaacaggaaauuuaagcauaccagaauaucaagcuagcuauccuauucuuuuagcagugugacauugccaaugaaaacuaauguuaauccuauuggaaauguuuuuaaguugaaagaaggcauaaauacaucuaacuuacucugagauauaagcucaaaguucaucucugcuaggcuucuuagcucuacagaagcugaucugugauuaaaauugaauucagaguuuccucuugugccauaguuucacccagaggaucuugcaagguaaugaccaccucccugacuagcuugcagucuucuagaauugcuuuccaauguucugucagagaauuuauccagguuguuagaaagcaaagauagaugggaccagcaagauggcucagcagugaaaggcacuugcugccaggccugaaggacuugauuucaauccugguacccacuugaugggaagugagaaccagcucccaaaaguaauugucucugacuccaugagcgccauaguaugucucugucucugucucucugucucucugucucucucucacacacacacaccuuuaaaaaaguaaguaaagauaaugaaaaauuguuugccuuugccuauuucucaacaguaaaauuuuagugcuuguguuuguuuugggguuuauuuuguuucagguugaguuuuuggagcugaggucugagucuggggccucacacuugcuaauuuacugauuuguucaacuucaggaaggguuagcaagguguuguuuguagcaggcuacugaaauucucugcaaaacaauuaggucaaguucacuucauuuuuuuuuuuucuugaguacuggcauuaaagguccaccauaccuggcuauuuaacuuuuaauaaaugucugcauagugcacaugaaggacuaauucuaauucaauauauucaauauauuauuagaguuagggaauuuguuaaaacucucuccaguccauaugcugacuguacuguuuaucauguagaacaaacaggccauuagaaaguaauauuuuucuuuaaccaugcuuucauccccuuuaacucuguucuucaccacuggugcauaaagauaacaggguuugacuuccuccaucuccuccucuucuuucauacuucuauuucuaacguuuuuuucccuuaagaaccauccuuaugugugcuagagagcugggucaguuguucagagcacuugcugcucuucaagagucccagaguuuggauggccuguaaccaacuauagcuacagaugcagggaucugaggccccuuccuggccucuccagguaccuacacauauauacacaaaaaguaaaaugcauaaaaacacauaauuucauuaugauuuauuaauuuuguuaggcaggaguaguuggcaugccccuuggcaugcgugcgaaggcuggaggacaguugcuggagucagcucucugcucucaccauuuggucccagagaucaaacucgggucaagcuuggcaaccugugccuuuacacacugaaccuucccccugucccuguuuauuuauuuauccguggacaaacacugaaaacaagauuuugcucacccucuuuauucauuaagacagggucucuuagguaccuugaacccuccuagaccugccccugccuccugagugaugggauuagcugugcuuggcucccauucacccuuuuauguuaguaauucugggcaauaauugaaagguaucaaguaaaaaagaaagaaagaaauugagauccugcauaauauucaaaucauacucuuuucaaaauaguuuugagcccauucauaaaaucugagggugugggcaucuugaauccaccacauucaggaaaggcauuugccugaccacugggaaauggugagacuagagaucuuggaaguuuaaguccaaacugaaaucugcuuuucuuaggaccagucuacaaagaagcugacuaaccuucaagcgcuuguuuccuuuuucaggaaugacagcagcuucauggugcuaguaagaacuaaaugaacucacaagugugaaaaugccugcaacaaaggaagcacuuggcaacuugcaguuggcaaaacuaguaucuguuugcucggaacuaggauucugugccaaauuuucucuaucuuccaaguaccauaggcuuuccccuuauccaaaaaagcuuagaaugccaccuacuaggucuccccagguuagaauagguagccuuaaucuucgggucuuugugucucucuaggaaggauacggcauuggggacgaugaguacuccugugccuacgauggcugccggcagcugauuugguacaaugccagaaguaagccucaugugcacccgugcuggaaggaagguauucauucuucuccauuugaacuugucaccuggguuaggacagcuagguacuagcagguacuuauuacauaagauaggcuuuaaauaccuuaauaggagacuuaguaucaaugucacugccgagauugucaaugcuguucccugaucaaucuuuccugaagcaaaguauuucagaauauuaaguccuuggggacuggagagaaggcucagugguuaagaacauaggugcugcuuuuccagaggcccugagguccauuuucagcacccauguugguuggcucacaauugccuguaacuucagcuccaggggaaccuaauaccuucuagcauccaugggcaccuacauucgugucacauaaaacacauacacuucuguuuuagucaguguucuauugccaugaagagacaucaugaccauggcaacucuuauaaaggaaagcauuuaauuggagcugacuuacagguucagagguuuaguccauuauugucauaguggggaacauggugacacacaggcaagcauguucuggagaagagcugagaguuacacaucuggacccacagacagcagagagagugacacugggccugguuugagcuucugaaaccucaaggccugccuccagugacacacuuccuccaccaccugccucugcuucccaagugcugggauuacaggugugugccacuaugccuggcuucuuaagagcugucauauauauuuauaugucuguauguauguguauacacacacacacacacacacacacacacacacacacacacacauauauaucuggggggcuggagagauggcucagcaguuaagagcaauggcuccuuuuccagagauccugaguucaauucccagcaaccacaugguggcucacaacugucuuuaaugggaucugaugcccucuucuggugugucugaagacagugguaguauauucauauaugcaaaauaaauaauuuuuuuuaaaaaaagaaaauauaucugaauacaccuauuuuaaaauuugaaaaauagaaaagugcaaagcaauuuuaauccuacacacauagagagagagaaagagaggagagagagagagagagagagagagagagagagagagagagagagauuuuaguuaggguuuuucuauugcugugauagaacccuaugaccaacaucaacuuggggaggagaagguuuguuuuaucuucuuccaacuaacaacccaucacugaggaaacuggaagcaggaacuaaaagcagaagcuauggaggaacacuguuuacugacuugcugaauuugcuuacuuauacacccacaaugggcugagcccgccugcaucagagaaaaugcccuacagauuggcccguaggggacugaugggggcuguguucccuauugagguugucuucuucccagauaauucccaguucaugucaaguugacagaaaauaaaccaacuaggacaugcauacacacacacacacgcacgcacacgcacacgcacacacacacacacacacacacacacacacacacgcacgcacgcacgcauguauguguguguguauaaauaaauauauguaaauacagauaaauguguguggguguuuugcauacaaguaugucuguguaccucacguguacccacagaagccaggacaggaguggaguuaacagaugguugugagagaccgugugggugcuggguuucuaacucagguccucuggaagagcagccagugcucucagcagcugagccagcucuccagcccuagagauuuuuuagguacuuaaauugguuuguacauauuucccauuuuuauaccucaucuucugaacagauuuccagguaaugaaaaaugacaacacuggggcuagagauguagcucaggugaaagagugcuugucugcaugugugaggcccuaggcucagucccuagcacugaguaaucuggauauagugauauaucugguaacccaacggcucaugaaguaaaggugggaagaucaaaaguuuaacuacauaccgaguuuaagaucagccugagcuagagacacuaucucaaaagaaaaaaaaaggggggggagggggacuggagagauggcuuagcuguuaagagcacugacugcccuuccgaggguccugaguucaaauuucaacaaccacaugguggcucacaaccauccguaaugagaucugaugccuucuucuggggugucuaaagacagcgacaguguacuuacauauaacaauaauuuuaaaaaucagaacaauaacaaaacaugauuggcuugguaugguaagauguguaccuauaauucuaccauccaggaagcugaaacagaaggauuucauguuugagaccagcaugggcuccauagccaguuugaggcuagcuaagacuacauaaagaccugucucagaaaauuaaaaaaaaacagaguaaaauaauuuagugcagccgggcggugguggcgcacgcauuuaaucccagcacucgggaggcagaggcagguggauuuaugaguucgaggccagccuggucuacacagugaguuccaggacagccagggcuacacagagaaacccugucucaaaaaacaaaaaaacaaaacaaaacaaaacccaaaaaacuuaauucuuuucaauauuucauuauaaacaagaacaaaaacugaagucucauuuuagaaaaucagugagaaugugugcuuuaaaacaaaaacaauuaucaucugagggauuuuaaaucaugccgagaagcaaaucagcacauaauuuuaucuuucccaguguguucauuuuuuucacauuuuagcauuugaaauugggauacaucuaauacaauugauggcuugucauaguuuaaauggaagcuuuuuuccuuuaaugaaacaugaaaauacugcuauggaaaugucagauaagcugcacaggaagcaaagauaaauguguugaauguguggcucaagacacaaacuuagugcagggcguugaggcgcuuccaggacugggguagcacaagccuaacagugucugguuugucuuccaggagacacaguaggguuccuguuagacuugaaugaaaagcaaaugaucuucuuuuuaaauggcaaccagcugccuccugagaagcaagucuuuucauccaccguguaaguagcuccucucaguugaagauugaguaaauucauggaauguacuuuucucaaagauaaaaaccaaaaagguuuaucuaagcaauuaugaaaaguugguuuauuucaauuaacuagagcuccauuugaucugaccucaaugcccgaggguuugauauuacauagaaagauaaaggugugggcuucccuggcucacgaccuguguagguuaauaaaccaaaucugucucccuuacuuucuaucaucgaggcugacucacuuugacuuucucaaaacgacucuguguaugacuugguuuuauaagcucuacugaccucugcucauuuuuaucuguagaucuggauuuuuugcugcagcuaguuucaugucauaccaacaaugcgaguucaauuuuggagcaagaccauucaaauacccaccaucuaugaaauuuagcacuuuuaaugauuacgccuuccuaacagcugaagaaaagauaauuuugccaagguaagagucugccuagcucucucuggacuguuaugugcaucucaugaaaaaucaaaacaacuuaugggagauuugggguuuuuuucagcauugaacaaacaauuuuaaacaaguaaucucacugaaaacguugacuuucuggggaauaaaaauuaguaaaacaggucucagaaagagucauacagggcuggugagauggcucaguggguaagagcacccgacugcucuuccgaaguucaaaucccagcaaccacaugguggcucacaaccacccgugaugagaucugaugcccucuucuggugugucugaagacagcuacagugcacuuacauauaauaaauaaauaaaucuuuaaaaaaaaaaaaagagucauacaaacuaaugguuauaauaaaauuauuugaaaaaaauauuaaaaguguuaucuggcaaaagcaggugguuucaugagaucucuaucaaauugugagugauaaccucauuauuaauuagaacagcugaucucaauggggaggggguugucaaacaacucuuucacaagggucaccugaggccauuggaaaacacagauauuuacauuauaauuuauaacacuagcaaaauuacaguuaaguagcaacaaagauaauuuuaaugauuagaagucaccacaacaugaggaaccauguuuaaaggguuacaacauuagggccacuaauuuaaagugucauaggacccaaaggagaaggaggagaaggagcacguccacguuccucuuaugagguaaauaauauugauguaaaacucagaaaagggauaguguggugacaccuucuuauaaccccaguacugagaaucagaggcaggagaaucucuaugaguuugaggccagcguugucuaagaaaagaaagaaccugucucaaaaauaaacaaacauaaaauaaaauucagaaaaaauauagcucauuuacacacaaaugcaaacuaacuuuacuggaaucuauauaaaaauccuuaauacuggaaaaauuaguaaauuauuaacaggcuugauuucuugaaaacaacuccuuuuggguuuaaacuacaugcuacaggguucuacagccauuaacacaaggggaugcaucucagguaaaacuucauugcccuuacuugauagaaacugagauuggcauuguuucccugcuuguuuccuuauaagaugaauguugucuguuccuucagcaagggaaagaucagcugcuccaaugauuacugccuguugaagccugacacauuguuagccaaaguuugucaauuuuuguuugguuugguuuggcuuuuuuuguaugguugguuuuugagacaggguuucucuguguaacagcccugguuguccuggaacucacucuguagaccaagcuggccucaaacucagauucaccuguugggucuccugaaugcugggauuaaagaugugagccaccacagcccaaccaaaguuuaucauuuuuuuagcagggcagcugccugagccaguaugaggcauggaauuuauauuacuaguguucacuaguaagauagucccucaacauuugaggagaccauacuggccaggacauagcuuauguugaaccauauaucauacccauaaaucaaugcaaugagagccuggcuucuguuuugaaacaaagcauaggucucuaagcugcccucuuccuuuaccuuacccccugucucagugagugggcacuuucagaugcacuagaacaugugacaguaagagcagcagaguccugacaauggucuaagaauauuaaggccauuuccauuggguuuagggaucagagguuaguuccucagaguuucugugcauuuugucuugguucuuuuuuuuuuuuuaagauuuauuuuauuaauauauguaaguacacuguagcugucuucagacacuccagaagagggagucagaucuuguugcagaugguugugagccaccaagugguugcugggauuugaacuuuggaccuucagaagagcagucgggugcucuuacccacugagccaucucaccagccccuugucuugguucuugauaaagauuauaaacucuaguugcucuuggugaaauuugaggugacaccucccuuucaucugugacacuucaguccuuuguuuauccagucugcuuuuucuggaacaaggcucauauauuaccugaagagcacaacucaucuauggaugaguuuuccccugcauccucagaguuaagcaucccagaauagaaguuaacuuuaauggccaacuucguggcugacuauucacuuaacauuuagaguuuagccuauccugaguaagaacaacagauuacauguuaggucaacuuuguucugaaucuagacuagacuuuguugucucugacaaauacacaaaguuucugacacacauacagaccuauaaccugaaguacuacaggggcugaaacaggaggguugcaacuaguaccuagaauuguguuguuuauguuguguuuauucucuuuacugcuuauucuuaaccucuuuauuaugcaaauucaaacacauacaaaaauguaagagaaucauacagugaagcacacauauccuuagcuacaguaguccgccacaauggguggucuucucacccauucuccuguggucuucccucacccaucuguuaauaaccccauuuccauucuaguuucucuguugcugcugccuagaauggucuccacagacagcaaggcucauguccucucccucgcuugccuccuaaaguuuccugaguaagccccuccuuggcugccauuauucuaaccccugaaccucacacacaggagcacuccuuuuccucuuuuccaguuuauuuuucgccaugguguuccucagcauuuaacauaaucaguuuuaauucucucucccccacugccacacuagaacaaaggcucuauaaaagcagauacuuuuccugguuuguuuugguuuguuuuguuucccuuucuuuguuuauggauugccuuuuuuuuuuuuuuaaacucugucaacucuggagcccaagcugcccaagacucauggaggucccccuggccuagcuucccaaaugaugauucuagcagugugcuaccaugccuagcuaaggguacuuauuuggucuccuguucacugcugaauuaccagggccuggggcaaugccaggcccacagcaagccuguaaaugaauuucaggagagcaguuccgcuugucugcuuuucuguauauucugcauggaagaauaauggaaggguucaaaccugaggugucuaaacuugcagggaguauacaugucauaaaccccuuuaccuuaugugaaaacugugagugauuuuucaccaaauucucaguauauaugacuuaaaugguugcugguaaaagaacacuggauuagaaugaaagggucugaauuugauuccucuccucuccuccccuccccuccccuucccuccccuccccuuuucuuuguuuguuuguuuguuuguuuguuugagacaggguuucucuguguagcccuggcuguccuggaacucacucuguagaccaggcuggccuugaacucagaaauccgccugccucugcuucccaggugcugggauuaaaggcaugcaccaccacugcccugcugaauugguuucuauuuauuaaguucuuauauaaaucauuucauugcacuuuaucuuuguauuuuuugucuauaaaauggcagucaagccuccuucacucugcugaagcugaaauguaugaaacuuuacugaacaaagauuguggaguguauuuucccuguuagggcuuuuugagaacuuucaugcgcccuacugcugacuccuuauugacaaaaugaauuuuguauuguuuugcucaggcacaggcgccuugcucugcugaagcaagucaguauucgcgagaacugcuguucgcucuguugugaugagguggcagacacacagcugaagccuuguggacacagguuagagacucugcuuuuuggaucaucuuccacacaucauauucagcaacauucauccuguucuugagcuacuucugaggaguuagcagaucuauagcuauucaucagaggcauuagauuauuaggacucuaaugggaugaaugaagaauuaaguugccagguaguaucuguugcuuuccagcaaauaccuggaguagaacaaacugucugauauagaaagccuaggguuuuauuuacuuuuugggguuuuuuuuguuuguuuguuuuggggcuuuuuuuguuuauuugguugguugguuuuugcuuuuuuuuuuuuuuuuuugcuuuuuuguuuacucagacaaacacacauacaaaaguagauuaggggauacagaguuugagacaggguuucuuuguguagcuuugacuguccuggaacucacucuauacauaaggcuggcaucaaacucaaaaagaucugccugugucugccuccugagugcugagauuaaagacaugcacuaucacgccugguuuauauuuuuauauaagccaggcuuacaacauucaaaagacuuggugcuguuugucagcaucuugggaaggaagucauuuugaaguuaccuuccucaccagcuucuuuacauuccuaaacauugaaaagguggagcuuccauaccaucugaccaaauuuuagcccugugaaaagaacauagaggacauccuagauccuguaggacagugucuaagcaucacaccauagcagcaaauaaacugaaaaagccauccccacuaacauuauacaggagagcaaacaguguggcagccuuagccugauacaugcugacagucugauagcagcacuaaugcugauaacacaagcugccugcauccaucuaucccaacacuaugugugucuguggucuugacauaucuuuagucaccuuauugcccagggguuuugaccacagauugccaugacuggauccuugacccagagucuucugaaguggguuagaagugcaugcagcagaucuccuuuugccuuagcuauggcaguuucucuccuauaccccagaacuucucagauuaaacaccuuugcacaauuuaguuaucagggccuuauaaacugauuaaaaaaaauaaagaucugauaccuucauacaguuuuccaucuuucuuaaugguaggaucuaaucuucaucuuugagcccuuuggcccuucugauggccucaaacacauuuaaggacuaauugaugauguguaaagacuuagaaguaauuauccuauguagccaaaguuucuggaacauccaaaacaauguuggaaagaaaugaaagaaugacaaggguauuuaacacaauucagucacaugguauaaagucugcaccuuuucagugauuaggaaguaaagaaguuacaguuacuuuuaaaggugguggugaaggagggaaaugaggauaaagugagugacaagagugaccccuagaaugcaucuggaggauaucauccugagugagguaacccaaucacaaaagaacacacaugauaugcacucacugauaaguggauauuagcccagaaacuuagacuacccaagauacaauuuacaaaacacaugaaacucaagaagaaggaagaucaaaauguggcuacuucauuccuucuuagacuggagaacaaaauacccauggaaggaauuacagagacaaaguucagagcugauacaguagaaaggaccauccagagacugcccugccugggaauucaucccauauacaaccaccaaacccagacaccauugcauaugccagcaagauuuugcugacaggacccugauauagcugucucuugugaggcuaugccagugccugacaaauacagaaguggauacucacagucaucuaaugguuggaacacagggccccuaaagaaggagcuagagaaaguacccaaggagcuaaaggggucggcaucccuauaggaggaucaacaauaugaacuaaaaguacccccacagaacugugucucuaguugcauauguagcagaggauggccuaguuggccaucaaugggaggagaggcccuuggucuugggaagaucauaucccccaauacaggggaaugccagggccaggaagcuggaguggguggguugggaagcaggguugggggaggguauaggggacuuuggggguaacauuugaaauguaaaugaagaaaauaucuaauaaaaaaagaagugaaaaaaaaaacaaauuggggggguaggggaaagugaccccuagaccccuagagaagacugaaaggacaccauuucucuugccauacuaaaugguugugaagucugccuuugccucccuccugaaagcacuaagcccagauacuuucacuggugaaccuuuaacuuuuucaaggggaaaguaguucaaauuuaucuaaaugucucuagaucacaugcaaaauaaaccuacagcacuauucuuauaaaaucugcauggcaaacacacuaaaagcugaaaagaaaacaccaaaaugcucagaaaacuucuuuuuguuucguuuuggguuuuuguugacauggggucucacucuguaggccugacuggucuggaacuugcucuguagaccaggcuggucuuguacucauagaacaccagcuucugccucacaagcccugggauuaaagacaggagccacuacaccuggcuauaagaccacuuuuuaaaauuacgauuauauaucuaaauaaaauauuaguagcuagagggagagccuagcacuuucugcuccuguagaagacguggguuagguucccagucccuaccugguugcucaaauccaucugcaacucaaauucuaagagaucccaugcuuucugaccacugagggcaccacguaugcaaguggugcacagaaauauggacauacaggcaaaacccacacauaaaauaaguaaaucuaaaaaagguuuuaauaaauacaauaagaagcuggcugguggugacagcacacaccuuuaaucccagcacuugggaggcagaggcaggugaaucucaugaguucaaggcaagccuucuggucugcccagugaaauaaucucaaauaaagaacagauaaaaauguccuuaacgauauuuuaaaauauuauauuugagcuaaaugcuagcaucuuuuuuauuaucuuugggcagugcaggaauagaacccagacccucacacaugcuaggcaaguacuauaccacugaaaugcuuuucuuuucuuuuuacuuuuauaaguuuuguuuguuuuuuagaugagguguugcuauagagcucaggcugcucugccucagcuucauaagugcuaaagcauuguagguaugaccacgcacucaggaacuagcaucuuuuuaauggugauaugcuggaagcauccuaagaugucaggggcaagacaaagaugcugccacugccuugauugcuuugauuuacaacaugaauaaaagucagcacuucuugcuauaugcguaaauaccaaucuguuaguagauuugucugaaagcccuuuuuguuuguuuguuuuuuguuuuguuuuguuuuuugagacaggguuuuucugaauagcccuggcuguccuggaacucacucuguagaccaggcuggccucgagcucagaaauccaccugccucugccucccaagugcugggauuuaaaggcauugugccaucacugccguccuuuuuauacuggcuuagaaaacugacagaaacguaagaaugcaugccaaggaguaugucaugcuucuauuaaaaagcuaggaggucuggagagaugaaucagcaauuaagaauacugguucaauuuccagcacccacauggaagcucagaaccauauguaauuguuccaggggauccagugccuucuucuggccacugcaggcacugcacaugguacacauaugcauagaucaaacacucaugcacauaacauuuuaaaaaacugaaaaucuaauaugcaauauaggccuugugucacaucugugauauaagauguauuuaguaaauaucucuaggauaaaugacaaguugauagaggaaaaaaauagcauacaucccugaacauccaaaauacauacacauucaugugugugaguauaauauguacauauagacuuuagugaacuauaaacaacuucuuuagccuacagaggaggaggauuaaagauaaaaaugggaagagaaauuuaauuuuuauuuaacuuuuuuaaugugauuuuuccaaaccauguauauauaauauuuacccuuuccccaauauacuuguuaacauuuuggauuuagcuagcagguagaauuuguccuuuaaagcauuaauuuaacuggcauuuauaucuuuuuccucagcgaccugugcauggauugugccuugcaacuggagaccugcccauugugucguaaagaaauagugucuagaaucagacagauuucucauauuucaugacacaugugaagagauaucauggaccuauuucuacucaauuccagccaauguucaaaaagaaaaaaaaaaccacaaacaucucuaaccaguuguacgcacauugaaacuuauagccauggccagauuuuaugcuaaaauugguaguuuaucaaagacaaauucucuuagucuaauccaacuugccaucccugaauuccuuuugaggccaaggaaggcugaaugucagcaggugggccugugguacuuccaugaaaaauaacagguggcaagggucuccugaauacugaaaccacgccagaauucuucauguuggguuuauuugauuguuuaacacaaaguguuuugugucuuagucuacaguuuuuauuuuggagugaagucauuuuggagaaguaauugacagcgugucuggguuaaguaucacuggucagagaacccagguguguuaagcuuggauauugcacugcaagacuugaaucuauaaacguagcgucgcuuagaucacacaggucauuacuacaaacagcacgaagauccugaaagaaggugcacagacuguagggaaagaauaacaacaaaacccaguuuuuuuuuauauuucagugauuccaaagagcauucuaguuuuuuuaaacuacagaaaauuggugguauuuucauccaugguguuucuauccaguuucaguacccauguuuugugaggaaaauguuuuaccaaugcaggaggaacucuuaaaccaauugcaauguuagacuggagaaaauugguaguuaguguaucuuugagguaccaucaaaucagguuuuuuuguuuuguuuuguuuuuaaaaauuuuuuaaucaguauuguuuugggaaguaauauacuuugaaacucuucaauuaguaaucucuagaagacagccugggaacacauauucuguuguuucaaauaaauacauguuuuugaauagcaaguucaaucaugaauuguugacucugucuucaucaaaaguguuuuauaucccucucagggucucuggugaaggccuucaagaguccacuuuuuucucacaaaaaaaaaaaaaaaaauuggaagguagaauuguaaauuuuuaagacuuauuucauaaugguguaccucagcaacugccuuucaauuuaugccaaguccuuacuuacugaguuuauacuugaacaguagaugucuucugaguuuuacaguguguuaaacucacugcacauccuauuuccuuccuuuccuucuuucuuguuugugguucauuaaaccgguccuacaacggaggcgaucuccuuccuggcuguauguguuggggugcugggguuuccuugugucucucuggucuuccauaaauccaaauauauauauauauauacauauaaguauauauagauauaguuauguguucuuucagcuuguggcgaaugcaguaauuugcauugaagaauaaaauaucuguugcauuuuuuacucuuaag

SEQ ID NO: 4658 - RNA, 7864 nt, Mus musculus
gguaaccauagugacaggaggcggggcugcgagcuccgucugcccuaacacaccggcgggguagccccgcgagaggccggcgggcgcugggcccagccaggagccgcagccccguccucgcgcgaucgccgggcggggcgugggugcggccuucugcgggcccuugaugcaguugaggccgcgcgggucagagaggaucccggcccggcggcgggcgcgguaggaagcggcagggccccgggcccgggccggugacugcggcgccccuacgauggacgcccuagaagaagagagcuucgcgcuguccuuguaagugaagcggccagggucugcucgaccucggccugcggacguccucuggguugcgggcuggccggucgaggcuccgcucuagcggggcguuuucuucccguggccaccacgggcauaugucacagauaaccagcgcuuccaucacaauccucuggccucaaucguggccgucagcaaaaacccagaggccuugagcugcccaggcuggcggcggccucaccgccugucuaaagccacuccugaccaguuacccccuaggccggugccacucccgcgugcggucacauucaccagcagauagguguggcguuaagagccaggaugcggugaguaaauccugcggguaauaaacgcggaaguaugaaguugugccgcaccagccucagcuacccaaauuguuggcugcuuuugugauugucauaccgguuuucgucacgaguguuuuccuguguuuguaauuucuguacuagacaauaauccuugauuggugaaacugagugaugggaggaucaucuugcuauuauuuuuaugcacguugggaaucuuacauuuuaaaaaaugcuagugggcuuuguugugauugccuggugugugcaaggccuuggguucaaugcccuuacccacagaaaacacaaguucagcucgaaaaauaauuauuuggaccggcaccuaauccugauguguuuuuucagcuccuccgccucugaugcagaauuugaugcugugguuggauguuuagaggacauuauuauggguaaguuucgacacuacuaagugacuugugccccucuaguuccuauggucaauuccuugauuuaaaucaaguagacccuugcuuuacaacaauuuuuuaauguauucauuuacauaugugauggaucgugggugggguuguugccaggagacuauggcuauguggagcucagaggacaacuuuguggaguugguucucuccuuccaccuucaugugaguucugaggguugaucucgggucacccgucuuacacagcagugccuucagcccccaagccaucucaacaccccaaaccucugcuuauaagggcaugcagagaaauaaaugugaagaguugauuuucaaaacacaaaacacugaaauuuuaacacaccgcacaauguaauaguaagcaagccauacugaguuuuguugucuuuauaaacaaucugugggucagcaagauggcuuaguguggguaguggcacucgcccacaagccugacaaccuuaguuuaauccccaggguccacaaggugguacuggcucccuaaaguugucuucagacuuccauacacaggcuguagcaggcaugcgccuacuugaaaacaaaauaaguaaaauuauaauuuaaagaagaaagaacccaaaaccuaguauguggcacaccucuauagucucagcacagguggguagaggcaagaagauaggagaguucagguccuggcucugcccucuaagcucucaugccuuuuaauuaauggccauugauugaagguuucagaggagaccaauuuaggaaaccaguuaacuggcagauaggacagagcucuuggccaggcuucaggugauauugaccaauuuuauuucacacaggcaauaagaaaauuuuugguuguuauaucguuuugagcuuuaacauuuucaugcuauagaacagaacauaaacccuaacccucuacagcacuuguccaugcaggaaacugggugucagaucucauuggaucucuucauuuucuuuuguuguuugccuuaggguuuguauuccugcacaaaagcaucaugacuaagaagcaaguuggggaggaaaggguuuauucaccuucauuuccacauugcuguucaucaccaaaggaagucaggacaggaacucacacagggcaggaacuuggaggcaagagcugaugcagaggccauggagggugcuacuuaucggcuugcuuccccuggcuugcucaguuugcuuucuuauagaacccaggacuaccagccagggauggcaccacccacaaugggcugggcccucccccuugaucacuaauugagaaaaugccuuacagcuggaucucauggaggcauuuccccgagggaggcuccuuucucugugauaacuccagcuugugucaaguugacacacaaaaccagccagcacaauguuguuuuuuaguuuuuggguuguuuuugauauuguuuuguuuuggguuuuuuuaagauuuauuuacuuauuucauguauaugaguacacugucacugucuuuagacagaccagaagagggcauuggaucccauuaaagaugguugugagccaccaugugguugcugggaacugaauuuaggaccucuggaagagcaaucagugcucuuaaccacugagucaucuuucuagcccccuugauauuguuuuuugagacaggguuucucugcguagcccuggcuguccuggaacucuguagagcaggcuggucuugaacucaggaauccgccugccucugccucccaaauacugggauuaaaggcgugcgccaccacugcccggccgcuuuauauucuugaugcauuguuuuauugguugguuugguguuaagaguuuuguuuuuagggucuaacauccaggcaagccuugaucuuccugucuucuugccucaggcuccaagaacuaggauugcagguggggcguggcagaggcagguggauuucugaguucgaggccagcguggucuacagagugaguuccaggacauccagggcuacacagagaaacccugucucgaaaaacaaaagaaaaaaaugaguaaaugaaaauguaauuuaaaaagcauguuaaggagaaauaccagauagcucuucaugggcaauuaguguaucgguauggcucucccuggccuucgaucgagcgcucgcguguguucucucucucucucucucucucucucucucucucucucucucucucucugugugugugugugugugugugugugugugugugguuugcccuuuuuuuuguuuuguuugaaacaaguuuucucuauguagcccugucuaccugguuuuugcucuguagaccagaccagcuucauacucaggucccccugccucugccuccugagugcuggguuaaagcugugcaccagcacugccugcugugguggguagcuguaaccccagcacucagagucggaaggauggcuacaaguccaaggccagccuggucuacaauuccaggucagccaagaauauguauuuauggaaauccuaucccaaaagcuaaaaaugaaacagucgcaaggacuuauaagccuggcaagugcuuacuuuaaaagguuaacauuuuaaauuuuagguauauuuuacuaaauuuuaaauuuuacuaaauugcaaauacauuuacuaaauuguaucagaugaugaguuccaguuauugcagagaaacuucauggacaaguacuaccaggaauuugaagacacagaagagaauaaacucaccuauacacccauuuuuaaugaauauguaaguagaucuguuucuccuaccaggaaaauuaagauuucuuugaaaucugaacuuagauccguuaugcauaauuaauauauacuauuaaaaaguuuaaauuagaaucaaaaaaaauguuauaaagcaugguggcaccugcagccaccugccacucaagaggcugaggcaggaggauggcuucaaguuagaagccugccugagcuaccuaguacauuucaaguuaguuuaagcaagauuauuuuuuuaauuaaaaaaaaaguuggcgcuaguuuacuuuuuauauaugccagcacggccggggggguugcugauuagaaucugguuuagaucauuucucucuugccagaucuuggagcuauuccuaaaggguuuucaugaaguaguuggugagccugcaacuucugguuuaaaacaaguuugccuucagcaugcucuugcccucggcugugauaccuuccauguaucugcugugaaagaacagggccagcaaagcagccaguggguaaaacguaaagacaagggagagagcugguuccauaggaguuguccuuggauguccacaugcacacuguagcacauacaugcccacucacguacaucauguacccaguagugauaaguaauauaaaaagcauagggcuggacagauggcucccagaggacugcagagcagcgguggcucacaauuaccuguaacucuaauuccagaggaucugacacccucuucuggucucugccgcugucugcacucagggcuuaugugugugcaggugugcaggcgcgcgcacgcacacgcgcccacacacagggucucagguaguggccagaggacccacaccucccuguuuucgcuguguccugcagaucucccugguagagaaguacauugaagagcaguugcuggagcguaucccaggcuucaacauggcggccuucacaaccacgcugcagugaguugagcccgacucugggucugugcuucucauuucccucuccuagacugaagaaaccccacucucuuccuugucaucacugagaacacuggguggcuggguccugagugggagugggagccuuugcaaggcuuuuuuuuuuuuuuuuuuuuguuuuucaagacaggguuucucuauauagcccuggcuguccuggaacucacucuguagaccaggcuaggcuggccucgaacucagaaauccaccugccucugccucccaaguacacuacccagcagcuuuuuaagagauuuuuaaauguauguguaugugugagagccugcaugaguucauguguaccgugugcauacaggacccuccagaggccagaggagggcuuuaguaccucuagaacugaguugcaggcaauucugaguguccacaggcuacaagaaauaacccuggguccucugcaagagcagcaagugcucuuaaccacugagcccucucuccaaccacucuuaggggggauggggccgggggacagggucucuuauagccaaggcuggucacacgccugauccuucugccuccaccucccaggugcugguagacauaccccaccaugccuagccuaugcaucuugaagggagucugucucccuguucauucacaacgccaucacucugucuuuugcaggcaccacaaagaugagguggcuggcgacaucuuugacaugcugcucacauucacggauuuucuggcuuucaaggagauguuccuggacuacagagcaguaaguuaugacugcuucccuacuuagccucgaggaaccacacagaaauuagagggcagcacuauagagacaacuaccugcccugccuccucugucuuuugucccccucaacccuuauaaugguucguguuaguuugguggcuuuugagaauauguagugcugcuccauucuggccaggaccuuucuauguuuugaugaaacaggcucagagcuuccaaaaaaagaagucucauuaugucacuucaugcaggcuccuuuaaaaaagaaaaaggagccaccuuguuuacuuauguaugcauuuauugagacaagaguguuacuauauacccuagaguuugcuauguaaaccaagcuggccucaaacucagacauccuccugccucaacugccugagaaccuggauuaaaagcauggcacuaugcccauuccuaguuagucauauuuuuuaaauuuaguuuauuauuuuuuauauguauaagugucugccugcacguaugucuguacaccacauacguguaugucuggugccuauggaggccaaaagaucagguaguauccccuaggacugcaauuagugacagucgggugcuaggauggcgggaaucaaauccagguccccuggaagagcagucggugauuuuuaaccaccaagccauuucucgguccccaagaaaggcuagggccauaguugagagaggcaauagccugcuguaaaccugcuugccccucucuguaugcuccuugguaccucacacaccuuccagcuauccccaccauccccccaucccagaugcuccugaauccggaaagcuuucuccauuccuggugucuucaaguucucuugguuucuccuguaggaaaaggaaggccgaggacuggacuuaagcagcggcuugguugugacuucucuguguaagucaucuucuacgccagcuucccagaacaaccugcggcacuaggucccaccuucgcacaaccggugugauugacaugaguucaccagaccagcaggcuccgagaaacaugggcuaaugaugacagguguauccugcaaagacccucugugccacagcccuuuguucaugugaaguauugauaaguccuggaaaacacgacugaccuugcuggcccuuguccagaaacuccuuccccuaguccgcuacccucauguucccugcuccaggugcuucugaguggcuccucaggcacaggcccggguuggccaccucaccugggggcuguccuccagcaacaugguaguguagugugucaacaguguggagaccacacuguugugagcccuucauccugcaggcuuuagugagucuauguucucccaguuuucaccuggguccccuucaggccucagccucaauggggcuuuuguuugggcauguugaucuagggaguuacagaccagcugucuguccugguuucugaaucuccugcgauuacagcuugauuggcuguggggauccaccgagagagcugcccucuacccacaagugaagaagaacucccgaccuuacauuagcaauccuuuuaccagugagugaguccugcuggucuugauguagcccuacuguucucuaugacucuaagcauuauuuuuaagaaacuuauuuuuauagaugaaaacucaggcuaaccuagugaguaugaucuuggaaugcccaugaucaaccacuuaaagaucaaaguauuauaugcugugugcuucguagcugugaguguugcgagugcgaaugugcuuuccgacggguucuccuugcugggcaccagaacaaagaggcugugugcuagaaguggaccgcggcucugucaggacagcaugcgaggugugcuugugcaugcuugugugcaguccuucguguaggccagugagcuggggggguuauuggggguagggacucugcuguuuguuuucauacaaucucuccugcuaaguugaugcuccccugauccagcucagccugggggugggggugggggcaggacacagauuucugguccucugucaucuuugguggacugccaccaaacagaaagcauguguaucacaucucuagaaagaagacgaaaacaguucaaacccuaaugcguacuuuugacuuuaacuuuuauaguaaacagacuccgugcugacuuuccaugugaccauuagacuuuaagggauauaagcuaagcuccguguuuuuuucuguagcugugugucauuuaguacuuuuguaaaaugaguaaaauuugagguguuuggcaagaauaaucacuugaugugcauuguccauuuuaaugua

SEQ ID NO: 4659 - RNA, 7864 nt, Mus musculus
uacauuaaaauggacaaugcacaucaagugauuauucuugccaaacaccucaaauuuuacucauuuuacaaaaguacuaaaugacacacagcuacagaaaaaaacacggagcuuagcuuauaucccuuaaagucuaauggucacauggaaagucagcacggagucuguuuacuauaaaaguuaaagucaaaaguacgcauuaggguuugaacuguuuucgucuucuuucuagagaugugauacacaugcuuucuguuugguggcaguccaccaaagaugacagaggaccagaaaucuguguccugcccccacccccacccccaggcugagcuggaucaggggagcaucaacuuagcaggagagauuguaugaaaacaaacagcagagucccuacccccaauaacccccccagcucacuggccuacacgaaggacugcacacaagcaugcacaagcacaccucgcaugcuguccugacagagccgcgguccacuucuagcacacagccucuuuguucuggugcccagcaaggagaacccgucggaaagcacauucgcacucgcaacacucacagcuacgaagcacacagcauauaauacuuugaucuuuaagugguugaucaugggcauuccaagaucauacucacuagguuagccugaguuuucaucuauaaaaauaaguuucuuaaaaauaaugcuuagagucauagagaacaguagggcuacaucaagaccagcaggacucacucacugguaaaaggauugcuaauguaaggucgggaguucuucuucacuuguggguagagggcagcucucucgguggauccccacagccaaucaagcuguaaucgcaggagauucagaaaccaggacagacagcuggucuguaacucccuagaucaacaugcccaaacaaaagccccauugaggcugaggccugaaggggacccaggugaaaacugggagaacauagacucacuaaagccugcaggaugaagggcucacaacaguguggucuccacacuguugacacacuacacuaccauguugcuggaggacagcccccaggugagguggccaacccgggccugugccugaggagccacucagaagcaccuggagcagggaacaugaggguagcggacuaggggaaggaguuucuggacaagggccagcaaggucagucguguuuuccaggacuuaucaauacuucacaugaacaaagggcuguggcacagagggucuuugcaggauacaccugucaucauuagcccauguuucucggagccugcuggucuggugaacucaugucaaucacaccgguugugcgaaggugggaccuagugccgcagguuguucugggaagcuggcguagaagaugacuuacacagagaagucacaaccaagccgcugcuuaaguccaguccucggccuuccuuuuccuacaggagaaaccaagagaacuugaagacaccaggaauggagaaagcuuuccggauucaggagcaucugggauggggggaugguggggauagcuggaaggugugugagguaccaaggagcauacagagaggggcaagcagguuuacagcaggcuauugccucucucaacuauggcccuagccuuucuuggggaccgagaaauggcuuggugguuaaaaaucaccgacugcucuuccaggggaccuggauuugauucccgccauccuagcacccgacugucacuaauugcaguccuaggggauacuaccugaucuuuuggccuccauaggcaccagacauacacguaugugguguacagacauacgugcaggcagacacuuauacauauaaaaaauaauaaacuaaauuuaaaaaauaugacuaacuaggaaugggcauagugccaugcuuuuaauccagguucucaggcaguugaggcaggaggaugucugaguuugaggccagcuugguuuacauagcaaacucuaggguauauaguaacacucuugucucaauaaaugcauacauaaguaaacaagguggcuccuuuuucuuuuuuaaaggagccugcaugaagugacauaaugagacuucuuuuuuuggaagcucugagccuguuucaucaaaacauagaaagguccuggccagaauggagcagcacuacauauucucaaaagccaccaaacuaacacgaaccauuauaaggguugagggggacaaaagacagaggaggcagggcagguaguugucucuauagugcugcccucuaauuucugugugguuccucgaggcuaaguagggaagcagucauaacuuacugcucuguaguccaggaacaucuccuugaaagccagaaaauccgugaaugugagcagcaugucaaagaugucgccagccaccucaucuuuguggugccugcaaaagacagagugauggcguugugaaugaacagggagacagacucccuucaagaugcauaggcuaggcauggugggguaugucuaccagcaccugggagguggaggcagaaggaucaggcgugugaccagccuuggcuauaagagacccugucccccggccccauccccccuaagagugguuggagagagggcucagugguuaagagcacuugcugcucuugcagaggacccaggguuauuucuuguagccuguggacacucagaauugccugcaacucaguucuagagguacuaaagcccuccucuggccucuggaggguccuguaugcacacgguacacaugaacucaugcaggcucucacacauacacauacauuuaaaaaucucuuaaaaagcugcuggguaguguacuugggaggcagaggcagguggauuucugaguucgaggccagccuagccuggucuacagagugaguuccaggacagccagggcuauauagagaaacccugucuugaaaaacaaaaaaaaaaaaaaaaaaaagccuugcaaaggcucccacucccacucaggacccagccacccaguguucucagugaugacaaggaagagagugggguuucuucagucuaggagagggaaaugagaagcacagacccagagucgggcucaacucacugcagcgugguugugaaggccgccauguugaagccugggauacgcuccagcaacugcucuucaauguacuucucuaccagggagaucugcaggacacagcgaaaacagggagguguggguccucuggccacuaccugagacccugugugugggcgcgugugcgugcgcgcgccugcacaccugcacacacauaagcccugagugcagacagcggcagagaccagaagagggugucagauccucuggaauuagaguuacagguaauugugagccaccgcugcucugcaguccucugggagccaucuguccagcccuaugcuuuuuauauuacuuaucacuacuggguacaugauguacgugagugggcauguaugugcuacagugugcauguggacauccaaggacaacuccuauggaaccagcucucucccuugucuuuacguuuuacccacuggcugcuuugcuggcccuguucuuucacagcagauacauggaagguaucacagccgagggcaagagcaugcugaaggcaaacuuguuuuaaaccagaaguugcaggcucaccaacuacuucaugaaaacccuuuaggaauagcuccaagaucuggcaagagagaaaugaucuaaaccagauucuaaucagcaacccccccggccgugcuggcauauauaaaaaguaaacuagcgccaacuuuuuuuuuaauuaaaaaaauaaucuugcuuaaacuaacuugaaauguacuagguagcucaggcaggcuucuaacuugaagccauccuccugccucagccucuugaguggcagguggcugcaggugccaccaugcuuuauaacauuuuuuuugauucuaauuuaaacuuuuuaauaguauauauuaauuaugcauaacggaucuaaguucagauuucaaagaaaucuuaauuuuccugguaggagaaacagaucuacuuacauauucauuaaaaauggguguauaggugaguuuauucucuucugugucuucaaauuccugguaguacuuguccaugaaguuucucugcaauaacuggaacucaucaucugauacaauuuaguaaauguauuugcaauuuaguaaaauuuaaaauuuaguaaaauauaccuaaaauuuaaaauguuaaccuuuuaaaguaagcacuugccaggcuuauaaguccuugcgacuguuucauuuuuagcuuuugggauaggauuuccauaaauacauauucuuggcugaccuggaauuguagaccaggcuggccuuggacuuguagccauccuuccgacucugagugcugggguuacagcuacccaccacagcaggcagugcuggugcacagcuuuaacccagcacucaggaggcagaggcagggggaccugaguaugaagcuggucuggucuacagagcaaaaaccagguagacagggcuacauagagaaaacuuguuucaaacaaaacaaaaaaaagggcaaaccacacacacacacacacacacacacacacacacagagagagagagagagagagagagagagagagagagagagagagagagaacacacgcgagcgcucgaucgaaggccagggagagccauaccgauacacuaauugcccaugaagagcuaucugguauuucuccuuaacaugcuuuuuaaauuacauuuucauuuacucauuuuuuucuuuuguuuuucgagacaggguuucucuguguagcccuggauguccuggaacucacucuguagaccacgcuggccucgaacucagaaauccaccugccucugccacgccccaccugcaauccuaguucuuggagccugaggcaagaagacaggaagaucaaggcuugccuggauguuagacccuaaaaacaaaacucuuaacaccaaaccaaccaauaaaacaaugcaucaagaauauaaagcggccgggcagugguggcgcacgccuuuaaucccaguauuugggaggcagaggcaggcggauuccugaguucaagaccagccugcucuacagaguuccaggacagccagggcuacgcagagaaacccugucucaaaaaacaauaucaagggggcuagaaagaugacucagugguuaagagcacugauugcucuuccagagguccuaaauucaguucccagcaaccacaugguggcucacaaccaucuuuaaugggauccaaugcccucuucuggucugucuaaagacagugacaguguacucauauacaugaaauaaguaaauaaaucuuaaaaaaacccaaaacaaaacaauaucaaaaacaacccaaaaacuaaaaaacaacauugugcuggcugguuuugugugucaacuugacacaagcuggaguuaucacagagaaaggagccucccucggggaaaugccuccaugagauccagcuguaaggcauuuucucaauuagugaucaagggggagggcccagcccauuguggguggugccaucccuggcugguaguccuggguucuauaagaaagcaaacugagcaagccaggggaagcaagccgauaaguagcacccuccauggccucugcaucagcucuugccuccaaguuccugcccugugugaguuccuguccugacuuccuuuggugaugaacagcaauguggaaaugaaggugaauaaacccuuuccuccccaacuugcuucuuagucaugaugcuuuugugcaggaauacaaacccuaaggcaaacaacaaaagaaaaugaagagauccaaugagaucugacacccaguuuccugcauggacaagugcuguagaggguuaggguuuauguucuguucuauagcaugaaaauguuaaagcucaaaacgauauaacaaccaaaaauuuucuuauugccugugugaaauaaaauuggucaauaucaccugaagccuggccaagagcucuguccuaucugccaguuaacugguuuccuaaauuggucuccucugaaaccuucaaucaauggccauuaauuaaaaggcaugagagcuuagagggcagagccaggaccugaacucuccuaucuucuugccucuacccaccugugcugagacuauagaggugugccacauacuagguuuuggguucuuucuucuuuaaauuauaauuuuacuuauuuuguuuucaaguaggcgcaugccugcuacagccuguguauggaagucugaagacaacuuuagggagccaguaccaccuuguggacccuggggauuaaacuaagguugucaggcuugugggcgagugccacuacccacacuaagccaucuugcugacccacagauuguuuauaaagacaacaaaacucaguauggcuugcuuacuauuacauugugcgguguguuaaaauuucaguguuuuguguuuugaaaaucaacucuucacauuuauuucucugcaugcccuuauaagcagagguuugggguguugagauggcuugggggcugaaggcacugcuguguaagacgggugacccgagaucaacccucagaacucacaugaagguggaaggagagaaccaacuccacaaaguuguccucugagcuccacauagccauagucuccuggcaacaaccccacccacgauccaucacauauguaaaugaauacauuaaaaaauuguuguaaagcaagggucuacuugauuuaaaucaaggaauugaccauaggaacuagaggggcacaagucacuuaguagugucgaaacuuacccauaauaauguccucuaaacauccaaccacagcaucaaauucugcaucagaggcggaggagcugaaaaaacacaucaggauuaggugccgguccaaauaauuauuuuucgagcugaacuuguguuuucuguggguaagggcauugaacccaaggccuugcacacaccaggcaaucacaacaaagcccacuagcauuuuuuaaaauguaagauucccaacgugcauaaaaauaauagcaagaugauccucccaucacucaguuucaccaaucaaggauuauugucuaguacagaaauuacaaacacaggaaaacacucgugacgaaaaccgguaugacaaucacaaaagcagccaacaauuuggguagcugaggcuggugcggcacaacuucauacuuccgcguuuauuacccgcaggauuuacucaccgcauccuggcucuuaacgccacaccuaucugcuggugaaugugaccgcacgcgggaguggcaccggccuaggggguaacuggucaggaguggcuuuagacaggcggugaggccgccgccagccugggcagcucaaggccucuggguuuuugcugacggccacgauugaggccagaggauugugauggaagcgcugguuaucugugacauaugcccgugguggccacgggaagaaaacgccccgcuagagcggagccucgaccggccagcccgcaacccagaggacguccgcaggccgaggucgagcagacccuggccgcuucacuuacaaggacagcgcgaagcucucuucuucuagggcguccaucguaggggcgccgcagucaccggcccgggcccggggcccugccgcuuccuaccgcgcccgccgccgggccgggauccucucugacccgcgcggccucaacugcaucaagggcccgcagaaggccgcacccacgccccgcccggcgaucgcgcgaggacggggcugcggcuccuggcugggcccagcgcccgccggccucucgcggggcuaccccgccgguguguuagggcagacggagcucgcagccccgccuccugucacuaugguuacc

SEQ ID NO: 4660 - RNA, 4563 nt, Mus musculus
gggagaacccuugcacgggugcuagcucucccaaaggggagaguuccacaugagggaggggaccuagcgagcuugcugccaucggaaacuguuguaaccaacaguuaucagaaaucguccagucccagaaaucccaacucuuccuauaaaagucucucuacaggugacagguuggcauggggcaggggaggggacggugggaccagaagagcccggggcuuacuuggcuuggggacaaagauaaucugucuuuuguuaggguuauacugaggcaggucagaggcugagggucuguuagugcauuuagugcuggugaacaggguggcccagccugggcuacugaaguucucugaugacaaggcagagcuccccaaaccccaucaccuucugcugaauaagggagguggggaggauguccccaccccuggcucuuggccaguuccaucugugccaguguaggccaguuccucaggagugcuggagaguuugaguccaguaagcuuagggggugacccugugcuaagacccagccauggcucaggccacagcauagcuggcuuaggaguagcccccagccaucugacucguggccgcguugcuacccacuccucgccaggccuggaagcugaagaaagcgcucacuccguaggcaaucaucaccagacaagcaaagaacuggcaggggagaaaaagaggccaagggggucagucagagagagccaggaaaccacauggggacagugacaccagaccaagugggucuccucagagggacuuggggauggaagcuugagcagcagccccuuggguuaaucagagccacuuguucuggcagccacaccccuuaugcccacccacccauaccacacaucuggcauuauguucuaagggucaggggcaagaacuacacaggccagacaugucagauggugccaggcacagcacucuggagugacagugggguaacuuuauauacauaagggaccuaguguccacaaguaacauucagggcuagggauguggcucagguaaagcuguugcccagccucccaaggaccugugguuccaggcccagaacugaaaacaaaaacaaccaguaauaauacuccaggcucccaggaguuuucugaaucaguuuuguacccuguauguggcgugugcuuucagaggcuugagucuccguucccaagauggaguucacuaauuuuaaaccacucucaccaggaagauggaagacaccacgcauuggcuguccuguccuggacaugaccacaacuccaguuuccuucucuaaaaaagaacccauagucucugccuuuagacgugaacuggguagugugaauggccgucugacacaguccaaguuuggaauuuuuauaagagaauacuaguaaaaaaagaaauguagacggaaugucuagugaugacagccagccugaggugacaaugugacaguguccacaguggaucccaugcauucagguccccuugaguucugcuguucacuaaggaaggaggcccacugagcauccagccagugacaacucagacaggagccugugaguucacaaaggccugggcuggauacccugcagaaggcuggagccugggacauacuuacagaggcagcugagcgcugguuauauggccgggagccccucagggaugucagaucgaccgccgcugcacaggcgauaaaggcaguaauguagagaaccguggcagcgacaaaaaagaucaguaacuguagggggaagggcgagaggcauaagcauccacaaagaacaucaccaccuugaagcccugacgggaaggccugaaguguugggacggugccaccacaacgagccacuugccucuaaccagcuaaagaaaugccaucucuuguguggcacacgccaugcccauguucuuccuaugaccacaucagcacuuggccaugugccuggcccucacaucccucugcccaccagugggagaaaucuaugacucccuuauacuauccuaaacucaagggcaaauaacagggccaggguccuagggaaucucuacaaagcaccaagaagacuggaugugagccuucagcuggcagcggggccuguuccauacccccaguggaugccucuuguccucaaaccggucuccagccauuuauugugcuauacauuuuuaauugccaacauuuaaaauuagauuucaugugaaaacuugaaaauuucauauuaaacauguucaagauuucuggacauagugguacacaccuguaaucccagcaucucaagaggcagaggccaacuuggugcauauagugagaugcuauaucaaaauaucaauuaagauaaguaguuguagcucacaccuuugaucgcagcacacaggagguagaggcaggccgaucucugaguuuaaggccagccuagacuagugaguuccaggucagccagggcuacugagaaaaccuagcucaaaauaaaacaaaacaaaacacccucaaagcugggcagaguagcuuacaggagccagcaugucagacacaaagacaggaagaccauggauuccaggucagucgggccuacacaucaaaacuguaucaaaaaaacaaagcaaacagcuaccucagggcugggcauguaucucaguguaaagcucugcauucaugagguccuggauuugaucccuagcgccaucaguacaacaaacaaaauaccucaaggcuuggcaccagugggccacauccucucaagguugaagccgggcagaggcagcuucucagggccagguacuuguuagguuucuagaaccuuccuggcccaguucacuaguccaucuuaccugacccuuuauauuaaacauguccccagaguugagaagggucaucacccaguuccucucccagcucagcccagcagcaccagacacagcccccagcugaccuccuucacuggcgcugugcugugcugccagccuugccucagagacagaggucuccagccuuguggaauucuucuuuaggggcuugggauauucagaagggggcuagaccuuuagccaggaguccagccaccgccaccucaaucccaaaucuuguccccaaguacagugaccacugcacacccugcccggcucuggcuagcgagaccaggaucuaacaaacccauucugucucggcaugacucacguuuccucucgcuaaacaagcauugaauuguaaacaaucgcugccuaguuccagccucgccugccuuacaaucaugcgccucugugcucacuaaaaggcucagacccagcugcauggguuuucuggguuccagaaaaaaaaaaaaaaaaacccagccagaggagccuggccugagacaaaccuggggcacccauucucuccagagagccagggccuggagagaauggaggcagcuggcacugacaaacccagaccuccgagcucaaaauucugaucccccucaagaaagaacaauaucccaagauucccaaggauaucugcagagucagucaauagccucucgaugcuggucucuuccaagcaccaagucaaacacuccacuuccgucauuaacauaccuucccaccccagcuccucauguagcuaagaggcaggaggauggcaucacacccacccaccugcccuccauuucacauuuauggaaggucaagaggucccguccuagccauucacagacgagaggacucagccuggagccgcacagucccugccccaaacucaccaccaacggccagggcaccauguacaacuucaugugcaguugaaacagguagaugaugaagaagacgauugucaccagccagaggaagacagcgacaaacaugacccagccauaggcaggauacagaugguauggggugucagcaaucagggcccacaccagcagccccagugccuguggaaaaauaagggggaguuucucagagcugaacagcuccagccggaggcucgggccuuggcccccuuucuuguuaacucaaaaaguuuaggcuggcaagauggcuaagaggguaaaauguuugucacaagccugacaaccggaauucaauucuggaacucagguguaaggagaaaagugacgaccagcgguuguccuccagccuuucuguguucacuguggcauggaacauggucacacgcacguacaauuaaaaacagcuucuucaaagaaaucuugacuccuguuguuuacaucugugcugggcaucuugucuggccacucuucccccuuucaauucccaucaugcugugugacaaaaggcucuuccccggugugacgguuuguauaugcugggcccaaggagugacaggauuagaagguauggcccugcuggguagggugucauuguggguguagguuauaagucucacauucuagcugccuugaagucagucaucugcuagcagccuucagaugaagaugaacucuccgcuccuccugcaccaugccugacuggauucgccuccguucuugccuugacgauacuggacugaaccuuugaaccuguaugucagccccaauuaaauguuguccuuuauaagac

SEQ ID NO: 4661 - RNA, 959 nt, Mus musculus
ccaggccuaucugccugucccccugaccuccuugugucuccuggcuuugcugcagucgccagcccuucuccuccccggccagcugcggugcuaucugcccuaugucucccucuauccccuguacagagcgcaccaccaucaccaucaacaccgcuguugugucuuuucuugcaugagguuaaagcuguguuuucuggagcucuccgggaagggagacaagcuugcgagaggguuuaaaguguuccuccccagacuuggaugugcugugaaggcaugcugcgucugaaggaaggguccaguccccacucggcuaccagcaccacaaagugccccaccuguaaaaggaaagaaacgugguccagagcuggcaauaaccuauggcccugacaucaucacuuucucugagauccuugucuccaccccugggugcaaccccaccccuuaucaacauuaauagucacugccauuccacuggacugacauuuuuguacccugugauucugagggcuggcaaggaguggcuugagagugcagaucguacccuguaugccccccccccaaauggaggcugaguuggggacuugcaggaacagaggccaacucagauggcuuccccuguguucucacuagaaaccccucccccaugcaccaaggugacagucacaggucugcccuggcuaaaggacaagccacauaggaaagauuaggacaagccccucggaggcagaggauccaggguaaaccccuggaguggccacaaacccaauuucaguguagggacuugugcauguguguacuugcauagucagacagaggcugccaggguccuuuccugucucugagagcaguguucacgccaaggacucaccuuugcccccauugcaggcagggccagaacucccauagcauucuccaagagcccugugacauuuucuggaagggacucugcccugggcgca

SEQ ID NO: 4662 - RNA, 1586 nt, Mus musculus
cugagggaggaaggcuuuauuccguugcuuuuuuuuguguucgccuguagugcauaagaguccauaaaaaagggaacagggacuucugcucuguggcugcucuugggcucugcuggucacaggccguuuuauguugaaaccauggacagcagcccuggcgucuccaaaugccucagcgggaaggucauggccuuggguuuuucaccaaucugauggccuucuucacauguuugucuuuggggucugcacagaugagcuugcccuggacagucagaaaccuauguaggagaaagcagugaguaagagcccaggaaggccuucaggguuuggccaccagccacaucugcauugaccugaacacugagcaguaggacuucaugccuagccuccucucuccucagagcaccuugagccugagagaaagagccucaggcuguguguuagucucuacucagcucagacccagagugagaggugacaguauuacugccuacuggcucuguuaccugggauguccuauccaucuuggaaacucaguuucaccauacauaaagagguuggacccccucagcugugugggguacaagaguaucccuggguucccaaaacugccuuuaggggaaucaggcuuguccucucuuccuucuuucccaguggccuuccugggcacuccaaggcccacccacuucccacucuggguucuaggcagaggagugggacagagggauacucacacgauggcaucccuggaacacuccacugaggucuuauaccagcucaccaacuuccugauaggaauggccccuuugaaguaauccaggcagcacucucggccuacauugguggcucgagcuggaagagcaauaggaagcagguguccugagagucaggccaugugccugaggacccauggaauguuccgauguaugccugugugagccuguggguggggacugcauguacuuuguauucuguuuguucuuggugugugugugugcucuccugugucugcaaguuugcauauucaucugugugugucugcauaugcagcugucugaaucuaggaaccucauuucaacuucccguucuaaacuaaauauaaaaaucuuuucauacauucuuggaaccaaugcuccguuguuauguuguucccugaugauacaugaagcccauuaaugaaacaaaugguagcgauucugagaaucguucguucugcaucaugagcccacaaucaaggccacuauguccuaacaucucagaauaagguauguguccaggucaggcaccugacaucaucccagcauccucagaaccauuauccucccuccagugcuccuguggccacccccuggugaccccuguuaagaacagacaggguauaagucacacagcuugugucucugccuuggucucugugugggugaaugguucccaucugcccuauccugucugugcccggcucuuaccagcucuggcaugcugcagaaaaguccccagaagcagagcagccaggagcagcaucugaagugaccucaugguaccaaaagcugaggugaaggucuucauggguccuucugccugucuug

SEQ ID NO: 4663 - RNA, 16578 nt, Mus musculus
ccgcacaacaccugaguccuagugagcggacgcggccccacugacgcgugacgcugcccggcgcgucgccgcccucagcgugcgugcgugcccacuuccaagauggcggcgacagcagccgugucugguguccucggccgcuugggcuggaggcuccugcagcugcggugccugcccggugaggugacagccagccgagccggggcgcgagggggaaaaacgggaagaaggcgcagggcggaucugggcuuggcgugggaugauagaggcucuggucggggcuagcaagguaaagggcaucggcguggagccgcuggagucgcgagcuggaaaaagccacuuaaggguuucagucgccggacuuugagcugugagggggcaaaagccgcggggcaguccugucaccccgguuccccagagguaauggagcuucagagagggcucggugugcccaaggucacagagcucguccguuccaaagcguucuccgucgccguaggcgcugugccagccucgcuggagaaaccgaccgaacagccacagagucaguuauugccacaccacgucacuaagcuggugacauucgucauuugcugccauaugccccguauuuuuaucuccacaguaauaguagacauuuacuuuuagaaacuuuguacauugucauuaaguggaaaagcaaaaaucgcuguccguauauagaaucuuucugcacugacacagugacaaaaaauaugcaacuaaaaucuccaugaaccgcagagaucucgcaaccauacuuugggggcuccucacuucaaauuuucugggccuauagcaaaugcugauguuguuaagcaugcuguucuguguuucuuuccuuauuauuuucaaugacuuccuuuguggcauuuuuagcuagaguuucagacgaaauauguuuaacaaaaauaaugcaaugugagccaacaaauccagucauaggguauuuacccaugaaauuguguccacaaaaaguucaacuguauucccgacaacuuuauauuaggugggcccuuaaagcccaaacauucaucuuuuuuucaauguuaugcaagcaguuuacaacagguaucuccgaaguaaccguccccuuucugaaguauuugagauaaagucucacucuauauuucuggcugaccuggaacucacuguaauauagaccagacugaccuggaacuuagagagauuggccugguccugccuccugaguguuuucuuucuuuuuuuuuuuuuuuuaaucagaguuuacuuuuuuuuuuuuuuuuuuuuuugguuuauuuauuuauuauauguaaguacacuguagcugucuucagacgcaccagaagagggcaucagaucucuguuacaggugguugugagccaccaugugguugcugggauuugaacuucggaccuuuggaagagcagucgggugcucuuacccccugagccaucucaccagcccccugagugcucuuaaaagagugugucaucaugcuuuucuuuuuuauuccuuuucuuuuuucuuuuuuaaaaacuuguuaguccugccucagccugaguuauauaggaagucuaugucucaaaauaauacgggcuggccuuuugauuuguguguguguguuuguguuuaaagcagaugaaguuuaacaaagauguucauguaggcuugagcacagugguuguggaaaaaagacaggcacucaaaagaaagugagacagauccaggaaaauggcuuuucagagauuuauaaaacauucaaaacauuucuaacuguugucacagacuaugaguuaccuauacuguucuuguaaaauacacuaauuaggaggagagggagaggcucugcaguuaagagugcauccugcuguugcagaggaugcuaaguuggcuucccggcacacacguugggcugcucacaacuaccuuaacuccagcaccagggaaucugaugccuucuuccuacccccacacagauugacacaauauacauaauuaaaagcuaaauaauggucuggagagauggcucaguuguuaagugcacuggcuauucuuccagaggacccaacuuuaguuccugccagacacauggauccagcagccccucuagccuccaugaacacaaagcaugcauauguagcacagacaugcauacaggcaaaacacccauacacauaaaucuagaauguauacuaagcagggcuugagaaauggcucauuaagagcacucacuguuuuugcagcugcccuggguucaguuccuagcccccucuucucaucuuugugggcaucaggcagacauguacacauacauacaugcaggugaaacacucauacacaugaacaaaucuuuaaaacuuagccagacaguggugggacaugccuuuaaaaagccuuuaaccccagcauucaggaggcagaggcaggcagaacucugaguucgaggccaaccauaucuacagagugaguuucagaacagccagagcuacacagagaaaaaccugucuugaaaaaccaaauaaccaaauaaauaaauaaguaaaauauaugaaacaaaagaaacuuuagagaaaucugaagacgagcaaaaacucacccagagugugaguuucagaucagaagaaugaggacugacugaaagcugggggugggggggagauuuucugggugauggucaugucugccuacauaggauucgaguucuacaaguguaugugucugcauugcgaacaggacuguguuuaagauguguauauuucaucuuauauaaacagucccuaaaggaacaguaaacuguuacaugggcugaaauguuggcgcugaggauuccugagaucugcaauaaguaugagaguaaagugguuagugagcacaugauaagugugcagcagcuagaaggauaugcaaauguucacagcuccuucaacuugucuacauguuugcagauguugauguuaagauguugggaaaggggaauggagagaugguuccaagauuaagagcacugagugcucuucuagaaguccugaguucaauuuccagcaaccacaugguggcucacaaccaucuguaaugggaucugaugcccucuucugguaaaucugaagacagcuacaguguacucaucacauauaauaaauaaauaaaucgauagauagauaaauaaaauguuuuuuaaaaaugcugggaaagaaaacaaguaguuucaaacacuacugguauuuccuaaggucgugaggcugcaggggcuggggagauggcucaaggguaaaaugcuugagugugagaaccagaguucugguccugagaacccucauaggaugcagcaugugauggugcaugccuuugaucccagcacucaggaggcagagacgcagauuucuggaaguuugaggccagccaggacuacauagugagaccuugaccaaggaaaggaaggaaggaaggaaggaaggaaggggaaggggaagggaagggaaggaaggagucuccaaagguggaaucuagggaucucuagugcaggcuggcuaguauaagauuagccauccgcucuggguuugauugagagagccuaccuuagugaauaaaguggagaacagaugcuuugggggugauucccaaaguugacuucaaacuuccaccuaccugugcaugcucacccacccacauacaugcaaacaugcauauguacacaauacacacaaacauggaaagggaagaaaagaaaggccauguaaacacuuugaaggcaggcacuguuauguucacauuuugguaccauaacaacauuguuauugaacaaguagagauuaauacucucaauuugugggguguuuaagcugcauauuaaggggccagcaauaugguucagugggugaaggugcuugacacaaacuuagguaccugagcuccauugccagaaaguguguaaggguagaaagagagaaccaacuccacaaagguguccucugagcuccaaacauggaauaaaucuccaugcacacaguaauaauuaagacaaauauuuuaaucugcauauugagggaaaugcuuuauacaggccauauaggugaccaaugguuggaacagaucaggaggacagccaggucuugugcuaacugcauuacaugccucaaggcuccuguuugacucaagaugucuauggggcacucagcacuggagugaguggcugcaggggcaucccugcugcgcauuaacucugcaucaccacucugagucucagagggucuuccauggugaaccuucauaaccaacagucuuguuucuguuucaguggcccgcugccgaccagcucuggugccacgugccuuccacacugccgugggguuccggucuucagaagagcagaagcagcagccuccccacucuucuucucagcagcauucugagacacaggggcccgaguuuucccguccaccccccaggucugcacuaguguccacaucugccugcuccuggcaaccucgaaugcuucagaguguaccucuuuccucaccguccucuccugccuucacacagaugucuucuucuccuuccuuccuucccuuccuuauucccucccucuccuuuuccuccccuccccucuucuccucuucccuuuuuucuuucugauagggucuuguuauuuagcacuuguggggguuuuuuuuguguguguauuuuguuguuguuggggguuuuuuguuuuguuuuguuuuggagauaggguuucucuguguagcccuggcuguccuggaacucacucuguagaucaagcugaccucaaacucagaaauccaccugccucugccuccuaugugcuaggauaaaagguguacaucacuacuacccagugcuccuuugcguuaucucucucucucucucucucuguguguguguguguguguguguguggguguggguguggguguguguggguguguauuguuccuguugagcgggugguacuuacuauguauccucaggcugauacccuaaacuugccuugaugucugggaaucuuccagccucagucuccuaaguacugggauuacaggugugagcuacugugcuuggcuacuuugucauuucuaaggcuaaaagcagugccuuuucguuuuaggaaauauaagccuuguggaaaacacuugcaaucauacccagagauaacucaguuaacaaaaaaaaauaucuuuuagauauuucuauuucuaauaaguuuuuuuuuuuuuuagcugagaucucacucuguagccuaggcaggcuuugaacccaaaacucuuccugacucagccucccaagugcucagauuguagaugggcaccauaggcugcccaacaguagauuuucaauguccuuuggcacuuuguaucauuacaucugcuuuccuuguuaauccugccacuggaaacugaacuuucucaguguucaucaguucauuucuaauguucuguuuguuuugagaaaggucucacuguguagcccuggcugggcuggaacucuagguagacuaugcugaccuagaauucagagauccgccuaccucuuucucccaagugucagguuaaagguaugugcuuccaauaccagccccaguuuuucuaguuuuuuuaaguacuuaaaaaagauuguguguguguguguguguguguguguguguguguguguguguaucuguugugguauggcacaugggugcugguaccagaaggccaagaacaaagcaucagaucuccuagaucuccuagagcuuaacuaauaacagcugugagcugcccgaugugggcgcugggaacugagcucagaucuucuacaagaguaguaaaugcucuuaauugcugagauauucuccagacccuauuguuuguuuauugauuuauuugagauguucucagguagcuaagacuggccuuuaacucugaacuaaccccaucucaaccucccauggacugggaucgccagcauauacccagcuaaaauacuacgcaauucaacaaguauuuuugaggauuuaugccugugaauagaauaaccaucuuucaugcucucuuggacuuccagccuggugcagacauaagaaaagccuuuacauaaccaugugcuagcaggaguguccagccuaugaccugcaguaugaccuacaaauguacugagccauagccauagcucucccagguugucuaaggaugaucagcagaaaccagacuccugcagggccauugucuuuauagcauaagaacucaaaucccuggacacuuucuuacugugggaggagggaaagauaguaggauucaaaccuuguugguauuguaacacccauacuaaugcagaagugaagccccucucagcguguucagaggagacucagaaccucugcuucugguuggcucauccugcauucccggcugggguguagacagugaggugugaugugugcuuuguucuguaucucagguacacagaccagaguggagaggaggaagaggacuaugagagugaggagcagcuacagcaccgcaucuugacagcagcccuagaguuugugccugcccauggcuggacugcagaggccauugcugaaggagcccagguaggcagagaugaggguggggcugcagacccaaaugaacccagagugagaaccacaaagggccucaugcuuccagccugggucagagcugcacagcuacggaauugucuggguuuucuuuuccuuucuuucuuccccauuggacugucucugucucugccugucugccugucugccugucuauagacagagucuuucuacauagcccuggcuguccuagaacuuacuauguuaaccaggguggccucagacucacagauauccuccugccucugccuguaugcuacacaccaaacuguuuuuuaaaagaauguaccauagaguuggcucuugggaguuauguccucaagcagcuuguuuuguagcagcaguguuuguugguuguuugugacagggucucucuguguaguccuagcugcacuagagcuuccuaucuagaccaggcuggccuggaacucagaaagauacuccugucucugccuccaccacugccucuuccucugccucuccgccucucucuaucucucauugccucucugccucuaugccccugccuccuaagugcuggaacuaacgguaugcaccacuguaccuggcuuaagcagcgcuguuuauaaugcauugauuuaaaauaaagaaaugcuggcgugcuacagugcuuuccuagcaugcacgaggcccuggguuucaucuguagcaacacauaaaaccaagugugagccagucgguguuggugugcaucucugaguuugaggccagucugguccacagagugaguucugagauagccggggcuacacagagaaacccugucucggaaaaaaaaaacaaaaagaaaaagaaaaccgaaacaacaacaacaaaaacccaaguguguugcacaucuguaauuccuucaugacucagaagacucagaagguggagucaugaagcugagagguugaaagggaauuguacucagggguacagagugaacgcaaggccagccugcacuacaugacauccucccgcccucccauaggaaagcaagaaaagaaaggcauugucacuaagcugugauaugucaccaguucugugaagcacacugguuuuguuuuaaauuauauuucuuuacuucuuguguguauguaucuagugugugcacauguauagaagucaucuguccaugugggucucaggcauugaauucagguguccugcuugcuguggcaaccuugggccuuuucucugaugagccaucuuuauguccccuuuuguuuugguuugguuuucuuuaauuuagagucguuauagagccagggccagacaagacugcccugaaacuuguccugcugacucuaccuucuaaauacuagaauugcaggcaugugccaccaugcccacagcuuucagugccuguuccuuugacaugaaaaaaaaauaauaacagucuauucuuuaaauacuuacuaagcaaugauguguagcaggcacugugcuagagauggugacagugaacacaugagaguuccuccucuuggucucgguccaauaauauuuuucuuuaaacuuaaggauuuguuuuuauuuuguguguguguuuuugcccacauguauguauaugcaccauguauguaccugugccuaaggaggccagaggggguguugaaucucaugggacagauggccaaggugguugugagcugccaaguagguguuaagaucagugagcauucuuuuuuuuuuucccuuaagauuuauuuauuuauuuuauguaugugaguacacuguagcugucuucagacacaucagaggagggcacuggaucccucacaacacaugguugggagccaccaugagguggcuaggaauugaacucaggaccucuagaggagcagugugugcccaugagagaacacuuucaaguauguguucgucuaaccuaguguauuucacuuaucagauugacacccaguuccgucagcuuuccugugaaugccuuccuuuuguucuuuacaucugaacacacuucuuuuauguauacuugcaauguuuuccuuaucuguucaccugcuaaugggcagaggagacaggaucuaugccuugacuguugagagcaguauagcaaaaaacacgaauguacaagcgucuuuguaaaugaugacuuagccuccuuaaagcacacaccaaggugugcuauagcuagaccugacaguaguucuuuuucaguuuguugugaaccucaauacugauguccacagugccuguaccaguuuacuugccaccauuggugucuaaaauccccaccgucuuuaccaacaagcacaguggcucaugccugaaaucccaguacuugagagaggaauaucacuacaaguuggaggccagcgaacgccauaguccaggccagccugggagagugaaguacuccccagacgccucuuuucucuuacccuuggcaucauuucuugucacuuguuuucuugaagcuagccauucugaccaggguggacuggagucucaaagcaauuucuuguuugcuuuaagauagucaccuguuggcuagacugggcucagguuugcuguauaucugaacuccaaacuacggaucucccugcuucugccuuccaaggauugggauuacaaguuugugccaccgugcccagcccucaaagcaauuuuguuuuaaaugaaauuuauuguuguuguuguuuuguuaguaguauugaaugugggugagugugugugugugcacaugcgugcgugcacgagagagagagagagagagagagagagagagagaagagagagagaaagaaagagaauauaugccaacaccacuuguagccaggcgugauggcgcacgccuuuaaucccagcacuugggaggcagaggcaggcagauuucugaguucgaggccagccuggucuacaaagugaguuccagcacagccagggcuacacagagaaacccugucucgaaaaacuaaccaaccaaccaaacaaacaaacaaaacccgccacuuguagggcauugguuccccuggagccagaauuagaguuaggagguucuaagcuacccagugugggugcugggagcugaacugaaacuagggauggagcuauauuuccucacaggcuucauucucugggucuagcauugugcuuguguacuucugauuuguuaacauccagcccuccuucaagcuggaggugucaagcaaacauagggaucugaacuugaacucgaggagcuagcagaccuccagcuggcuguuagaguauucuagcaugugucaggaugugagcauauggguagacggcaagagcauaaaguggagaaagaaucccaguguucuguggugacucauaccuguucccaacacuaggagucugaggcaagaugacugcugcacauuugagggcagccugggcuacauauugagagccuaucaagagaagggcugggaagaaggguauagggguaggucuggguuacagcaucuugguguuggagaaagaaaaaagccgucuucuguugguuacuauagcaauaacuauugggguccugggccagauucagagggaggagcuguggcauggaagaaguggagaaccguuaggcugacaaggcugucaagcagggaaggcagacuggaaggcgagcuuggcugaacacuugagggaagaggagggaaucguaaguaaggguggagauaauagaagguggcaggcaaaaccaaacccacgugacucccaaggcaggaguugcaagauccagagaacagguggaaggaccggccucagacauguuaggaacagaguuggggaaggcagccuuggguuuguuguuuuuuuguuuguuuguuuuugagagggucuuccuaugcagcccuggcuauccuaggucucacuagacuaggcuagccucaaacucagcaggcuuaguuucuaaacauuaagggaguugcuaugggaugacuuuuguuuucuuugugugcaugugauagccuggagaaccuaaggucaggaaggaguagaggguagcagaaauuugugggagagggaagauauugauggaacaaaugugagagaguguaauaggauuguuugggaaaauuggaugaaagggaauucucuguuaagaggcuuuccacaccuggucaucuuccuuugugcagggugugugauaccuauagacccugccaacccaguuugugggagagagcuggaagccucaguuucuugcuuuguaaaguauagccaugacaugcccacugaauagagcagugugcaguuuggugagacggggagugcagugugcacggucgccugcaguggucaggcagcugcuguucauguaauagccaugcucuccuccagaagagaggcaguucccaugcccagcgggaggaaggcguacuaagguuuuguuccucucccgcugucugugccugcugccaucaagguuccgccugcauugggugcucagcaaacaauauggagcagggaagcaaggggcaucucugacuuauuuaacuccucaaugcauucauuggaaaaaaugugucuuaaacaacugacagaagcuuaggauauaacucguggguaaaaaugcuugcuuagcgugccucagacccuagguuugauccccacacuacaaaauugaauggucagggcuacacagagaaacccagucucgaaaaacaaaaaagcuuggguuggaagccaaauaaauucuuuguuccuguguugcuuuagguuuucuuuuagagauagaaucucacuguguagcccuggcuguccugaaacucaaucuguagaccaggcuagccucaaauucagaggucugccugccucugccucccgagugcuaggauuaaagacaugccaccaccacagccuuguguuguuuuuuuauagggguaucgucacaacaacagaaauaaaauuagaaccucuccauacuaagcaagauuccuaugguagacuccugacuuuuaugcgugaucauacacccauccuugagccagccacugaacucuaacaugcacaccuggggucaugcuuuguacacauugaggggcuuggugcacuaauaguggucacugaaaucacaggagcuuacagucagggauggccauugaaaacccaguccccauuaagcgaugagguguuuuggggaagcaggguaguaugcuuacucaccauuuuacugcuuucuuuccuguaguccuugggucucuccagcgcagcagccagcauguuugggagcgauggcagugagcugauucugcacuuugugacccagugcaaugcucgccucaaccaggugcuggaagaggagcagaagcuggugcaacugggccaggcagaguaaguuucauggcauuaagcucaaaguggcaacaagugauuggccacuugccccauuagcuguccucaagaagccgauaaaagaagugcccagaguagugcuaacagccuggacaggucugaaauccagcaaccuaugcugacaguuuuccuccacaacugguggcacauuccuccuggggcugcaaaggaaguauggccccaacuuuugaacuagaaacacacuguuuucuuuuuccucuuccaggaagaggaagacagaccaguuccugagggaugcaguggaaaccagacugagaaugcugauccccuacauugagcacuggccccggguacagaguccagcuaagcuccagagcagcaguaacaacgguccauccucagcaccgugcacucgggggacucagcacaccacugagacauuagcucucgagcacccaugggaccaggaaggcauagugcacuuggcagagcuagauucuugcuagggaguagccauagggaguauaaauccauggaccugcgaguggcccugcauacuaauucauauccuagguggacccaguagcccaagugugccaccaggucuucaaggaggaacagucuuccuugaguaaggucacagcagucugaacaugguaucagccaucuuugcucagcuucucgcuagauaagaacuuugccuccguuuucuagagcuucccuuucuccuuucugaagcaugucguagugugggccuuuucugaguuaagaaagcacccggcauccucuguccagcuacaagacuugaccuugacccgggcagagcaguauuggguuucagcugccugguucaacaagguccugccuuugggcuauuuuguaagggggugcuuuccucuacugaaggaccucugccagccucauagccaaggagauuauagaguagauaaagugucaagagcugguucacuaaggcccagagaagcugguauuugcuaaaggaagcucucagaucggugcuggcacuguuaucaucuggcggaguuuugccuguugggaauaggaaucaacuugaguuaagcaaggcaacaggaauugauugugacagaacagggcacccuucucauccuugcuccaggucucuuagacaggagugaccccuucagcugucaguauucccaauuucaaauguuggccuggagauucugauuaguucaucuuaggacaaaaccaugucucuggccccaucaccucuagucaagguuucuuuuuuuuuuuuuuaaagauuuauuuauuauuauauguaaauacacuguagcucucuucacacacuccagaagagggagucagaucuuguuacggaugguugugagccaccaugugguugcugggauuugaacucugggccuucggaagagcagucgggugcucuuacccacugagccaucucaccagccccuagucaagguuucuuagugcuaccuccacccaugaugacuuucaaagagcaagaacuagggcaacacccaugaccuccccaugugagcccugugugcugcucuuagguguauaugaugccuccucugucauuuguucuucaggcccucagcauccuccugcucccucacaacaucccacccagccugaacuugcucaccagcaugguggaugacauguggcauuacgcuggggaccaguccacugacgugaguguuuucaguaggcccauaacguugcuagcaaaggcuccaguuuucuuaaaguuugugaaauuucuuugaccagaaaagucuggaagggcagcagugucauucccauugggaggaaagguccugaugagccagaggagcaucugggucgcuguccuucagggaccagcguuugagcaugagcuggugacuguccuucccaccuguagagguggcacaggccuuggggccuuaggcuggugcugcuuuagccgucuccccucagucuuugaaggcauggcuucugcagcacaauuccuccaugugucccuuuaaaggaaaccaccuggagacacccauugcuuuaaaaagaaacuccuccccaucuugaccuguuuuguugagauaucaauaagccccuuuuaagcaggcacaaggaagaacaugacuuguuaaugcuaucauauuucuggugggauauuaaaaaaaaacaaaaaaugccuucauaaaggaaauuaaaaugugaugguacuuuguggccucuaggauggaaagguacacagcagcuacauacucccaccauacuuauaacaaagugcuuuaauaaacuuugucugugugggaauauaccaccaacagagauggugggagaacaaaauuagaaagcaaagaaauuaaaggaauaaaacaccaaguagcugagcugguccuccaaagagcaauuaguagggcuggcagaaguccccagggacuggaacgcucagcuucgcccagguguuauaaccugccccugauccugccucagcccuccccaugugguauacaugcuuagguuuagucauggcuaucagaucauagagccuucccaggacucaaaggguuaggcauuuuaccaaucaaaucaucuuggcugcugguuaaaccuccugguuccuggugcuuaauucagacccucugacucucaaccuaggagcuuauaguuuuaaucucacaggcaguuuugauaaccaaccaaguucaggguaguagugguguccagagggcuauaugugucagugagggaaagaagaaaugaggaaagagccugggcgucccugaggucuugagugggaagaacccaagacucccguaacccacagagcagugauuccccgucugccggguggucucucugcaguuuaacugguacacccgccgugcagugcuggccggcaucuacaacacaacagagcuggugaugaugcaggauuccuccccagacuuugaagauacguggcgcuuccuggaaaaccggauuaaugaugcaaugaacaugggccacacggcuaagcagguagcuggggacuggccauuuggaaccccuuuucaguaggcacacccgucugucucaaacaugugaucuccuagcuguucucuugcuuccuguuguccuuaacugacugucccaaacgucuuuccaagaaggcuggccauuucuuccucaugcuagcccuuccuuaacagucugcucugucugucugugguuguguuguccguaggcucuuuuccaguucauuaagccaccuugacuccacugugagacucauaggcuuccugaauuguccuaacugucucaccuuugagcucacucugggggcuuaagagaaucugacccaggcuccucuuaggugaaguccacgggagaggcacuggugcaaggacugaugggugcagcggucacggugaguacugcccaguucacacugccugccucccauuccacucuggucccauguuauuuguaaggugacaccaaccaauauagcuuuggaggguuaaacagaagcugaauaaaacugaccuugguuuauccucaguaucuucucgaaugccccagcucuucccuguugucaucaagaagcaauugcuagaguagggugaggcagggcagggcacaccuguauuccaucacucauuaugcuaagguggaaggauaaaaaguuccaggccagcuuggccaaauggcaagcucuccccaaccccuaaagaagacugccucugccucugggcccccaguaugcuucagucuguguccuagcuauaccugcugaacaccuugaacaccccaggguuucccauuguagucuuggagauaaggcaggccucaccacucucuuuaauucuguuccuguguuagcucaagaaccugacgggucuaaaccagcgucggugagagaagggaaccaugugccugggaggagcagcaguagauaugaagggcuuugacaagaugggccacccauugaacaggauguuaaugagaacacacugaagaacuuggagucguaugacagccacaaggcuggaaaucacaaugcacuugcugccguucugaccugggacugggccacuucuucaguuccuaaugccaggccuggccuccugaugccuuuugcauugcagcuguguguuugaaaacugagacucacauccaagguuucaaaccacaaaaccuuggcaugacucugccauggugucacaggcaucuugaucaugucuugaccauagaauugcucucuaggagcugggcauggugaccuacgucuguauucucagcacucaggagacugcuacagcaggauugagagaucagaggcaggcuugucuuuguagagaauuacaagccugcuugagcuacagagugugauccugucaaaauccccugagaaauauucuuaggggcucacaaccaagguccggaggcaacacauagugggagcucuuccccagcacagggcagacagugcucacaaacauuugccacuggccauugucucuggauccccucagaaagcugccuccccuaggcaggugccuuuuggacaguugugcugagccuggcaucacagacaccagcaugcacuucaggaucauuaguguauuuagaaucuguaaaaauaauaaauauguuugaaacaauu

SEQ ID NO: 4664 - RNA, 16250 nt, Mus musculus
cgcugcgcccgcgacuagccggaagcgccgauugccccgccgacaaacugcugguggccgcgcaggcgcgcugugcggcuggcgcgggagccuggcggagggucgcgaugccguacgccaaccagccaacagugcggaucacggaacucaccgaagagaacgucaaguucauuaucgagaacacggaccuggcguaaggcggcgaggggagaggcgggcgggcggccggguccucgagcuccugaccccggggcuguggcuucggggccgcucacaccgccugucuuuccuccuguaggguggccaauuccauucggagggucuucaucgcagaggugcccauaauagguaagcgaccgucccugggagcccgugccgcccacccuccgcccggggugggggcugagaacacugcggugcuguacgcugggcuggggcagccuaggcccgccuuggugcgugccuugcucagcugcggguuucccaguacuguucgucuaccccaaagcaacagaaaucaaaaccaagcacuguuaaacagcggagggcugcagccuccucauccgggcgguguagaugcuaggcgucguuagcaggugaugcagcgauugccgaaguaguguagaugaugcgcuuuugcuuugacgucaguguucgcuacuggcuggugucuuuugaacauauaugcugauuuuacaaaaucaugggcuucguuauguaguuugaaaucuacacacacagaguguaccuggucucucccauccuuccagauaguacccugcuauacuuucuugucgucucccccuaucuuuuugaaaaccuuuauuuacauauaugugucuaucucugggcucgaguaccggaguucauguguagaggucagaguacagcuuguaggagggauucucuucucccaccauauggggcccaggauugaacuccuuaaggcuugacaacaaaaaguaucuugcacaucuugcaggcuccgaacuuucucuuuauuaaagagagaaagagaaaaagagagagauuccacaugagagaaagcauguguuauaaagauuuucuaauuuuguuuguuuguuuguuuuucaagacaggguuucucuguguagcccuggcuguccuggaacucacuuuguagaccaggcuggccuggaacucagaaaucugccugccucugccucugccucccaagagcugggauuaaaggcgugcaccaccacugcccggcuuaagauuuucuuuaacaaacaacauacuuuuguuccuuauuguugaagugugugugugugugugugugugugugugagagagagacagacagacagacagacuucgguuuuuuguuuuuuuaaauccauccuggugucuuuuuaaaaaugaauuucuuauuucugcugcauauguaaaucauguacguuuucaguuagagacaagacaugagcaaacauaacaaggcaaaauaugacaccuucaggagaaucugaccaguuuuaucguuuguuuguuuguuuguuuugagagaggaaggaggccaaaagggaguggagcguuuguaaacauggacacucgagguuuucugagauggggaauucccaccaggggucggggaaugggaaugguggaaguagauuaagggcauucaaugggccccagaaguaaaucaucaggaagcuugguccuugcuugaguugaggaagcacugcggugaagggcagguugggccuauccucagcuggucuuccggccucuuccuggccuacaucagcuccuugagaacuggguuuccaacaccacugauuucugaacauuauuguuuacaugcagguguuugcugaugggugacuagacacaugcuuaagugcagcaucuguaugcuacagccccauuugcccagcagugccuggggggggauuggguucuauuguuagugggcuuucccuggugaagcuguccagugaacaucuacugaugagaggaacacugaaauuccaagugggcuaucugguuauaucacaaacgaggugugggcccugaaacuugggauguuuugcuguugugauguuuucccugacuuuuaaguuuuuaaaauugugucucuguguguggguguuuaccagugaaugcaggggcuggagguggccaggggucucagaugccccuggaguuggaguuacagggguugugagcugccugacaugggugccaggaaccucagaacugcggagccaucccuccagcccaugguguccagauagcuuucguucuuggguuugggauuggcacagguagcagauuuaaaguaauccuuagauaaguauucaacuccuuaaauaucccaaaaagcucuaagagagaguaugugcaugcaugugugguguaucacuagcaaggcccaucccccacuggggcaggaagguguuauguauggcgugugggaugccugaaccuggagccaucacuuugaagucacuuugagccucuugcagccuggucaggacaccuucaacuuuguaagcugaauugaugcuugcuugcuugcuugcuugcuuuuuuuuuuuuuuuuuuuuuuuuaauuuuuguuuuuguuugguuggguuuuguuuguuuguuuuguuuuuugagacaauguuucucuguguagcccuggcuguccuggaacucacuuuguagaccaggcgcuggcucugcucccugagcgccgggcagaguggagacagugcugcugcaggucuguagaugugucuggugacuaguccucacuuacccuguuuuguugcugccuuuuccagccaucgacuggguucagauugacgccaacuccucgguccuucaugaugaauucaucgcgcacaggcuuggugagugcugguguugagguggaccggaucaaaugggacgcucccuguccccagccugcgugaccuccuugaggcucuugugaugguuuggcuguuggcuguucugcaaagcacucuucugugucuugcagguuuaaucccccucacuagugaugacauuguggacaagcugcaguacucccggguaugugugcuggugggaagacuggggccacggggaggggccgggggauuguucucccuggagucuuccggggugucucccuuccaguuguuguggcugaugguggagaugaugucuuaauagugugguccuugguucugauggagcaucggauugcucucagcacauccaggcgucaucagugagccucaaaagggaacacacgggugggugugguggcgcacgccuuugaucccagagcuuggaaagcagaggcaggcggcucugugugaguuccaggacagccagggcuguacagagaaacccugucucaaaacaacaaaaagaguccgggaaacauacccacuuuuacguacguacaggucugccucugugucugagcaggugggcuaaggugaaaagagggcaucagagcccccggaacuaguuacaggcaguugugagcuacuggauucagguucugggaacugagcaggagguacuucuaacagcugagccaucucuccagccuccauuuauucuuuucgguuuuguuuucguuuuuaagagagucucacuauguuguucuggcuggccuugaagugaaaucugccugcucugccuccugcaugcugugguuauuaaaggcauguguucccaugccugucugagaaauguuaauaaaacaccguuuauuuuuuccucuguaguuaguagauguuaaugcuuuacuacauuugccugauuuuccucuaaccuuuuagauaauaaguugcacgugcucuacccuucccuucuacauacuugagcgcaugucugugcuguaauccucuauggcuagguaaucccuccccaaauaaucuaaaacuugaaagguguuucgguuuuuuggggugguuuguuuguuuguuuguuuuccuguuuuucccuucuuuguauuuucaguuaauugccaagcuggucugcauaaacaggacuauauagucccauacaaccuuggucccuugagaugaccucucuaggcacugcuauauuaggagugggcccccuaguggucagcuguagcagugaacauggaaaggaaguguaguuaguuauccugaggugaaccagaugucacagcccagaagggcugggaccguggucaccccuuuucaccaagaagaaucuggaaagagcuggauaggagaagcagagaguccagucuccucauccuagcuguccuccugccucaggacugcacaugugaagaguucugcccugaguguucuguggaguucacucucgaugugaggugcaaugaagaccagacgcgccaugucaccucccgagaucucaucuccaacagcccccggguuauuccgguuagugucuuugcccuucucugccugccuccaagugggacagauuggagugggucuuuaugaggcagaugcuaaccuacccugugaccaucuacguuaacugccaccuagacgugcugguccugaguuccugaacagagcaguauuagugccaugugcccuauguuguucaaagaccccauuaaaggccucuggguucuuuggacagcucugccaucuccuucuucuucucagccuccuuuccccggauugacggauuauaggcugcauuugcugagagacaguugccagaggugacugagaggugagaggcuaaugcauacuuguuugggcuuccuacaggugacaucucggaaccgggauaacgacccuaaugacuauguggagcaggaugguaaggggguggggcgggggggugaaugggggugaggggguggggcaggguggugaggggguugggcaaggguggugagggggugggguagcaugauaagagguggggcagucaagcggguggccagaagaugcagaggucagaugugccccuuugaguugccugguaucuuucauucaucuuuggacccuuugccaagauguggauugucuucaugcaguacuacaggucacaaguuggagaacuugccucuuuuuguucuggcucacucucaccucucccugcagacauccuuauugucaagcugaggaaggggcaggagcugagacuucgagccuaugccaagaagggcuuuggcaaggaacaugccaaguggaacccuacugcggggguagcuuuugaauacgauccagacaacgcacuuaggcauacaguguaucccaagccugaggaaugguauguuccuggggggaaggggaagcagcaguggcuguagugagcgauagguggguagugcucugagagccuugcuacaagcagaaguagccccugugccucaccugugcuugcccucaggcccaagagugaguauuccgagcuggaugaggaugagucgcaggcucccuacgaccccaacggcaagccagagagguaagaccccaggccugcuugcgacuguaauuguaaauagaggugugggaggcuguuaggcagucacacacccaagcucaccacaccccaccccaucccccacccugugauagaagagcuaacugccaaacucacauacacaucuugaguuggucuuccuuccucuccggucacugugaggaaaggggccuuauuaaccccugcuguuucuggccuuccuguuugggcucaggccagagcaagacugaccauagcccuccccugaagugcugaagggcuguagccagcaucguguuugguuuuuccugcugucucugguguagaaaugcacauagagucaucuuaggguuuguacagcagugcucuuuagaaguagcuggagcuuccucggggagcugugaaguggaucuggaccauugcgcauaaggagucucaggaaaagggaagacccuguccugagcucagggccucauaggaauggaaucaagucucagaggacagaagggaagucugcccgaagccggagcuuugccucacgagagcucucaccccacucucgucucucagguuuuacuacaauguggagucguguggcucacugcgcccugaaaccauuguccucucagcccugucggggcuaaagaagaagcugagugauuuacagacucaguuaagccaugagauccagagugacgugcucaccauaaacuagccacggcucgccugccuccgaagacuagguucacgguggcuggacuucaggccucgggagcccuuguaguuucugggcuaugcacugcacagucugcccccuggaaggccaucggggagauggccagggucccacugguguuagacauggcggguuuuauuaagcguugagcaucccgggcccuacuguagugguuuucaggcagcauggggggaaacacacaccagcacggaaaagaaggaauauuuauugaucaacaguaguugucuuuuuaaaaguuuuuauuuuuggcaauaaagagcacaacauaaucuccuucaugcgucaucgugccacuaacugagccaguuuugccucccucccaaaggguugggcccauuucuuguacaaacuagcugaccucuggguggucauuuccugggucacagaguugggcuggcugugccaccucccuggcucuagggcacccccugggaggggccccuuaucauucugccacacaugugaacagugguuauuuacaaggucuguucccacaaaucagaacccuaaaguauuaaaaaacagaaacacgcaacaaaagguuugaugugaauagaaagauagcccuucugcacgguagucaauaaauaccagcacuagaaaaucaauugcuuuaauugcauuucagcagggagccucagcaccguguggggagauaggaaagucuuaguuuuggaaucuggccugggguggcuggccugggcaagggacucccccugcuggagcuuuauaccccuggucagugaaggagagcagcaaggugcuccccacagcaguccugcugcaguccucccuccgggcuggccccaacuguccucugcugccgagguaacgggagcccugcccaaagacaucuucagccuacugagcaggaaggggccagugcagaaagugcauuuaaaaaccagaugccgccucugcuaaacacucccaagugcaaggcugccacacgguacagugaaguuuaggacucuuccugugucacuguaggcccagaggacagagcuaccugcuguccuggcccuugggcuucugaggaagagccagcagacagcaccagucugauugucccccuccucugacccuggcagcucaggccaucuuggcagcaggagaguuguaucacugaggacaggcacugccacccucauacucaaaaacagccuugaccaugccuggucguggaauuaaaaauggguauguguugguggggagggauagagggaagccucguuuauacaguauauguuauaagccauauauauuaaaaccauuaacaguguauagucccacgguggcucuuagccccucaugcucaggugguguggccagccaugugcugagguccagccucacccuugagggcaaggagggauagcuugcucuccucuggcucuuggccaccagcuccucgaggcuguccaugggcugcgacagugagccuuucaacagguggcccggcaaaucaugaguucucuccagucuggcugucacugggcaggggucuuggccucacugcuauccuccugacugggcuuuggcuuaagcaagaugaaccuguucaggaggucuguuuccgagcuggccugggcugccccauaacuuuccccuguggacagagaugcaggcucagaaucugaauccaagaccaaaggccauugcccaggaagccuccauggggacaggcuccaaugacgacucaccauagcuggaggcuucagcaauguucugagaaccugugauauggugccaguacgcgcugcggggcagcauggccgugggugugcagggauaggaguagugcucggugcccuuguucagcagcugugacacaaaggagaggucccaucugugaguucuggggacacugccgccagcccaagguccuuccugccugacucaccagcaaacaugcugguggagacuuagcuagcacaucugcuccaccucccagugcccuggggcaacagccacugccucacccucacauucuucuccaucuccagcaggacccgcuugugcugcucggcgauggccaggguggcacugugaacccgcugguaaaucugcucccccuccugugucugaaagguauagagcccuuccccagcgucacacauccuaaggacacagggagcaaggaaggcaagguguuaggaauuccacuuguguuuguuguuuguguguguguauaugugugugugugugugugugcgagcaugagcgcaugcaaguucuaaaugccagcuguggguguacaaggucuucagggagaggguggccauggucuggggaauuggccacagugcacaggcugagcaguaguuaccacguaccccguggagguuugaaagcuucacggcaauuauucauuuagaggaaccuaaagcauccaggaaaauagucacucagccaagguuauacagagaguaguguggagcugaagccuaauaagcaggcugguggaaucccagcaagggccuucccuagcuacaccaucauccugucaggcuaggcacuuuuuuacccuccuauaggaaacugguacuaaggccacaaagaaagugucacugcuggcagggacugagccagggagcugggcuuuggcauacagcuucgcuugaccugccuguuacaagcuaauuacuucuggcuuugaguuccucaaauguaaaacugaagcauuauauaccaccaccaccaccaccaccacccccggggguggcaaucugaugaaugaaugugccugauaccaugcagagagagcagucuccauaauggccauagcgagccaggaugguaagaaagaggguacuaccugcccgccucaaagguaaagcgcguagcaucucggccauaacggcgcaaagagcagaggggccacgagacgagcuucacgcggggguuguguaugucccagagguagauguucucgugagugaucugcagcuugcacuccccauacacguccagguuggggcaggguaacaggaagacguugaagcgaucuguggcagcaguagauaacagcugagcuaauggggguggagggggaguugggggaguccaccuucccccuccccacuuugagacccagccccagccucaccugucugcucacacuguacuccuggagccaggaggucaggcucucccaggcugaugucauugagccgugaucccagacauuccacggacagugucuuguaccacucuucugccuccagcucuagaaaaaaauagcacuucauaguucugccagcucagaggccccagcagcccaccuaaucugcccuggguugacucauugcaccaugcaggaaggccuugcugccugccuugcccaccucugucugcgaccuacuccacuaagggcacagcucucccacucuuucugcaaggguuggccuugcucugguacucacugccuagaccacugacugaccagcccgaggagagcagauggagccugcaguccuggggccuuaccugagucacaagugaaggugcgagcggagucgucugugaauaugauggccaccgccugccucuuggucuccuuggggagccgugugacacacuugacguugcuaaucucagucaccuggaaagauaucccaagagauuuagccaggccggggcacuucaccuuaccuccuuagcuggguuccccaggaagguacucucagaccucaggacucagcaagucaucuuugcucacagguugggggaucuaggacccaggccccuaaccuuggggcagccucggaggcacacggacuucucaucaggauacuucuccagccgcuggggccccuugcuggaagauuuccggaacaccagccagcaccuccgguaaaucugugggucaagaagcuaaugaucggauuguugcuggaccgugauccccaacaaugcugcccugaaguuaccccagccuccugagggagcaauacuacacccuucccuggauccuagcuuagagaaaaccuuaggaugguaggguagcuacaggauagcagccaacagaggggcagcccuaaccaaauggccaaggugaguguugauguucaucucuaucgggcuguucuaugaugcucuguguaauggaaggaacauuuguggaaugcuuccuauccauguguggggagcuggcacuauucagugucagggucacuccugaaggcagucgcauugccaccuccauuucagagacuaguggacuaugaagaaggcaaguaggaaggacccaacaagcgcuaggucuggugugaagacaggauuuccagagacacacccauuacuauaggacagaccacuauggccauacuugacgucucccagagacaaaagguagccccuugcacucagccagucucugccucauccuugcccuguucuugggcccgggcaaggcucuggugugaggggaaucacucuugccccccaaggauuucccucagcacuuaacagugugccacagggguucccauggggaccagaggcccacagaagcuaagggggcagagcuaugagccagcugugccuccacagcaugguaccuuccuuaugugguaucuugccugucccaaccacuaaguacccugugcucuaugcccgcugagauucuccagagcuucauaaacuccuauagaggugacucuucuccagagacaaacuggccuacuggacaccaugaaaagcugucccagcaccuccauaaacugcccaucugaccucuugcagagccucucauuccuaccucaaggcucucuuggauuuaccagcuccugccagcaggcuucaagccuggcagaccuguuucccagacaucccugugccauugucaaaugcaaacaggagagaguccuaaagagggccugggcugagcagaggaaggaagaaagccgcugggccauagucacuggccagcccagcuaccuucucuguguauggcaaaggugcacugggccacagucccaaagggcuggcagucaucucagcuacuucucuaccugugccaaaggugcaccaggccccuagcaagcagaucacagaacaagauggaccuagacaguccuugucccuggaacucccuagaguuggguuacauguagcuccugucugggacccugggaggcaugucugccccugcaccucugccccuagcacagcccugaucuguccacaugagccuuuuuaaagcagagaccgcguguaccauauuuucauacccuuugcuaauaccagcuagcaauuaccgacagcuaugcauaugagugcaugaaggacaggguggacagacagauggaugaauggguagaucacugggugagagcugcccaagcaccccaccccaccccacccggcagcaacacaggaggccugggggccugagcacccugguugccugguuacaggagacacacucacacaaccccagggagccaugcacucaagagcucuccucaguucucacaggucuuugaucagcucuuccuaaguacucugccaggcucugcugagggaggcggggaggcccuggcagguaggaagggaggguaggcgccaucccauuuccauuccauucagcacacccccaccccugaucccuggagacugagauaagacacugccuggggcaacugccaagccuagccccucacaagccugcacaguaagcucaggucuguggagaguagaauucccuggacacaguggauaccaaucugggccaggccacaccccaccccaccugccaguucuuccccuggucuguccacuucucuacuuggggucugggaauccuccuguaacaggucugacacggaccgcacaggacuguccuguugccagcgcuuuccugguaagcccugcccuggccagagcucggcuggccccugcggacuugcuggaucuaagcauaagggauggcagcaggaaugagguccccauucccaaggccucuuugccugaccuuagccuugcucuuuguucugucuuggaaagaacagagucucuauaggcuugggccagugagacucugaacauacccagcagcccugccugccuccauccacugauggcccagcugagagcaguggacugcuggcccuugccuggacacaagauggcucaagaagagccccagaaccccaggaggaacaagaaucacccccacucuaagguggcccugaguaagacaaguggcccgugggcaucugucacccuuaggcuagcccagcuuuaaacccaacccaucaagguagcagggagggaucagagacuugagucaccugucaccaaggcuugcuuuccugcugagaagagccccucaguggagguaggggacagcaggggaucagaggcuucaaagggagccuggagcccuacucaugccccuggggauguuuccuccucuggaaaccaggaugggguagagagaagggguaugugcccuuccaagccccaacucagggccaccaacaacaacuccaaggaaagcagccugucccagagcaagggccguggugccacccacacaugggggaagugacagcaccccucagccucucuggccucagccccugaugucccuaccccuaccuugcaaugagccacucuccuucccaaacaauucuuuagcacccaaagcaaccaaccgccuaaaauaugaugagggcaggcucuaaacacauugagacacggguguguggcagggcgggcaggcaggcugguggagguggggagggucacuuuaaagaaaagaggacagaagagguggggagcaaggcaagggagggagggaaagggaguggggaucaaggggaggaggcccgggagccaaagcugcucuccucucuugacagccucacucuccagucacucccgcuacccggugguggcugccaccucugcugcugccagugccucugccgcuguggccacaacuucaacaauagcggggaugccucugccagccugucagcuaccacuacugguccaguggccgggaugccagccagcccagcuggggcgagagaugcaguagacggaggcuggcuagccacaugccagccagccaguguugagaagccucaaaccacagucacacaguacccagugcuggcgggcgggcagcauguccccacacaccaugccuccagaccuguccguccucaggacuguuuauugaccagggccccugccaggguggcucaccccgagcuuccugcucuucaucuucacauagccuugcuugacgaugucguugaaauuggucgccaugguugccccgcugucuuuggggugccggccgggcugaguccgggaggggugcccagguggcuuggugucccccgaucaccuguuuaagacacuccucaccucccccgccucagcauuguucuagcagauccuucgcccagcuccugccagaaacccaaaugacagggagauuagagccagugacaucuuucucucccccuagcugucuccuucuuuuuuuccuuccucuucccacacuccucccucccucugccugcccgcccuuccuccuucucuuccuccccaccccaggacggcagaaccauucaggaaaaagcgagguggaggcagagcagaaaaaugguccagcccaguccccucccucaaggcuggggcuggcaguuaaccccuuccugggauggcugccucccguucugcuugcuguggaggugaaggcaaaagaagggaaggaaggaggcggugggguuuuggaggagccuggccccucagcuugguggcaacuggccagccucuuacaacuucagggcagacuuagagcaacuugccagagcacacacccccuccugaggacuuccaggaaauggugaggcgggugugugugugugugugugugugugugugugugugugugugugugucaagagauggcccaggguucuguaccuacaaaagccuacacuuccaucccaccacacuauaccugguucucuccagccugaugaggcugugagucaccagcucaagcuauucagacccugauccuggccccuggacucuugggcagcucuucuggggacuggcguuuccugggcaggagggcagaguccaaggggugaggcccuggauaagucugaggagugugugggacugugggcuguggccucugaggaaguagacauuuacccuggccuuggagcuggaaggagcaggccagucugaggguagggacagggucccaacaggacacuugaucuggccgagccaagaagagguauguucugagcacgggcaggcauuaauuauauaaaggaugacccagggaaugggauguagccuaagcaauucaggaaacuugggaauagcaggagagaacugggcucaguuaacacagacccaggcaaucucagccauggcucaaucugacaccuucauucuauacacugguaaagaaaauaccccagagagaguaagccacuaggcuuaggucacaaagcaagcccaggacacaaccaaagaugaaugagaaguuccccguguggaacacaaucuuguagcccccuuuggcuuccugccaccaccuaagcuuucucugccaugaagccgcaauagucaggguugugcuccccacaagacuccccacaucuccaggauccuuggguggcaaugcaguagcauuucuggggucagcuggacaucugugcugccagaauggggcccuagggcaggcacgcaucucagucugccagcagcuugguauuaauuaaucuccuagagggccugucuauugagucccuaacaaggaacagaugggacuccauugggcacaggcaaacaagagguggggcagagggguuaccucucucuucuauguagugacaguccccucagcccuucacauccucuaucccagcucccauguccaggauguucccacagcaagugcucugccucucccaggucuaauugucaccaguccugucacaccugggcucuggcagccaaagaggggucaguuuuucccagcucugucuccaccaccucccucugguguugucuugaccccaggacaagcucccuccuaagaugaccagcaagcuggccacuggcggcugguccaguuuuccaaccuguccccaagaagucgccaggcccugggaucuucuuagguagcccagacaacaaggaauacagcucucacaggcugugcagucccucaguuuugggggggacauuaauuuugggggggaguaggggagguugggggauggggauauuuuuuguuuuuuuucuccaaaggauccagguagaauccugaugauauauacaugcaaucccaacacuggcaguagggguagaaauucaaggccagucuuucuccuuuaaaugaggagugaagccaggagguagcuccauucuccagagccuccugcccagcccaggcccccauuacaaaccagucuccauaaacccgaugaggcuacuucuuacuggcuccaucagccaucuccucuguacaacccgugguguucccaagaacacccaacacuagaaucacugaaaaguaacgucuaugggacagcccaagaccugccuucucuggucucauucaaguucccaguuagguuguagacgcaaauacugacccagucccaaaauggagugcaaagaggguuggaaagagagagcaucaagagagggauccagggcugguaagauggcucaguggguaagagcacugacuguucuuccgaagguccugaguucaaaucccagcaaccacaugguggcucacaaucaccuguaaugagaucugaagcccucuucuggugugucugaagucagcuacaguguacuuacauauaauaaauaaauaaaucuuugggccggagcaagcagagacugagcaaguggaauugaccagagugagcggagcggggccaacaggagugagcagagguccuaaauucaauucccaacagccacaagaaggcucacaaccaucugucaguuacaguguacucacuuacauaaaauaaauaaauaaaucuuuuua

SEQ ID NO: 4665 - RNA, 15232 nt, Mus musculus
caggaggaggagacuuggcggcccucccccggccucccgacggccgccgcagccagccccgcgcccgcuccacccagagcagcaguucggacguccggaaucccagccccggcccgaggugaguggggacggcggggcgggaggucaucgcgacaggguacucgcugcggucucggagccgcucacgcgagggaagaacuuugcagcgagggacaggagccggggcggcgcccgccgcaccccaaacuugaguccaacuuuuuagucccacuuagagucccccggcccgucuccauccccguggaagccgggucccguggcgggacagugggggagggggcgcccguggaaugccggcagggccaggagggggggggauggcaggcgggggcggaauguggaacucucccgggggacccaacguggucaccauggcgagugccggacggacggguggcacuggccaaucggagcacggcuuuacgcccagacccguugcgcuaccaauggaaaccaagcgguggggugggcgggaccgcgucuugcaggaccggacccccgcacccccuccagccgcuagggggagcggggcugguggcccgcgaaggggcuaccaaguagggacugggcccuggaaagcugaaaacuuaauuucgggaaggaaugcgggcaaguggggcaagggcuugaugcuaagagaagggaagggcuucagcagcccacugcccugguugugccgagggguagcacucuuccucaucccgggacuucaguuugcguaagugaaugucccuuauucggcccggauuacugagcuguuguaggaguacgaugaguucuuauuggcagagucuuacccaccugcuggaggaauuagaaaucuuguuggugccucucaauacauaggaaaacugaugcucagaaaggccaggaaccugcacauaccacacgguguguaauagcaacgcuaggguuaaugucuguucuauacgaaugugcgaugccaagaguugcuaagaguccuggggcuggaguaggugaaagcuuccacucuuccaagucauguuuguuuggcgggccuaguaucugaagaucucccuaguaagcgcuuccaggggcauggugcucuucagguagucacgcaugacccagccacaagcucuguucuagcauagaaacccugcucuccucccuuccccaccccuccguuucuuuccuggagguccagcagcuguaagcugggcucucucaguauccauggucagagggacagacagcccacagucugcgggcugaccagccuugggcccugcacuuauccaaucaggcaguccccuugugguuuccugcugggcucuaaucccuacccacagcuaggccuguggcccugggcuuaccccagaguccaccugaaagauucuaagaagauacgggagaauucugagcuguggaggucuuggguuccccauucccucagcugguccccauccagggcuuaguguuucucauuccuugcaguggcuucugagaaaaccaaccgaaccucgagggcagaauacaauguugaauaucuccucccucuccccaucagagaguuccucuggcaagagcucagacaccggacucugaccuuggccacagaugggcuuagacaccuaccuguauuagcgccuggcugaaaaccaacuucugauuuuuaggaugacaccgcucucccaaacucugucuggucacaagaggucccccuaauaggagcuuuauccaucucccauaggcucaggacacauucagacagcacauuguucagcccuguucaaauagcuaacaaaaucaagaagccuuugagagcuuuuuagaaugcacacuuccuaaaggagagguucacaaccucacuaaugccucaacccuuuaauucacuuccucaugcuuuggugaccaccccccccccccagccagaaaauuauuuuuguuacuuuauagccaguuuugcugcuguuaugaaucauaauguaaauaucugauuugcaggaugucugauuugugacacccccccucaaaggggucgugacccacagguggugaacugccacccccaaaggaggaggugcugguguuuuagggaaacuagcacgaaguauucagagguuaggaaaguucuucucaagcgaggagauguugcagguccaucuugcaggguguguaggaguuuacagauguagaaggaaagggagacguucccaaugagucugugaacaaaagacgacguuggucacuuccuacgggcagcacugaaucuguggccugaaaugaguguccagucaaaacauccuuguuucugagaacggggaaugacagcuggaguucaggagcucugagaccugcagcucagcucagacacaaggguacagcucuccauccuccaucccuccagccaacuuuaagcaaguacuauacgcaagauauaaguggcacacaugucucauugagugggaggcugugcuauaagagaggccacuggccagguauggcuggcugugggaugggacagggcaucuagggcauuuccuccuaguaguggcaccugagucaggaggaugggcugccugacuuuaggaaggaugaagacagaaaggaacccucuggguaugugggggcugcuccccccccccgagcuuggagugcaguggcagcauugugauaaaucgggagcccacccccuauaaugucaucaaacaaagaaggcacugaaccugggcaggaaggggcaagugaccggcagcugggcccugucugccuaucuauagcaugaggcauguguacccggguuacugaagcuacuugaguguuuccaaggcuguuaugugaguagggugggaaugggggugaggggguguuguuaggcagaggccagcugcacuggggucugcacaggugugcuugugggggagggguggaugcgccucaccucccccucuaugcgugugcauaccugucccaggcauaaggagaaaagcagaggguguucacagccuuccuggccucccccacccccuccgcaacccagacuggccagggcugccuuuggaggccccaaccuggaagcuauuaggggccuggauaaugucugcccugcuccuguuucaugggcuuggccuuucucaaaggagccaguuggagucuucucuaagucgagcagagcccuuugccaggccuggcagcuccaagccaguggauauggcaacagcacccgcugucacacuucuguggggcuguggaaaggccugcccucaggacugguacuugggcuuccugccaauccccaccccucuccucuccccugcagaugcuaguacugcuucucuuaggucuguuuugauggaacugggccaggaacauggggaaggaggaguaugugcauaugugugugugcguguguguauguguguguguucagaguucucuuaagaguguauguuuaggggcccauccgugugcuggugcaaguauaucuaucuauuuguauaaccacauggugccuauagguccaucucugacugugucauuuaucccuguuuuguguggaugagauggcguguauguucccagaugugucugugugugcagaaaugucuagaugcuugugggcgccaaggcuaccaagucaucacacgggccgagacucugagucagagaggacaggcacauugccuguuaggaacuagagccggggucuguguggcuggcuggugacugucuacacaagcaucuuugggguugagauauguaugguacuguaaguaaugagggugguugauuugggcucagugguagagggcuuguugguggcuuugcccgaaggggagcccgagagacuugaagucucgcugauguuacuugaauacucauauggacuucugaaauguagagucucugcugcgucccugccaaacauccuggcccauagaacuguuaauuguuaauuaagcgaggguccaggugaaucugaagcacacccugaugaaggaauccugggcuuccuugccagguccccgauguacagguggagaggcagaagcccagaaaggcccaguggcacaacaagcagccuugagaguaugaggggcauuggagccagggcugaaggucucuacuggacuuaggggccacccuggagcacaccucccccugcuucugccaguacugcccucuucauccccugagcacacacagggcugauucgggugacugucgguggugggcacagcccaguaaugguccuguucuuccgcaggucugaagaggcaccccagaguauccuagagagcaguggaucgaggcguccaucacacgcagugagaucauguuagaucucuguccuacgcgccguccuugagccuagccccaaguucgcacccaaggccagcccagccucacuaugagccacgguccgagcccgcggcuggcugagucuccgcagcuguccaagagcagccugcucaccauccugggcagcccguccccggagcgcaugggcccggccgacucgcugccacccacgccgccuagcggcaccccgucaccaggaccgccacccucacuacccuugacugcucccgcucugcuggccgacggcgacugggagagccgcgaggagcugcggcugcgggagcuggaggaggcgcgcgcgcgagccuugcagauggagaaaacaaugcgcugguggucggacugcacggcgaacuggcgcgagaaguggagcaaggugcgcgccgagcgcaaccgugcgcgggaagaggugcgccagcugcgccagcgccuggauacgcucaccaaggaguuggcgggcgcgcgccgugagcgccaggaggcucagggcgagugcgaggcgcgcggccgcgagcuggcccggcugcggggagugcacagugcggccgacaagacucacgacgguccggagcccgaacgcgagcaggagccggugcgcgacaucggggcggaaaggccgccuggcagccaggugcgcccuacuacacgacuuggaagaaggcuggcauucgggccaguguugcacaggggcccagaugggagggagcagugacaagagcuaguaaggaucugguuuccagugcggugcuggucagcccuacguccacuuaauggugguggugguggggaucuggagcagguaaaggucaccuugcuuuggagauucccaaguucuagccgucccuccuccccauuuagaagucaucaaaaucaaagaaucuuccauaauaagcacaggagagauccuugaacuuggcuuagauuagugauagagcugacuccucauucuuucauccugaagggauguggucucuuugggagccuuugggagggguggcagaaaaacugucuaaacaaaacaaaacaaaacaaaaaguuaguuaagcugggacugagaggaggcauacagauuagcugcaggaagugccagaauccauaaucuaccgucauugcagaagcccggaggcugggggccugcugagccugggcaguggcgguagcuguccccaucauucagggucuacagucacauuaucuccuacagcagacccugagacacagggagguucagaacugagcucuguguugguuccuccggcagcuggguuuguacccugguggugaaugcuaacacuauaguuggucagaaugacagaaucccaagggcgggccacagaggcaaagacccagcuuugguccccagaagaccagaccccagcaaugguucucuuagcugcuccccuccucucugaccuaacccucucccuaugaccuaguauuuggagacauuuuucuaaccuagcuaccagggccucguguucucuuugcccucuuguuugguagucaucacagccccagaguccccagggacaguuuagagccccaggucuacagucugaguuuacaugccagcucaggugugacccuuccuuucugucauucccaucugucccagguggcagccagagugcaccacaggaccaucugaggucaggggaauaggaggucaguccuucacaaguucucagagccaccagccucccugugcccagguuugccccugaaucggaauccugagccuuggugggaauucuugccucacuaguugcaaccauugcacccaguguuugcauacuuggggugaugggggccuucccggggaauguuccaggaaacaggaaacccugguagcuggcaauguucuuccaggaugugaaggcggaggcccagaggagaauaaaaugaaaugccaaagacaaaaccagggccaggaggcacuguuaucaccugccucaggucacuuagcaagcuccuuccagagcagggccucagcuagccaugaggauggaggccagagcaaggcccuggaccaggcagucccuuaccuugguccccacaggagcuggaccugguagagagccugcugaagagcagaccagaggagccugagggcugcugggaugccugcaguguagcagcagggggcccucgggucagcucaggacgccaggaucgcaaccgccugcccugggaggacacagccaguacagaagaggaugccuccaaguugacugcucugcgccuacggcuagaugagucccagaaagugcuccucaaggagcgagagugaguuaugggcggugggguugggugaggggcuggagccuggcacccccagaauccuaagugauaacacaugaaagccguugaggcacaaucucagguuuuacuucccucaggguggauuuuuguuuuggucuuuuuggucauuuuucuccccuccccccugcagccucccacuacaggacugaacccaggacaugugcuuacuagggaagugcucuaucuaccauugagcuaaaucccaaaccccacaaucuaagauuuuagaacagugaacccacuacauucuuuuucauuuuuuaguaaagauuuuuaaauauuaugugugugaugugugcgugcguauguuaucugucugcccauccuucugucugugaguguauguuugugucuauauguguauguguauaccgugugugugucuggcgcccauggguauuggaagaggaggguauuggauccccuggaacuggaauuacagauguuuauaaacugccauuuuggaugccaggaaccaacccuaggucuauuguaagggcagcaaguacuuuuaccucugagccaucucucaguuccccauccuuuuguuuuuaaaauagggccucaguacaugaacccaugcugaccguguguagccuacggugaccuccagcuuacuucuggugguagagaggguagcaggcucagaaaaagcaggaauggagauugguuaggaaguuuaggguuagaggaguuguguuuggcucagcaaaguaacaguuugugaacggguaggucuggagguccggaggagucuggaugagaggugcaaaggcaggggucaugaacaauagaaauguaagacucagugguguggaugggcaaggagaagguuauggggugggguccugguucugucaagcucagaggcuggcagaggaagugggcagugaagaggaaggggagccauuugcagugcaaaggagcuaagagagacuguuucacaggagaguggguggcuagacugagacuuaguugacggauggauuuagaacauggaggucaucaugggcuuuggggagggcgauuagagggucugaccugaugauguucgugaauauucuacagcucuggugucuaggaaaugaguguauagaugauauacuugguucacaugugugauuuuacuuuuuaaaaaaaucauauaaggacuacgcaagaggggauuugcucaaugguagagugcuugccuaucauggaucaaguccugguuccaugggacaggggaggaaagggaagaaggaagaaagcauaccucugacgacaguuggacuaauacuucuguggguaucacaucuuuggcuaaggaaagccgaagggaccagguagccagcagaagcuaggcagaggaugacauagguucuuccugaccacauccccugcccacgccucaucucagacuucuagccacagaacaugggagaacacagucuauuguuuaaacaacagcaaagucaagcuaacauauucccugaaauaugaagucaaaacaaaagaagucuaauaacgucuuugugcuugccuauccccacuccccagggauaagcuggcucugagcaaaaacaucgagaagcuggagggggagcuuagccaauggaagaucaaauacgaggaguugagcaagaccaagcaggagaugcucaaacaaguaaggcuggguguggggcugggacauucugguggggguggcugcacgcugggggcuuccaaccuaggggucaaguuaggauagaauucacacacucagccauaguaguuccgaguaccaggacaggugguuaaugguagcacagcccagggcugugaaggcaucaaaagagcaugagaugggauggaggccaaggagggccucuauaagaugacauaugagccgggucuggugggacacaccuggaaucccagcccuuaggaggcagagacuggaggauugccuugaguucaaggccaguuuggacacccugacucagcaucccuccuccacucccuacaugaccuuguuugaaucaagaccuaaaggagccaaauggagccauuuuugagcauauagggcauuugguggcucacagcagcaguccugaaguaggcagacaacuggugugugcuggacacagaggagguaguauggcuggagaauccugucagagggaggaucaagaggcuacauuucagaggguuugugaucagaacggaagugucagaugugacauuuaguguguguccagugaaacugaagccucuuggcagucaaaagaaaaugcaaccucacggucccaucucagccaugaggugcucaaagcaggcuacuucgucucccucuuguacagauugaguauguccaccagggggcgcagccauccugggaaagccuugcuggauccucuggguucauggaggucaaagaccagagacuugcauuggaaauuugcccacaccugggaaucucuucaaguucauaaagagucccagaaccccugccuaccuacuugaaucucccuucuuuuggggaucugggaaccuggccccacauuauucagacugccaacuguaguugccagaaggacacuaacagagagccaaugugcaucugcgcagaaaaugcucuugugccuggcuuccauccacaguauugucuuagaugcccacuguguacuugcguggaccagcagcuugggagaagugcccacagcgguucugaugucugugcauacacacugguguugagagccauggggaaggcagacagacaagcucucugcccucugggugugcagucuugugggcagugggaagaggccaggugaaugggaguagcacacgggagcaagauguugcagggcuuugugagagcauaggaguugggugcuaucucgaggcaccaagaacucucagaggagccuacucugaaaaguccuucauugccuuggcuggugcucaccucuaguacggccucugggaucuaucccggugguucucaugaccaggcuggcugauguccuugcagcucagcauccuaaaggagacgcaccaggaugaguugggccgcaugucggaagaccuggaggaugagcugggcgcacgcucuagcauggaucgcaagauggcugagcugaggggugaggucaguggugggcaggauggaggggcagugcucagggguuugaucaagcaguccguaggaaaaggauaaaagucccagcugugcugugagggggcccguccacaccccaggggccuagccugcaggaggcacccccuuucccacacaaaacccagaagcgcccccacauccugcacaccgugaaaaaaauaaaagcccggcauaauuauagcugcugcagcuggaucugcuuccuggugccauuuuuggcuucaggaggggggggugcaucuagcuugucucuccacuccuguuccccccaccccaccccaaccccccuggagucucacuaccucccuugcugcugcagauggaaaggcuccaggcagagaaugcggccgaguggggccgcagagagcggcuggagacagagaagcugggccuggaacgggagaacaagaagcugcgcgcacagguuggagaccuggaggaggcucuggcccgcagacggcggcagaaugccagugcccuggacugugaccugagggccagccaggcugcucuuuucgagaagaacaaggugggcuagucagcacacuacuguauggccugcaugugaaugaccacacaguauaggcugagccucugaucccccccaaaccaaacauccaaaaugcuuucaaccccccccccccgacuuugagcauccacucaaugccuuaaaagagcagaaaauuucacaccuacauguggucgguaccaaucaaaaugugagggcagaaaagaugcugaagaaaauugcccucaagcccuggugacauaugcauucaacuaguggauucuauguuuagacccagggccuguccccaagagaccucaugauguaugugugaauaccccccaaaaguccaaaaaaacuguggaaucuaggcugaagauaaaguuugguaggguaccugccaaucaugcacagagccccgggucccauccccagcauccuauaacauagugugaugucucacaccuauagucccagugcucgggagguagaggcaggaggaucacaaguucaaagucauccuuggcuacagagagaauucaaugucagccuaggcuacaugagacucuuuuuauuauuauuauuauuauuauuauuauuauuauuauuauuauuauuauuaaucaaaauacuugagccuaggcacuucagauaaaagauacucaaccugcaacugcauugacuaaacuccuauaagauaaagcaguugauaauuauaguagcucuguaugcugaacaccuacugugcgauccuggcagcaaugagcagacaggugugucuaccuguuucacgaaugaugguuuaaaggaacaaaagugcugucuccaucacauggucaggccugauccugaaaagguuucccuuggggguggggguaggggucagugggggacagcaacuuugagcugaggucugcuggagaagcagaaguuaacuggugguaaacugaccuuccagaggguagagcgagaacaggggagucccagaagaaaugaggacucugucuggguaggggugacaagggggcccaggcagacgaaacaggauccauggcugcagugugagagcagccagcaggggugaagcgggaagcugccagguggcaggcuguaguaggacagaggaugggaggccauugcaguucccaaggcuaccagggaugccagacaauggacccugcuggaguagauggacuggacaggaccaaugagcccuucaguaggaaaugagacaccccagaguagggcagcccucucuuuuccuggcugucccucugcuuuugaccucugcucuucucccgugccacacuccucugucuagcucauccccagagccagaaguuucaugccacaugcuugucacuaagacuguagacuucacugcucccccaaacccugaccugaaguuccacaguccacuggacacccuccuggcucauuacaguuccacacgcagauaaagccacugagucacacacccaccucacgagguggcacugccagcucccgauugaucaguaagccuuggagcucagaacgucccagcaagugggacaucccuucagaggagacaugaggccccaugggugagugagcauguggccugauggccugagccuccccaccccugcaggaacuggcagaucugaagcacgugcacggcaaacucaagaagcaguuucaagagaagguggccgagcuggcacacgccaaucggcgcguggagcagcacgagacggaggucaagaagcugcggcugcggguggaagagcucaagaaagagcuggcccaggcagaggaugagguaaauaugaauaggccugagagggacaggccauucacccccaccuguguuccuguaugcuggggcccuggcaccugagacaggaagugagggcagcuggagagaaaggaaaguggaugagcugagugaaugagccagggaggugaguggugguguaaaugguuagaaggcaggaggacucccccaugcacagaggacuagauggacagauggauggagagcggaguggaugaaugagguagagcggcaggugucuaguggaugacggguacacacacaaauuggugacugggugggucaguggacaggaggaagggcaucugaugagaagcaggugaguaugggugaaaggcuauguggccgggcauuuggguggguucuggguugauugcugcaugcuggguagauuuggaggcugguggccugcaaggauggauaucagaauggaaguggucccaaggcaaggcuucaagcgcaggagugggaucagacgcgguuccagaacagaacaggggaaguggcugagccaggcccgagccauuccucauguccucuguccugcucaccccagcuggacgaggcccacaaccaggcacggaagcugcaacggucccuggacgagcagacagaacagagcgagaaccuacaggugcagcuggaacaccugcaguccagguaggcaaggaugcucugcugggggagaggagggauccuaaaggcacacacggggcaagggccagaacccucaggagagccggaggggaagaacaagaaggaagagcucuuggggcgagaauccuguccccuccaaacaggaagggccagggccaggaagcuggaggggaguggcugcaggaagacagcucagcugugggcucuggaauugucuccuucgguugggcgggcgggcuagcgguggugugaguauguggagggcugccaaggagggaggcucugggccaccugccaaggaggccaggcucuggagagggcuagugaauguugggaguccuuggcaagaaacagaaccaucuuccccggucuuggggauggguaaccccagggacaacaggaauaugaaaaguugaaggguuggaaauagcauagugacgggccaaaucccuugguuauggcuggaacccucagccccugagaggcgcuuagauccuccuucauggugcacugccaccucuccuguaccugccccacugccaccucuccucucccugucccacugucccagcucuaaauccugucuucuccacacacuuuccacuuccaagaugaccuggucauggcaaagcacucaggcagagccccgcacagucauaacugggaagccccaagggccacggggccagcguggcuacacccauaccugccuucuaaccugugcggggagggaccuggggccugcagccagauuuuuuggguagguggaaaggcugagugaccuuaggucacugaauacuucugggucagcucccccaucuguaaaauggagaucagucacugugaaaguggagagaguuuauugaaucuuuaaaaggcaccuaaaccaacagaagccgggacaucauuugcacuugacuggggauguacuggugggaucucgugguuaucagcaauggguuuauugagcaucuacuuagugcugcugugugcugagagcuuguguuuaggaugggcuuuggagccaggccucauggucgugugguauaaucuauagggucucaguuuccccauagcuuaagugacaucugaaauuuauacagggcccagacacggaccuggaccugagucaggauuauuggaugcccagcuccgcaagguccaacccuugcagucaaucgcccccucccccucagcaggccacucacuaagccuggggcuuuccagaagucucagccacauuccuggggagccauaaacucccaaaaugggcagccuggcucugcucagccucgccagcaccucuguugggggcgggcagggccacccaggauugcugccucauuuuaguuuguaacuuuucuugcuuuaauguuccgggacagggcacuaaaucaccgugcaguaauggagccgcacucccaccccucccugccgcguuaauaauucaugccuuccaguaagaugcucggagcuacugccuuauuggaggcaguguguuuccuccaccccccccccccgccccuccucaaacgggcaaggucugucugagcagacacuagaacguagugugcucagcgcucuauuucuugauaucucgcauccguaugaggaaucagacccaucucagucaguucugagucugcagucuacaccagaacugggacuguagcucagagcccaauccccacugacuccugucugagcgacacugggaaagucauuuaacucccucaugcuccucguacguaaauugaggugacugaccauaguguuuccccaucugagcacggguaccucagaguacauugcagcucagaagcacuaugauuccuguucugaccugucaccccaccccacccccucaggcuccgcaggcagcagcaaaacgcaccccuuuuugggaagauucguaguacccgauuuggcaccgaggaagccggagacggagccagcgaccuggaugaggaugaggaccugcaaauccagguggccuaggacauccaggguggaagaggaccgaccccaaagcacagaugcccagcggagcauccucucaaacccugacagccaucuuucgcugucuguacgcacuuggguuccaccccccugcuucaaaccacuuccuucucucccaggaaagcgggaguuucaccuaucacaccccugugaagggggagccuguuggauauguauauuguauauaugcccaggguugcuuggacccaacugacagcccagcacccagaucuuaagaccccaccugcacaagacuucgugcagagauggaacauggugagggaggcuugguggucuggaaggggcuauucauaguaagauaccaugaacaugaacucagacuuuuguaauaaauggacuugaagcucucaag

SEQ ID NO: 4666 - RNA, 5085 nt, Mus musculus
cauaucacaucugguccaguuaagagacacaguagauauucacugucccuugagcuccaaggaagcagacucuguggaugcccugccaaagauaaagucugaauaugagucuuggagaacuauugucaccugcuguauuuagaagaggacagaauucagguuggagaccagacccaagccuaccuguuucuccacaagaggacauucuuccucccaggcacagaagcaccuggcugggccugggguguccugugaggcaggagguaugcugagaucuuccuggggguuggucccuuguuucucuggccucaauuucuuugucucuugcaugcugguagcuguacugggacaagaauuacaaaccaugauacucauaagccaggcgacaaaacuggcccagagcagggagguggaaccagcaggaggagggagagagcaugaacaagagagcccagugcucaacagcagugcccagcucagaggauguucgcugcaguaaauacgggaccauguagucuggugcucagggguguuuguuuguuuacuugcuugcuuguuuuaaagauuuauuuuauguauuugaguacacuguaacugugcagaugguucgagccaucaugugguugcugggaauugaacucugggccuuuacucacuccggcccaaagauuaauuuauuauuauauguaaguacaauguagcuugucuucagacccaccagaagagggcaucagaucucauuauagaugguugugagccaccaugugguugcugggacuuuaacucaguaccuucagaagagcagucagugcucuuaaccacugagccaucucuccagcccugguccucaguuuuugccagagaaauuagaaaugugaauuuuaugugagaaauccaacuauuaaaaauuuggcagugguugaaggauggaaagccauuggagguggaauggaguccaucuaaagucagaacccagccccggcuccaacugggaccuucucgagucagugucaaggcuggcugcuucccaaugccaccaccacugugaggagcagaaccccuguuuuacagcuggguccagacuuccuuggcugggucaccuugcaguuaaggguggccaggugacugagcacuggacaauagguggccccuggaaccugagccugcacugcuggacuccccauuccugagcaucagaggcccaggcagugagagggaucagguuaaauguaguugcuaccacugacagccuagguuugaucccugggacccccaugguggaaggagagagcugucuccauaaguugaccucugaccuccacgcgcacaugguauguguggccaaacacacauacacaauacauacauacauacauacauacauacauacauacauacauaauauucuaaagaguuuuaaaaacaagagccaugcauuuccaucuuccccaacuuacuauucugaguaugaacacaugcuguuggccaugagcucagaugaaggcauaucuuggaguagagagcaaaagaaggaugcauaucugguacccuaccuggccauacucacccuaaacagucuggaccauucccugucuaacaaucaccuugugggcauuaccauagccauaguaacaguccaccuagcacagcugcaagaaucuuccucagcugguauuauuuguuucuuuuuacauguauuuauuuauuuauuguucauggugcuggagauagaagacaggaucucucguguauuauuaccccugagccagccucaguucggaauuucaaaaccagaguccucaaaugccuacccccugcuugccuaucuaaccauuuuacaggcugggacgcccaggcacaguaaagucuguaacguaaugaguacagggccucucuauaugcaaagccacaaacaggacccauguucuucccuaagauaaagaggcucuaaggacuccugugcccucagcuguuguguggccccugccaaucacuguccugucugggcaguuuggcaucuugccuggccucugacuaaacagguuugaauuggugcccagugccaauucugucauuugaaguuucuaccaggugacucaagacuuggcaauagaaaggcaguucuuuucccccccaaaaccuugggugcugggugcgagccuuccacuggcuucagcuacuggcucaucuuucucuggagauccagggcuugugaucuggaaagccagaugugcagaaaagaccaauggaggagaauaaagugcuuacuggcuucacuugcccccucaaacacuccugcccucaucucuaaguaacagccucugccagccucucuuagguacuuagccagggugcucacacagcucuguagagccacugcaggcugaguuacucagaggaaacagcaugggcuagggaccagguaggccagguucuccuuccacacgauccugucaagggccagaauccuugacuuugaacucaucuuggaaacaaaguugcaaaugcccaagccaagguccaugcaggagucugcgcaagagcgucuacuuaacaaagcaaggcgacaacaggaaggggaaguaagguggcucucuccaguacuuguagaaguugauagcuccaguccaaagucaauaaaucaagaaacagcaggcuaggcauguuauuuacugccuagaggcagccacaaaagccaaaaguguguggaggaguuugcugagaacccagacuuuuuacuguaagcccucuuuauuaguuuggguuuuaagucuguugguaguguuguuuguuuaagugaccauacucuccaguguugguuugugacauugcugccagucacagaccuguuuggaucuggaaagccacucucaggguuucaugaucgacuugugcagucagguugcauggucggucggucucuauaaaugagcagauaucuggcuuuaggcaaacuucucaaucccucuaagguccaaguuucuccgacuacagaacaggcuucugguauaaugcaguaaguggccacuaggggcacuguucuaauuaacccuuaacgcaagcagucacuucucuuuccuugcuugcccagguauagugccugccaguccacaugauuacagaaaguucuacgucguccuuuuuaguuauugcaaaaauuucaaugcaugggauguaaaauuaguuauaccaggcagcuuucacguucaguguaacgcacuuugcagcgauuggcaggucuucuugggcagaacaaugacucuuuuugacaaaggcaguucuuuuucuuuuucucuuucuuucauucuuucuuucuuuuuguuuuuguuuguuuguuucgagacaggguuucucuguguagccuuggcuguccuggaacucacuuuguagaccaggcuggccucaaacucagaaauccaccugccucugccucuggagugcugggauuaaaggcgugugccaccaccacccagugacagaagcauuucuaaaagaggugacuaggccacagaguuuguguaauugaagcuuuuauuaaaaagcacuaacaacuagaauccacccacaaaugccauaagauagcuuuaacugagucauauugauaccggguauguucacccugcguuuucuuuuugauuuuuuguuugaugguuuauuuuuugagacagggugucuuaagcagagacugaccuugaacucucuccuugcugaggaugaccuugaaagcccacgcccacugcauccacugcguccacugcacacaccucauccugugcauuuucuaacucaugucaccacgugugacuaaacauuuuugcuaaguucaucauccauguuacccugugaaauacaaaucugcauccuuugcccauuuuaguuagaacucucguaauaucccaccgacucauagagccuuccgcauauuacaaccuuaauuccuuaaugcauacgaggcacacaccuucccgcagccuacucugugcccaguuucuucauauaucuuugagcaaagaaaugucauacacucuugacuuauucuaaaaggagggacugcccagugggcagagcaggugacccuugagacuuaccuacaucuccuuguaccaugacacugagaggggacaaggcccagagaagguuggugggccagagugagguacaccaguuuuuuuuuauauuauauaaauaguuuauauucuauuauauuaauuuuaaaauauuuuauauauuuuagcacuguuacauuuuucagucacuggagugucuauacgggcuuaucacgagaaauaggauuugcuauuuguuccuguuggagagcagcuaucccaaaccucucuaccgacaaagccauucuuuccuacagacaugauaucccuuugacagacaucucucugacacucugggcacuccugucaagccuggcauaugauggaacucuguuaacacuggcuuuggggacaucuggaauaaccacucaaugagagcuagccucuccagagugaggcugagcacagggcucccaacucagaaguacaacucaagauuguggcuuggguuuagcuucucaucucaaaucgucuugacuugucugccuuaaaauuucuacauuucacguugguuuugugcaagccacagcacagugacucagcguguguauugcuugugcaaccaggacccucaccuaaucaagauaugucagucuuucaggaguuccuguguuccccgggcagucugucucccuccccuucccccacaggcaacggugaucugaucggucuaaaugcaugagugcagacgguugauaacauuuuuucagagagagacgugagcacacaccagcacgagccguuggcuggggaggaaaguuaacuucccccaagggccugcucuuggaugauggauguggaggaggaggaaggcuguggggacaaacauccccaugggucugaaggcuugaagaugucccucauggaaacccccuccuaggccagagaaaauugaucccagaucacuucaaaaagagccauguugaccucuucuucuaaagcuaagaauaaaaccuguuaaauauuuaccugacauuac

SEQ ID NO: 4667 - RNA, 23041 nt, Mus musculus
uguuaccauagagacaaguaacaguaaggcuguucuuggaggguaaggagggaacuggaaacugggcauggcuggaccugcuugagauagggagggagggcccagagaagcaaaguauuccuuccuggggucuccuagcccugaccugucgggaagggcuguuuuguggagaggagaaggcugcugggaagaggcucugguaggacacuaugggucccucaguagcugaggagguagccuguauggggggggggguguuaauguugcaggucuggacccagacccacuuugauggccuaauuugugaccuugagccccagcuagagcuggccugcccccugacaccuugaucuuucugucauguuucuuuccuugcuccccaccccccaucucccaccccuuucccuuccauagcuccccucuuacauggguuucaaaggcagaaauccauggguuccagucaaagaucugcucucugcuguauguaacuccgaugauucucuuaggcucucuaguccuugcucuucucaccuguagaaugggacucauaggacuaacuacaucagucuguuaaggaugagggauaucauuuuuguguuuaccacacaauagguuucuagugagcugugaaauaaaaguauaacuuuauuaauaaaaauauaacccacuucuugguuaucucccuguaccuaagaggcagcaaagggcuuuaaaaaccagaccaugcugcuagguuggaggucuguuccuggcugguggaagggaugcuuccaagggauguugcuccuccuccaugaggaauguaccugggaccacucagcauguacgaguggucucggugacuucuuccugucggacaacggccauuuugagcgucuuugcuuuuuccucaucucuagcugucaggauggagguccugagagagaaaguggaggaggaggaggaggcugagcgugaagaagcagccgagagggccgaacggacugagaagcuggagagggugacaaaguccgccgaagugagcagagaggggaccauccugagccaggaugagcuucgagaccuggaggggaagcugauggccaucgagaucccuacccaagcugaucacucgugaguguccggacuggggcuuucccagcccagcgcuggcggucagaaaggaccaaggcaggauugguagcaucugggcugggagcgggggucauagagggaugugauucaguuugagguucuacucccagacugcucaccuugccccaguugugugacugggguguguggggaugagggguacggggguggggggaaggccgucaaccuuuugcagccuccauuacuuugucuguguaagagugaaaauauaaguaguggcagucuccauggaguugugaaaaucaaaugaagauaaggcaaagacagcucaggcauuuuaggggauuucugggugugccaagcauggccucucuuagauuauuguuaucuuuccuuggacacagggucauaagccaggccccuguugaugucaccaagcugccuccuuccuauaccaccaacucauugaaggaggagcaccugcugcugguggcagacaacuucucccgccaguacagccaccuguguccagaccgcgugccucucuucuugcacccguuaaaugagugcaaugugccuguaagccuggggcuuggagggcagggccugagcaggagcggggugaggguggggaauggggugaggcauacccaguucuacgugguggucucugggucaaaucccagcuguccuguagaagucccugugaaucagcucuggccugucaggggcuggagagacauacagacuccuggguggguggggggggggggguugcaggccugagaucugaagcucugauuggaagcuguagaugagcccagggccugacacauaguagccuagcacccugccacugcacuguaucuccagccuuuucagucuugaguuaaggugagguguuacuauguagcccaggaugcccuugaacuagcuguggcuuucaguguugauuacaagggccugacacauaguuuaggcuagugcccugccauugagcugcaucuccagccuuuuuagucuugaguuaaaguggcuacuauguagcccaggaugaucuugaacuagagguugcucuccguguugauuacuaacauauucuaggagacugugccuauguauaggguagccacagauggggaaaacugaggcucagggagcuaccuggggccauguggaggguaggccugcucugcucaucuuuuuccuauugcuuugcucuucccuugaggggucaguaccugcuacuggagaccacccuggucacuaguuaccucuguccagaaccucuguaggucucugaaaagaccuuguccugguuggagaucuguguccuuuagcccuuucuuauugagugagcuuagacaauucacuuagugucucagucaggguucucuagagucacagaacuuauggaauaucucauaucguaaggaaauuuauuggaaugacuuauagacugcagucuaacuaacucaacaaugggcagcugugaaugggcagucaaagaaucuaguaguugcucagucccaugaggcuggguguuuccgccagucuucuguauaagcuggaguccugaagaaguagguuccaacagaggagcuggcaaguaagugcaagcaggcuaagaagaaagaacucuuccauuguccuaauguaggccuccagcuguggcccagauuaaagguguguacuaccacaccuggacuuggaacuuguuuugucccaggcuggccuugaacucagagaucugcuugccugucuucugggauuaaaggcauauacuacccugccugggucucagcuuucaguggucucuaugccucaagaucuggaucacauuucuggauuguaguucauuccaaauauagucaagucgacaaccaggaauagccaucauacuuggccuucugggcucgaaaggaaggggcuuuuccccuguccuuccagcccagaugcagaacaagcuaguauuauucccgcggagugaugugaaugggugccucucugccauugccuccuccacgggccaaugccaguccuucccagcaagagacugcuccaacacccugaggcccugugaaccaggucucuccagggucccccugagaauucaagaaaggagguuggaccagccaggcaugaacccucacaggucccugcuauauggggucccuggcaagcucucucacuugcagaaguucgugagcaccacccugaggcccacacugaugcccuacccugaacucuacaacugggacagcugcgcccaguuuguaucugacuuccucaccauggucccacugguugauccccucaagccgguaagugcuauucgcugauuacauagagcaagcccaggggcuuaaggugagccugggugcuagaaggucagccaggcuccagccuuuugcgacacccguaggggaaaacgagagaggacaaccacugacccaaggguacauagcaagccuggucucuccccugcuggauucugccucaguuucaggagggacagcaaagagcuggaggauaccaagcugucuauagcuuucaaccccaucuuugggcuucuaaaagguuuagucugcuuuucacugagaaugggguggagacaggaaagagugguaaauaagcagucguugauagaggaugaggcgagcccaccaguuccuuaaaacagcagacacauacagguuaugugggucuguuuguggcacauccucaagaggcucuggaugcaacaggggcccugccccuacaagugggaggcgacugaugguggguggcaaggggaucuauggagcugacaggugugcuguguucagcccacgcacuuauauuccucgaccaccgugcucaagugccagaagggaaacugcuuugacuucagcacccugcucugcuccauguugauuggcuccggcuaugaugccuacugcgucaauggcuauggcucacuggaccugugccucauggaccugacaagggaaguguguccgcucacugugaaggccaaagagguaugcccaauguuggcagcccaaagaaugcacaguccugggacugcccauccaucuuaggagaucagggcacugcucugacuauccuuagagaaagcaagaacugggucucugcccuggccaccuuagagaagugaggacugagugucugcccuagccauccucagagaagcagguccccaugcaggcuguccuuauacuuauggguuccugccccaucaccgugcauccgcuguugcuccagacucccuauugcaaaccuuuggugauuucucuguccucagcaccacccacagcccaguccuccaaacuguggucccucuugccugucuuagcucaguuuaagacauugugcucccauggggaaagucucauaacucaaauggcuucugccguauaaacagucaucacuagcuuacccacuuccccuugcaucugauaaaagccuguccuguccuguuaauggugggaaacaauggccaaguaagugcuugauucucaguccuccucccacucagacagacagacgggcagacacagacagacaagacagacagacaagacagacauaggcaagaaagauacagacaagacagacagacagacacacacacacacacacacacacacauaccuguuauuguuuuaagauggaacacagaaccuuacccgugcugggcaaagcaucugcucugagcuauauccccagcccguuuagaggggaauacuuagcacugaccccagugagugaugcuugaguuuccuggcugcucucuaaggaagugauaagcaccagaguuucugccaacagaagaagcaguuaucaaauuuaaaaauaugaagugugguuauggucgugggaaaugaacauuacccacauaugaacauauacauauguauauauuucaugccagaaucacacagacaacaacaacgaaaacaaaacaaaacaaaacaaaacaaaacaaaacaaaaaccccaaaucucuuuacacuugaaaaaacaccaugcagagugcacaggaagagcucucuacauccucaguggauuccaaggcucagugacaagggucaggccccucugcagcuggaggauggagacccggagaucugaagcacugagcagcaggucaagaaaagaacucuccaggggcugcuccccccuucucuugcucuuucuccugguuuuucaagacaggguuucucuguguaacgguccuggcuguccuuggacuugcuuuguagaccaggccagccucaaccacaggaaucccccugacucugccuuccaagugcugggauuaaugggaccauggcaacuuuuaauaaggaaaacauuucauuggggcuggcuuacaguuucagagguuuaguccauuaucaucaggauggcauacaggcagacauggugcugagaguucuagaucccaauccacaggcagcaggaagagagagagagagauaccaggccuggcuugagcgugugaaaccucaaagcccacccccuagugacacaccucuuccaauaagaccacaccuacuccaacaaggccaaaccaaauagugccacuaccuauaagccuuuggggcaaauuuucaauaaaacaucacauacuugaugggcaaaugcucucuuacauuuuuuuuuucauuccauggccucugagcucacaccuccuggucuucuuguuucugaggcaaugcaaagaaucaaauguaugucaauaaguaacgaagguagagagcugucuggaugacaaacagguuuaauaugggcuugggucggcucaguggcuauucauggcauccuggguaguugguguuaucacucuuaguauacagaaagauaaaauggcaugcucaagaagaaaaugugauaacauaguuuggaggauggagacccagggauggaagccuggguucgauccccaagacuggagauuauauuucuuucacagucauaagcccaccucagcagcuccuguagaguucuuuccugggaacacauaucaucauuuuguacuuaauuauauacacaugugcacacacauucauguagaaacacacacguucacuuuucuuuccugguucagaaaacuugaacuuggaaucuguguaugaacucucccaaggauaaccccugaaaacucuuaguccagacuaucugccccacccucuaucugggauccagaucagcuggguugagcgccagugcgagcccuuguguguguguguguguguguguguguguguguguguguguguguguguguguguguaauguucuugugccaggcugguggggaggucuuuaguauucucugccaugcagcuagucuugauccauaaagaggauccuccaccucgacucccacuccucccuucagguccuggagcuggggcggcagcucccucuucugucagggcuaggccccgaucccauuaagccuguaaagggugcagugggcgacuuuccacucuucuugggugacagauagucaagaagaaagagaagacggugccuaagaaauacuccaucaagccgccccgggaccugaccagcaaguuugagcaggagcaagaggagaagagaauacaggagaucaaggaucuagaacaaaggcgacuuaaggaagaggaagaucgcauccuggugggccuccacgacacugcacucugacaugacccggugggcccaguggauaacauaccagggccauaaggccuucccuuaagauucacuaaagcgcuccuuacccauagaauguauugccuuucuuuggaugaaaucucaccuagggugccccaaagagugagccacagaucuggucaccugccccaccccccaccccacccccgccacugccaccauuuuagugguugaaaccuggaauucuaaggaggaauguuggaaagagaguuccccuuagcugguggucacccaccuucccugugcaggaggcagagaaagcgaagcccgacccccugcauggccugcggguacacuccuggguccuggugcuggcaggaaagcgagaggugccugagagcuucuucaucgacccucugacugcacgcagcuacaguaccaaggaugagcacuuccugggcauugagagccucuggaaccacaagaacuacuggaucaacaugcaggauugcuggaacugcugcaaggugugccggagucgggagagggguggguaaagaccggggaugggggguuguggggagccuggccaccuacccucugauagcagggucugguggaagucccagacuccacacccacagcuaucaagggccauucuggcaagaugaacuucaccaguuugcuaugugcauucuuuuuaacccauaugcuuauugguuuaugcaaaugaacucugggugcagguuguccaucuaaagggcuaagcacacuguccaccgaaggcccugcuuccuguacccagaauaagaaagaauacggcccaucccucaggaauccucuuguguaaagugcuugccaccgacccuaaugaccugcguuagauacuaggguccgcaugguggaaggagagaacugauuccugaaaguuguccuaugagcugcauauucacacacacacacacacacacacacacacacacacacacacucucucucucucucucucucucucucgaaaaggugcacaauuguaagggcgcaucuuguuagauugguuugugauaaugaacuccccuacauaccagcaccugcccacucccauccaauaaccccuccacccacaagcucuguggucuagcaggugcuuaucagguacagguuaauacuacaaaaacaaggaaaaauuccuuuauacagacacucuucacuugagaaaggaugcauacguccacagggagacgucacugaagggcggggguaggggcagguggcauggccuauggggguggagccagugcugacuucuuaaggguccaucauuuuguuuaacacacuuggucggcagagucguacggugcacguacucuucuguguuggguuugucaagucguggagauguuugagagauuuguccauuuccugccgggcaaugcguugcucguguuuacuguucauuaauucccuguucuugaagcaaaccagaacccauuuugcuguuuuagaguggcauguuuaggccauuuccagcacgggauuauuuggauagugcuucagcgagcacuucccucccugcauuucagggaacacauacauaccugccucugauggauuaagacuugggagagucaccuaucaucucaguagauucuucucauuuugcaaaagugaccgauucaaagcagcacucugugagagucuggacagccuccugcuccuuacacucaguguuugcuugggggagucugagaugaggucucacuccagaccagguugccccggagccaugccuugugccuuagccucgggaacgcugagauuccaggugugcauagcgaggccgcuuguuuuugccauucugugggcagaaggugauguuacguuguuucaaaacuacaacuggccuuuugaagacgguccucauauucagaaagucuaaaaucugucuauuaacucuaagaauuagaaagacuccagggcuguucucucugggaggucaguuuuaauccuuuugugggugacuuucuauaaaaucaguguuguuucuucuuuagacgucaucugggucuagaguucucuuccccacccccacccccacccccaacccaaguucucuuuguaggauguuuuaaaugacacauucaguuuggauaacguguuuaucuggcagugcuggagacaaaccccaaaccuugaguauuccaggcaaaugcucugccauugagacuuauacacccaacucaggacauuuauucuugaguaauuucugguacuuucuuuuucuuuuuuuuuuucuuuuucuuuucuuuuuuuuuuucuuuucuuuuuuuuuuuccuuuucuuucuuucuuucuuucuuuuuuuuuuuugaaaauuuggucccuuucguuuaaauuuucaaauuauugcuauaaaauguuaauagcuccuuauuuuucuuuuacuauuuuaaagacucucucaaucuugacacugauaauguagugauuucuccucuaaugagcuugguuagaggcuuuucaauaguguugguuagaggcuuuucaauaguguuggaauugucaacaaacuagcuuuugguucuguugauuuuuuuuuuucauauagcuuuguuucauuuauuucuguucugauccuuauuauuuucuaauguuuguuuuauugauuaguuucuuaaggugaaaacuuaagaaaugaaccuggcuggcuuuauuuugcuaguaaggaccuucauuucacuccagcgacucccccgcccuuuuucccaguucaaaaauucucucuccuuuuccuuuucacuuauccucugauccaugagucauuuuaaaaugugguguuucagccagauggugguggcaugcccauuuaaccccagcacuuggcaggcagaucuuuugaggccagcccuggucuacagaaggagugccaggagagccagggcuacacagagaaacccugucucaaaacaaaacaaaacaaaacaaaacaaaacaaaaaaacaaaaccccaaaaaacaaacaaagguucuguuuauagacauguagauguguuucccagugaucugucuauuuuuauuucaguuuuuaauuguaugguuuuuagagaauguuuaccauguaacccccacuaucuucuuacagcuugguuguugguccagcuuaugcuaccucucaaauguucugugaauuuaacuaaaaugacuauuuuuugaggcugacuagaagguucuguuggaugucaaucuucacaagccuguugauggugcucacuucuucccuggucuucuuugcugguuuucuauauucuaaagcuccugccugacauuaucugcacccuggauuagaauguuggacuucuuuguuucuucuauugguguuggcuucaaauauucuagaaauauguaauguagugaauacacaguuaagauggccacgucuucaugauaaacagaccccuuguauuauaaaugcccaucuucccuccuucaauauuuuuaauccugauaucuguuugcauuacauaaauauaguuuauucagcuuucuuuugguuuauguuagcaaggcuaccuuugccuuuuaaacaaaucucuguuuguauuuucuauguuuagugugcguuguugggccuuuguccauucugucggucucagccucuugguuguggugcuuaggccacuucuuaugauguuuuuugauaaaucaaauuccuagcuauuauuuuucuagauacauauuccucaaauuugaaaguuuuuuaaaguuuugauugaaaauagauuuuuaagcugggccacacucaggaggcaaaggcaggaggaucucugugaguugaaagccagcuugaucuauauagcaagcuccaggacagcaaggacuacauagaaagaucccauuucaaaaauaaguaaauagacauuucucaugcgauauauucugauuauagauuucccuuauuccucucauauccugccuaccuccccacucacucaaaucuacacccuuucucuauaaaaacaaaaucagcaaaagacaaagcaagcaaacaaaacagaaaggaaaagcacaagaaacauacacaaacacauacacacacacacauacaugcaugcagaaaucccauaaaaacagaaaaccagaaacuauaauuuauaagcaaagaccuagaauguuaaaaagccaaaacaacaacaacaacaagaaaacagacagacagacaaacaaaagacaaauuauuaugagacaaaaaaaaaaaacuuccaaaaauaucacugaguucauuuuguguuggucgucuccugcugggcauaggccugcccuaggugugguuccuaugcccaccgagacaccaugggagaaaucucauuuuucauuugugagugcauguugccauuucccauguguacaugugucuauguuacuaaaacccacauaugaaaaacucagagaugauuggcuaucucaucuccuguagagguguugggugaggaucucgugggaaaagggaagaucuaccaguccuggaugaccuuaccugagucuuucuguuaucuuuagugcuuuggugugguccaucaaagccccagggcagagccuggauuucccaccuccuccuccuccccuccucucccuccccuccuccuccucuuccuccuccucuuccuccuccucuucuccuucuccucuuccucuuccuccuccuccucccccuucucuuccuugccuuccuccuccccuuccucaaccucccccuuccuccuucccuccuccuccucuuccuccucuguaaggagucacaggcagcccaagcuagccuugaacucacuauauaaugaaggaugaccuugaacugcagaacugcagaucuugccuccaucucccagauguugggauuuuccaggcacgugcuccugugccuaguuuaugcggaucugaggacggaucccagggccuugugcaugcuaggcaagcauucuaccaacugagcuacauccccacccccccagaagcucuucuuaacugcuucagaccccugccuggagaaacucuccccccgaccauaaacaccuuucaguucucucuuuucaugaaucuuugcuucuuaauuuucccccaguaguggauggaaccugggccccacccagcccucuaucacuaccuuggagcugcaucccagcacagcuucuuaauuacuaugggcuugauguuugcuucugaagucguaucuuccuuuacagccaagguuggccuuggacucagcaauccuccugccucagcuuccucaauggugcgggauuacagguccacccaccaugcccagcucuuguggauguacuuguggaggaagaaauguuuaaauguagauugacagaagagaaaugugggagaugggaccggauaaugugauuaacucauuugguggggucauuuagcacagcaaaguggcaguuccgggagagaagcugugugcucaaccucuccaugaagcaccugcuguguggccaggcccuguaccuggccuagggacacacagcagaugacacagagcagaucuccaucauugggcacauucguggaagggaaaagcagaaagccacuggaauugaacucaggccucaggucugaguucuguugaguccugugcucuguuguuacaccuaguguccccuguuccugacuagauagaacccugccuggcucccaagggauggcaguggccccuugggagccaggcagggugaauaugcuuguagcacucggcuccugguuccuggcuccuggcuccuggcuccuggcuccuggcucccuggcugggagaaaacaaaaacaaaagcaaaaaacaaagaggcucacauuaaaccagucauuuccugcucagaagugcuccguagugacauacaaugucaucauguauguacagacuguucccagcagggggcaccacugagucuucucuagacaagcuauaggauuucuuucuuccuugggaaaugggaugaugggaugggaguggggucucaguuucccugaugagaugaagaauguggcuggacucuuagagacuggauggagcugacauucugcacagccccugauggccucggggaauagccacugccccuuaggagcaggcacagucaugggguccaggggguggacucagcugguucccccuccaucaggacuugaucuucgaccugggagacccuguaagaugggaguacaugcucuuggggaccgauaagccucaccuguccuugacugaggaggaugaagaagggcuggaugaugaugaugaugauguggaagaccuggugagucugcuagcauggggguggggcgagggccuucaccccauucggugccaggcagucugacagacaucccugcagacaugugcauucugggagagggaaguccaaauguaucaguccuacauucuuccaagcagaggggucuuguagagcucucauuuuacagauggguaaauagaggccuaagcauacccagugaccaucccagaucccagaaccucucaguagguuaggggacagacaguacuugaauucaggcucuccuaucuggagcccugaucaaggcuugaacuguuccuuagagggaccauaccuuuggagugggagcccucaggguccacucugcuagcuccuucuuagucacuggccugggguauccccucaucagacuucugucugucaucuuucaccaagggguaugugugugggggugguggugggguacuuccuacauggagaaaggagagacuaggaggcaaauucccccugcuuuaggaaucuuccaugucuccuuuauguguaaaacuagggugagggucacuguguuugguauccauagcaacaauaacagguguaucagucgccuagcauugccauaagggaguacuacaaaguggaaguuccacacucccagaggcuggaaauucaggaucaaaggugcugcuggcagggcugguuucuuccaaauuccucuggguuugcugguagccaugagcacuguagcuuuaucugacucucucucucugaaucuguguccuuuaucucauaaggacacuuagcauauugcaauagaaccaccugaagacccaauuuagacuccauugccuuacccauaaaguccguacuuccaaaugcaacaggauucauaguuacuggggcgguguguguguguguguguguguguguguguguguguguguauacuuuagcauaugauuuuagagguagguugaggaagcccacaucaacaggcaacacugcggggacagguucugcuccugccgcagaaucugaguucacucauuuaaauccccgcuuccuggguagcugaggacagcuuauacacagcagagcaaaaggagacaccaaaggugucucacccaauaagugagagcuaggaaccaaaccccaacagucuggcugccuucucaggggggugauuauucagcucugacggcugccuaagaaugacugaggccagcugggcggugguggcucacgccuuuaaucccagcacucgggaggcaguggcagguggauuucugaguucgaggccagccuggucuacaaagugaguuccagggcagccaggacuauacagagaaacccugucucaagaagaaaaacaaacgacaaacaacaaacaacaacaacaacaacacaacaagaaugacugaaguggcccuguucuccuucuccuugauucugagcacuggugucccugcuggcugugggcuauguacccuucaacucaggagccugcuccuucuggaagcccugucacaucccuggaaugggaauccuggucccuccaucauggacagaugauagauccugagaaucagcccucagcugcagggccagaccugggauuccugggcugucucaaaaaaguuacuauugcuugccgccaacccaucgaucaccuugugugaucucaaaagaagucacaauuagaugagcaagcacccaaggccugagcauuguuucuggcaaaaguauauacacaggaaaucuugagcugggucugaggaucacuugucuagaccaggccuuauuucacagaccagggaagaacagccaugcagggcccaagacuuauucacaauaucuauuaguccucccaagaggcccaguaaacagcuaaggaaaccuaggcuuaagaguggauggaaaacuuacccagcccuccuuaccuggugcuagguacagucaaagacuguacucccucugacucaggauccccucucugaguagccauuauggcugcaggugguuuggcaugagaaccagugcuaccaucuuagaccacgcaaagagggaguagggguccacccaaaccuacuccucuccuccccuaaccugggucaucuucugacuucuugcucuuccggggaaacugacagcccccuuagcaagucugggucugggguaggggaacagaacugugccauggccucugcuccaaggcccuggccagcaaccaccucuuuuccucacagggcaaagaagaggaggauaagagcuuugacaugccgucuucgugggucucccagauugagaucaccccagaaggucucugucacucacugguucucagcccacagcucagcagaggagccguagaggcuuccugggcccuucuucccagccccucucaacacccugccagcucuguacucagagccugacccuaccugccacacaacuggacuguuaccauuaugagcaccgagguccggggacauggucucuuucuucccuuuccccggauccccuguucagaggaggccaugggcagaacauggaguauauggugccauggggccaggccacaggaaaaaaauaggcaaagaaggcaagaggcuggguuauccuuugcccaaugucuacauaugcccaccuggaaaugccuagaucagaagaagggcauaggcuguuccagcagguggcaaagugcuacagaaguggucaugaacccugggguaggagcacccauuacauccuagauaaggcauggaggcaaaaugggucuuaagagguaguagucauuggggcuggguuuugaaggaucagaugucuuucuagcacauuauucucaguggugaaggccuggcaggggaaaggaguggcuggaucacagauaugauucucagguagcccugggaugcuggcucgcccaagaauaccuugggaagaguugaagccagcacuggcagguauuuucuuccuccuuggagcugguucugggccuggaggcacuuuauaggcaacacagacaauggacaagcauccaggaagggguggaaggaaagaccccagcucccucuacauccacagaguuugagacccguugucccagugggaagaaagugauacaguacaagaaggcacagcuggagaagugguccccauaccucaacaacaacggccuggugugucgccucaccaccuacgaggaccaacaguguaaggcaccuugggggcacggaauggggaaaacaaggagaugccgugcuuggugacuccggguaaaucaguucuaguguguguguguguguguguguguguguguguguguguguauggcagaggccagaggagcuggucugccugcagcaaccaucucuguguccccacaggcacaaagguucuagagauaaaggagugguaccagaaccgggaggauaugcuagagcugaagcacaucaacaagaccacaggccugcacguggacuacuucaagccaggccauccccaagcucugugugguguguggauccccuggcugggcagaccaagggccgugguuggggaggggcguuuacauacgaugacacugaugggaagaaccgacccuaggcaucacggagggccuuggguggcaagcaugggcauuaccucugacucuguaagauaaggugguguguggucagcugaggaagcccagaaagggaagacaccaugaccaucggcucucuaggaaagucaaagccagggccacaugcuguucugugccugggaucaggccggaaucuccuccagaggguacaugauaugggccacauguaaagggucuaagaaugcugggccauaaagccaacuagcaccaccaaagaggcaacguaggagcagaguggccacuguauggcucuauggcuaggaguccaugaggucgggaagaggggaaagaaagaacgugccuccugagguccauaucguaccccagacuucagcagagaaaagucuggagccuacggacaccgaccacguuugggaguugaaauuuucaagauuaaaccaagaagggaccaugccacaaccuaugugugggcaagugguccuaaccuggugggugugcuggggguugaaaguggcaggaaguuguuccuuacugauaccagccagucacucuuaagaauaauugagcuaaauguguuagcaauauggagauauagcucagugacagaacacgugcuuagcacaccugaggccccgugugcacuccaucucuaaacagcaacauuaauggccuuaaaaugggagcacgucuucuuccgguaauuccucugcugagaauauguucucagcagaggcugagcaagaacaauaaauguaugcuacaguuguucaucaugguguuguuuauaaaaacaaaaacaauuaaguguaacuguagugcccagaaaguggggguuggguacacaauggauccucacgugugcuucggaacaugggggccugggauuggguuccagagccagcugccgcagcccuugaugcucacccagccccuuccucccuccccuucugccgcccccccuacccccccgugccucagugcacucauacaagucuaugcuaccugagauggaccgcgucauggaguucuauaaaaaaauccguguggauggccuggugaagcgggaggagacgcccaugacaaugaccgaguacuaugaagggcgcuccgacuuccuugccuaucggcacgucaauuuuggacccagagucaagaagcucagccagagcagcguggagucgaacccaaggcccaugguggugagaguacacgugggcuggggacuggcugcccacccucgcuggcagauagagagccagcaggaucaggggagcccugacucagggaugaucauuaaugccugugauuuuugccaggguucuaaauaugaaacaaccacuuuuaacaaaugcagaccccugggcuuguuaggaccaagccuuguccccagccacuagacaaagaagcaaggcuuccucauuguaaugaacaaauacacacauaauaaccagacaucuggaaauaugggaaacuaaugaaacggacagauaucucaaauaaccucucuccaaaauuacuguggacuaguaggcuuguucauagcuggacaacuaaucccagcaguugagaggugguagcugaagaguaaagaguucaaggcaacccucaucuacauagugaguccaaggcugagccacaugaacuccuagcucagugagccgaggacauagcucacucaguaaagaguuugcuuucuaagcacgaagaccuggauuuaauccccggcacucacaaaaacagccuggcacuaugacccgcaucugugaucccagcaccagggaggcaaacauaggguuuguuggccugccagucaagccaaaccagugagguuugaguucaagugagcccaaguuuugagacauaaacccugucucaaaaaaacaagcaggagaacaauuaagaaagacaaugucaaucucuggcuaccacacaaaugcguguaugcacaccaaggcgcucacacacaauuuguuuuaaauuauauugagaucuggggugaggguuucagcugcuuggacucaaacugagcuuuguuuccucugagaugcuacaaaguucuuggccauugaacuuccuggccacacaccaaagaugcuccuuucuguaguaaggguuagcugauaaugggacaggcuuucuggagagcuccccgccucuagaagcagacaagcagagucguguggagggaauuggagaaagguccaacaccaugaaaacccacgggggucauagaauccauugucuagcaggaagggcgcgcaccccuggacuccugggucaugagaguccuucccuccugcccacagagcaugcucagaaaaacccccuccucugcguguucuggccacacagaaaaucacagagcgguucucccgcaauccagagaagcccgcggaugaggacguggcagagcguuuguuucugauaguggaagagcgcauccagcuucgcuaccauugccgcgacgacuacaucaccgcauccaagcgagaguuccugcggcgcauggaggucgacagcaagggaaacaagaucaucaugacaccagaaaugugcaucagcuacgaggugggucggugacugcacggcacacagaaagguuggggacacacuuuaaaaacugcgccugcaagcaucuucugguaacuugagagacccuaaguggaauuucuaugaaaacuacccuggggaaacccaucucugucccugguaacaugcaaagcucucaucugaggaccuuucccuugcaacggcucugaaaaucaucccauuuccaccaaaaugaaaacccuaucagauguaacuggaaugcccagagaguggggguugggcacacgacuaauauucauguguacuucagaacaucccucacccugggccugggguuggguuccagagccuuccucauggucccuaccugcaccucuggggauccuagaccccagaucccagggaccuauccugaaggugacaggauauucuuucuuaugcccuagacucuaggauggucucgccuuccucuucuaauagcauaaccguaaucccccugcaucuuucuuuggucccucuuuguuauuauguuuuuguagagaaggauccuggggucuggagagguuaagcaccuugcuugaggccacacagcuagaaaaaagggaguagauuuaaaccaaguggucccuagaccugcccuggcgcagcuucccugucaccguggugguucuggucucagguagagccgauggagcacacuaagaaacuccucuaccaguacgagaccaugaaucagcugaagaacgaagaaaagcugucccgacaucaggccugggagucggagcuggagguaagguccuaccccagaccucgggggggggggguggcgggggggggcagggagagagggccuccgccgugaugcaccuccuccaugaugucugaucaaggugcuggagauuuugaagcuccgugaagaggaggaggaggcacacacgcugaccaucuccaucuacgacaccaagcgcaacgagaagagcaaagaguaucgggaggccauggugagucucccggcucuuccugggucucucuccccggagcccugccuccaggguagggaggaugugagaacccuguguaagggaugaugaggggaugugccaacccuucacaagggaugaugaagucgcuggugaugucaggugaguauuccuguuggcuaucaccugcucguugaugggucacccucccacccccaucccaaagagcacuuaagauccaggcuggguguacuuacccaggacugugaccaaaugaaaaagucucuaccuuguguagagaaagaaugagaacuacaugcccaccucuaccagggcuuucacugaggcugugaccugagcugggaauccagccaacugacucaggcacagguugaacaccaagacucagccacgcaaugcagggcuuuggcuuuacccacucucgccaagugggaggaccaguuuggguucccaggcucgaggcuaaauccucuucaucaagcagugcagaucucuaaagaaguuuggaguuggccuggcaaggcuuggcuuuggaauguucuuggaucuauaggaaagggcaacagcuccuguccucauguucucuggcuccugugugccccauguaaggccggccuuaugggcaaaagagaaaaaugggagcucagaaucuuugcuaacccacugccacucacuauaagugucugcuuuggacuuuccagaccugagcuggucuguuuucagaggaggaaacuaaggcucagacugauugaugaauucgugucagaaacaggaauuacauguuagaaagaaauaaacagggagaaggaggcaaucgugucucauaauccugggacauggauuuagggccuggcuuuuaccauugcacaauggacucagcugcuccggaggucuccugcauaucccgaucuuucagcugguucccuggcccacaggagcgcgucuugcaugaggagcaccugcggcagguggaggcccagcuggacuaccuggccccauuccuggcccagcucccuccaggcgagaagcuaacccguuggcaggcggugcgucucaaggacgagugucucagcgacuucaagcagcggcucaucgacaaggcuaaccucauccaggcucgcuuugagaagguguggccagggcccaggcaggggaggugaccucaccauccucagugagaaaacgggaccugaggucuuugcucagugccucacggauccgagagugacagaugagcggaugagugugugucuguggcauccaaauaccugguuucuucuuuccccuuuguuauuguaugaguggauggauggaugguggguagcuggguaaauggaugaguggauggauggguuaccagguggugguggggugggcagguacaguuggaugugcagugaggauuagaaguggaguguggguggaugguugguugguuggauggauggauggauggaugaugguauggauggguaacuaagaugggcagacagggggauacaagaguggauggguagguuugugaauggauggacgguuggaugguacauuauaauagcuccuaguccuuggccuguuuccgugagacaggugaggugcguaccacgugguccccacgcagugucuuggucugcagagugcagagaagaguuggguggaaugggacccaccuuguuuucggagacgaacugcugggggcucugagcacgcccgcaacaugucuagcucauguagcuauuuuguguguauggguguuuugucuguaugugugcaugcccaccacaugcaugccuagugcccucagaggcuagaagaggucaucgcaucccccgggacuggaguuucagaugauucugagccuccaugugcauuuugagaaucuaaccccaguccucuggagagcagggaguccccugcuucauuuuuugagacaggguuucacucuuuggccuucacugaccuggaacuugcuguauagaccagacuggccuuaaacucacaaagauccaucugccucugccuaaugggagcugggauuaaaggugugcacaucccacccaguuguuuugauuuuauauaugagcugcuaggaguggaacccagggccaugcacuaaaccacaucccuagcucucgcugacuguuuuggcccuguucugauuucaugcacaugcuguccuuuaaaucaugaccccagcaguuuccacccaagauauuuugggaugcucuaacugugucccuuuccuuggggguccggguugggguguuauccucuugaggcugccugaucaucuauggaacuacagccuggcugcagaucaguucgcacauucccauguucaucucuguaugcuucuaggagacccaggagcugcagaagaagcagcaaugguaccaggagaaccagguaacccugacgccggaggaugaaaaccuguaccugagcuacuguucucaggccauguuccgcauccgaaucuuggaacagcggcucaaucgguaaggggcagagccgggaggacuccugggagcacucugauagcuuggauaucccucaccuucuccucccucccucugcucaggcacaaagagcuggcuccacugaaguaccuggcgcuggaggaaaagcucuacaaagacccacgcuuaauagacuucguaaaagucuuuguuugauggccccuccuggaacuacggcagacccugccagagaauggagucucucccuucuccccaaccacuaugauccuauacuagccucgcugccacacuaccucccuaucccucauagccucccucaaauaaaugcauuuccuguuugccauuuau

SEQ ID NO: 4668 - RNA, 1008 nt, Mus musculus
ucuuuuuuuuuuuuuuuuucccagagucucaguauguaguccagacuggccuggaacucauccuccugccuuuguuucccaaaugcuagggucacaggugucugaagggccgcuucauccauugugcugaugagacaccaugcucaccugaguuaggauauaggcggggccccagagaacagcucaccacauauuauuucuuccagagccauucucagggacccuaaauccggggcaguagcuggggguuaccccugcaguucauuggagcugccaccuucucucugcagagccugacaggucacacguccccuguggagaguguccgucucaacacuccugaggagcucaucguagcugguucccagucgggcuccauccgcgucugggaccuggaagcugcuaaaaguaggccuuccuccuuccuaucccuuugugugugggucccacuucaggcuugggucauugggcugccaccuccaagaggucugggugcuuugaucccugaucacugagcagaguggguggugccuccauaucacguuaucaauguagcagcaguggucacugccaucucccaguugcuggcaugagguguccaagggaugaagaguaagguguguguacauguacaucccuguauugagaacccagaaggacaucaaauccuaggagguagccugcaggacaugugaauaaguagacugcuuugugggaagaggcagauacuggggagcucccacagggguggggguggguggcugagcuucuguuugcuucucuuccccuugucuucaguuaaucuuucacuuugacaggaauaacagaguucugaaaguuuauuuuaucaugaaccuugauggcacaaggcucaugaaggcuucgacccagucauccccgccccuguucuaagagccuccagucucccuuccuugcuguugugcccacaccaccaccaucgcuuuccuaaagacacagcauuucccuuuagaacaacaaaacaaaacc

SEQ ID NO: 4669 - RNA, 15924 nt, Mus musculus
cucuggcuucccugggucccaggcagggcucuuuguccacaccuccuuggugaagacaccgcuggguccugggaccagcgugcuugccaucccagggcaggggugucuccucagcacaguccccuucacgagaggauucugguugugucaucagcaggcccugcgggacaaggggugcgagagcaagagucaggggacgaaagaagacgagcucccgaagaggcaggcgccggcccccaggcgggaccgggaggccccagaagcuggugguaccaugaauguagaaaauacagguaaaagaggucagccccacugugacacacucuggcugagcuagugcaggagggagaccucugucccacagcuggaaguggcucagccagacuggccaccugacaugaacuugagacucuguccagccucuuccagauccacggacaaccaugugucugucccagggccacacccagugauaagagacuuuggccacuggagguuggguuggauuucccuucuuuuuugucuuuucccaguaccuaccuaaagcagggcgcaagagcagccucccagacgccaccgggucccuucgccaccgggucccuuuggcagaggccuggccguguucuggucagaggauccagaggucagggauuuguuuccccuccccccagacugagacaccuaagccugcaguuccauuauccucugaccgcuguggcaccuagagcuagcugguuuuauuuagaagguucuccgggcuccuuugcagguucuggguuuucggcaguaaguacuggccaaugaacacagggagagaacaccuuacggagccucaggacaaggccaggaguacuaggaaaaggugcuucugcuuucucagagucugugugucugaauuugcugagguuguuggaggaugucacucccuucucucugagucugaaccagugccuguuccguacgaacgagcccugguccacccagauucagggcaggcauaggguguggguaagcagugggcaggcaggcuuucaaaauggccaccaucuggccagcaagguggggcagguccagaggaggaaggcuagguccucuuagcagugaggauuggugcagcaccugagccaugggcccuguggugggccaugccucuggaaacuggccuguugggucaggugguugcuuccucagccaggggcuuggucugcgcaaggucccuugggccucgccucuccucccuucuucccauucucaguccucccuuagcuucaagagaguuucuuccacuacccaugacucugcagguuccacucaacuccuggcccucuuacacgggguaccaugcugaggucuggggcucagagccucccaggacaggagccaugucauggaugacacucggaccugugcuaccugugggaucccagcuacuuucccagggcugcuuuugggcuagguacaucgucccuguuucacacaggaagagccuacaggguccccccuucaaugugauucaagaggcaagcccagcucucagccaagccagcacauucugucacgcaccagugcagucuguggccauacugaucacaugucaucuguggcagccccgugugccgaccuagaagcaucgggggcugcccuuacucccucuagaauagaucacagaggcugggccuguaccgugugacuuucaugcugugugucacaugcagagccacacagcuggggccacuugccuagcacggguuguccagcuccggaucucugggggggguggggggugggaggacacuagccccacccaugggagcccagcuaccgcugcugccucccauuucccugugccacucuggggcuuugcagaacuguggucaaggcuugcuaguggugugggguggccccucaccuuugagaaagccagaagcuaaggcugcauugaaauagaaggcuccccagcuagcacugggccucccuccgaaugcccagacucuuugcaggaccccagcuugggaugcugaggggagaaggcaagucauuuucuuguucccccuggacugcugcugguuccucauugcacagagcuuuggaacagccccauugcacaucacagccccugaugcuuguccugucucccauccugaugacagaacaguagaaaguauugggggaggaggaguugggccucucuugugccugugugacacuccacucaaccccccucugcaccccaguucccccccccagaccccuguacaggcaucaaccugaaaaugugccuagccccuggucugucccaugugcuggccugucugugcucacagacaugcccccuaccccuccuccacgugcacaggugaccacuucacaccgagcagcugacuaagucugguacucucugcugugcuuuugagagaucgggaauuagcauggagagccauuucugagugagccaccuuucuuuccaaguggaaauugccugagggcuggccacugagagaugcacuagcccuggcuggaauucaccaguuugaggggauucaggaaaaaugguuuuccucagucuugguuuaggcaguucuguccccuagaagcuauagcuaaagugacuuccccagaggccaaccuggagguccccugcaaacccauuuugcuguauccuucagccccaccugcuagcauccucuucccgcccugauggugcgcccuguugugauggccgccucccuccuccaggcagaccuccacucuccugcugaucagccacuacuuugcuuguaggugggcggcucuuuggcaucgggaggugcucaagccuguccggggcaccaggcccagaccccgugguacauaggaccguggaggccaugucccagcuucaggaggagcugguaguccuucgggagaggcuggcccuccacgacagugaccggcaagccacaaccacccagcugcagaaccagguaccuggggaggcagggaugagcagaggccacucacugcccucuggggaacaggucagaggacauugucagggcaccuagacuccaccagaagccagauggugacgcucuucugguucgggaagacgcuguagggugaggagguucaaaccugguaucuuacugcagcaagugucuucggcaccugagcgucuucccagucaaaacauuuuccucuguaauugauggaaucuacuugcuuguuaauugggguaguugagggccgcugagaugguucagcagguaagagcaccugacuguucuuccaaagguccugaguucaaaucccagcaaccacaugcuggcucacaaccaucuguuaugagaucugauucccucuucuggugugucugaagucagcuacaguguacuuacauaaaauaauuuuuaaaaaaaggugggggguggagucgaaagugaacugcucagacuuucuggugucccuagcuccgcuccucucaucaccuuuaagguggaccuuaacccacccucaggccucagaugacuugagaauucaaaacuguaucuagccucugcucagguuuuauuggugggcuuuuugguuauguguuuauuacaauguucuuaagggaugguaucuguagcugugcucuguaggguccaacccuguggagacauggccagccuccugagcugugaguaaacccugacucuggcagcacuuacuaguccugggcuagguaacuaccagucugcaccucauuuccucaucugcaaacggauaagacaacagaauccagaugugcuagcacauuguaggggcagaugugacucuggaacccuggaaauacaucugucugagguggucuuggcugugaggcuguagggagaguugucuguccugugaaccccacuuucugaauuccagccaggccgagaugaguguggcuuguaagaguggacaagaaguugguuaugaacuauaaaguguacuguccugugggggcuguuccuguggccccuugaauuccugagccucaccguggguuuuguuuuauguuguuggcuguugguuuuucuuuucuuucuuuuuuaaguuuauuuauuucuuucauguaugugaggacacugucgcugucuucagacacaccagaagagggcaucagaugcccauuacagauaguugcgagccaccguguaguugcuggggauugaacucaggaccucuggaagagcaguuagugcucuuaacugcuugaaccaucucuccagcccugcuguugguuuuucugagauaagcucuccaucuagccuagugugccuuggaacucacuaacuggugcuggcuauuuuguuguucccaugagcuccacaguagguaguggccaccuucugggcacggugagugacacugcuaccaacaccugugcacagcuguccuuccaguuccugcuuucaguucuuuggugcauaugcccaggguuggaauuacuggaugguguagggcuucguuaucucuucuuguuuauuuauccuugagauguggcuucuuuuccuugcuuuuuccccccuccauuuuuucaauuuauuuauuuauucauugguguuuucaagacaggguuucucuguguagccuuggcuguccuggaacucacucuguagaccagguuggccucgaacucagaaaucugccugccucugccucuucccccuccauuuuuaaacagacaggggucucacuguguggcuuuguuuguccuggaacucccuggguagaccaggcuagccucaaacuuucagacucauagagaucuaccucucucugccuuccaagugcugggauuaaaggugugugcuacuaugccuuacuguauuagcucaagcugcuguugaacucagggugacucuccugcugccuccugugugcugguauuacagguguaggcuacauaacugacuauuaucauuauauuuuuccuuuuuucuuagaggcuuccuaugugaccuugaacucacaggcaacaguccugucucugguuucuuaggggcuggggcgguaggggugggcaccuccaugccgaacucaguuuauaauuuuuuggaguggucaccuccaugccgaacucaguuuauaauuuuuugaggauccaccacuguguuuuccacaguagcuacaccauuucccaugccaccaacagcgcccagaguacuggucucuguguccuccuugacgcuuauuuaauagccauuccaguggguauagaguggugucucauugugugguuuaaggguuuuguuuuguuuagauuuucaagauaaaguuucucuguagccuuggcuguccuggaacucacuuuguagaucaagcuggccucgaacucagaaaucugccugcuuccugagugcugggacuaaagguguaugcuaccucagccaaguucuuuuuuggcccaggugauuuggugucuguugcugagugguaggccuuuuuucucggauguuaacccuuucacaguaacugaguagcacauuuccuucccacucccugguugccuuucacucgaugacuuugguuucagggaucauaccggaagcucuccaccugggaugcuauuuuuuaaugucuuguuuuuacuuuuauuuucuauguguaugcguguuuuguuuguuuuguuuuuuuuuuguuguuuuuugagacaggguuucccuauguagcccuggguguccuggaacucacuuuguagaccagacuggccucgaacuuagaaauccaccugccucugccucccaagugcugggauuaaaggcaugcgccaccaccagcuguguaugcauguuuugccugcaugugguaccugcagaagccagaagagggcaucagaucccucggaacuggaguuacacacagauguuugccacaguguggguugcuaggaaucagacccggaucuuuugagagagcagccagugcuuuuagcuucuacaucucgucuccagccccuauaccugugauuuuugucaaguuguagaaguucaaaaguuaauuuuuguaaagaccacuuaacuuuuuuuuuaaaaacuguuugugcuuuaguggucauaucaaaaauuccacugccaaauucagugucuaugaaguuuuucucucuauccuucuaagagucuuaucauuugauuucuuguguuugggucuuugauccauuugcugguuuuuucuguauauuacucuaugguauauggguaagggccagacuucauuauuuggcaugcggagacgacacaguacaccguucuccaguugucaguauuauuauucuuugccauugcacggucuuugcauacuugucaaaaaucgucaggucauaucugugaggucuacuccggacucccuaguccucccuguuauccucacgucugccuuccugccugcgccacacugcucggaucgcugugguacugaagucaagguacagacuuccaccuucauuuuucuuguuuggcauccuuuaacuuugcacgaguuuuagcguggauuuuuuuuuuuaaugucuucagaaaaugcuguuagguuuugguaguaacugucuugccucucuagauugcucugaguucugcugaaacccaauuuauugcgucucccacccaugacccacgauaccuuuccuuuaugcugcugucuucaaucuccuucagcugcuuuugaagucuucauucuguacggucuuggugugugacugugcaugcacguucccguguguuugcagacacccccacgggcagaggcuggaggugacaccgaguaucucccucugucacuucccaccuuaguuuuugagauaaagucucuugcuguucccggcgcccaccauuuuggccagacuguuuaggaaagcccuggaauguacuuccugucucaguccuccagcgccaugugcagcccugccuggauuaauacauauuaaccuuucuauucuuuauguguaggaauacucugcuugcaugucugucugucugugcaccacuuccgugcaguacccuuugaggccugcaguuacuacagaugguugugagaugccgugugggucaucuggacacccggccacuuaacuagccacugagccaucucucuggcuccagccacgcccagcuuuguccguggaugaugggggccugcgcuaaggcccacggcuugagcagcaggcacuuuauccacaagccgucuccccagcuccuccugcuuacauuuacccugguuuucuucucuugaggcgaccacaaguggaaugauuuuauuuuucucccuuggauugucuguuguuauagcaacacaacugacauuuguguugauuucacaucccgccacucugcuaaaguuaauaguucuuacuggccugauuuuaaaaucaaauuagucgccagcuuuaaaccugcuugcaugaaaaucugccuacccacccuuccauugcuggggauuaaaccuacagccucugcuuaguuagccacaccccggcccugggcugcacuuuuguuucuaacauuggauguuguggcuccucugggcugacauucccacauggccacuucugcaugaggucauguaguaguucuagucucuaguggagugugcaugugucagcccaccucggcccaggucuucccucuggccaacucccccccccuccccccccacacacacuggugucugagggcacucccgcauucagcacucaucacucacauuuaccaagaaccagccuagugcaaggcacuaggagugcagcgccuaaggucaccacagaucuccuacgcuagcaucccugauccccagaucccagauguuucaaauguucaaaguccuguaucaacaccaugcuacaacucuugacaacuaagcccaaacaaggguuauuucaugucccaaaauguuacuuuaaaauacuguaaaaaugaccucagguuauguuuauaagguacauauggcacacaggucagcaagcugccuagaccugggcuccaugcccaagaugucucaucgucuguacgcaaaaagaagauucugagcuagagagaauuccuggucccaagcauuucagaggccagauucuacuacaaacuguuuaugguccaacacaccgugugcugggccugggcgaacacgcugcauagauucccauauuuagucuccaagggcuugaugcgguugccuugaguguggcugggaagcggaaaggcaggcagaggugaaggugaagguacuccuccauggcugcucgcgugagcugagcucuuguuggacuugacuugccauacuguguucucaaaugcugcccugccccucaggguggaggacugaggggaugacuuggcacuggauacggcugugccaaccaggcuaggccagccuccuugcuggguguaguggcuauuccugguugucaacuugacaauauuuggaaugaauuacaauccggaauuggaaggcucaccagugacccuuaucuggaggcuuggagauccuuaucuggaucuugguuugaagaucuugagccacaguggcuaugaauuccagaagauugaaucuccgaguuuaaggaacacacauuuaaucugggcuacgccuuucaucugggauuaaaggugugguggaacacaccuuuaaucugggcuacaccuucugcuggagacaauauaaggacauuggaagaagggagucuagcuucuugcucuugcuccuucgccugcuugcugcgugagacugaguaacugcuagauccuuggacuuccauucacagcugcgacugaacaauuguugggaauuggcugccgacuguaagucaucaauaaauuccuuuacuaucuagagacuaucuguaaguucugugacucuagagaacccugacuaauauagaaguugguaccaggagugguucuagaguaacagaaguacaaggaugaaucuuuuaaaauucuggaauuggcuuguugauccaccagcacuuucaacuauugaaaccucuccagauucucucccuccugggagcucagagaauuuugaagacccaugguugaaacuauauuccgaacuuaaagaagcuaaugcccuugauuuucuuaaugaauuaggugauucagugcacaaagcuuucuacaagauggggaaaaaaucgaaaaaugauuuuacuggcuggcugcucuuaguaucuguggaaaaaaugaugaaugaaaggaaggaguugugugauaaaaucaaaaggcuccagacacaaguaaacgaucuaaaaguugcuaaguguguccuugaggagaaucuucucucuuguagcaauagagcucaaguugcagaaaaucaaacagaaacucucauuguaagguuggcugaacuacagcgaaaauucaagucucagccucagagugugucgacaguuaaaguaagggcucuaauuggcaaagaaugggauccuacaacaugggauggggaugugugggaagaccauguugaagcugaaaauuuugaauccucagauucucaaggguuugccccaccugaggaaguaguacccucagccccaccucuugaaauaaugccuuccccacaugaggaaauuaauuuugcagagucugcucacggcccaccaauaguuucuucuagaccuguaaccagacucaaagcaaaacaggcuccuagaggggagguagaaaguguaguccaugaggaaauucgcuacacuacuaaggagcuuaaugaguuugcuaauucauucaagcagaaaccuggugaauaugugugggaauggauuuuaagggugugggauaaggguggaaggaacauaaaacuagagcaggcugaguuuauugacauggguccucugaguagagauucuagguuuaauacggaagcucgcauaguuaaaaaaggugucaaaaguuuguuugaaugguuggcugagguguuuaucaaaagauggccuacuggaaaugacuuggagaugccugauauuccauggcuuaguguugaugaagggauuuuaagacuuagggaaauugcaaugcuagaguggauauauuguguaaagcauaauuguccacaaugggaagguccagaagauaugccuuucaccagcucuauaagacgcaaauuggugagaggggcaccagcacauuugaaggguuuuguucuuucccuuuuccuugugccagaucuuagcauuggagaugcuucugcucaauuagaugaauuaaauucacuggguuuaguuggauuccgagguaacaagggccagguggcagcacugaauugcccgagacaaggugauucuaguuauuauaauggacagcguagacaaaagaauguuuauaauaacauacccaguaauggucagcacaggagaggugaaauuuauaauggcaugacucgguuggaccuuugguacuggcuaaccaaucaugguguuuccaggaaugaaauacauaggaagccuacugcauauuuguuugaucuguauaagcagaaaaauucucaaacaaaugaaagaaaggcuacauuagaucgugguaaacagccaaaugaaagaaaggcuacauuagaucgugguaaacagcaaucucggccagugaaucaauuuccagacuugagacaguuugcagauccagaaccccuugaaugaagggguggccagguuccgcugaggaaggaucuugauaagacacucaaagguuuugcuguuacccuuucuccaguucuuccccagagggaccuacggccuuuuacaaggguaacuguacacuggggaaaaggaaauaaucagacuuuucggggucugcuggauacugguucugaguugacacugaucccaggggaucccaagaaacauuguggcccuccaguuaaaguaggggcuuauggagggcaggugauuaauggaguuuugacugaugucugacucacaguagguccaguagguccccggacacauccuguggugauuuccccaguuccagaauguauaauugggauagauauacucagaaauuggcagaauucucauauugguucccugaacuguaaagugagggcuauuaugguuggaaaggccaaauggaagccuuuagaguugccucugccaaagaaaauagugaaucaaaaacaguaucguauuccuggaggcauugcagaaauuacugccacuaucaaggacuugaaagaugcagggguggugguucccaccacaucuccauuuaacucuccuaucuggccagugcagaaaacagauggaucauggagaaugacaguugauuaucgaaaacuaaaucagguaguaacuccaauugcagcugcuguaccagauguaguuuuguuacuugagcaaauuaacacaucuccuggcaccugguaugcagcuauugaucuggcaaaugccuucuucucaguaccuguccauaaggaccaccagaagcaauuugcuuucaguuggcaaggccaacaguauacuuucacaauuuugccucaaggauauauuaacucuccugcccugugucauaauuuaguuagaagggaucuugaucguuuggaucuuccacaaaauaucacauuggugcacuauauugaugacauuaugcugauuggaccaagugagcaggaaguagcaaccacuuuggacucauugguaacacauaugcguaucagaggaugggaaauaaauccaaccaaaauucaaggaccaucuaccucagugaaauucuuaggaguccagugguguggggcaugcagagauauuccuucuaaggugaaagauaaguuauugcaccuggccccuccuacaaccaagaaagaagcacguuuagugggucuauuuggauucuggagacaacacaucccucacuuggguguguuacuuaggccuauuuaccaagugacucggaaagcugcuagcuuuguguggggccuggaacaggagaaggcccuucaacagguccaggcugcugugcaggcugcucuaccacuuggaccauaugacccaguagacccgaugguacuugaggugucuguggcugauagagaugcuguuuggagccucuggcaggccccuguaggugaaucacagaaaagaccuuugggauuuuggagcaaagcucuaccaucaucugcagacaacuauucucccuuugaaaaacagcucuuggccugcuauugggccuuaguggaaacugaacguuugacgauaggacaccaaguuacuaugcgaccugaacuacccaucaugagcuggguacuaucagacccugcaagucauaaagugggacaugcacagcagcagucuauuaucaaauggaagugguauauacgugaucgggccagagcagguccugaaggcacaagcaaguuacaugaagaaguugcucaaaugccuaugguuucuacuccuguuacaaugccaucugcugccaagcaugcaucuauagccucaugggguguucccuaugaucgacugaccgaagaggagaagacuagagccugguuuacugauggcucugcacguuaugcaggcaccacccagaaguggacagcugcagcauuacaaccucuuucugggacaaccuugaaagacacaggugaagggaaaucuucacaguggucagaacuucgggcaguacacaugguauuacaguuuguuugcaagaagaaauggccagauguacgauuauucacugacucaugggcuguagccaauggauuggcuggauggucagggacuuggaaagaucacaauuggaaaauuggugagaaagacaucuggggaagaaguauguggauagaucucuccaaaugggcaaaggaugugaagauauuugugucccauguaaaugcucaccaaaaggugacuucagccgaggaggaguucaauaaucaaguggauaagaugacccguucuguggacagucagccucucuccccagccaucccugucauugcucaaugggcacaugaacaaaguggucaugguggucgagauggagguuaugcuugggcucagcaacacgggcuuccacucaccaaagcugaccuggcuacugcugcugcugauugccagaucugccaacagcagaaaccaacacugagccccagauauggcaccauuccucgaggugaccagccagcaaccugguggcagguugacuacauuggaccacuuccuucguggaaaggacagcguuuuguucuuacuggaguagauacuuauucugguuauggauuugccuuuccugcacguaaugccucugcuaaaaccaccauucacggacugacagaaugccucaucuaucgucaugguauuccacacaguauugcuucugaccaaggaacucauuucacagccagagaaguacgacagugggcccacgaucauggaauacacuggucuuaccacauuccccaucauccugaagcagcugggcugauagaaagauggaauggccuuuugaagacgcaguuacagcgccaauuaggugguaacagcuuggaaggcugggguagaguucuucagaaggcaguauaugcuuugaaucagcgcucgauauaugguacaguuucacccauagccaggauucauggguccaggaaucaagggguggaaaacggaauaguuccacuuacuaucacuccuagugacccucuaggaaaauuuuugcuuccuguccccauaacucuagguucugcuggccuagaaguuuuggcuccagagaggggagugcuccuaccaggagcuacaacaaacauuccauugaacuggaagcucagacuucccccuggucauuuugggcuucuaaugcccuuaaaccaacaggcuaaaaaaggaauaacaguguuaggaggggugauagauccagauuaccauggggaaauuggauuaccucuucacaauggugguaagcaagauuaugucuggaguguaggagaucccuuagggcgucucuuaguacuaccauguccugugauuaaagucaaugggaaacuacaacagccuaauccaagcaggaugacaaaggacacagacccaucaggaaugaagguaugggucaauccuccaggaaaagagccaagaccugcugaggugcuggcugaaggugaaggaaauacagaauggguaguagaggaagguaguuauaaauaccaauuaaggccacguaaccaguugcagaaacgaggauuauaaaguaauaugaaugcccauuguaaauuuacuaaugcguuugcgauuguacgagggauaguuauaucauguuaggcguauuuacaaccuuguuauuguuuuaugugaacaugagauauuauuugugucaaguugacaagggguggauuguaguggcuauuccugguugucaacuugacaauauuuggaaugaauuacaauccggaauuggaaggcucaccagugacccuuaucuggaggcuuggagauccuuaucuggaucuugguuugaagaucuugagccacaguggcuaugaauuccagaagauugaaucuccgaguuuaaggaacacacauuuaaucugggcuacgccuuucaucugggauuaaaggugugguggaacacaccuuuaaucugggcuacaccuucugcuggagacaauauaaggacauuggaagaagggagucuagcuucuugcucuugcuccuucgccugcuugcugcgugagacugaguaacugcuagauccuuggacuuccauucacagcugcgacugaacaauuguugggaauuggcugccgacuguaagucaucaauaaauuccuuuacuaucuagagacuaucuguaaguucugugacucuagagaacccugacuaauauacugggacagcagaauggucgggugggcuguguguguggugggguuuacugccuugaucccccaggggcuccaggugaaaugacaauucagccaggcucuauaguuaguacccucggcaaagccccccucucucucucuccucucucucucucucucucucucucucucucuuuugccugagauagcugcugaccacacuacccaggcgaggugggagguagagguaaucacuggguugggagcagacagcugagaaaaugcagaccugggcggccgugccaccucuacccagcugcuucugccaagguaaaugcaggcuuguaucaaguuaguagacagacaggccccagucacucugcccccugccuuaguuucuccagcuucaguaguucugaaccuuccuaaugcugugacccuauaauacaaguuccugauguugugaugagccagccccucaaccacaaaaaauauuuucauugcugcuucauaacuguaauuuugcugcuguucugaaucgucauguaaauauuuuuggagauagagguuugucaaaggaguugcuacgcauacguugagaaccucuucaauagcugauaaccucaggugggagagggauguugcccaaggccacaaggaugucuguccccuucugcuuugcuagacucccaguucucugacucaggaguuauacacacugcccucugcuguugaacauguugaagcaucuaccaugugcuuggcccugugcugcucugugacccuccccuccugagcucacagccucaggucagggguguguguguguguguguguguguguguguguguguguguguguguugggggcacaggguguugguaccuugcucucugcuuuuccugugccugucuuccauccaguucucugugcauuccauuuguaucggacacuugccugcagacgcaacaggaucauccugccuucuggcauucgggaagcagagccuccugacagcaggcucuaccugcccuagcccaggugcagcugguccucaggagccaugaagaguuaguggguugugccugaugggggaaaauggcuaccccccacacaggguguccuuucagaccagca

SEQ ID NO: 4670 - RNA, 14623 nt, Mus musculus
ugcgccuccgaggggcgggcccaagcgugcggagggauccguggcgggccgaggcggcgcuccgccuccucuccggcaggcucggcggcgcgggcggcaguugcugugguuucggugcugagguggcucggugcucaccgaggcuuacggaucugcgucacgccgccgcuucccgccgucaguggcugcagcucucagcguccuaccuucggaccggcggcacccgcucucuuucgccgcucggugccgaucuccaaucccgggccuagggcggcggcugcggggccgcggcuggcgagauguucaagaacacguuccagaguggcuuccuuuccauccucuacagcaucggcagcaagccccugcagaucugggacaaaaaggugagcggugggggcgggacggggguggggccgacuagccgcccacgugauggaguggcuaccgagccuugacgucccggucaguagaaugggggcagagugcccacagccuagcuugaaacgcauagcacuuugaagaaagacaugcauguguucgcuggugccaagcacuguugcugcacuccauacggagggccuuuuccccggacauccugagcaccggccaagccagacuuguucugaucccauucauuagcuccauccgucgacagccaaaccuuuggaacuugcugcgagcccucuguaacuuagaguccguacuauucuuccuguacuggccuucuccauugggaaaccugcaaaaaggugauuguuaggggcuucucgagagccaguaucaagccucuguauuuuuauccagccguccucuagaauggaugguguuuuugcuugccacaugagaugguggccuucccuguucacuuuuggagauauuaagaucuagaugaaaugccuugccguuucuuuucucaugaagauuccuggggcagugagcuggaccguuuuuuuguuuuguuuuguuuuugaauauaaaguggucacucuaauguggaagccaggugauuuagggaauaucuuuaguucugcccucggcuggggaagauggagagaggugauaugccuagugugguguucauagagauguauauagaauggguggaguaagucaagauuauucguaguaggacuagaacaaugucuuuccuaauucacagagaagggcuuugagacacacagugguugacagaguaccugcauugccuucuguuugucacugcuaggcagucguguguucugaggacagcuuugagagaaaccuguugggagugucuugucauuuggcuaagacaguugagaguuccucaagaucuggccuuugguauguaagcagucugaccaacucuuucagauccauagcuagaguuaugucaagaguaucccauaggaagcggacccuuagcuccccccaucccacaaucuccugaguguucguucacuuugaaaugaagcagcaggagcucuuaaaugagaccugcagggagaacccagagacaguccaccuggcaguguugggagggugcucaccagccuugguaucuugccuguucugcacagccagagggcacagagagagagcaggcuugugugcugcuugaacuuggaaacugagcugucugaaguguugguguaaagcagucagaacagggcuggagaacaugcuguuuugagaugggaaagaagugucggagcgucuaucagaggguucauuuacccccuggcuuuucucugugauguguuuuauucuuucaagcccgaguuuuugacuagucaacauguuuacacauggcauagaaagcagaguaaccauggugcacugugucccuuaacaacgccucuaaagguccagugguacccugaugacauaaacaacauacacaacauuauuagggcagagucacauggagcaaauuaaacagacauucuugcaaaaacaggaauuaauuacguuucuaacucuuguuuggauuugacaaacuaguguuuaagggagaaguuuucuccaacugaggcaagagggggcaagagaaaaagaagaaguuuaggccuauccacaucagcuuuauuguauucaggcuuuuccucaguuaagcgaucucaguaacuggggaugcaguccagucaaggaaacacuggaguuggucauguuuaucaaugauuuauugagcaacaucugagugauaggccuuguacaaagaaaaucacccuucuccugggaacuaaggcaaagcuguaauaaggucagagucugguuguaggguaggggcgacagggcugucuacauuaccaaccugugccuuggcccuuugccaggaggcacuacacacugacugggaugauuauuuugaguccuuauuuugauaucacaaguauuuacuauucugacuuuugcguuugugcacagagaaaaugccuauuugguuucuaugaaaaacgaucuugaaagauuagguguagcaucugcuuaggcuucugaaauuaaggugauguagucauuguccuuuggcuuuuccucuccuaaaccucuaauguggcacugaggcagcgcugagacuaacuaguuguccaggcucacucaccgguuccacucccuccuuagagacaggcuccugcugcauggaggccaugaagcgcucugcacgcaaaaccucccgcacgcacuuggugcuccuggccuucacccacaucuuccuuggucuuuggucacagagcagagguagcagugccucugaugcuugccuugaccccacagggucauuuuaucagcucccagccucuucauccuccuguccccacacugggacuuaguuaagagcugagacagaucuuuguuggcuuucagaccaagagcuuagaaaaaaaucaacagguucuuuaaugucccuuuacuucuggaaccaacagauccgacuaccuuuauuaagaauguuagggcuggauggguacaacuuuaauuagaugagucucugggagucugagucuagccuggugaacauaauagcaaauccuagcuagggugacuuaaugauguacugucucaaaacagaaauaaaacgaagaauguugcuccuccugcacugcacugcgugagugucagucggcuuugcugcugcacugggagcccauggcgcuggcugcccauggcacuggcugcccauggcacuggcugcccauggcacugggagcccauggcacuggcugcccauggcacugggagcccauggcacuggcugcccauggcacuggcugcccauggcacuggcugcccauggcacugggagcccauggcacuggcugcccauggcacuggcugcccauggcacuggcugcccauggcacuggcugcccauggcacuggcugcccauggcacuggcugcccauggcacugggagcccauggcacuggcugcccauggcacuggcugcccauggcacugggagcccauggcgcuggcugcccauggcacugggagcccauggcacuggcugcccacggcacuggcuuguguugcuacuagaagcccauugggcugauuugugagugcugcucucuccuccucccucccagcugcuaauguuucuccauggaaugugacuguaucagagucuuuuguugaucuuguuaaguagucauaaugacuggguccccauuucuuauuuuaaggaagaauaaagacccucuccagaauuuaaaaaaaaaagucacuacauuuuugguguguguguguguguacacucacacacaggcauaucuucuugccuguguccauagaagucaaaggacaaguuguaggagucaguucuuuccuuucaccacguggguccaagaauugaacucaggacagcagacuuagcugcaguaagguuuaucuacugagccacuuugcugacccuagacccugacuuuuaaauugauaaaccuugcugauguguacuaagucugucuggccuccaggaauggaauugagugccuuuggauagaaagaguaaaaugauuuucacuuucccaggcguggucuuuauuucuaugguugauaacuuuuacuguaacaggaugaaagcagugagcuucauuuacuugugcccuuucaagaaacacugugagcaagguggugcucguacacacauuuaauccuaguagccagguagaucucugugaaugugaagccauccuggucuacggugugaguucugggacagccaggguuacacagagaaaccaagaaucaaaagaaagagggagaaagaaagugaucgaggcuugggaggcagaagcaggcagauuucugaguucgaggccagccuggucuacaaagugaguuccagacagggcuacacagagaaagccugucuugaaaaaaaaccaaaaaaaaaaaaaaaaccaaccaaacaaacaaaaacaaaaacaaaaaagaaagugagcgagggcaagagagaaagaaggaaggaaagcagagcacaaagaaagagaaagacacuguggugcccaggguaacugaagggacggaccauuugcagaugucuggaguuacugucagcuggguaaguagcccaaagucccuugagccugagcuuugaccagucucccacagagggcucccucugccuguuuucugacucagagccaggccccuggcccugggcagacuuuccuacugcaguagacagcuuuaggggcuuaauguaaauugggacaugugucauuaagaggacaugccagauagcugaggguuccgcugcagaaugagugaguggagccagaaaaugaaagugggggaggggggccgagugggacugguacagcuaauguguuauuuuugaaucacucuguagaacuguggagauuggccagcuuccucccgaucccuguaguauuauuuuucccucauccugacccuccucccuggggcucacacugagagggaaaucaguguucuuuauuaguugcccagcaaccaugaaaagccugggagaacacugugagaugagcuuaagguuugcuccuuuggugucuguaauacuggggaucauucucaucucuaauugccaguaacuuggguucaaaagcccccacauacuuaauguguaggauagcaggggucaagguucacagggaggacuaagaauacaagaugauggcauuugcaugucauuaugaaauccacucaucuuuuccuuuuuugaguacuucuggguaguugugugcaugcauauguguggaguguaugugcugacguguuugcuuguggaggcuggagguaggcaaaagcugguuagccauugaacccagaucugccugucugccuagccccaccucacagugcugggguuauaggcagugugauugccuuccccagcucuuaugugggugcugaggauccaaacucagucuuacaauguagcccaggcauaucugaaguuaaaaagccuaagguagccacagacaagcaaucuuccugccucagucuccuaagugcagccacugugccuguuaagccugcuacuuugcaugcugauauuaauuuuguugcuguuuuugcugcuguggcagaacaacuuaagguaaggaaguuauuuggcucuuggaggagauaguaggaguagggagaaagauauggccaaguucaugguaacagggacagacaacugggucaucuaugaagaccaggaaucaaugagcagagaaaucugacacuaaucuugcauuacuuuuuuacuuaucuuuauuuuauguccauugguuuauuuaccuuuuuuuuuguccauugauuauguccauuugguguuugccugcauggauaucugugugagggugccagaucccuugaaaccagaguuacucauaguugugagcugccaugugggugcugggaauugaacccagguccucuggaagaacaggucuuaacuacugagccaucucucuggccccuaucuuuucuccuuuuuauucagugaugagucagaacagaagauggauggauaccacccacauucagggugggucuuuucucauaaacuucucuggaagcacaccgcagacauccagcaguguaccuucaucacacuaacuuuaaagacugaggggugugugugugugugugugugugugugugugugugugugugugugugccugugugccugugugugugcgugugcauggucauguguacguacuugguugccuuuuugcuuaccaagugagugcaggugccugcagagacuggaagagcacaucagauccccagaacucuaguaauaugguuaggagccacauaugagugguaggaccaaaccugggcuccucugccagagcagccagugcucuuaauugcuucagcccaugauuuuaaauauuagugaaaggauaguaaagcaagaaaauguucauggccacacucugcuggugagcauauaucaugaaagaauuagucauaagcuaauuagaggaagaaguaaagugaaaccuugagcacuaaaugcaucgaccgcauuuuaucuucauccaaggccaggucugcucagugaacucugggccgaggaaaggaaguuaacucuuucuggggacaugcaucuuaccacauguguuugcaagaagcuucccggaggaugggguuacuuccugaaaggcaguguuagccugcaucuguuuuguuuuguuuaguuuuguuuuguuuuuguuggagacgggauuacuauauagcacuggcuagccuuacauuugcuauguacgcuaggcuagccucaaaacauacugagaccauccuaguuugcaagugcuagguucccacccauguacuaccacagccgggcugccuguguaauuuaauguagucauuucuagaggggagggguggaaaccacucccuucucccagagcaggcuuugggaagccuccuguccuugaguguucacgucccggaucaucaucugcaccccacuccauuuuuccagcuuguuuguguuuccacccuuugaaaggggccuugaaagggggaaaugguaauucacuaacaaaucaggcugaggagagaccuaggaaugcuagagugcauucuagcgcccucuguuggccucugcaugcuguggaagccauuguucccuucguaaggacuuaguggguaagacuuguaagcuguaaaccuagagaaggucagaaaggcacuuccuucugugaguucuggcugccuuucugagcugggaagaccucuuguugacucuggauggagagcuuuucggaaguguuaggacugaggccaugauuugaaacaauguuggauaaguggcaacaguugccuuuuagcgauaguagacuugagagccuaauuauuuuuuuuugucucuuuuaguccauugaauuucacuguucuuguagcugccuucuuuagaaggaauguguguguuauuggaaauaacuaguguauguuauaaaauuaguacagcauuuuauuggaaugcucccagcucuuaucagugugcuauaccacagcauuuggaaauaacuucuugacagagucuuccuucaacaaguugccugauuuuccacagaaaauacaggagaaaucuugcuacuuugguugggagugcuggggaaggaggugggcagugcuggcauguucuacacagacuugagccuuugugcucuuaaucucuguuggaaaguagcccagaauucagagcaggaggccauugacuguggccagcuuuguugagaagcauuucaaugugacauuugugucuugacaacccaagaacugcuccccauuggcagagaugagaggcccaucuagccccugugccugaaaauggcaccaaaggguguuuuguaagaagcauucuucaugccacuaguuucaugugcuuucugacgcucccaugaucuccagcuuccuauaauagucuacagucgauauguuauccaggaauguuuaaaacccuccuugaaccuacucagaugugccagcucuuagggugacagauuccagagucagcacauauuugaacacuuagcuuaugcuucacacagaacuaaaugcugaagaggauccuacagauggguggcauuugaucuauucuuggcugagccucacagaugucaccuggaaaacaccacacacagugggguagauuuagauuggacucauugauagagcguacagagacugaugguaaagcacagagcaguauuuuuaauagucuguguuaaaaaaguauugucaggcuccucagugccuucucccuauaugcaaaucuuaacagaaaauaaaauuguaaucaccaggcugauuaaugaacaagaacaaggagcuuuaaucacugagguugagucauugauuauguggccaguuuuagcccuccccccccccuuuuuuuuuuugguuuuagucuuuugagacaggguuucucuguauagcuccaacuguccuggaauucguucucuagaccaggcuggccucgaacucacagagaucuaccugcuucugucucacaagagcugggaauaaaggugugcaaugccaaugccccgcucaacacuguccuugcucguuuguuuguuuguuuguuuguuuguuuguuuuaguacccaggagccucucccacaccuaagugaucuuuucuguauuagcacauucaguccuaugucucuugugcauuuuagcugcuuuggauuuagugcucagaaauguuuguuugagaaaaggaauucauauuuaaugagagauucucauauucuguauaauauguauaucuguauauguauaaaguacuaaauuaugcugucuagagaauauaaaucaagaaaguaaaucagaaaauggagaagucacuuugcugaaaaugaaugucuguacaugauaugggaaagaacugaacuuauacaagcaaaguauauaaaaaagaaaguaaaggaaaacguaggaauaaacucaaggaacacacacacacacuuccuuugaaacaaggucucuguguagcccaggcugcauuguaauucacagcagucuccuaccuuagcuuagaugagaaguguacaucaacaggugacgcuugggaauacugcucucacccuuuuuagugacgugugucugugugugugugugugucucucucugugugugugugucuguguguguguguuugagacagggucuuucuccauagccuuggcuguguuguaacuuacuagaccaggcuagccucgaacucacagugauccaccagucucugccucuggagugcugggaucaaaggcaugcaccaucuugcccagcugacacuagauuauuaaucuuugaggacaaagaagcuauguuguaguaacuuuggaguuuuggcuucuuugagaaacacagaaauauuauguggauguguguucauuuuaaucucaggucugggauaggaugcugcuucagauuguccacagcaguugacugauuugucuagugcucuagcaggacugugauuuuugccagcugcaguuucugcaacuguguaauguuuggaauucugaguucagaggauauauaaauacuaggacccugaaagguggacuguugguggguuguuggaagguuuguugauugugguuuuuuaaguagucauuugugaagaagaagcaagaaauaagauaucccgauggcgaagaucaaacuggucacaaggcacugaugcuccuaaucagcaaguauuagucuccugauaacaucuccccuuuccaaccucugacuuuauucagaucgauugaucuccuucuuucucuccuauuuaguguuagggaguuguaggguagaaaaagggggugaagaaggguggaagaaagaagaacccacagaguagcagaagacagcuacacuauguauguauguuugugaaugagacacuuauuacuuaacgcuguuguugaugugcugugggguugaguaauauacucuguaugaacuuugcuguugacagaguagagaguaaauguuagaugaaucugaaacagggaggaguuuauuccaaacggcggguacagggauacucccuuauacacaggcuuugacguguugccaacuuguaugucaugugucuugggccauauuuccucaaauggacucaaucaaccuuccgaauuuuuaugaagcuguugcgaaaaacugcaacauugauggauuuucaccccuauagguacggaauggccacaucaaaagaaucacugacaaugacauccagucccuggugcuagagauugaagggacaaaugucagguagguugccagcuguguuaucuagacguucuacagcaggagggagggcaguucacaucaguguuaacaggcugcagaaucaggcugucuguggaccccuacaccacuuacagcuuuucucaggcagcuuuaguuuccucaucugcaaaguaggaguguuucccugcaggguuagugcauagguuaaauauggcauuuaggccaugcccagcguagaaaucaguuagcuguguauuacuauucggccagaguauggcaguacuacccugaucucccagcuguggccccugugguuuuuaauaccccagguuuuuuugaucuacccuuucauauuuaccuuagacaagaacugaagucuuuuacuggaagaacuucccaggcuuuguuuuuuagauacuuuauuguuggucccaggcuuuuauuugaguggguuuggguguggauuuuuuguuugcuuauuucuuugguuuugguuuuucucaagauaggucucacuauauagcucuagcuguccuugaacucaccauguaguccuguagaccaggcuggcuucccaaccucccacgugcuaggguuaaggaugugagcuaccacacccagcugauuucaguauugauugauugauugauugauugauugauugauugauugauuuuucaagacaggguuucucuguguagcccuggcuguccuggaacucacuuuguagaccaggcuggccucgaacucagaaaucugcuuaccucugccucccaagucaugaagcacuauacagaagccauuaaaaggaacccgagagaugccaaacuguacagcaaccgagcugccugcuacaccaagcuccuggaguuucagcuggcacucaaggacugugaggagugcauccagcuagagccaaccuucaucaaggguuauacacggauuaaaggcgugugccaccacgcccggcuguuuuuguuuuuuuuaagauuuauuuauuuaauguaccugaguacacuguagcuguacagaugguugugagccuucauaugguuguugggaauugaauuuuaggaccucugcucgcucuggucaacccuacucacucuggugggccucacucacucaggcccaaauauacuguagcugucuucagacacaccagaagagggcgucagaucucauuaugggugguugugagccaccaugugguugcugggauuugaacucaggacgaccuucagaagagcagucagugcucuuaccugcugagccaucucuccagcccuuuuuuuuuuuuuuuuuuuuuuuuuaaagauaagcucucuuuauauuacccuagcugcccuugaucuccuggccucuagcagucuuguacaucaccacacuugacauuugaacugcuuguuuuacuuauuuugaauguguauauggggaaugcagaauggugcucaagccauggucuguguuuggaggucagaguuuucuccuaccaugugggucccagggcuuagacucuggucgucaggcucggcagcaagugucuuugcccacugaucgaucuaucucgccagccuugacauuugaaaaaguguucacuaacugaacuguugagggguuuauuaggugaugaagcuaagcccuuuagaucuguuuucuaguuuuuagucuuggaguauguggcauuguacacaccacagaggaggaaagacaaguaaucggcuccuguguuucugcugacaguaccacauacaucacguguccugcggaccccaagaagacacuggggaucaaacugccuuuccuugucaugaucaucaaaaacuugaagaaauauuuuaccuuugaaguccaggugaguguagagcacgcccucgggcugcacgcccucgggcugcgugcuauccucccauguaugcgcuuugcugccuccgcuaaagcucaauguggcucucauuagggaggucaaaagcaaagcuuaacugugggguuuugaaagaaauagcacccaaaaaaucuaaucaauagcuacaaaaguccgaagauuaaagaucaacagguccauuuggggagggaauauuuaauauugaaugauuguuucuguuuuaguaucuuugagcguuuagugugaagaaauaggaaaucauucuauggucugagagccugcaaacugugucauaugucauagcagcugcuguugucuugacaacaaauaauauaaacuugcuccuuccgggccaucugucaccaguugugaccugucucuggccuguuuauucucccugggguuuggcauugggaaucaggcuguggaggcucaggaucuggucuuaacagcuauccugagcuugagaacauggaacuaguguggcccuccucuggguguugcagguacuagaugacaaaaacguucgucgaagguuucgagcaaguaacuaccagaguaccacucgagucaagcccuucaucuguaccaugcccaugcggcuggaugauggcuggaaccagauucaguucaacuugucagauuucacccggcgggcauauggcacgaacuacaucgagacccugagagugcagguacugcaccuuccacacagggagucccauacugggggcuuuaggacacucugguuggcuaacuggcuggcuuauggcccauggagcagaacaaugugaggcuucuagccaaaguccccaagguauuguucaggagguuuuggccucaaaaaagguccagaaaguaaucugaggucuacucaaacguaagguaaauucuacaagcaaccucccacccccagcaaagguuuuuuuagauuuguguaugugaauguuuugccuacaaguacaucuguguaccauguucgugucuggugcuuuagaaggccagaaaaaguuauuggauaccaaaaaacucuccacaggaguuagggauggaugugagcuacuguguggguccugggaacugaaccuggauccuuuacaaaagcaacaagugcuuugaccacugaagcaacucuccaguccuuugaauuauacacauaugcgcaugcgugcgcgugcacacacacaguguaccacauguaugccugguaccugaggaagucagaagagggugucagauacccuagaacugaaguuaaagauagcuguaagccauuguauggauccugggaauugaaucccaguccucucccugcaagagcaaguuauuaaccagugagccaucucuccaucuccugaauccuccuacuguuggaauccacgccagggcaaugccaguuugcuaauagagaugaaguuuuuaggguaccaugagaaggcuucugagagaaucaggaaaaggggaaacaauuguauuuagccugucaaagugagucuuucuccacagauccaugcaaacugccguauccgaaggguuuacuucucagacagacucuacucagaagaugagcugccagcagaguucaaacucuaucuaccaguucagaacaaggccaaaguaagacacccuuccuuaaggaagccagggggaggacauggggagccauggucuaggacaugcccuugaccaaaagcuggccuagcugggcuggcacuggaaguuggccauugccuuaaucccccuuacaguguggcagugccaagucaggggagcuguggacuguucugacuguucuguucccggugccaccgcagugcaucgucccuucccucucaggccuuccuauuucuugcucacaguucuuuuuggaggaaugcccuccaucugauccuuugucagucucaaaggcuaaugagcaagcgguguacaacuguggacauguuguguaugccugcuccagcacgcuuguguccccacagccuggugucuacccggguaucaucagaaguaagggacuggugggacugaccuucaguuaccuaguagcugaaacugacugcucguuucugcuuuucuccuucagcaauaacuggauagcagcuaaggggacagacucuggaugugagucuuaguuuaaaaaggaaacuacauggagaccaugcaaaaacauuuaaauaauccacugugcuguggcucgcugaccacuguguccuugucauggacaccagugaccaugcacaguuguguuccuugcauucuaagucaguggagggaagcagagcuuugagugacacacgaguguugggguuuccugcugccugcccuggcccgugagagacgcacgcaacaaacggaagaauuagagacguccuacaaggcagauucagaccaauauuucuucguauaguuuauucuuucuuuuauauauuaucuaaauauauguauauguuguguaauacacauaaucuggaaaugaauaaaaugcuauauucuugguuuguaaau

SEQ ID NO: 4671 - RNA, 46146 nt, Mus musculus
caugggugugggcaacguggugaaggaugagaggcaagaacagggaguguggguggggccagaggugggccaggguggaggaggcaaagaauggggcucugccagggcuuggacacaguucucagaucaauggcaguggcuuagaauccucuccaggccauagucuccuuugagaaccugacacaugcagaggaaaaagagcauacaugcucaaacuagcuacaauuucugcacagugucaggagcuuucuagagcuaagaaagucuaucuaagauuuaggauugugacuugcuggucuagacaaguuaauagaacauuuugaggggggaaaaagaaaacaaaaaaaauaaaacuuggagcaaccuuaagaucuuaaggguguguuaaaaaggagauugagagggggugccguguuuggaaucaaggucaaaguccauguguucgcuaaaugcuuuauuucauucaaauuuuaaaauguauuuuaugugcauugguguuuuggcuacgugcguguccccggaacuggcauugacagacaguugugagcugcaauucgggugcuaggaauugaaccuggguccucuggaagagcagccauugaucuuaaccccugagcuauaucucuuuccagcccacaguucuuguuuuauugaagguguuagaguuugcacaaaguugcaaauuugugggcuuuuucuuuuaugacaaggucuugcuaugaaacccagguggacuucaaacucaugacucuccuaccuuugcgccuccaggguccuggcguuacggugccugagucaguacuugcggauauuuggcuuaugucauuaauugucagccagugguuccuucuuuccauggauggucauguccuugggaacccauggguuuuuguuauuuguugguuuucuacagagccacuugagaauacauuguggagauuaaaacaguucauccuucaacacuugaaaauuuuaaaaccaaagggcuuuucuuguuuaaccccaauauaaagcucaugugcuucaaguuagcauuaaaacagugguauuuuccaggcagugguggcgcacgccuuugauccccagcacuugggaggcagaggcaggugaauuucugaguucggggccagccuggucuacagagugaguuccaggauggccagggcuacacagagaaacccugucugggaaaaacaaaaacauugguaauauauaauauacaccccauauuaaaauuaccccagagauaaguguauuccucucucucucucucucucucucucucacacacacacacacacacacacacacauacacacacaguuccugcuuuugcuuuuuuguugucuuuuguuuuugaaauagagucuacauaacccacacuggccugaagcacauuacagaaucuaggcuaugcugcugccuuagccucccaacugcuaggcuaacagucauggacuaccccaccuggccugacccauuuauuuauuuuggauauucuuugcugcuuuugaaugauaagggcaguagaaauagugugucugucucucuaggcuucugaaugguuuguuuuauuuuuuauuuuggacaggucucacuccauaguccagauagacaggcaucaaacucaugcugaucugccugucuuaaccucccaaguaccaggguuaccaaaaugcacuaccacaccugacugcauccccccacaaaaaaguaaacaaacaaaacaagaucuuacuauguagcucaggcuggccuugaacccacagucuacuccucagguaggauuacagugugcagccucaggggucgcucucagucuccuuuacucuagagcagcaccucaaguuuuguuuuggcugugacacuguuauuuuuuagcagugugaacuagauuuuuuugcugaacugucccucaguuuggccgugucugguuggaugcagguugagcuuuuuugacagcaaugugaugagugguguguccuuucucugugcgucacacagaaagucagcugguccaugcauaauaugaccuucaggguccccuuuguaaccagcaugguaaccgugggccaagagcacuguguugacugaaggccuccugcccggcagacacugagugaccugguggugaucacccagcccuagucaugccuucacauuguuuucacagggaggggacagauggcaaaccaggagaggacucaugccaagcuguaguuuuacgaagggcauggaggagucgcugagagaaguaucaacuucagagaaaguggccucuaaggugagauuugaaaaagaaagccagucauuugugggguggcagcgguaccccguggccaagcucagagagaagaagaaacugaaagacgggcaugcgcuauucucagggaaggaaagguguagaguuuaacaacagcgggaacauguaguguuuuaauauggagcaguccuuagucucuguacagcucugugaagucggugcuggguugaugcuacaaaaucuguagcacggagacguugagucauugguucaaaucugcauuccuugcaaacuauggaaccgggacuugaaccucgauaguucgguaugugaagaaagaggaaacguggccucaucuagaaaacagugugugggggggagggagagggggaguuuagagucagagcaaccugggcuggaagaagagauccuuguuguuaaagaauaugaacaggaaaacaagauagccggggaccccaggacaucaaugagagagaagacuguucaagaaguccucacuccccagcucucccuccucccaaacaaacaaacaaacaaaauggauauuuacauucucaaaguaugauccacaaauuacagguucaauacaaagggggaaaaacccaguuaacuuuauggggaaacuaucuggugggcucugguuuaagcaaguggcccaaaggauggcucagugggcucucagggaggaaucuggauggggaauugggaggcgaggguagcuuuaggacuaguuugguuuuccucuugaaggaagggaucuguggauggcagggugggguccagagugggaagaggagugaggaagggggacaguuugaggggaggguucuuggguuucaaagaaagucagcucagggccaauaugggaggucgugguggguggacacgaggugacuggacaguggaacuaugcuaagcgcggcggcagucaaagguagagacuucugggggguggccugcaguugggcaggcagccggccacauugcuuggaggguggcgagcucgcugagggggcgggcgccggccauaguccccccgcacuguagggggcgcugugggccggggcgggccggggcugggcggcggccgcuccuggcgagugcggccccuuuuccggguuuccuccgccuccuccuccucccucuucgccgccgccgccgcugccgcugccccucucccgaccgguggcugccgcugccgccaccaccgccucuggggggccgcgagccgagcggaggccuccgcggagcacgaaccccgccgucccuccggcagccgaaggccccgggccggcucggccggcgccuuccgcgccccccggcccgagcguccguccguccgcccgcccccgcgggcccggccuggcgcggacgcccgccgccgccgccgcgcuccuccucuugcuugggcagcccgcggcccgccgcuucccgugccugccgccccgcgccccgcgccgcgccgccgccgcccucggcgccccgcggcgccccccggucccgcccgccaugcccggcccggccgcgggcagucgggcccgggucuacgccgaggugaacagccugaggagccgcgaguacugggacuacgaagcccacgucccgagcuggggguaaagccgccgccggccgccccacgcgcgaaccgcacccgccggccgcucggccucggggcuggcagggaggcccggccccggccgcacguguccccggccucuccuguccgcccugccucgguccccggcucagccgccgguggggagaagcguggggucgggggugggggcggcccuuccuccucagacuuugggcuuccuauggguugggaaguccauggcuguccucuugagcuguugaaaucucuaccucuuuacuuucugaaaugaggcugggugggagggucauuuugaagaggggcagauugucuagagcgggcagugcccccuggaaggugugaaaugggaggcaggugccguggagccacgggcagggcaccccaguaccaccaggggggaugcuucccuuaguccccuuaauggcuccugaggccuuguagcugcccauuccucuucuuguuaagagucaguuagguuaggagcucugcagagugaagggagccaagcuucuguguggcucucauuuaagagaaugaguugcugugugaugguaggaauacuuccgaaugcuugauuaguuggagauggcggauggaugugugguggacagaggcuugcuuaaucccaaauccuggcauuuauguauaucucuugccuuucacaguaaucaagaugauuaccaacugguucgaaaacuuggucggggcaaguauagugaaguauuugaggccauuaacaucaccaacaaugagagggugguuguaaaaauucucaaggugaguggccaacgguggcauguaaccuuuccccccacagggcaaaagaaccagcuaucccagaauaagcaucuccuacaggacuccuaccaugcuuuuccuugugaacuuuugagaaaaugugcgggcuggucuuaauucugaguuugguaggucaggaacauuuaaagugugaauucugaacuucucaaacaaagcuugugaggggggacuguaucugauauggaauaaagagguauucgcaagagaggaaggaguuugcauggagaaucugucaacuguagggauucuaaaucuguacucguuacucucugcucccaguuacuccagaaaaaguccggaaaacccaaaacaaaacaaaacuggagucugcucagagauaaguuuaaagccaaaaauucaggacaauucccucaguugauauuuucauuucauguagcaguaaaguuucaggugggcuggauauagcaagccagccgcuaagagaucuggggcaacagaagaguacauucuagccccugaaauaauaacuggaacaaaacuugucucuguggcaagacuagcccucucgcuuugauaaugauagggcuuuuguuaucacucaaaugaagacaugaucuuaaugagcaugaagagucagccaaguuucuguacaggugauugaagauucaauagugcuuuguagguuguucgagagggugguucguaggaccugagcgguucuucaugguugucaagucauuuaaaugcauaugcuugucaccuuaggaucugggcaguuuuucauguugucagaucacuuaacauguaugugugucacuagugaaagagcacuggagagugguaguguuucaccagauuuucacagugcccagugaacaaaaaugcaggauugaaaagcuugugccuuagggcaguucuuauuuaauuguguagauuuuagcguugugugaaucaccuuucaaaaaaaauggcugcugcuaaugcuccuuaccauccuggccuagugaugaaggagcagaguugcugcagagaugggugaugcuauugcugcugcccaagacacuggggugagaaggaaggaaugauggcagauagggagcuuggccccgcuaaguaugaguuguacauuggaggucuguaguuaugggagggguguguuuuaagcagagaaauguuuccuucagggaacuugcuggaggaaaccaugcaauuucauuacuuacauaaaccuguuuugaauagaaguuacuucagacauuuucauuuuaaggauaagcaaaaacaagcauaguugggaauauccauguucuguugcugcacauuuggaggauugaauuugccaagucuaaagcaauuucagggaaaugucuaaaugucugugcaguagcauuuugggacuaagugcuguuugcuguggaguguuuggaagggaacagugcucagguguguguaagccccaguguguuuaaggaaacauaggguuaguaguuucccaugguucuugugaggaacuucagagaugaguugcuugauaguuuuuccucugcucuaaagauccaaugcauauauuuaccacauccaguacggaagcggcuuuaaauuauuuuuacagauagcagaccuaggcacaaagaaauguaccugacaucauuguucuguugaaauggaccuucaccagagcucuuccuuccuacuucuucauuccucugaguguucauuucagccugggcuguaggaucuuagcacugagcacagguucaaguucaagcaugagauuugggagacccgcucgaugcucuaguuccugacguguuugguuuuucucagagggcagucugaaccaccucauacuccuuugucaaaccacuguguaggcauuucuguguagcuuuucuuuauauuugaaggguagaguaagaaaucacuaauauugugguuuugcuuuuauaauggauuggaaguauuuuucaaaaagaacagaggcuauaccaaaauuaugcuuauuacucaaauaaguugaaguuacgacuaauaccuacuauugugauauuuucucagagaaaauuaagcccuuagcagugccagcugcucgguuuagggcagucugggaaagguuugcuuuucauagaaucucacaggaaagacuaggugggcacguggugacugagacacagggcgcaggcacucagugacacuucauaucagucuuugucauuuugucacaguugggugcguagugauggagggcuuuuauuucauuuaacuugcauguaagauuucuaaguauuucauuugucaagguaaguugaggcuauuagaggacuuuacaaauuuaaaaagcugcuagugaaaggucuguggguuuuuuuguuuuguuuuauuuuuuucuaaaacaggguuucucuguauagcccuggcuguccuggaacucacucuguagaccagguuggccuugaacucagcaauccaccugccucugccccucaggugcugggauuaaaggcgugcaccaccacgccuggcuuaaauguaauaacucuuaacaguuucuuuaaugugucugugugaaaaagugagcaugugugcaggucugagguuagaccuuaaaacuuuguagugaauagagaagccaugucuuuuauuuuuggggaguggugucagaaauuguguuaacaagaaaggaaaaugauuuuuuuuaaaaaaggguuuauuuaugcaacaagguagaaggcuacuucuuguccugaguuucaucuugacuguaagcugucaguucuugaaggugugcccagaaguaaaauuaaagcauuggugaacacggcuugugugcauucauuccagcccuuccugggguccuugagagcuuuuaguuaaacugcuguuuccuccgugcaugucaagagcaauccuccaaagugcuuugacccagugcugcagcggcuuggaaauucucauguaaggcugcuguuaacagcauuauuuuauauuauagacagcuuggcugacugucacuuuccccucucaaaauucuugacgaagggaauggugguguuaaaauuugucuuaaacauaucuuacauauuuguaguucuuuuuguuuuuugcauugguaggacuaggguggcugcucacugguagagcacuagcuagcaagcuugagguccuggagcuaguccuuacccuucccccaccuuaacacagcaaacagaauaagauuguagguucuuaaaaggaagauuggcauugauuacagcucuuuauuagugauuuaguucuuggcugauggccuuugucauauccaaaugauugugucuuucuaagaucaaauguucccuccucugggcccucucugucugagggaagguuauucuuuuacccaucauuuaagcaaagguaccaagacaucuucauaaagagacauguuaauaaaagcuucgcuuuuuuguaaauucuaguuuuagcaaauguuucauaguaaaugaguaguuacuaagaguauuggaguauugguaauauaaauuguuagaaauuguauguaaauuggccggaguuauuuguaacguugacauuauagggacauacguagaggguugagcagaaucacagaauguacuugcuuagaauccauuagaagcauaucagaccgauuucuguaggaaggaucacagugagugcaggcacugugaauuaggaaucugugugucacaggaaauggggacauuagcugguugacuuguugguaauucugaguugucauggaagagagaagggcacucacuggaagugaacgggaacugucuguguuuggaguuacucuucuaaaggggauggcuuggaagucgggcuugaagcagacugaacuugagugaguucugucuucguucccacagaugcaugcuugcugauuugucugcucucaggccuugguggugauuuuauugcguucaguuuuuacuuuuuaaaaucucuuucuugcuuacuuuggaggucaggggagacacgcgguucauguguggagucagaggaugacuugcagggcuuguuucuuuccuuccauacuguggucccaggauugaaugcaggucacuacagccugggcuuuuaccugcugagacaucuuguugaucacgcaccaguuuccuuagaacggugguucucagccuuccuagugcugugacccuuuaauauaguuaguuccucgugcuauuguaaccuccagccauaaaauuauuuuauugcuaccuuauaauuuugauacuguuaugaagcauaauguaaauauaucuguguuuucugauggguuaggugaccccugugaaagggucauuugacucccagguugaggaccacugcuuuaguccuuuugaccuauacaguuucuccaagucucacagcaguuacucaccagauuuugggcuguauagcuuaaucccuuuacuacauuagagagaauugugugugaaaaguauacagugauaguacccauccuugugcauggcucaaggcuucauauggcauuuacaaccuaguuuaugggucuacugucuaccauucauaauccaaguguagacuguuagccaugugaaaaauagggcagaggacuugaguucuacauuguucauuuauagccuuuggcucuuuuuuuucucaucauuaaaauaggauuauaugauauaaagguagaaggguauguagcugauauuauugucagaaucuguaguguuuuucuuuccagaguaaacugccugaaagguagaugucagguuuaauaguuagcucugugacauuagaugcuuuggguaaacuguaggaagagaauuaacuuaccucagaagauuaaaugugcuuaauaaacucagugcugagagagcaauaugauacaguaauaacaguguuacacuugaacuaauugaacaauuuuaaaagcaaagccaauagucaaagggauuguaacauuaacuuggugagauuaaaagacucugcucuaugcuucgcaaccuacccccuguuauguauauugaauauagcauaaaauuuaagcaaugcaaccauuuauaagcgugcaguuuguggcauuaaaugaauugauaaugcuguuaggaccacuauaaccaucuaucugcauaguuuuuuuuaucuuguaaaacuaaaacuauacccauuaaaugaugguuccccagucuucuauuccccagcuccuagcagccaccauuuguuguuugacugucagguaucgcauaagugaaaucauaaaucuggcuuaugacugguguauuugacuuaaccugcugccuauaugcauacgauacaguuuaguuuuugcuaggcaagccuguaaugucagcacuucagaguugagauagagggaaauacccuaaguucaaggcaaaucuaggcauuaguguaagacccuguuucaaagaaaacuaaaaaggaaagaauaauuucuuuccuuuuggagaauaaaaguaaugaugggcuuugguuuuggguuuuuuguuuguuuuguuuuucgagacagaguuucucuguauagcccugguuggccuggaacucauucuguagaccagacuggcuucgaacucagaaaucugccugccucugccucccaagugcugggauuaaaggugugcgccaccaugcccggcaguaaugggcuuuuauauauccguucaucaguagccaacacuaagcugcuuccaugucgucaccgugugaccugagcugcuuugaagacgggcauacaaauuccucuuugagccuaugcuuugcagcuuuuggguaucuucagaagugcaauugguggcuuauaugguaauuuaucucucucuauaaauggcaucucuuaaguugcccaggcuggucuugagcugaugauuugccucagccuucugagugcuucgauuguaggccugugccaccauuccugacugcuuggcuucuccuaagauguuuucacaggagcugauccauuuuauaauguccacagcaggaugugaggagucuucuuuguauccucagcagcauguuuucuguuuuaaugauguuuucuuuuuugagacuaaaucucaccagcuagcuagcccaggcuggccuuagacauguaaauuuuccuuguacagccucccaacugcuaggacuacaaguauguaccaucacacuagcuaauuuuuuauuuuauuuuuuuuaauuaaucuucuuaauaguguguugucauugggauuuuauacuuugccuuuguacauuuuuuuuuucuuguuuaguuuugagaauaauuucccucaaggaacugguaauguaaguagaauggugagacuugaaagaguagaggaaaaguugcuguaaaugacauugguuagcucauauuuuuauguaggucaaauguaguaguuuucaaagauguaugcaaaugaggaaguucaugucagccuggcuaagccuauucccuccuccaucguuuuucauuccuggcacaaauuguugauuauaauucuucauugcaagggucggauggacaccuuuguucagcagucagugauuggauaauaggaucaaaguuuaaaaguugguggcuauauuauugucugucuugaauuuaucaaucuaguugaacuuggaaauaaauuuuaaaaggcuuugcuuugauacuuucuuuaauggcuugagguucugacucacaugcaguugguaagcaaaaguugacuagaugaauugcaguggauacugucauuaaacuccacagcgcuggcucuauaggagaggggcugggcucacuaggaaggugauggcuuuguugacuuuucuacagugugucaccagcuuauauuuuguuguagguuuguuuguuuguuuguuuguuuuuuaagaucugggccacuuugagcaagggucuuccagauggccaucaggaaacuuucugaauaggcaauuugcccuuuuuuucuuuucugaguguacaucuaaaacacuuuaaauguuaaacaaguuuuugugguuaaaacuuuguuuuucuuugcuuuaauguuucucaacaugcaugguaguaauaccugaucccagugcucgggggcugcggccaguuaacuuuugcugcugcuuuaucuacuuugagaaaaaaaaaaucaguuuggaaaacagcuaaacuacugcuguuugacucuuugagacagauaaccaucugaguuagauaaaugucugagagcccugguagcaugcuugcugauuuguaacugguggccaguggaacguucucuauacaagugagcugaagcaucuauuucuguaaaacuugcaaagcuuucaagguaucagcaaugcucucugguaaaucuucuugucuucacugguuccauuuguacaauuaaaggaucucuuucacucuccaagcucuuuaacaguuagcuucuggaaucuuccuuaggcucagagcaguacagggaggcagauggggcugcuugcugccuugugcuuugaaagggucuguccagggcugugggucacuuuauuuuuugagucuucuugguaucuggcagcaucugaagacugcagcugcucugggcuccacuggaccauuucagaguugcccagcuguuccuagucuggucuggguaguuuuagggcaucugaaugugcuuagcugcacugugaggucucuuuacucagucuuucugaguuccaggagcugcacuuguguguugcuggggagcuaaggagcaacacaaggcuggagaaaguggcagaggcagagaagcaguguguguacuggcgcugugcgugggugcugucaggagcaggagggcuuuuuuaauugaacauuggcuuuauccuucucaguuuuucucccauaaguagaccccacacacacacuugucuauuuauguagacaaauauauguuuucagaugugugcauauaaauauaguaugcuuaacauguuucuaugaccuguguaaaucagucaucccuaacuguuuuauuuuaguauuuuccuuaaaauggugauuccuuacauaguccuauaguaucauguuaaaaaauaagaauuaacauuaacccaguacuguuaccuagucugugguuuuauuuacauuugcuaguucuucacucuucuucacuguaaggaaaaucacagcacauggguuacauucauuucuuuuuuaaaucuggacuaauaccucccuuucaugauguuggcagaucacacauagaagcugcgugcccuagcuguuuuuaauugaguuuuauggcacuugguuucuccccaacauugaggccuugauuacagaaaccgaauaagauuccuggaagagauggggcgaacacaguggccggaucucugcugggaacccugggacaguggagaaguguucuggcagcuggcuuauacgcgcacagcuguguuugcuccccagguugacacuguugcaggugaugcuggcucucucucucucucuagucuuucuccuccugccuugugauggggcgugcagguauccuggagaaggccaggggacaauguuauccugaagaugcuaucauuaaaccuagaggucacuguuauucugguagacuggccaaucagcaagcuacagucaugccuggcucuuuucauagacaccgaggggucugaguauggguccucauacuuacacagcucuuguccaauaagccacgucugcuagcccacuuucccugcucuucuccagcuagcccaccuucccugcucuuguccagaggcauguuucagugaccaaccugcgucgucaucucugagcuuuaaaaauugugugugucuguguguuauguauauguauauuuauauauuuauuguauguguguugaacugggagagagagcacaccaugcagaggucagaagacaaaaucugagagugggucuuuuugaccuuguggauucuagggauugaauucaggucaucaggcuugaugauagcaagcacccuauugaaccaucuuccaccuucccgagcaaggcccuuuaggucuuauuuuaucauucaggaaaauccauggacgucucuuuaccuugcuguuauaacagugccuuaacaauaaaguagcccauuuccuuagcucagucucucccuugacccacuugggagaaaagcccagaggagaugagggugcugcugaccagucagguugccaagccugagucuugcuucuguuagcugugacccugggugaauagcuccucugcuacugacccuccugcuuagaggcuucauggggucaguggacuuccuccucagucaguaggugaaggucaaagagugcacgcucacugaugugccuguggcuguccugaguuauaaauuauauugauaaugacacacguuucuguuucuuguuuguuugcuugcuugguugguugguugguugguuuuucgagacaggguuucucuguguagcccuggcuguccuggaacucacuuuguagaccaggcuggccucaaacucagaaauccgccugccucugcuucccaagugcugggauuaaaggcgugcccggcacacaauugccuuuucaaaacugcuuuuauuuguuaacuucagacaggaaauaguaacacauacugggaguauuucuaagaagaacuuuaauuuuccauuuguagguuggugccuuagcaguuagcggucacugcuggagaucagcuuucucccuugcugauccaacagcuuucucucucuaggaaugagaucguugggagaguuacuggcucugagcugauuugauucuaaauauuaaggaagugggaguggcaauaggaaaugggagccaacagcuuggaaacaaguuuguaacuugaugucagugaacugguucuugcucauaagacacaauuacauauaacucauggaaagagcaggugucuacccauuucaguuuuccacuuguccauggucuacagcuguugagagcuauaacacauuuggcagugauccaauaaacaugcauuuauuuuuaaaagacuacaugaauguuaaaguuugcuaagugcccuagauguaacuacuuaaagaucacauaagcuauaaacuaaaauguuuaaccuaaaagaguccuauggguaagcucacuuacuuucuucuaauuuaagcauauucuuuaacacaacauaguauacagcaaacgauccacgcuguugcuuaacauugauuaacguuguauuuauuauauuaacuucaaaaggagucucacuucugauuacucuuguguauuuaagccagugaagaaaaagaagauaaaacgagagguuaagauucuggagaaccuucgugguggaacaaauaucauuaagcugauugacacuguaaaggacccugugguaggugccugguggcuggggcuugugcuaguggauuggggugggcuguuuaacacccaggaccucguguggugcugcauaaugggcugauggcacugguaauuacugcugaggggauuuaaaaaccauacaacagucacgcucauuggugagcuggcugucaccauuaaauggaaccuaaauauguacauagaaaaacuccaccaaagauuucuucccuguuucuuugauuuagcccacagagguucgcuagauagcucccugaggcccugcuuuuguuguuuuugaaagcuucucacugccaguuugcauucucuuaccuuacucuaguaucuaguagucugaucuugggaaucucuauguugacucuaguguagagaacuaaacaggucucagaccaccaguccuuugaaaaggaagccuuacuguuucauauugcuagucuuuagcucugcaucaaccacaagccccucacauuguauauaugcaaauaaaaauauauauuuuuacaacuaaaaugcuuuuguuaaaaugcuucauuuggggcaagaugacuaaguagauacaggcacuugucacacaggccuggugacuagaauuugaucccuaauaaccaugucaggguagaacaaaagagccugauccacagagcuguccucugacuccacaugugugccauggcacaugugccaauauacacauguguauguacauauacacuauaauaaaauuuuuuuuugaaauuuuaaaauaauauuuuuaauuuugaccuacccuagggugcuauucccuuuguuucuuccccuaaggaaaaacauggcuguauuugauugccuaggcuuugauccuuaagaucaccuuccugccacuuauguccucuugcugcuguccaccugcucugucugguuaucucccuguucucuaggagaguaagaagcaggucuuugcuucuguaugcugaggacauccccaugcuuuaguggcuaccugagugccugcuguaggccggugcuaugcugaguacuuagcuauaucaccccauuuaaacccugugaugaaacaggggcucuguacugcugugguugacaucuuacuguaaggaaacaaacugacaaacauuaaguaauuugcccaccugcacaguaauaauacagggugagaaaauauuuuucuuuuggacccugaucgagccugagaagggguuguuauauacaaguuuguaaugauuguuauuaauauauccuauccugcuuaguucagauugguggcuagcccagaacuaguuaauguucagguuaaaguggguuuauccacuugaggauauaaauucacucuguguguguguguuuguguguucuuaauguuugagauaaaaaugggcauugcucauacacaccauauauauagaaaauguaaauuuagggguauagcugaguugguagugucugauagcauaaguaggccuugaguuugaucccuagaacugcauaaauuaggcaaggugauaugugccuauaaucccagcacacagaaaaucgaagccaaauggaugaucagaaauucaaggucauucucaaguagggaauuuaaggccaaccugagcuagacacccugucucuuuccugacucauacauacacacacaaaacuaagacugcaagagaugguacuagggaauaaaccuaaagacuuuguacauaauagacaaauaugagucaguacaugguuuguaagccccccucccccucucaguuaacugaagauacgaauaccugucuuaguauuuguaacuuguuaauguguguguauaauauaugaguuaagcaaaaaguugaaguaggacuugagagugguuaaaagcacauguuauuuuccagagaaccugaguuuuaguuccaguaccugugucagguagcuaagagccaccuuuaacuccagcuguagauggaucagacauuuugcuucuguggauagccauacucaccugcaaauagcgaacacauaauauacacauaauuuaaaauaauucuuuuuuuuuuuuuuguuuuuucgagacaggguuucucuguguagcccuggcuguccuggaacucacucuguagaccaggcuggccucaaacucagaaauccaccugccucugccucccgagugcugggaucaaaggcgugcgccaccaugccuggcuacaauucuucuuucagauugauguagguggaaaugggaagggaagccuuagcccugaauucgagaggauuagcuuaccugagucuguagaaagccauguuugguuuuuuguuuguuuguuguuuuuaaaguuuuauuuuauuauuuauuuuaugcauauaaguacaccaccauugcugucuucaacacaucagaagagcccaucagaccccauuacaaaugguugugagccaccaugugguugcugggaauugaacucaggaccucaggaagagcaguuggugcucuuaaccacugagccaucucuccagcccaaggucagguucuugaugaaaaugcuagaaucauuuguucuuggugcugcauugccuagguaaagaccugugugugugcuauggcccacucccuaagaaccuugagcuaaauaaaguucucagcaguaaagauuuuuuagaugaauuuuuacuucuauaacccuaaaaccccugcuuuucuuccaguuuugaaacaguauuucugccaauuugcagaaauuuauuucaccuaaguaaaccugauauuugaagcucuagauuucuacaaggaaguauuaaacuaaacaucuuaugguuuuuucauuaaagacuaugguuuuguguggagaguuuguguuaugugcuauaugcuuuaugcauguauguauagggaugcauguguuuggaagccagaagucuuuucaguuaggcugagugcccguugggcuucggcuaucugucuccacuacuggagauuacaguacccaguuuuugcauaguugugggggauuuagacucagguccucuugcuuucacagcaagugcccuuaaccacugagccaucucuccagcuauacuacuucuaaaaguuugauuacauuugucugccucugaguccagaugaucuuuuaggagccuaaaaagacaacagauucugaaaaccuauaaaaacugucagaugcaucuugcuugcucaacccugauccaagugugcagcucucgauauagguggagacuugggauauugcugagaguaaaucuuaauaaagugaguugcucagggcugcugcuguugaaucauuuggggaauaaucuuccugcuuaaaacuuuacacauauacagaaguaaauaguauaugcugugcccacugagcaugacugaacuugggcuauauuugcccucaugccaacuuauaacccugccccuuucccaccucucacuuauuuugaagcaaucuagacaucauaaauacuucaaauuuuaaauuuaaaauacaaaaagguuuucagggcuagagagauugcucagcgugugaguacuugcugcucuucagagggccugagcucggacaccaguacucauuucagucugcucauggcugccuaguucuccagcccuaggggcuccaguacacucuucugaucucuuuggagauggacagacaagaacaaaucuagaaaaacaacaagaaaaccuaggcugucucugauuugggaauccccuuuucaucugugagguuugaggguggggcucugcaaauugcauuuauuacugucugaguaucuaaaaaaaucacuguucucucuuucagucaaagacaccagcuuugguauuugaauauaucaauaauacagauuuuaagguguguaugcuucuuucuggcaugggguuaauggggguaggagggaguggcuuggguaccauuuaaacuccaaaucaaagcacucauggaucuuguuggugagucacgugacaacuuggauccugaauagugcagaccuugguugggguucuugaacuuggaggaguuauucauugcccuuugacuugcuuccucaaggaguuagcuguggaguucucuguguaacaugagauguaaggccucaucuguaacacgcuuguucuauucagcacaguuuuagcggguuaacuuugguuuucaugacaucugccauugcuaaaaggaaaagauaguggaaagagcuucuguguaaggaaucauuggacugaagcuacuacuuuacacuauagcaguugacagcaauaaccuaaccuacugagagucacuguggucagagaacuuuauccugggauauauauuagagagaggcagacagagacagacagacagagucagagucuuauuuuugaucaggacauacuauuuaaaacugagggguggguugguugguugguugguugguuuuguaucccugggucuguauaucccagaccauccuagaacuugcucuguugaccaauuuaacucagagauccucccgccucagccuccagaguacugagauguacucaggugccacugugcuuagcugacugaagcauucuuuuaaaggaauguuuuaaauaucgaaugauuuuugagagacacuaucccaggcuugccuggaauucaucauaggcuuucugcuucaguuugcuaagcacuaggguuauaaaaguaagcagccaugagcagcuuuaaacuugguucauggauuuguuuauuguauuuauucaugaagcauaaaaauagagccuacucaugaggguucugguguugcaacauacaaaaggaaaaccuuuuuagaacacaguuugaaaacaauauaaaaacaaaauagugauguugauuuccaagggucugagaggacuugugggugauuacaacucuggcaaggaaucagacacuugugaauuguugagggagaggcuagagauaaagccaucuugucagauguugguguccagcauuuauguugcaggugaaauaaaagauccuuauuugcacauguauuuucuuagcuaaucucucuaaggguaucuaaugaaaacuaaaaggguacauugacuuaaaaugaaguaaauuuuauaucuuucuuguauguaacaaauguuuuauuauaacuccuuuacagguaaaaucaguggccagcauuuuguguuucucagaggugauaugugccagguucuguggggaguuaacaaauucuaaugucugggaagccuguuucucuggaaucugaaccauuaaaggaaguguucugaagacauggauagacuuuuaaagaauauccuuuugaaggauauguuuuuaaagaaaucaugggaaucagucauuuuugaagguugcauauuugggaacaucuuuucuccuccucacucaugucuucacuauaauucuguguugaauuccugaucucuucuguuuugaagaguuuguuccagugucagcacuggugccauuccuguuugaucuaaagauuucucuuuccuuuuucuggaagcguuuaggaauuucucuucauucccagucuugugaauguucaaaugugugccuuccugugggcgccuuucauccuuuguucuggauucuugcugcgccuuuuccaucugaaagcucauggcuuuccauauuuucaguguucuuugauuucucccccccuuucuuguucucacugucuagaauauaauucaaauguuagacuuuguauuuuagaaguccauuucagucucugaauuuuuaaaaauagucuucuguucucuuacacuuuauguaauaucuguuuccucauagagaugguugcaucuucuccccaugccguuuuucuucacaauuucauugucucuguuaguugcugcugcuguuuuggaguaaugcucugaaaggcagucaccuccugccuuggggauaccuuggcuguugggucuuauugguuuccaguugaguguguuagggucucauggagauuucagugauguuggugugcuagcucacagcugcugccuucagcuugcuguuugcucucuuucagacauagcugggucuguccacuucuggaccuuucugugcuucuuaguuugaagcuguguaggcuucucacuguuugucugaacuuccagcuuuuuaagucuauagaguccaugaccgugcugacuucaaacuguuguuuuacucccaguuccgagucuaucccuuccaggccuguauguaacugcagagaaccuucaggugaagcacagggauuggaauccccuuugaacacugagccgugcuauuuuggucagccuaaaagaacacuaaauaucagguagcauguguguuuggaaggaugaaugauagcucuuagaugguuugucuucuagguaggaugacaggucaccaauuggcaaucuguucgucuuuauauacucuagaaagauuuuuuauuuugucuuguguguaucuuauuggaaagguuugguuuuccuuuucaucauuucccuuuuacugugaaguauaguaacuggcuuuaaaguacuacacagagcguguuuguccuggcuggaugucagguugaagcauuagugccuuggcuuagggaguugcucagugauggguguucacuuagcacuuacuucccuagcaugcacagggcccugaguuccaucacuagcacuacaugauaaaacaaagcaacaaugcaguguacacaacuuguuuagugauuuuuaucggaccauugguaaucacuuugaucgguaaguuuccuuucauuaucuguuucauuuuuauaucuagguuauauugcaucuguaaaguuaguuugaguaguuuuuccucacuacugccucuaaacgcgugcacacgguguauaaaucuaggcagcucucuuccugacuucuuguuaaugguagaugacaaguuuuauauucaaaauuuugaacuugugggcuauguauggguuuucucccaggcuuucugcacaggggccacuaucagccauggcccaggugggccagcuaguguuuccaugucuuccuguuccaucuuuuugcugagucaucuuguagauaguuggacauucucuuacuuggcuuuugaaugugcuguuaauagaaccugagcauuuaccugugcagucacagaauccaagacauugauuuucacuauacuccaucuacuaucauaacuauucucgguaacucuugucccccacaaugucuuucagagcuguauguuugagagcauaugguucaagaucaacugggcauuucaaaaaaucuuuguugacuccuaauuugauuguacuuguguccagagaauauaaucucuucagguugugcaucucuagucuaaaaaaucucaaauauggagugcuucucaguacaucaccccacaaaguagaaaaugggagccauaucaugaaaguuuuuaacguuuuuuuuaaacuauuuaaaaucuugaaugaauaaacugauguggucguacaugccauuaaucuuaccacuugggaaguagagacagguagaucucuguguuugaugccauccaggacuacauaguaaggcccugucucaaacgaaaagguaugaaguuagcuuuguggucuguggcuaugaaacacaaauggauuuggccagauguuguggcuggggccucuaaucccagcauucaaaaggcagaaagaagccaaagggaguuugggguuaaggugggcuacaugaaauccugcuuaaaaauaaaauaaaauaaaauaaaaaaguauccccaaaacaaagccaugaaugaauuuuauguuuagacuugggucuaagaaccaagauauuucacuaugcugauguaaagauucuaaacacugaaaauuaccugacaggagaaacauuuugggucccaaguaccucagauacccagcccguguagugcuggcucuuuggaaccuguugguguucacugaaucuaauguggacaauguuuuaaccaugacgguuaguucucugugaccauaaucacucuguguuugauuucaugguagagauacuaguuggguuaguuccuccuuuagaaccaccagcuguuuccucuaugugaaaguuaaacaguaaaagaaacguaguagcccuuaaauggcagagucaucucuaagaguuaagagugacagcauacaccucaacuugaaaguucuuaagaguuggauaugguggcacagaccuauaaucccagugcuugggagacugagauagaagaauucuaaguucaagaccaaccugggcuacauagcaaauucuagcucaccuugagcugcauaggaagagcgugucucagaacaagucuaaaggaaaagguaucuguugagacauguccauuuucugccuguuaaguaagaauguuguaagggcuggagagauggcucagugguuaagagcacugucugcucuuccagagguucugaguucaauucccagcaauuacaugguagcucacaaccaucugcauucaugcauaggaguaagugaggcccaguguggccauuccuugggugucugugauuuuuguaugggagaccucaggccugguuaucaaauugcagugucuuccauucucuuguucagauguaggguuuauuuuaaaagcccaagauacauucaaacaggcuguaguagaacugauuucagggaaacaugagugugggugaggcuuugcagccaaacuggaaugggaaagagguuucuuccuuacuacuugcacuuuauuacauuuaguguguaugcaugugugugcgcaugcauauacaugugucauaauguguguggacuggccacuguuguccauauggguccuagggaaccauacacuuccauugaguguggcagcacgcgccuuugcugugagcuccuaaccuucugggaaacagaggcuuggugcguuucugauaagucucuuaugcaaaugugcaaacuguucacuuccugccugcauucugcaguugcuugguuaauaauauucuccacauagcuggugggaaagugugguucuuacaaaguuuuucuuucuaauuucccauggacucuguuuagccuuggaagauaggaucuguuuuguuccacuaacuggcaagcauuauaaaagcaaauguggaggaguuagaccugcuauauguccugccguaugaggacuuggcuugaggguuugguagagaaaauggguguagguuacagcugugcaauggagccaugacauauuauauuuggaaaaguggggagaguucagagauccugaaucaccaugguagugcccaccaucagcugagggcaccuguuucccucaugugcauagccaggcacucaggcaacaugaacauggcucuagcaggagacaaguuuauguucacaacagugaggguuuacuucuagaacuccagauugcugccaguaccuggugcuaauucuagggccacugaggaucucacugugcugugaacaccuuagaacagugguucugagccauguguugcaacccauuugcgcauugcauaucagauuuacauuacaacagcagcauaaguaguuagggaguagcagcgaaguaauuuuaugguugggguuaucaccacacgaggaacuguauuaaagggcugcagugcuaaccaggaagguugagaaccacugccucagagggagaucauggcauggccuaagacucagagaagggagacuccugauucucucuagaaagcucauaggaugguuuggaagagaaacacugggaagggaugauggagagcaaauauauguuggugucuucagagagggugguuccuggagccacaguggggauuguagcaacaacuauuaaaggaagccagguugcccaggugguuacuugguccagauggagcuuaaacuucuucgaccaagaacuccuggggaaaaaaggaggucacaaugagugauggcuagccauucagggcuuuguaaugaaauaaauccaagcacugcuguguagguaaugucuuucauauucaguaaaauugguacugguuugaauaaucagaaauacuuuguugacagcucaaggacuuuuuuuuaugccauaggcccuuuauacuaugauugauauagauaguacaugauaugagaagaaaagccuuuuuuagauuaaagguucaaauaaaauagcccauugguuuucugaaaauaaaaauccuagcacucugagaguuugugaauuuggucuuuucucuuuucugggcuauuuauugacucaugguucaguuuagcacagccuguacaauugaucugucucacccaaguugguaucuaaagcuuggaccuguacaucccauuggaaguugugaccaaguaguagauaagaagccuguuuucaagcacaaggcugggaagacagagcccccuuggguuuggucauuaggaagcugaaagucccuggcagaaauggugagugaguaugcuugaguacagcucagcucucaagggccacccaggggugagccccuagcaacacagcagcuugugggccugcgccagcagcugucugaggccaagagagcugcacauuccuacgaaguuacucuuuuugcuaaaggccaaagggguugggggugcccucuucuucuacaccugugcuuagaaaacacuuuuuauuaguuucauugaaauuuuugccaauaagcaguuuuauuuuccucuuuauagaaucacagugucuauccauuacaaaguagauauacacuccuuguugugugagucuuucuucuaagaguaaaaguuuaaagccauuccaacaacuuuauuuguagaaaguacuaccuagauugacaggaaaggagacuuacuuggaauugauuaucagaggcgggcuugggguacuuuaaugauccugguacucuucucuaagaaacugaaauuuauuucaaacgcccaugagguggaucucugaaugaucaguaaugaaagguuccaugaguguguuaccuuguggucaugcuugacacugcagucuuuuuauuuuuuuaaugcccuauuuuauacaucuuuuuuuaaaaaaucaaauauugccugugauuuuuuuuuuuuccaaccuggaauuguuuggagaacauagcauagauuuuuggaaagucucuugacaucuccaaaauucucacuuuucuuguuucuuguacgaaauguuuuauuccccuaacacuacuccaaauucccuggaguaguucuccaggugugcugugucgggguugggcucagcuugcugugcaguagaauaugugcacagcucaacaacagaccucacagcaguguggcugugguuauugaaauugaaguauuuccugucccagaacuccuuccuuuccccaucucuacugaagguagaaauguuggacuccuuaucuuugcuauuccaggucaggcagugaacuccuggguguccauaauguaagcgcaaaauuugcaggggaaggccaauguuuagaauaucagaacacagucagacuaaauuaacuucugcuuucugaaaucuguuucagcaacucuaccagauccugacugacuuugauauccgguuuuauauguaugaacuacuuaaaguaaguggcguuuguugauggugcuuucccccucaggcuuguauuuuugagaggauguuaaaaaauacagagagaauucaagcagaauauuucuuaauagagaacuuagugagacuuaaguucugaugagaauccuguugugagaccucacagauuuucaaucaaacuuggaaauuuggccaaacaaggagugcagggccguuauacaaaguucacaaccccucguguaugucucuuauuggcaguuggaguuuuuuuucuuugccagguaauuaaucuuaguuuuaugauuuaguuuuaguuuuaucuuaguucuuaguuuucucuaugacaagugaccucagacuuuuuuuuuaaaugccuuuucaauugcuuauaauuugaugagauggccugguaacuuuuuuuuuuuuuuuuuuuuaagagucagggcugccugacugagacaagauagucuggguugggcucauucaugugccugugugaugugggcugggguugcuggaauaguugagguccugccuuccaaguaacaguaagagaaugggaaccucagccugcagccugccaaggucagcccuguaguuuggcccucaacaucaauauguuuguugaauuaguugguauaaaauguugguugguugguuggguuuuggggggggggucggggugcgguuaguguuuuaguuuucuaaaggcaggguuucucuccuggaacucccucuguagaccagguuccaggggauccucaaacucagagaucugcuugccuccacuucccgagugcuugggaacaaggccaauugccaccaccuggcaguuacuauuucuuucuugaugggaaaguuaugaagagggauauacauaauuggcagaccuuugauaauuggcagacauuugcagccaucuuuuuaguuuuucaaacugucuuuuaacaucccuuuuuuguaugagaacaucugcaucucaccugcgcuggcuaguuugagcaagugagaagugaugggugaaccuucuaagugacuuaccaaguacuaaaaaaucgaagcauuaucaaucaacagacaccuguuuuuauuugucuugaugaacacugcaguaaagcacugugaaccagccuuguauaccuuuuggguaauggaucacuaagaacuuaauaacaacuuuguacccccccagaagugcaucauaaauacaaaauuggccaacaugguggcacauaacuuuaauccuggcacuugugggguagagguaggcgaaucucuugaguuuaaugcuugugaaccucaauuaagaaaauugccaagaugggguuuguaugggaacugaaaaacauugcucaagcaaaauaccagguugaaaggcuggacuuggggaguggaaguuugcagaucuggcuuccugaaauguuuuccuuagaauuguucuugagugaucugccuguuacuagagccagaaugcugggcuuagaauucacuagugucuguugagcuuuguuaggaaggauagacugcuugaccuggccuuccuuuccuguggaagugugcagugggaagagguuugccaugcugugaacuucaagcugugccuuugcuagaggucuucccagaaauccccaugcaugcacuaugagaaccacuguccucuucucacaggagcucauuuaagucacuuucgagucuuggaguuuuuagcuagcacaagcuccaugaagacaaaccuagcacaucagugcucagugcuggugcccacgcugcuguccagugauggcagugagcuaucucuuucugcuaauguggcaaaaucccaaugucuaggagcagaagcuguggcagauauuaaaacugaaguaccccucaaggaauguacaggcauguuaggaacccacaguaugucuggccacuguacccugccaagaacuaaucgcugcuuuuuuuuuuuuuuuuuuuuuuuggcucaguccuugguuccauccuauauuuuucauaucccagguauugucagaauuagaucuuugacagagacuagauaaaaugaaaaaaaaaaucaacauuuucuuuuagaaaauaggaaauauuuaaccuugcugaaaauguagaagaagccgggcgguggugucgcacaccuuuaaucccagcacucgggagucagaggcaggcggauuuuugaguucaaggccagccuggucuacaaagugaguuccaggacagcagagagagagacagagagagagagagagacacagacagacagacagacagggacagagaaggacagagacagacagagacagaccgaccugaggcugaaggcugugggugacugcucagugacugccgcugcccgccaggcuuucugugaucggauucagauuuaggguguggugugugcccucacggucccuaguuucauaagacaacugcagagauggauuugggugagagcuaugaagaucuggguaaacaaauaccaguugaaagaaggcaccaagagcucguugcaaucuugcuacaucuauuguaaagcaaaacaaaaaaauggaaauagaacauagguaaaguaaaucaaucuuaagucuccaugguauuccauuguaaauccuccagucagauguccuuaaaucugugguagcuguuuaaauuaagcaaaacuaagaguucuguuaucuguaggacacuggucauauaccaggugcuuaguggccuugcauagcugggacaagcuguaacuauagauuguuuuugcugcagaaacaguagcguaauugcggauguccaggaagugacccuggcuccuuccucucaguauuucuuucuugggagauuaugucacugauuaugucaccuuguccccagguucuguauugcccauucuccaaauucauacuaaaagcaucaacuuuguuguuguugcuguagauuaggggagcauauuguuggcaucaggcugaugcuccucuguggcauaaagcugccugggaugguguccuuuucagucuugcuguccccagccaggagguacuuguucucagaguuaccuaaaaggaaaagggcauauucauacaaauuuaaagauuuaaauaaauauuucuucaaaggcagcauauagacugaccaauaaagaggugacaaauguguuucagcgcuaauaaggaaauacaagucagaaacacauuaagauacuacuuuaacccaccugaauaacuguuauuuuagaaagggugugacagggauuggccaguguguaaaacuggaaccauccuguguuagacuugagaaaacaggcaguuccuuagaaaauguaaaguuuuauacagcaaggaacuucccaagauaaauagaugcauauucccccaaaagucuuccacgugcuuauucaaugcagcguguucucaacagccaaaaguagaaacaaccccagugcagcaaacuaauaaguucauacaacuacucaaucucaaaagcacagugaaagaaaggagaccaaggaccaaaaaagucuagaucacagagcagauccagcaguggcuugaagucacucugugugggaauuugguccugagaguuguaaagugugguagcaaugguuacgggguuuucuacuuacuaaagaucacaggcuuucaacccauaaaagccucuuauauugauucuauuacagaaaauaauuuucucucagaauuauaauguugguuuuuaaaagcuaaguggcucagauuuuauauuuaaguaaaauguaaaugcuucuuagccuagaaaacucacgcuuaugucugccuuguuagaagauguauuaggaugucauucuucaggucccacgugcugggucucguucccuccuuauaaagcaaccuucagcaugaccauugaaagcccccuuucuacuggcugccagcuguaguguccacagagagcuuuuuugagaccauucaaguuaaagugucacaaauaauaagaauguguuugcauugggggcgauuaaaggguuugcuuacuuuucucugugcuuucuuaccuacuaggcucuggauuacugccacagcaagggaaucaugcacagggaugugaaaccucacaaugucaugauagaucaccaacaaaaaaagguaccaauccagccaggcagcaccaaaccuuugcugaaggcuuagggaagaucuaaaccucgucaaauagcauugugguaucaguagacacgaugcugucuaugcugucuguagaccaugcugauuccuuuuguagacugauuacucugacuucucuagucuccuguauuauuaguuucuaccaggaacguguguacaugcuaaccaugacuauaguuucugguuuuauuuuaguucuagaguugacagggcuuuaggaagaaacuacaacagugguuucuacgucacuucuucaugaucauuccaguccaacuagcccuaagagauacacuuggggcccuccaacucuggcugucacagccaguguuagcuuaauaaccaguuagagcagugugcagugcuucugccuggagggagccauacauguccuucaguguugccuggagcucauguuaacagccgugagugaugggggaguguguuccauauguaaguagcauggaggcagaaacaagguugaguucugaugaucuggagagaguaaaagaccaggguaacuuaaagggaaaaacucggaaacauuccaagugcuccagaaaugaccucaucugcaguucuugaaguguagucuuccauggguacacuccuacucuaugugaucaaguaccuguuauagauacgugcuguggccucaccacaggcaugggcauguccaagggcaucuuucauggucuguuuccucuugucuuucuuauagcuccgacugauugauuggggucuggcagaguucuaucauccugcucaggaguacaauguucgaguggccucgagguacuucaagggaccagagcuccuuguggacuaucaggugagcgugucagugaagcugcucugcucugcauuaauuuuauauuuucuuagggauuuuccugguuugcuauguagucgauggauucauacaaaacccaguuauuauucuacucuauaaagcuuuuucucaacuacauuaaauuuuuuuucauuauguauguauaagcuuacuuguaccacagcccacgugugaggguuagagggguuuguucucuccaccauguugguucuuggcauaaggauuagguuguugggguuggcagccuuggauacuuagucuaccagcugagccucuugcugcccuuuuuuuuuuuuuaaggaaagaaugacuuuuaguuauaacuucagaaaggcuaagaauggaacuugccugauaaguauaagacccuagugccuuagaaauacgggccaaucuucaggagucagaugaguacuagaaacuccaucaguacaaagaguuucuagccaucuuugacugaucgaccguccuuacugccuucagauguaugauuauagcuuggacauguggagcuugggcugcauguuagcgagcaugauauuccgaaaggagccauucuuccacgggcaggacaacuaugaccaggugagcagauuauguuauaaaugcuagagauauaacauuugagccaugaaugucacucacuauauaugggcuaccauguaagcugaugaguuguucagaauugugucugugguacaaaaucccaaagcaugcagacauuugcugucuaugcugaaccuucaagaugggucuaagaaauaagguaucucuuuguugcaguaaaucuccagccccaauauguccgagcaaaaaccacacaacucaguuacagcauucacaagcugcacagcuagauugggcacauuuaccgcuacacuacucugucgcccaucuaugagaucccuuguuacuugcggcuucuccaggccacgugguacuauuccaucuuccaccuccucuuccucugucuuucuuuccucuuucuucucuuccuccucucuaaaaccuccagccccaccuuucccuuccacugcccaaucacaggcucuagccuuuaucugaccaguuagaaugaggagaagguucacaugagaucaccugagcacaugauccacuccuuauucgggcagccccucuugaggaagcagaguuaacaucagaauacaaauagcaccagggcaagccacaauguuucccccuuuuuguacaauuaaagggcucucccuuuuuuuuuucccccucguauaaauugaguacaacuauuaugcaauuuagaaaguauaagauauauuuaaaacccagucugucauauugucaauuuagauaaaacacucuaccaucuauccuaacuuuaaaagcuuacaauuuuauaucugaauuauauucugguuuuagcuuguauuaccaucugaaaaucauccucucaaaucuguaucaucucucuuaauguuaaacaguuugagugcuaugaaacuauaacuagucuucaacuccaucagaaauccaaaaaugacuuaaauauuaccugaaaauauaggaagcacaagagauagcuuccaaaauuuaaacauuuuguagagacagcugacuaccuggacagucccuaauuccucaaaauguuagagcuucagucuccaacauuuauaccuuaacuauucuuagucauuucuacuugaguaaauuaaaaacacuuuauuauaauuaaauccgaauauauaaugagccuucuggcccaggaucaucugacagacuuuuguaaagcagaauugugaaggacugcuuacccugucuugcuuggcagagcuaccggucaacuauuucacauaguaugaccuuuuccuggacaguauuuuuguagaugaauugaggcaauuuuugccuagugguaaucucuccacgacuggagcaauucuauugauauuuaauuuuuuucuuugaaccaagaaagggguguagucaggagcagacuagauucuagucaaaugaucuuuaauaaugaaauggccuuaaauguuguauucuguggacuucuguccacagaagacuaucugucgggggcuggagagauggcucagugguuaagagcacugacugcacuuccgaagguccugaguucuaaucccagcaaccacaugguagcucacaaccauccauaacaaaagcugacuccuucuugagugucuuuaagacagcuacagugugcuuacauauaauaaauaaaucuuuuuuuaaaaaagaagacugucuaucuauuuaaaguauaucugaacuguuauaccuuaacuauucuuagucauuucuauuugaguaaauuaaaaacacuuuauuauaauuaaaucagaauauaauauaaucuagcccuugacuuguauuacuuaaucauccuaaacacuguuuuuacucuuuuaaaguuaaaaaaagauuuauuuacuuauuuuaauaccuaaauacacuguaguugucuucagacacaccagaagaggccgucagaucucguuacggaugguuguaaggcaccaugugguugcugggauuugagcucaggaccuuuggaggagcagucaguguucuuacccgcugagcugucucuccaaccccuaaacacuuuuuaacgggaguuauuagaaggacuggguccaagccuuguauucuuagaagaguuguacaggcacaaugccuaucaaagaguaacaauaauaauuuuaaaucuuguaucaauauaagaaauuuaaaucuguauuauucuauaaauuguauaucaauguaaaauuuuaacuucaaguugcauuaauuauaaaaauuucugccaacguaggauauggcuguauaauuuuuuuuuuugaaaauuugauaaccuaucccuaugacaacccacaauaucucuuugucuaacaaaaucagauucuagacauuagaucacaauguccucaaagauauuagcaucuaaauuacguuaacccuuuaaaagcaguuuagaaacuuggauuugugugagacaauuuguaucuuuaagucuucuuguuuauccuaggcucaggucucuguuaaguuccuagagaucugagugacauggaaucuccugauucccaggucuggcucaguguucucuaagacucaugggaagcucugugcuuggugguuuggucaguuuguuuuguguuucagcuuguucgaauugccaagguucuggggacagaugaacuauaugguuaucugaagaaguaccacauagaccuagauccacacuucaaugauauccugggacaguaaguaaaaaagagaagaaggucgggauggggagggaggaagggugcaccuugcugugauucagaaguuggaagguuagacaaaauccaguuucuuucccuuuucuaacaccaguauugauguugguugguugguugguugguugguugguugguugguugguuggguuagcuggcuggcugaagcaaggucucacuugccguguagaccagagcuggucuucaacucacagagaucuaccuccuuuagccuccuaaaugcuaagacuccuacuuaucaauagaaaauggaaaauaagccaggaguggacauggauaucucuaaugacaacaucagggaggcugaggcaggaggaucauugaguuugaauccagccuggcaaucaugagaucccauggaagcagagagacaaaaucauaauguuccaggggaaauguuuacuugguuaaagcauggacuuaguauuuaacacgcuggcuuaucuguaagcauguuuuaccugugugcaugcauuuguaccauguauguauugcugucugcagagccagaauagggguccuuugaaacuggaguuagagaugguuaagagccaccaugugguugucagaaauugaacucagaagcucuggaagagcaaucugugcucuuaaaaccacagagccauucuccaaagcccuaaauauaccuauuuggaugacaaauccuggaaaacuauguuuuuaaauaagaaauguauagcuuauuuucugaaguaaguuuuacaauaauuauuaaggcauacugaauuuucagguauaguguagauuuguaugguuuagagauuuauuuguuuguucauuuguuugacauggucuugcugcauagcccuuucuggccucaaccugagugcuaggauuauagauguacaccaccaugcccagcuucagucuucagugcaguaugcaaaaggaaauacuuggcugguggucuucacacauugucauaugaaaccauuuguuucuaaagccaacucucuuaaaucuaccuaagcaucguugauugcuuagucaccaccaggcuguacuuacucacaguugaaaagacugggccauaagagugauccaggaagauugaaccgacucccgcucagauguagaaguuuuaaacagacucuguuuguccagugauugagccguuuugugucaguacaccauggcugaccugggugugacagguugugaaggugcugcuaugugagguaccagugagagugagccucagcggcuucacagugcaccguucuaagggguccuugauguugggucagcagagaauuuauguagaagagaauuuuucauguuguuuagucucagaauaguaauggcucacuguuuuccuuagacauucacggaagcgcugggaaaacuuuauccauagugagaacaggcaccuugucagcccggaggcccuagaucuucuugacaagcuccugcgguacgaccaucaacagagauugaccgccaaagaggccauggagcacccauauuucugugaguuuuuuguuuuucuuuuaaaguauuaauuacuuuauauugguauauaagcguacauuguagcugucuucagacacaccagaagagggugucagauaccauuacagaugguuguaagccauguuuuucuugcugggaauugagcuuaggaccucuggaagaacagucagugcucuuaaccauugugaguuauuaaccacucuccagcccugugagguuuuuuuauuuuguuuuguuuuuguuuuuggguuuugguuuuucaagacaggguuucucuguauagcccuggcugaccuggaacucacuuuguagaccaggcuggccuuaaacucagaaaucugcccgccucugccucccaagugcugagauuaaagacgugugccaccaugcccggccagcccugugaguuauuaaaagacaaaauugucacucuuuauuuucaaggucagucagaacacuagaugucuggcaucaaauuuuauuuauucuagaucacugaggccacuuuauagaugauuuuucuuaguucccaaagguguuugcuuauucacuaguaguaguaccucugaggccaggcuaucuacccacucucauaacccugaucuuauagacugaagguaucuaagauuuguuuucaagcauaaaauguguauaaaaacuuagucagcaauauuuuuucucauuuaaaaaaguaguuagcgcacccuuauguguuucuaaaggaagcaaugugugaauaagagggcucugaggcgagggagcaggcagugugacagcuggacucugcccucugacaucucgcacugcuuacgguuugaguguagaucuccccauugaaacuucacauacacugaccacgugcuugaagagguagcucagucuaguccugggugaggcuggaagggaugaugcuggguagcgacuugacucucaguucacucugaaucaagaugaacucuggccuguaagguuuggguguauugucugaccacugugugcucuuuuccuuuuuaccucuggaguuuaauauuaacuaauaugaagaauauauugcuaugguuucaaacuuagagcagaaguuuaaggugacaaaaaguguaaaggacuguucuuuuagcuuucugugccuuagacaggugacauucaguugucugcacagagugguggcacacgccuuuaaaucagccacucagaagguagucagaucuacuuaaggccagccaggaacacauaguaaaacucuggggguuuuugagguuuuguuguuguuguuguuuuuuuaaagucaggugugcugaugaaaauaccuuuaaucccaggacucagaaggcagaggcagguaaaucucugaguucaaggccagucuggacuacaaagugaauucuaggauagcuagccagggcuacacacagaaacccugacucaaaaaaaaaaaaaaaaaaaaauugccggacagcgguggcacauaccuuuaauccuagcacuugggaggcagaagcagguggauuucugaguucaaggccagccuggucugcggagugaguuccaggacagccagagcuacacagagaaacccugacucaaaacauacaaaaccaaauaaauagaaagcaauauuaguguaaacaaauggaugugcauaugcauaaggauugcauauuuuaagcuaucuaagguguugguguucugucuggacuccacccccacaguuaccuggcaacagcaaggcccacuauaaaaggggcugugugccccccauaagguauacagugagauucugucucagaaaugauaacuaaaacaaucugaugaauguuucacauaauucauuauuugguuauuauccaaauaaacuauguaucucacugcuccuuaaagucaguagacuggcucuuuuauucaucuuuucauaacaugcuuaucauauaugcuuuaaagaauuuaggggcugaguaugauguugguacucaaagaaaaaacuggaauaaaugugaacaguuguaaauuaggguuucugugcuuuucagcaguuggaucuauauucuaaggaaguagaagaaucaccuagaaaaaguuucccagugagcaugaagccacccuggcugagcaggaggaucagggugaagaagagggaagaguucagggcuaguuugagcuccuuguaaaacuucauacccaaauccaguguucaguaggaauugagacagugauuuagucguaaauugauugccuagcaugugugaaacuacacccugcuuugagggagaaaaaaauaaggaauuauuuccugauccugccuugaugccugguuuuugugugaccugagucccacauaaacgugcauguagaagaagaaaggcagauuggccucagugcuggugcugauguggggaaccugugcuuucuugcagacccgguggugaaggagcagucccagccuugugcugagaacaccgugcuuuccaguggucucaccgcagcacgaugaagccuggggaaucgacgguaaugcggcacugaugcuugccaauaaaaccaaccaaccaaacaaaaacuugaaggaaacuacagugugauaaaaagaaauucuaaucauuccuucuaaaggcaaagaagaguaaagaccuaaagucugucaaaagcaagaaacuccccaguacuagucugcagggagcuggcugugcaguguggcagagcgcauaguucaggaucugagggacucucccuuuggaaugcaugggagaugagaagcucggaguuguuguacacguaccugcguuuaacaggauaccacuguugaauuaauccguucggucaacaagcucugaauaucugacuuccuaucuauuccauuguggucugauuuucugugagaauucaggcucaaguuuuagcaaaagucagcagucuauucugacacaccagccucauuuacaaaaaaaaaaaaggauuaaaacagugacaguauuuuuuuuaagcucuuuuacaaauucauguguuauguauuuuuuuaugacaugagcucuccaggaaauguaccucguuccugcaguuugcuucuaaguguauucauugggaagcaaaccgccguugcucucgccacguccucuuuggugucagaagauggcacuguaacucucgagaugccaagaacaggucccaggcucguuagauguuccaugcugugugcaugacuuggggcucaccuuuauugauuugccuaacuauugaaucuuguugccuuuuuuuuuuccucucucucucucucuuuagcuuuuuuucccccuggccuuguaagaaccucacaguuucucagcacaucuuugugagggcgcuacuucaaugcuccacuuuaaaacaaagacuauuuuuguucacuaccauagcuauagcuggaaaguuagucuucaggcaggucaaagagggaggaaaacaguucuauuaggauuuauuuaggaaagaccucacggguguaaaaaggccgaccaccaucuucccuccccuaacccugugacaaacaagucuggcugcagucaggauggugggcagauggagcucugauaggucauacaugaaugugaacgcaaagacaucucuugcaugcggcugcuagcuguggguaaggcuguccuggaacuccugcagcuggcuggagagggagagccauggcuuccgggaggaaguggggcuccuggagcaagugucaaagcuuuacagauccacuguuaccuucacguuagcagaagcuaaauuuuguuuuuuguuuuugguuuuuuguuuuuuuuaaauagggcugauuugauuugugggauuggucacugacaugguuugccagcuaguccccucuccuuggcugcagccacgccucagcacuggggaccuaacaugcuugagauauccaccacaucacacuuaggguuucuucagaaacuauuuaauaaugccacacauuuuuauaagguuagauuguuuguucgaaacaucuguuuacauuccaaauuccaauaaauuuguauugguauugguagcagguccauuucuaaaugcagauucuauuuuguuguuuggucuguaggaacuuaaaaggcaaauguaacucuucucuugauaguacagaguugaguuuauagaugaaaauaagaucuugggccaguggcauggcagguauagauguuugcugccaagacugauggccugaguucagccccagacccauguggcagggggagaaccuacuccgugaguugucuucuucccacaccugugcuguggcaugugaacacauacacaauaaauaaaguuuuuaaaaucuuuaagaucuuuauaaagcaggacauacauucaguuaagguuuuuauagagcugcugccuccucgcguugagcccuguguucccauguauauauuuguucuuccugagagguggaaacauaacauggccgagacaugaccaguguuaacacaucaaguauuggggauuaccauggcuauucucaugugcugucacaggcagccuggauccuugguggucaggggaugacccaagcuccucuucccucucucucucuaaguuguucaagagcuuauuggagggucucaguugagcaguaaucccaccucuuugcccuggguccuccagagacaguccaaacaucugggaaaagaguuggccauauucccccacacacacacaaccacuccccccagcccccuggaaugcuggggggaggcccuugagugacagcugggggcggggcgugcagcagggacugcacuuuaccucucccgccuugggcuugagaugcucccccuggguuuguacuugaucuuaggcugaccuuucccaaacugcaguguuaguggaccuuuccugccugucucacaucucccuugguauauauguaacauguaugcccggcacagcuugcuccagccuccuggagauuuucccuggguuuuaaagaguguguaugaguaguggugaggcuaggaaauuuacccauccaguauccuuuuuauauucuuuuuaaacucaucucauaauucucguuuguuucauuaccuuauuagaggucaaaagugccuaugacaaggacuuaauuauuuccuaaugaaaagcaaaaaaaaaaaaaaagaccccacaaaaaccuguggggaacaggguaguguugcacugucaucucagguaugccuguguugaagagugcaccugguguaauaagaagccgcuccaggcccaaguuccuaucaguuucucuccuugguauccacagggagugcgaccgcaagguugccuggacuaaaagccaugcugagaaugagaaguguguuggugacaguuuguccuuuucaggugccagucagcugaccugcucccguccuuguagguggcuggguagaagccaggccugguggaccuuacccuaauguccaugcuucgggcacauggguucccugguugaaagggagaagguacucucaguccaacuacugagagaaaggagcuaggagucccugaagcuuagagaagguggcuggcuguugggagcaggugaaaagauccuguaaggacaguguuguaaaggugggccuuaagagcucauacuucuaaggaugaaacuaggggacacuaaguuccuguugcaaaugccuggagaggacacugccccuggcugggguccuguggcccuugaaagguaguugccaagcgccucagggaaacaaucuaggucuccaggagcuaaugugucagcagagcuacuugggggacaggaaggauagaaagaguuuauaugugcauugagauaaauguaggagccaguuaacuuucuguuaacaccaguuaagauucccagacaccacagggaagggaguuucuagguaagagcuggggagaggugguugcagaaugccagcccuucugaaagcaaaagcaagcaggugucuugagcacacaagaaccugaauuugucagggagcuuaauaaauuaaaacugaaguggguucugucuuuaaaaaauaagcccaagggagguggccaagagugcuugcuuuugcuauggcggucuugguuguagaaccuggcaaggauggauuauacagcagacgcauacuuugugucaaccaaugugcuacaaaugugacacuugacccugaacugcauguauuggggauuuuuaaaagaaaaaacaaacuuugaaucaauaaauuaacaguuuuuuccacuugguggcucuucuugauguaaauggugaauuggggacagaaucuuguuauccaguggcaaguuuggauaaucuucaagaaccaaggagccuucuguuugcaggggaaaaaacacugccuguguuguggucuuuuuccaaaggaacacuacaaacccaguuccuccguguagcccuggaugacugauguggugccgugucaaaucccauuuuccuaaauaaaguuucuguugacaauuccuggccuucccaacuaggagacaaaccguugcuucggaccuuaacuugcauucaggggauggggaugggccauaaacuuggaacuucaaagaccugugguggcugaggcugucacucugguguggagauuuccuuaggagugagaccaguggcaccccuugaccccugcuucugagaacugucugcuucugucgcaugacuuuaaccuugggacccaggcucgggcguuuguaaaagucccucuccaccacuacuuacaacacaaaugugagugugggccacugucauuuggcugaugacgugggucuuacaugcauguagguuuucccuaacggauccccggugauuagacccuuggacaacagcugaagagcucugaggcaaugucauuccuuaacggacccagagugucugggccagcuuccccgaugccaggugcuuuccacacugagcucucuaaaauccagucccgggccucagccaccugcuuuaccaugauggguaugggggaggccaugccagacagcuuaguuugcagagguggguuggaaauuugaagccuacuugcugcccuacagugauaguggguuuggccuuuuucccugaguaacuccaagucacuugauuccuaaacucaagauguccucaguaaaugggucagauccgagaaagcgcggggcuggcccuguuguugucuggcuugcaggaugcucacaggcaucugcauaagcaccuacauuugaaggacagggcagaacagauugugacgugaccagaguuccucuaagaaggccaggccucuguuggggucaaaaagcaggaagaggauacuugaagaccugggcucaugccuaucuaguguccccucuaguguggagaagacaggcuugcuugugcccugucccagguggccugccucucugccucagauugauuaaugcccucuuuccccuccucccaucucucuccccaggucuguugcgguuccucccacuuuuccauaagcagaacaagaaccaaaucaaaacgucuuaacgcguguagcgagaucacgucccgagagcagacacaaaaugguggcaggcuuggcgaacaggaacuagaccacccgaagggcagcccaccaccguaaaucagaccucacuuccgaauguaaaagguucacaugccuuuggcuuccuguugacuuccucccgacccagaaagcaugggaaaugugaaggguaugcaaaaaugguuguugguuacuguugcuccccgugcccuugacccaucccauggucgccugucgcuccagcaaaccccaaggacuagcugaccacagacuccacagacgggaugggagcaguguauggcaugaugggcaguuacauauuauuuuaaaaguauauauauuauugaauaaaacguuuuaaaagaaguggauggagcguauuuagugugcaaggggccauugaccgagaccuguggacagagaggacugagucaccagcgcacugugccaagcucuaacuagagggaagcagggccaggguggcauugucaggcaguggagugaacagccuggcucacugcauaggcugggagagcggggccgugucuugacugagguccccaucaguuguccacccuuaccucuuccaaaugaggaguggcucaguauuugagggggauaaguguccccauggugacuucaggcuauaagccacccuuugcuguuucucugcucacaccucuacauuuuguuacauugcucaguuaagccuacucccuucggaagaaaugccucagaguccuggaggcagguugaaucugcuaaccaaugagagggaggagaucaagcccaaagguacuucucauccugcccugauacucgagggaaaauagggagagcaacccccacaugcaugcaugcaugcauacauacauacauacauacauacauauguacaugcauuacauacacacaacggucugcaguggaagccguuaacaggaaacagccaguugacagugcccuuucaauguccucagacgacugaucccagcacagcuaugcaggcgcuguaaccacagcugagggaugaccaaccugggguuuggcuacuggucauucucaugcugccuauagaucuagcacagaggcccuagcagguuugaggccaucgagaagguuggggugccagcuugcuccucacaaggaccacuugcucuguauucuucugccacgcguucugaauggccaugcgaauccaagugugaacacucaguauuaaagugauuaugugggaaggaaacaacaggccucuccaaggccaccguggugucaguguccuuggaccccauuucugucagaucuggucaguucaccaggugugagaccuuaacacgccccaccccaccccaacaggggacaccagcaaguacccuccaggccacuggccauagaccagaaagccaaugggcuacaagcaccuugccuugguuucuuucuguuugcuuguuuucuugaggcaggguuucucuguguaaccuugacuauccuggaacucacucuugaccagucuggccucgaacucagagaucuucccacaucugccucuagaguguugggauuuaagaugugugccaccaccacccagcuuugccuucauuucuaacccuacacuggcuuacuauccuuaagcugucucaggggagccuuuucaacucaaggcucuagaaaguccaguaucaguugcucauccauacgcucuugcagauguacauaguggguaugggcugucuccacagaccugugcagaugugcagggucucugcuggacagauggguguggagauccagcagugcucuuaaggagccgggaaggcuagcuuuaguccuugggcuucuccugcuuuuuagcccugguucuccuucauuucccagcgugaaagucuuccuuuccugaagucccaggccugucagauacucagguuuuguggguggcaagaaaggaaaagagggaagggaaagaaagggguucgggggaagggggaggaaggagaguuuucacuugagcuuugacuuugagaagaguaccuggaggcccccacccacccagaacccgaguagcccauccaccgcucacacggccugucagagaacucuugccaucugcauuaguccugaaugacuucugacugcuuguaguuaucaagagguaauaguuguuacuauuaccuccaagccauacuguuguucaauuugaucuuuuuguuuguuuguuucaauaaaccuuuauuaucuacauuuua

SEQ ID NO: 4672 - RNA, 3490 nt, Mus musculus
ugaacaagagaauggaagacacugcaauuugauaaccaggccugaggucucccauacaaaaaucacagacacccaaggaauggccacacugggccucacuuacuccuaugcaugaaugcagaugguugugagcuaccauguaauugcugggaauugaacucagaaccucuggaagagcagacagugcucuuaaccacugagccaucucuccagcccuuacaacauucuuacuuaacaggcagaaaauggacaugucucaacagauaccuuuuccuuuagacuuguucugagacacgcucuuccuaugcagcucaaggugagcuagaauuugcuauguagcccagguuggucuugaacuuagaauucuucuaucucagucucccaagcacugggauuauaggucugugccaccauauccaacucuuaagaacuuucaaguugagguguaugcugucacucuuaacucuuagagaugacucugccauuuaagggcuacuacguuucuuuuacuguuuaacuuucacauagaggaaacagcuggugguucuaaaggaggaacuaacccaacuaguaucucuaccaugaaaucaaacacagagugauuauggucacagagaacuaaccgucaugguuaaaacauuguccacauuagauucagugaacaccaacagguuccaaagagccagcacuacacgggcuggguaucugagguacuugggacccaaaauguuucuccugucagguaauuuucaguguuuagaaucuuuacaucagcauagugaaauaucuugguucuuagacccaagucuaaacauaaaauucauucauggcuuuguuuuggggauacuuuuuuauuuuauuuuauuuuauuuuuaagcaggauuucauguagcccaccuuaaccccaaacucccuuuggcuucuuucugccuuuugaaugcugggauuagaggccccagccacaacaucuggccaaauccauuuguguuucauagccacagaccacaaagcuaacuucauaccuuuucguuugagacagggccuuacuauguaguccuggauggcaucaaacacagagaucuaccugucucuacuucccaagugguaagauuaauggcauguacgaccacaucaguuuauucauucaagauuuuaaauaguuuaaaaaaaacguuaaaaacuuucaugauauggcucccauuuucuacuuuguggggugauguacugagaagcacuccauauuugagauuuuuuagacuagagaugcacaaccugaagagauuauauucucuggacacaaguacaaucaaauuaggagucaacaaagauuuuuugaaaugcccaguugaucuugaaccauaugcucucaaacauacagcucugaaagacauugugggggacaagaguuaccgagaauaguuaugauaguagauggaguauagugaaaaucaaugucuuggauucugugacugcacagguaaaugcucagguucuauuaacagcacauucaaaagccaaguaagagaauguccaacuaucuacaagaugacucagcaaaaagauggaacaggaagacauggaaacacuagcuggcccaccugggccauggcugauaguggccccugugcagaaagccugggagaaaacccauacauagcccacaaguucaaaauuuugaauauaaaacuugucaucuaccauuaacaagaagucaggaagagagcugccuagauuuauacaccgugugcacgcguuuagaggcaguagugaggaaaaacuacucaaacuaacuuuacagaugcaauauaaccuagauauaaaaaugaaacagauaaugaaaggaaacuuaccgaucaaagugauuaccaaugguccgauaaaaaucacuaaacaaguuguguacacugcauuguugcuuuguuuuaucauguagugcuagugauggaacucagggcccugugcaugcuagggaaguaagugcuaagugaacacccaucacugagcaacucccuaagccaaggcacuaaugcuucaaccugacauccagccaggacaaacacgcucuguguaguacuuuaaagccaguuacuauacuucacaguaaaagggaaaugaugaaaaggaaaaccaaaccuuuccaauaagauacacacaagacaaaauaaaaaaucuuucuagaguauauaaagacgaacagauugccaauuggugaccugucauccuaccuagaagacaaaccaucuaagagcuaucauucauccuuccaaacacacaugcuaccugauauuuaguguucuuuuaggcugaccaaaauagcacggcucaguguucaaaggggauuccaaucccugugcuucaccugaagguucucugcaguuacauacaggccuggaagggauagacucggaacugggaguaaaacaacaguuugaagucagcacggucauggacucuauagacuuaaaaagcuggaaguucagacaaacagugagaagccuacacagcuucaaacuaagaagcacagaaagguccagaaguggacagacccagcuaugucugaaagagagcaaacagcaagcugaaggcagcagcugugagcuagcacaccaacaucacugaaaucuccaugagacccuaacacacucaacuggaaaccaauaagacccaacagccaagguauccccaaggcaggaggugacugccuuucagagcauuacuccaaaacagcagcagcaacuaacagagacaaugaaauugugaagaaaaacggcauggggagaagaugcaaccaucucuaugaggaaacagauauuacauaaaguguaagagaacagaagacuauuuuuaaaaauucagagacugaaauggacuucuaaaauacaaagucuaacauuugaauuauauucuagacagugagaacaagaaagggggggagaaaucaaagaacacugaaaauauggaaagccaugagcuuucagauggaaaaggcgcagcaagaauccagaacaaaggaugaaaggcgcccacaggaaggcacacauuugaacauucacaagacugggaaugaagagaaauuccuaaacgcuuccagaaaaaggaaagagaaaucuuuagaucaaacaggaauggcaccagugcugacacuggaacaaacucuucaaaacagaagagaucaggaauucaacacagaauuauagugaagacaugagugaggaggagaaaagauguucccaaauaugcaaccuucaaaaaugacugauucccaugauuucuuuaaaaacauauccuucaaaaggauauucuuuaaaagucuauccaugucuucagaacacuuccuuuaaugguucagauuccagagaaacaggcuucccagacauuagaauuuguuaacuccccacagaaccuggcacauaucaccucugagaaacacaaaaugcuggccacugauuuuaccuguaaaggaguuauaauaaaacauuuguuacauaca

SEQ ID NO: 4673 - RNA, 3490 nt, Mus musculus
uguauguaacaaauguuuuauuauaacuccuuuacagguaaaaucaguggccagcauuuuguguuucucagaggugauaugugccagguucuguggggaguuaacaaauucuaaugucugggaagccuguuucucuggaaucugaaccauuaaaggaaguguucugaagacauggauagacuuuuaaagaauauccuuuugaaggauauguuuuuaaagaaaucaugggaaucagucauuuuugaagguugcauauuugggaacaucuuuucuccuccucacucaugucuucacuauaauucuguguugaauuccugaucucuucuguuuugaagaguuuguuccagugucagcacuggugccauuccuguuugaucuaaagauuucucuuuccuuuuucuggaagcguuuaggaauuucucuucauucccagucuugugaauguucaaaugugugccuuccugugggcgccuuucauccuuuguucuggauucuugcugcgccuuuuccaucugaaagcucauggcuuuccauauuuucaguguucuuugauuucucccccccuuucuuguucucacugucuagaauauaauucaaauguuagacuuuguauuuuagaaguccauuucagucucugaauuuuuaaaaauagucuucuguucucuuacacuuuauguaauaucuguuuccucauagagaugguugcaucuucuccccaugccguuuuucuucacaauuucauugucucuguuaguugcugcugcuguuuuggaguaaugcucugaaaggcagucaccuccugccuuggggauaccuuggcuguugggucuuauugguuuccaguugaguguguuagggucucauggagauuucagugauguuggugugcuagcucacagcugcugccuucagcuugcuguuugcucucuuucagacauagcugggucuguccacuucuggaccuuucugugcuucuuaguuugaagcuguguaggcuucucacuguuugucugaacuuccagcuuuuuaagucuauagaguccaugaccgugcugacuucaaacuguuguuuuacucccaguuccgagucuaucccuuccaggccuguauguaacugcagagaaccuucaggugaagcacagggauuggaauccccuuugaacacugagccgugcuauuuuggucagccuaaaagaacacuaaauaucagguagcauguguguuuggaaggaugaaugauagcucuuagaugguuugucuucuagguaggaugacaggucaccaauuggcaaucuguucgucuuuauauacucuagaaagauuuuuuauuuugucuuguguguaucuuauuggaaagguuugguuuuccuuuucaucauuucccuuuuacugugaaguauaguaacuggcuuuaaaguacuacacagagcguguuuguccuggcuggaugucagguugaagcauuagugccuuggcuuagggaguugcucagugauggguguucacuuagcacuuacuucccuagcaugcacagggcccugaguuccaucacuagcacuacaugauaaaacaaagcaacaaugcaguguacacaacuuguuuagugauuuuuaucggaccauugguaaucacuuugaucgguaaguuuccuuucauuaucuguuucauuuuuauaucuagguuauauugcaucuguaaaguuaguuugaguaguuuuuccucacuacugccucuaaacgcgugcacacgguguauaaaucuaggcagcucucuuccugacuucuuguuaaugguagaugacaaguuuuauauucaaaauuuugaacuugugggcuauguauggguuuucucccaggcuuucugcacaggggccacuaucagccauggcccaggugggccagcuaguguuuccaugucuuccuguuccaucuuuuugcugagucaucuuguagauaguuggacauucucuuacuuggcuuuugaaugugcuguuaauagaaccugagcauuuaccugugcagucacagaauccaagacauugauuuucacuauacuccaucuacuaucauaacuauucucgguaacucuugucccccacaaugucuuucagagcuguauguuugagagcauaugguucaagaucaacugggcauuucaaaaaaucuuuguugacuccuaauuugauuguacuuguguccagagaauauaaucucuucagguugugcaucucuagucuaaaaaaucucaaauauggagugcuucucaguacaucaccccacaaaguagaaaaugggagccauaucaugaaaguuuuuaacguuuuuuuuaaacuauuuaaaaucuugaaugaauaaacugauguggucguacaugccauuaaucuuaccacuugggaaguagagacagguagaucucuguguuugaugccauccaggacuacauaguaaggcccugucucaaacgaaaagguaugaaguuagcuuuguggucuguggcuaugaaacacaaauggauuuggccagauguuguggcuggggccucuaaucccagcauucaaaaggcagaaagaagccaaagggaguuugggguuaaggugggcuacaugaaauccugcuuaaaaauaaaauaaaauaaaauaaaaaaguauccccaaaacaaagccaugaaugaauuuuauguuuagacuugggucuaagaaccaagauauuucacuaugcugauguaaagauucuaaacacugaaaauuaccugacaggagaaacauuuugggucccaaguaccucagauacccagcccguguagugcuggcucuuuggaaccuguugguguucacugaaucuaauguggacaauguuuuaaccaugacgguuaguucucugugaccauaaucacucuguguuugauuucaugguagagauacuaguuggguuaguuccuccuuuagaaccaccagcuguuuccucuaugugaaaguuaaacaguaaaagaaacguaguagcccuuaaauggcagagucaucucuaagaguuaagagugacagcauacaccucaacuugaaaguucuuaagaguuggauaugguggcacagaccuauaaucccagugcuugggagacugagauagaagaauucuaaguucaagaccaaccugggcuacauagcaaauucuagcucaccuugagcugcauaggaagagcgugucucagaacaagucuaaaggaaaagguaucuguugagacauguccauuuucugccuguuaaguaagaauguuguaagggcuggagagauggcucagugguuaagagcacugucugcucuuccagagguucugaguucaauucccagcaauuacaugguagcucacaaccaucugcauucaugcauaggaguaagugaggcccaguguggccauuccuugggugucugugauuuuuguaugggagaccucaggccugguuaucaaauugcagugucuuccauucucuuguuca

SEQ ID NO: 4674 - RNA, 3106 nt, Mus musculus
cggaagcgcagugaggacccggcugcucgcagcauggcggcccccgccaagcgcgcgcggguaaguggcgggucgccccucgucgcgcccugucccuccccgagagcugcccgcgcgccccugccgcucccugcgggguccagcggcggcgagcccgagggcgacgcgguggccggcuuccugcgcuggugcaggcgaguggggcuggagcugaguccuaaggugacggugagccggcagggcacgguggccggcuauggcaugguggcgcgggagagcgugcgggccggggagcuccuuuucgcagugccgcgguccgcgcuucuguccccccacaccuguuccaucagcggccugcuggagcgagguggguaaggaaggggcagggggaccagcucggaggcuggcaagggaguggcgcuuggacguucaccuggugucuucccuagagcgaggcgcgcugcagagccugucugggugggugccgcugcugcuggcgcugcuccacgagcuccaggccccagcaucacccuggagcccuuacuucgcgcucuggccagagcuggggcguuuggagcaucccauguuuuggugagagccgagggaagggccgggaagaaccuguugcaguuucuuugcucugggacugggcaccugcugcaugagaaggcugcgaagggcuccgggugggcuguccuugcaggccggaggaagagcgguugcgacuccuaaaggguacagguguccccgaagccguggagaaggauuuggugaacauccguagcgaauacuauuccaucguccugcccuucauggaggcucacucggaucucuucagccccucuguucgcucccuggaacucuaucagcagcucguggcccucgugauggcuuauaggucagugauuaaagccuagaggagcagacccucaucuuugagagggaaggugggaaagaacagugaacuccaggucccucacccgagacugggccuuagcugaguucucucugcggcagcuuucaagaaccgcuggaggaagaugaugaugaaaaggagcccaacucacccuugauggugccugcugcagacauacuaaaccacauagccaaucauaaugccaaucuagaguacucggcagugaguggaccccuaucccuggucagguggugugcauuacaaaucaaaucacugggcuccaguuuccuacuaaucgugaaaaugcggugagacuagcuacucuccgguguacuuuugauaucaacugagaugguguggacacacccuaaguccaccagaauagcugccugcucugccaagucaccucaggcccuguggagagcauuaacagcaguucagugcuauuaggaggugggauguuuaugggccagaggcauaguaagaaaggccccacuuuaguguugauucuguaggaaaacuugagcagacagacgucuauguaauguaaauauuggcagcgucuuaacaccuguaaucuuaggaggcugaggcaggauccaagguuccaggcccauagcuuccaguuuucgucuauacaugucaaacuuugcucuccaguguaagcagaugugacuuucacuuauucuuuaccuccguugcuauuuugacaugaggauuaacuuguucuguuuuugagacagguguguauguauguguguguauguauguauguauguauguauguauguauguguauguguauauauauauauauauauauauauauagcuagcccaagacucaagaguuuugucuccugagcacugaguguuuaucaccaggccuaggcuugguuuucuuaaagcuuguguagguaacuaggcagauacaccuaauauacuaaauugaccucuaaaguugguuucacccccucaguauacaggacugaacaguagacaaauggucuguguccucagcgcacauucaguaggcucuuccaagagagaaguggucuggugggggcuaugguguggucccagcuuuauccuuuuaacccaggauuaucuccggaugguggcuacucagcccauucuugaaggucaugaaaucuucaacacauaugggcaaauggcuaacuggcaacugauucauauguaugguuuugcugagcccuauccuaacaacacagacgacacggcugacauucagauggugacaguccgagaugcugcacugcagggugcgucugcccaucccagguucuguauaccucuugacugcacuugucuugcugggguugaugucggcucucuccguccauuacuuuauaggaacaaaggaugaaacugaaaagcugcucgugugugaacgcugggauuuccugugcaaacaggagaugguaggggaagagggagccuuugugauagguugugaggaggugcugacugaagaggagcuagccaccacacugaagguacaggacugacaggguauggguugcugguauuuagaauaaaaccaaagaaaggggagggaccuaacuuucuacagugguaugguugucuugaaacucacaguagcacauugcaacuaaagggcccauauuucuuguagguacugugcaugccugcugaggaguucagagacuauaaagagcgggcuggauggggagaggaggagacagaagacgacaguuuggcaaucacagauauccccaagcuccaagaaucauggaaacggcuucuucgaaacaguguucuguugacccuacagaccuacaccacagacuuaaaaacagaccaggacuuacucaguaauaaggaggccuaugccacgcugagcuggcgcgaacaacaagccuuacagguccgcuauggucagaagaugaucuuacaucggguguuggaacucacaaauuaagcaggcuuccugagaaccuuuuaaggucauguucuguugcuuggagaggagggaaauuugggacuuuugcuauuuggcaguuagaaucaaaggaaaaauagcuaaaaaguaaacuuacaugucggcacguuuggauugaugucagcagauuuaggagcaugcuauuuuuacuaaugccaucagauuuuuuuagaacuuaauaaacaugggcugaguucaacuuugaga

SEQ ID NO: 4675 - RNA, 88018 nt, Mus musculus
caucuguagugggagcugaugcccucuucuggugcgucugaagacagcaucaguguacucacauauauaaaaucaauacaucuuuuuuuuuaaagugacauuucccaguuggcuggguuguccacguuuacaaccagcacuggcugcugcugcuacugagaaaggcacaguggacucauaugcaugucaugacuuuaauguuuaccgucuucacacauacaugaaagcugauuaaggcccagaaacuacaaaggcuacaaaauauaacacgggccuagcuguucacggaacauuuacgauccugauccuuauaaaaagcagcagcuguaguagucuuuuugacuuuuguuguuuaacuaggcuguacagccuaaacaaggugaagcagaaucgcaggccagagauguuccucuuuggguauguucucccuuaggaccaccaaagcaggucaacuaccuuuccagaggcaagcagaacccccuggucuaucuagucuacacuuauaacuuauguggcuuuguaagcuuccuuagcuacguuuuaaaaaaaaauugcaugaauucaguauuugcuaaucuuuggaaugucauggaugucggaagacaugcugcuaugcuugagacaagagcaugccaucaacugccuguuacaagguaguuuacauacguacacacuuuacacaaacccaagaaguuucagacaaaaguuuucucuuucauauauuuacacaaguucaaaaugauauucacagcaucuucuaaauuuuggccaagagucaaaaaaaaaaugcauuuaaacuuuggaacuugcccacauagacaggagaucaaccccagcaguugguggggcagaccccugagaaccaaagggcuaggaaagucaggaggaaucuucaguuuaugaacuugguucagcggaccaaggcugaugcaucugcaagggauauacacaguucaucuaacuggcaccgguccccuccaucacuugcugagccugcuucugucccaugcagcacugugcaacagacugaaauaaccuaagaaguggagacaagcaccaauuaacuucacaacaaacuuuaagccuaaagaucucuuaaucugaauuagcuauaacugcccuuuuaacucacagacccaaauuagacacauucuuuucugucucccugcuugguaauuaacauuuuaacucacuuuucaaucucuggggcacaguguacaaauucaugguuccagaacuuaaaugcuggguuuuuaaucagcucaaugaaggugauaagaagaccccaaggauguggccuauuuacaaucaaccguuccaagagaacccuaaaaagggguauagaagaguuaguuaauacauuaaaaacaaauucacaacuaugccuucauugccccuuucccugaaugcacucagaauuuagcauaugaaaauaggugaaauuuuuccuacaugacaagugcuggcuaguaccaaaucuuuguucuuaaacuuuuuuguuuccugguggcaaagauuaaggccuuugcugcugaaacuggcacaaguauuuaguugggcgaagagguaaaguacaagucuguauguacaccccacuauauugugcacuaauauccaauccuauacaguuuaaacaaacaguaugacccuacuguuucccuuuaaaaccuuaaaaacaugaaguacacaaaaaugucaacaagauucuggauaaaaaacauuacugccacagcuaccaccaagaaacuaauguugcuuuuauuguaaacuaguacccagcauuucaaagcaaaccacuguccauuaucaacuuguuuuguaauuccuuagacauggcucagcauaauaacacagcgaaacugggaaugcacagaacucauucagaauacagcggaagcagucagugguggugcacaccauccaucccagcacucaggaggcagaaacaguuggauccccaaguuugaaccagccuggucuacggagugaauuucaggacagucagaauacaggagaaaagagccccuuuaaggcaucaugacaguacaucucucaccuugugaucuguuccuggauugccucaguguucgccucagcaaaaagguacaacauugugcagcugaaguagugaguguggcuguuuggguaccguagcugguucgcaauugcauuuaagaagagauaucggccuagaaauuagggaaacuagauuuaggauuugcucugaaaggccaguaugagagacaaaugaguuuccuuaggcuuugguuucuuagggggacugauaccaucagucagacauaaucuagcauggugggccuugggcaaacugaguauuauucuaauuuugcgauuuacuauugguuuucuggauaugaacuuuuuuuuugcuucuguaggcguuauuugcaauccauauuaugaaucagcaaaauaccuuacauucuuuaaaaaaauuuuuacugaaaaucuugauccuacacaacaauggaaagcuaaucugcauugucucaacauccaacuacuuaaaacauuuuauuucauguaguacuugaaaaauuguacacaugaaauaaacauaaugaaggcaaugucuuccucugacaaaaacaguccuaaccucaaagcccuuauaagacucuugccccuaaugauccuuauacucugaaaaguacuuugguagaauaauuggagagaaaguuucaaauccagaaucucccaccaugcucagguggcaauagaucucuuaucuguauuugauuaucuuguuuguaccauugaucacaaagacucuuaaacacuugucuaaaggacguaacaugaggccucaauucuacacaaaaaacuacaggcaaccaagaaaugcucagaguagaaaaaaacagucuugucuucucaaagaugagaacagcaacuggcuauccaauaccaaauggccagcccugaaacauaugcacagguaacaauuauacagccugagcagcuuauacuguaaaauauauuaguagucucaagugaucuagcaguuccuccugacaugccccacuccuaacaucaugguggcauacuagcaacagacuggauucagcuacaucugguaguccuagaucagugccaaagcagcgagggaugcccugaagaccaaguucaaagcaaacgcuaagacuucuggcaggagcauaaaaacugugaacauaaguaguggaucuggacugaagcaugagcugcucaaucuucaaaaccacccccaccuccugcagacaaaacuacacauguggcugauaaaacagaaaagguuagccccccacccccaaaauguguguauauacaugcacauauaugcauggaguaacaauaaaaaugaggucaugaauuucuaagagaaaaacaagcaaacaaaacaacgagcagagcuucuuuagcacuaagcuggggauucugaaucuugaccacugaaacaaacagcgcaggagacaccacagcgacgugcccuguacauuuccuacagaggaacagcaagcucuggcccauuaucuucuuacacucacuaauguguucuguucccugucaagcagacccuaguaauuguugguaaagacaaacuuauguaugaagcaauguaguccgaccuucagauguaggcuaucaaaaagaacauacuuauuucccacuuauugcacucuggcauaccaucuuuacucacaggauaagauuuggggccauuuucuuaagcauuccuuauuguagcuuaaaggaaauuucuagauucuuucgauuauaucuguggcaaaguacagagucucugaugaugccaauggccagcugcugcacucacccucagugucuagguccacagccagguucuggaagauguccaugugugcugagugggugauggugcucauugagggcgugcugcccuuguuguggaugugugcgauagccugagucccuacguagagcaccaaugcauugauaagcuggagguuguagcgauucccgggcucauuagauaccuaaaugggcaaagagaaaacguuaccauagaacuaugaauaacacuuaauauuucauuauuuuuuccagagacgggaucucacagugcagcucuggcuagauucaaacgcagagauggcuaggccugugcuccccaugcugggguugaagaaaggugagcaccacugugcugggcagcacugcuguuucucaagccuccuuucucugaaagggauagguagcuguugauauuuacauauaagaaacuuguucaagauugugagcuguacaaaugugcagcugcccucagagugauucuacuagaagacguguuccuuuggaaaaccaaauacuuuugcucaugauacagcuauaaaauaaauuucaagcacaaccucaaccauauauaauuuagagaaagaaguuguugcauucuaugcuaacucugcagagccaauuccacuucaagucacuccauaaaggaaauuuaacuauaaucacucuagaaaugcugucaggucuugcaggaaaguaauguuuuuuuccauaguggucucaucuauaacugggucaaggacgaacuauuaguacagugugugacucagguaagcuaacccaaugaacaauuacaacaauacuuaaaucuggggauggauguccagggaugaggucuugcucuaagguggccacaagcuugucaccugucugccccagucuccucugugcuaaacuaacagguauggacugccacauucagcuucaauguuucuacaucagcuuuaaaauacuaaucugagggcuggagagacggcucagugguuaagagcacugacugcucuuccgaaggcccugaguucaaaucccagcaaccacaugguggcucacaaccaucuguaaugauaacugaaucucuucuggguugucugaagacaacuaugguguacuuauauauaauaaauaaauaaaucuuuuaaaaaaauacuaauaugaaaaugggacauagauagacagugcacacaaacugcacucuacaaaagacacagcaaagaacuuaagucaaaucaacugaccuguagguuacuacgcagaucagacaggaaagugaccggcgaccgaguuuuaagauaagaauccaaauccuuuuugaacugaggcggcaucacuccagugaaauuggugaggauccgaggugcgauguuaauuucgcuuaacauguccaccugccacacaucccaagaaucacaaucaaucacagauguuaacaagcccuuccccuucacagacguguuaugaugacguucuaaaacuauacauacacauagacugugauuacuacaaauccaccuuuucuugucacacaauguuagcuguuucucauuauuugaaaagaaauuagggguuggagagauggcugaaagagauggcacugacugcucuuccagagguccagaguucaaaucccagcaaccacacgguggcucacaaccauccguaacaagaucugacucccucuucuggaaugucugaagacagcuacaguguacuuauauuuaauaaauaaacucuuaaaaaaaagaaauuaaagaauauuuugugcccaucuaauuugcaccauuaaccauuuuuuccaaccuuacauuucuuauuuguuuguuugguuugguuuuucgagacaggggcucucuguagcccuggcuguccuggaacucacuuuguagaccaagcuggccucuaacucagaaauccgccugccccugccucccaagugcugggauuaaaggcgugcgccgccauggccgaucagauuucaaaucaguacaggagauuacuaccaagagucccagccacugaaagaagccccagacaaauauaugcuuuaaaauguuuaagaaaggaccuuaaaaaagaagagcuacaagcaaaguuaaaaggcuacuuggugguaugauuuuuaagcgguucgucuuccuuaaauaauuucaacacaugcacaugaaaacuugugagcuauagacauuacaaagaucacuuuguucuucaauuaugcagugugggaccagcaacugccuaccauucagucugggguuugauaauuaaaccauguuaaaaauaugagaaaacagugaacuaauauucaacgacaguaucacccucaucaucagcuacccuaaaaguaucaguaccuaaagugugugcacgcuggagagagggggacuaaauauacugaugaucagagaaggggcugaaaugguaagauaaaaaauuuuccuuuaggaaagaugguaagagcgcuggcugcucucuaagaguccaguucccaguacccacauggcagcucacgaucaucucagacucuaguuccauggacccacacuaccuuauugccucuguaggucccacaggcaucugcugcacaugaacucaaacauacacacauaaaaucaaucuaagggaggaaaacuuuaaaaaacaaaaaauaaaucaagaaaacauuaaggaaguaaaaguuaaauccccaguaaagcaauggcaaaacaaaacaaacgugucccaucugcuaaaacuuuaccuucagauuaggagugaaugggucugggagccucauguuucuugggaaggcacucaggaucaaauuucuuaacuggauacaauuaggagggaucacaucacagaacccauaaugguaaucacaaaggaacucugggaaaucaugcaaaagaaccagcagcacucucagaguacccugcauacaaacggaaaaguuccauacuaaaaaagcaguaguuuuuccuccauugucgaaaauagcaaaaguauauuuuauuaacauuaaaaacaacaaaaccuauaggcuuuaauuaauacaugcaguuaagauuauaaaaaaguuacaugcagaaaucaugaaaaaauuagcuuuuggagcugaagccuuaaaugaagcacacaaauauucugcaaacaccaaugcugccacauuuaucuucagaaacuagaaagaggacuaacaaaagugaaaaggcaaacuaacaagaaaacuacugaaaauggggaugggaucaaagcuagccuuuuuuaguuuuuaacaaguucgguaaauucaacaauucugauauauagauaggaagaacaccuuagcaacuugagauagccuaguauauuuaagaaggcccuaaguuuuauccccagugcuauggaaaaauaaagucaaauuauaaaaaugcauaacaaaacaaaaaacauggggaacaugagcaaacacuggaaggaacaugacaaaaagauacaucuauaaaugaaaaucucacuaagaaggugagauagcggggcuggagagauggcucagugguuaagagcacugacugcucuuccgaagguccugaguucaaaucccagcaaccacaugguggcucacaaccauccguaaugagaucugaugcccuuuccuggugcaucugaagacagcuacaguguacuuagauauaauaauaauaauaaaaaaaaaaaaaaaaaaaaaaaagaaggugagauagcgcaugcuuuuaacaagagugagaaagagucaggaggaacucugaguuuuagguaaaucaggacuaaauagugaagcuccgcuucaaaaaacuaaacaucccugccaagaugacccugcaguuaaaacacuugcugcucuugcagaggaucgggguuugcuuccuagcacccacacgguggcucucaacuaucuguauccaguuccugggaauccaacauccuccucuuuauucucugagcaccaggcacacauguggugcacauaaaugcacgaaagcagacaggaaagcaaaagucauacacauaaaauaaucuaccaaaaaaguuaaacaagaaaacauuaaggaaauagaaguuaaauuccccagugagauuguagcaaauggcuaggaugguggugguuggggguugggagugcagugcaagagauauacaaaagaugagagaacaacuuuccauugaaaagguacauugguagaugcacuagagugccacuagaguauccuuaagucgggccucugaguaucaaaugauucuguaaaagcauaucaacaauaguucccauauaaaaacacuuuuaaguuauuuauaaauaaaaauuaccuuguagaggauuugcauagguuuagugaguuccacauuucuaaggaaaggugcuaaauauuugaauaaaucaaucaacagcugagcauacauaggccaccccuaaaagaaagaaauauacauaaguuguaguaacauuuacaaguuguuuggcuacuacaaacuugcccgucucuacugcaucuuaucuauaguaaccugacacgagggccucuccuagauuggauccuagcaaaaugaagcaucagcucaguguggugggcguguccauaacccuaccugccacaccggaggcugaggaggaaaacuuaaguuccaagccagccagaaacauaaauauccaacaaaacaaaaaguccaaguauuacaguaguggauaauguuaucuaaaacaacaggacuccagagacuuuggaaaauauuuaacuuugugccuauaagaaaacuaaaaagaaaggagaauacccugaggaaauugcagaaguaguaucaaaccagcuacaggcugcuugccauaauuccuucuuuaaguccuguaguaaauaaccuugcugaacucagagccucaauucuguacuuucagccccaaguggccuccuuacuacaguaucaccaaccacacaaauucuaguucauucuuuuugugugcacaccaugcaugugucugugugccauggauugcauuuggaaaccagaagacaaauucauuaagaggcuacuucacuuucaacacaauuuucuucuggucagaugaggguacuuauuauaugcaguacuccuuugccauuuacugcagugacaaacuccucugaaauacuguuaacuccagcauagagagacuggcauaccugguccauagcaaagcuagaaaagcaauaccuggucacccaacaaagccuucagaugcagucaaguacuugauaagccuaagccucuucuacuacuaagugacuaauaaaauugacauaaauagugcuagaaagccccagguaguuacaggcuucaucuguaggagauaaacugcagccacaccuucugcuguggcguaugugccagcauucuugcaauaaagauccgaugggaaaucaauucgagccaagcauauacaaagccaggagcuuuaguaggucucaagauguggaauguauugcugaaaaaaaaaaaaauucagaaccacaaauugaaauauaguaaacacauguagacuuuacaaugaaacacaucaaaacaucaaaguucuaccugacuuuuaccucacuuaaccaacagcccugaaauuucagcaaaguacugccugugaucccagcacaaccucugacaccuacaaaaaucaaccauuaaguuggguguuggggugugugccugcaauuccaacucuuggacgcucgaauugggaguucaaggccagccucaacaauacaggaacuuuugagaucaaaccugagcuaugagacccuguauaaaauaacaaauagaaaucucuacuauacacaacacucaccagaaagcaguaagagucuggaaauuaaugguuuccaacacaugcucgggugcauugagcuccaacagcagcaugauaaaaauccuaugguacggaaguugcugaaauucacucugccgaacaucaugauccuguaggagaacucccacuacuauaccgagaaccuauacagaacauacagauuacaucccaucaaccacacagauaagccacuugucacuuuuaccugugucuuggauugaaccuaggcccucccaaaugcugaguacuuaacacuugaauauuauagucaggcuuuuaagaaaacaaaaacaaaacaaacaaaaaaaccaaaacuuugcacaaagucucacuaagcuguccaaaaacuggcuuugaacuuacaaguuccaugugauguucuuaccuccucacucagucaggccugcacuaccagcaguggcuuauuuacccugaacucuguaagcacuacaaacaauaaaggaaaggauacaugcuguuuagacacaaauuucuaugcuggcagccagcaaaagggaaauuagauuuucugucuuguuuuguuuuuuaaauuuguuacuggaccaaacuucuauauucucaauaaaggccacuggcuuuucuaaagguauagaaaccuggacgucucuccacauuucaucauguugagcucuaacaaggcuagacugucuaaugugacccaacggggcaacgauucccacuuugcuuggcagaaguguggguucucaacgauaagugcagggauaguaaugacccacuuguauuucuccacagacaaaacuacagucaagguuuacagucuugcacuaguuugauauucaaauuuucaugauucacgcugucuaaaucgggucaauaauuaaucaaaugccauuccuagugacccauccagacaugaguggaggccggaguguaccagcuaccacaaucucuuguuuagaucaucaucaaaacaccaacacaccaacugcaucucccucuucuaaauucugcuacacaauauauggauacuaucucuucuauuucauuuccagaugaaaaagauuuggggguugggugugggggugcaugcccuucaaucacggcaccucacgggcaggggaagguggauucugaagacagccuuguccacaaauuggguuccaggccagccagggcuacagugagaccuugucucaaacaauggugugugugugugugugugugugugugugugugugugugugugugugagagagagagagagagagagacacuacaauggaucagagaacacaauaacccgcaagucaagaaaggauuccagaccuuauugagcagguugaucuuugugacaguguugguggccuccccagagugcuucacuaacagugcaaugaggcggacaaaggcauccagguugugguagcacuuggcccggaucaugguaggguuagccgcaggauugugcugcugcuccgccugagcacgguaacugauuucaacacacauuucagugcaaagacgaaaaaaccuuguuaugaggucaucaguuuuaaguauuccuuguuggugcaucuacagugggaacaaccaaucaacaugguuaagacaauccucaaaaucaacuuuacaguuagcuuucaaauggcaaaacucuaguuuauacucauuuaacuucuuacucugaaaggaugccauuaggaaaaugacgucccugucaugaaggagacauggcagaguuccucucaguuuuaauucauggagaagauugaagcugacaaacagauauuaacauuaaauaaaaggacaucuacaguuugggaaauuauauuaauaaagcuaacuuuuagaaauucucuucauagaugccuucuucuuauuuaaccaguggcagcguuuuuuaaaacaucaucugcagaaaaaucaauaauuuaauaaauucccaggauuaugucacuuaaacguaaugaucuuuuauacuguuacaaugaguagaaaagacuagcuccaggucaggaaaugguacauagcaacacugucucaaaaagacagcagcagggaagaccacuaaccgguaaagcagcagaggaaaggggucggcgcuuacuuaggaaccaagggggggacggacggacauaaagucaucuuggaaauuuuuaaacaauuuaauuaucuugauaauaaaacagcuaaagguuugaauuauacacaauguucccaaaccaaggcagaaggccagcaaaaggaucuuauuccacauuugacacgugaaagcuugagaggaauaugugcuaugaccaagcacuacacauaaaaaggagcaguaaaguauagugcagcaucuccccaagagaagugaguaaagcgaaggaagaggagccaggcagguaccacauccauacucacacaggcaaugccgccgagccacgcgucugcauuccgucaacggaaugacaagucagacuacaaacauggaggauggccucucagccugacuuaugguaucauuuccuggauucuuuuagcagagaaauuuauguagcauaguuuacugguugucacuuauguugaaaaguaaauccaauucuuaacaaauccacaaauguaaauaaagcauuuaaaaauagaucaaucauucuuuggaaaaacaaccaucuuuuggcgucaauuugagcgaaugaaaaaauacaacagucaagcuuucuagcuuacugaaaguacuguaaagcacucuaaaggaguuaaggccaguucaagacaguacucuucauuuucccuuucguccucacaccacugaaaacagccaaugaugauaagaaacaaauggacugugauuauuuuuuccaguuuauucugucuguaacugcuuacuuuuaaaaagguuuacuuuuaauuaugauuaugugaaugcucaugcaugcuuguuauuguguaauuguguucaguggugcacauauaugcacaugagaucaggcaucugccaagaccagaggugcaggauaucccugaagcuugagucagugagcugcccaaugugggcccugggaaccaaacuccaguccucagcaaacacagcacaaagcaugugcucucugcggugagucagcccggguccacuacaacuauucauucucuguguggugguuugaguaaaaaugcuucccauagacucauauauuugaaugcuuaggcauuggagagugguacuauuugagaaaaauuaggaggcacacccuuguagaagguguggccucguagaaagugugucaucggaggugaacucugaguuuucaaaaagcauaugccagguccagucugucucuguugccccucugucugucugucugugcuuguaaaucaggaugucacucucagcuacugcuccaaugccacgcaugucacuaugcucagaaaaccgaaaacaaggccuaaaugaaaugcuuucuuuuauaagaguugccuuggucauggugucuuuucaaagcaauacaaaugugacuaagacacuuugguagccugauuuuuaaaaagcagcucaauuucugagacauuuaaauugcaauuugugucagauucauauauauaugagacaaaaaaaaaaaucuaccacuaaauagggauuuauuguaugguaguguuguuaaaacgugauauccuaacaucauaauguguuagcuuauacucuaucacuagugacgauuuuaguaaaauuguauguuguagcuucauuaucauuuucugauccacuacagcuuguagccaggacaacuggaauaggcugaguaggacugaaggaguaggaauguugaaucaacaguagcugugaucaacagugaggaauaaaguaggccagauuaguuuaauaaagcaugguggugguauuuuugguuugcaugaguauggagguaauucugaccacaggcauacaaaacuaaacuuuaauaguggaguaaucacacccuacuuauguugaauaaaaagcaccuuucuuuccaaaagcucuaccuguccaacaaacgcagagaaugcuuugguacugucgcggccagcugcugcugaaugguagagauucacccauucccucagaagauacucugccuucucccucaggccuggagggucaucauauucugaggcuugagagaucccagaaugcaucauaaaguuagggccuccaugagcacgaucaaucauugcuucauaguuggaucucaccacuuccaucagcuggggcaaccuaguaugauaaauucagagugaaaaaccaguuaacccacaguuguuuacuuuucaaaacuugagaaauucaggcaggacaggcugucuggucaaugagcuucucucugccuccccagugcugagguuacuaauauucacaacuacaccaaguuuuguuuugugcugugugcauuccuugugcacacaugaaagccagaggauaaccuuggauauuauuucagcaggauucauccacuuuguuuucugaggaagucucucaccaggaccucaccauagcugauuaggcuaugccaccugugccuaacuuagcacuggcauuacaaguuuguaucaguacacuggcggcugaggacuugggcuucccaaggacccugaaagcacuucacucccugagguuuaucccagccuaacagagccaguguucacggugacuucugcugccacucagcagucacuguaugugcagcucuccugaaucaggaaggcagcaguggauuacgaguucauacuuuaaggacaauauuggcccaaccuaaaauuauguuauagguuaagaaagucacaaagucacgaguuaugcuaguguguaucuaauuucugaagcucuuaagagacugcugaguguacaggagagcagagcacuucauucuuacccuucuggagcauugccucuggaaugagcauuaauucucaugaggguuucaaugguauggaacagaucugccucaguaauaugggcaacacuccuuucauccaccagcagaauuuuuaccaguugcauagcaaacgccacggccauauaguucaagccauucuccaucgacuggcaacacagcaaauucaagagaguaauaauuaaaaaacaaaagcacuuccugaauccuuuaauucaaucaaguuaaauuucuuccauaccugagcaagaugaagaucauacugcugcauguuaaccaaaugauuucgaauuaacaauuccacagccuccacauuauauuuauauucaucucgacauucaauuaggcaccuaaaaaagggcauuuuucuuaaucucucuuuuuauuugcauugguguuuugucugcauguaugucuaugugagagugucagaucuugggaguuauagacaguugugagcugccaugugaauacugggauuugaaucaggguccucugcaagagcagucaagucuuucgaggcccccccaaaaaaacagcauuuuaaccguauuaaccauauuagcuauguguucuauacaaagaugucuuaaaaagacaacugcgggagcuggagagauggcucagcgguuaagagcacugaaugcucuuuuaaagguucugauuucaaaucccagcaaccacaugguagcucacaaccaucuguaaugggaucaaaugcccucuucauacacauauacaauaaauaaauagauagauagauaaauaaauauuaaaagaaaaaucaauaacgugaguuggaguacacacauaaguaaaaacaauaauaaaaagacaacugcaaacaaaaacaaaauaguauuguuugaaaaaaaauaggcagguuagggauauucaaauaccaccuaggcuuagcauccaugagguccacggcacccuuauaaacaauaaacaugauaccaauacaguacuagccagaagagauggccuaauguuaaaaaugucuaaacuugcaccgggcgugguggcgcacgccuuuaaucccagcacuugggaggcagaggcaggcggauuucugaguucgaggccagccuggucuacaaagugagcuacaggacugccagggcugcacagagaaacccugucucgaagaaaaaaaaaaaaaaaaaaaaaaaaaaaaaaaagaggagggauuucauucaagacacuaaaauguuuaccaugaauguggaaucaugaaaacaaaugaccuaaaguuuacuucucaaagacaugugucagaacuacucaacaauucuuaccccuuagaaucagggauuucaaagccccauuuaucuuguaggcaaaagaaaaacauuuagaaaaauaaauaaaguaugacaaaaucuaguccauggggcugaagagauggcucaguggcuuaaaguacacuuucuguuuuugcaaaagacccagguucacuuucuagcacccaacucacaagguaguucaccauuauccuaacuccaguuucaggggcucacauguccucuccucuccucuacaggcaccagguacacacacauaguacaaauacacacaugcaaugaaaaccacacaugcauaacauuuaugaacauaaacuucagaaacauaaaauaauuaugaagcuagcccaguuaugacgaguuuucuaaggucacccaccuugugauuuguuuguugcaccauggagauccauaugcccugccauccugcagagcuuucaguaccaacagguggcacucccuguaucgcagcaguaagucggcgucagcaccacuuguggcaucuaauaagccuucuacagccuauggacacaaaggauucacaagcauguaaaauacaacacucaacccaacuguuagagcuggaaaucaaacacaaaggacuacauaauuucugaagcuucaaaauucuuaucuccacucucaacuucuaucuaacuuaagcuuauucuuuaguauuugucaucuuaaagucuucuuauaguuuuuccauucaccauagugccaagaaaauauuaccauauggaaaagauguccuuacuacuucuaacugcuauaaguauauucuauggaaggggguaggggugggaaucaacaauacuugguuugcauuauuuuuuuuuuuuuuuugguuuguaucaauuuuuaaaacucaguucuaaauauauagauucaguuacagucugaaguccauaaaccaaguuccuauuacaagcuuaagaaccaaccuucuguaguaauccaagagcagcuaucgcaucccgagaauuccgagacaacacuacaaccucuaaaagacuucggagagccugggcuugaggauucauggccagaguggguggaauggcguguaggugcugcuccaguucuguaauacacuuaucauaaaucugcgcuacaucaucaguugcccaagcuugcuguuuuagaaaaauaaauagccagagauaagcaaacauucuuaagguuguucacgggcacaaugcaccgauaaaauagaagaaaguccuuggcauauugcuuuagcuuauuuuuuucguucacauaugcaagcccucuucuacaccuggcucuugaguucuucagucuuaguauuauuauguggggguaauucacagccaggacagaccuguugaaaaggccuggccaucaccaacacaacuaagugaucagagagcauaauaucaacaauggaaaagacugcacguguaccauccagaaagccuucugcaacuuaacgugugucaagguucaaauacaauacuuccaccaaauuuuaaaccauaacuggaaaauaaaaacacaucacuucugugcuuccccuuuucucuuccuccgaaacaggguuucuuucucuguguagcccuggcuguccuggauccagcuuuguaguccagacuagaguguaacucagagaucugccugcuucggccuucugaguacugacuggauuaaggcaugugcugccacacauggccaugugcuuuuccuaucaaaaaccugcuacuggccuggaaagauagcucagugggucaagggcuuacccugcaaccaugcagaccugaguucacaucucuagaagaaaguaaggaugggugugauggcaugugccuguaauccuauuguucuaacaguaaguuggaaaauggaugaaggaguauucauggaagcgcacaggacagcuagccuggggcacacaggagugaaaaaugaagagacuggguuucaaaaaaaggugaaaagugagaacagucuuuugucuaccacacaugcacacauacacacuucaugaaugcauacacaaaaucauauccauacucuggaguaaguggaaguacuauaaaaaucugaguguagcucagcagcagagcauucaguuaccacauccaaggcccugggugaaucccagaacaaaugaggaaauucaggggguuauuucaaagaaccacuacaugaaauguaugauucuaaaagagcauuacuccaacaacuugaagcaacaacuugaaguuuaaaagaauuagaugaggauacuagcauuuaauuucuugauuuuaacauuugcacacaggcuggagagaugguucagugguuaaaaaacccgacugcucuucugaagguccugaguucaaauuccagaaacaacaugguggcucgcaaccaucuguacagcuacaguguacuuauauacauaaaauaaacaaaucuuuaaaaacauaaaacauuugcacacuaugguuauaaggaagaauccacuauaagccacuugagcauuacuguacaugccugaaguauaagggagagguguguguguguauaaaaagaaaugguaaauucuagaucaaggcaacagcaauauaacugaaccugucacuccaaaaccuuguggugagccagugcuuagcuagaauccaaagaccuuuaaacucucuucucuggcugggcauugugguacaugcuuuuaacuccagcauguggaggcagaacugagagucccaggacagucagugauacaggcuacccuguguugggggcgggggugccacuacuuuguaaacuaauaauuaaaaaaacaaaaaaaguugaggcuguaguuugguggguagagggcuuagcacacacaagguucaguuuuucaggaccucauaaaccaagugcagugguguauauuuguaauucuaacacuaaggaggugggaggugggggcagaagauuaggagggcaaagucacccuuggcuacagaguucaaaacgauucugagcucuaugaaacccaaucucaaauacaacaacaacaacaacaacaaaaaaaaauacacacacaaacaaaaacaagcaaacaaaacuuaauuuguguauacacacugagaggugacgggaagagaaaaacuaagacugaaugaaugggcaguguuaaacauuaguaaguaaaugauauccuaguuaccaaaauucccauucgauaccccccuaacagguuguuguucagggaagucuuagagccccucaaaacaagacaggcuacugcaauuacucacagcugccaagcaguagaacagaaaaugggagaaaaaaaaagcaaaacaaaccaaacaacaagcuagaacugaacuaaaacaagcuccucugcuagguagcuuucuuagcauaggaaauuaaucuguaggcugcuagggaauucucuauggcccuacucagcugugagccauguaagcucuaagucaaguaagauaugucuaccggugcaauaguggcaucaauauggggauaaucugccaccuucuggcugaaaugagucccacuccaaggagggaauucaagccucguacuauaaaaccggcuaaaagcccaugguugggacgacucugguggaaaggaaauuacuacuuuuguuucgcuaaguggacauguugucgaacugucuucuaaauaugcaucuuuauacucuuaauacuccucucaaccuacguugcaaaagcuuguuuuccaaugguuaacagagaagacuggucaaggagcugagaaugaguaacuguugaacuuugcccugaacacuuccucuaaggcucagggaauuauuuaaacaaggguacaaauauguuuuugggguguagcuuauguuaagcuucuaggauccagaaaaaccccaccuauacccaugccgaugaaggcugcccucauuaaauucagcggaauauggaugcauauguggaagucagaggacaauuuauagcaaucuuuuucucuuuccugggacuccagaggaacuggagauggauaaguaagaaaauaauagagaugaaauuaauaaaaacuaaaccuuaaaauuauuuuuaaaagagacaagagccuccagaaaagaauacaaauucaauaaaggugcuuuauguuauuuucuuucuaaaaguaaaucaacagaaacaaagcagauagcagcucuacaacucaagugguuuaugggaaaauguuuuccuuguagugucaacuucaauuaaaugugcugcacaaucuuagaaacucccuuucauuaaauuuaaguauaaauuaaagaaacaaauauuuaaaaaaggaaagggaagucaaaaguuaaguuuccuugaacuaaacaguagucaagcuaaugccaggacucacuacacugcuugacaugcugaucuaacaaagaucaguuguaaccaauggcuuccauuuuccuacccgguaacaagcuccccagcagaaagcaaugcacuauuaaauuguauuccacaacacaaacaaguuaaucaaaugagguauuuaccuucaugggcugagcuaaaaacccuguaggcugacuuaagucauuuguagguaagaagccaggcacauuucgugcaaacucuucauagacggcuagcugcuuuggguccacaccaccaaccuuaaaagaagaaagccuuuuuuggguagaauucacuucacaaucaaaagaaacggauuauuuuauuuugagguggaagaguugagauggagucucucucugguaauagaacucacuagaucaggcuggucucaaacucaagagauccuugcuucuccccacccccaccagacccccugcuaaaaugcccagcuaaaacuuauuuucuacaagugauaagcuugcacagaauucugauacaacaguuaauacaacauaugccagcauucaugccaacagaucacagaagagguuuucucauuuuccuguuagagucagugucacuuacagucauuaauaauuccuuacuggagucccuauaacagcacugucugcagucccugccccggcacuugggacuuaguagagaccagaugauuauaaguuugaggcaguuugguccacauggaagccuugucucaacaacaaucgcuaggaaaugccucaagaggagacugccauggaagucuccucucccuugggguaaauaguaucaaacccucaccaucuuguugggaucaauaaggagcuaucaauaaaaagauaaauaccagaaaauaugaaaaggcaaauuuaaguugggaaaacacaacuucaguaguccaugcacucuuuuuauccuugcuaggaaaugugaaagugagcugcuaccagagaugcuccuucagcagcagcauauagaugcacaguccuuaggagggguucaugcaacagugacagagaaagagaggggaagcaaggaggcaagagccucaguucucacuuucagccugaucugcuccggcauccgcucggcuugguagguuaagaccacaggaucacaguaccuacguccuucuugccgggcaugcuuccucagcucaaauuccuacaaauacaaaacgucacugaggcucuuguuaugagacacuuccucagacucaaagaaaccacaaccuuacagauacacacuaaacacuuacaguugccaaucucuuguccaucucagggccugcuuucuccacugcaguuuucugaauaaaacaacaagcuaauucacaauuguccugagcuaacugagcagcagccugguccaucauuucccuuugcuguggggaugcagucuauugagaacacaagacaaaagaaaagagcaauucuaaaauguacaacaggaaaugcgguauggucaacaggucauuccauauucugguacuaccuauguaccagcagaaaccuacaaauauuccuaauucauucacauauaagaugaaaauacuuuucaacauuucaucagguuguggugaacauacugaacaauuugugaacuguuaagaagcaagaauucuuaaaucugauacccacaacuucaaaaugaaaaauuacuugaagugauaaaaguaaaguaacuauauauuauaaacuauuaguccaacugcuguaaucuaaauucaucuauguuugagaugcuggcuccaaacuaaaaaaaaaaaaaaaaaaaguccucuucucuuggguacugcugaguaucugacaaguaacacugagcacagaacuacauaaaaaagaagcaaacgcaacacuuugccuuaacacaacuuagaaucuaaaagacgccagaggcuggaaguauccuucagugcuaaggaguuugcccuaacucauucucauucauucauucacauucauucaaauucucucucucucucucacacacacacacacacacacacacacacacacacacacacacacacacacacacacacacagcacaggcccaagcucuuacagaccaguaauacauuuuauaguacacaaaacagucugcuuacacgcagggcugaggcaaagcuguuuuugagguugguggauaugcucaucaguaaagguucccugcaaguaaucauagccauuccagcugucaaguuccgcaucaugugaugagcugcuauucucauucgagacuccucagaauccagggcaaaguccuuucugacuaucuguucgcacguagucauagcaaucuuaauugagcgauccaccacaggauggacaagcuccuggacagcucuuucaauugcuugccgcacacacugcuucagcugaggaugagcuugaaauaaagggaucuggaaggaggaaacaaggcacaagucacaucugacucugguacuccuucaaugcuacagaaaccacagaguucacauaaaacuaacaaagccccaggaaacagaaccuaggaagaaaagaagucaguauaaccugugaucuguuuuuaucuguuuaauccccuucaauuuuaacaagcucauuaaacaaauaguacuugcuuauagacauaugacuuucuaaguuaaaguuauagcuaaauuauccguuaggaaggcaguaucagcagacggcuggcuggugaaaagcacucgcugcucuugcagagucccugggcuaugguucccagcacccccacuguguagcuucacaauagucauaacuccauuuccagaucugcugccucaggcacacauguggcuuauacaugcaugcaggcaaaacauuccuauacauaaaauaaagcuaaauguaaagacuuugauuuaaaaauuauauauacaaacugcauucugccaaaagaaguagcuuuaaauagcaggccaaaguggcaugauaaugaaggccaaaggaaaauacuauaguauacaucaagaagaaucucuuuuuauugcuggcauaauuaaaucacugugggguaggguuaagaguaaaaaauagaaauccuaaccgcuuaaaauguuugccuauuguaauauacacauuauagauccccuacuuuuuaaaaaaauaucccaggggaaagcugguaaacagggaaguaaguaaccaagaguucacugccacaaacuagaagucaaagcauucuggggcugcagagauggcccagcguuuaagcacuugcugcucuugcagagggaucaggauuugauucccagaaccaauaugguagcucacgcaugaccaccuguaacuccaauuucaggagagcugauguucuuuuccgaucaccuuggguaccuaacaagcauguagugcacaggcaugcauucagguaaaacacauaagucaaucuuuuaaaagaagaaggauaaguuuucacucacuguaggguuuagaguaauaugaggugccaggccugcuagagaguagacauugaugucgugguagcuguacuguggcugugguggaacuguggcuguacacguaguacugguagcugguguuguagaaguugcuacauguaaaguaaaguaaaagauaaaaagcacauuuaucgacugaacaaagaaaucagcuggauaauaaauggaucuuaucuauuuaaacuaugucucaacucuugaguaggggcagcuaaugucauauuuuucccauuuugaaaaagaaauucugcuauuguaugacauaugagccggucuauuaguggcaaugucuacagcacaggaacauuuucaggauaauccuguauuaggcaggccaagcuuccaauaucuggcaguguuguggguacauguucucaaccuagccuuuaccaggcucauuugggauuugucagaugccaagagaaggcuggugggagaagagguguugggugcugguuggcauauucuaccaacuccucaccuuuaauauaacuacauccaacucccaaaggcaaucccaccaucaccagggaguaugugugccugugugucucacuagugagugccagugcgucucugucugucugucucucccucucugugugcacauugugcgucuguggaaugauuuuuaaacagggucccaggcugguucaaacucauguagcuuaaguuguccucaaaugcacaauccucuugccuuuaguuucuuaagauuagagcccuguaccucuaaaccucuugucuugaugcagauaagauuguccuuguaggcaugacugaucuggcaaacccuggauuuuaagaaauaauguauacuauuaugucauucaaguacugugauacuuaaauguuuugcaagauaagcuagccaggcuaugauauaagaacaacucaucuacucauaauugcuuaaaauuaucuuaagagauagugagacgaucuaguaagccuauccuuagaugcugcucacacuugauaaucagauggcucacaguguggggugguugcuagguggcuuaugaggaguggugucaucugagaaggaucugaugaacuugugcacuuacuuguuguugugauggcaggaagcucuucgggcugcuugacaucuuucuuuggagcagagaguugcucaucuaaguucuucagacgaucuuuaucuuucagcagguuuccagguuugagcucauugaugucuaaugcaagguucuuacagagcaccucaaucucaaacuucagguuuaacugcaugauuccaguauuuaauuagaauaagagaaaauuugagcucuguccauaauauauccuacaauucaauccacuggugcaaugaccacugccuacccccuguacuggucuaucuuuacauuaaaucaucugaaggcccagaauccucugagagaggcagcucuuuuaccuuuaagucaugcuccugaugcagcucagccaauacauucauaauugccauuguccagggguuugguggucuaaaaaccuaaagaagagcuaugauauuaaggcagccuaaaucaaaccuuuacucuguauuauuccaacaaguaaauaaacaugacagugacaaaagccccauucuuagauacaacccauuccagaaaaacacaaaacggaguggaaagcugauccacucagccucuucaccuaacuuaauguguaauaaucuaggaccaacuaaggaagauuguucaacuagcucuaugugcacaagaauaaagcucugaucuuuugguauugugugagcagccucucaccaauuccccaggacuaacauuuacucaccaggcugcgaaugcuggacucuagaacuuuggcaacaaagggcaccacauagagcaacucuugcuguccuuuaacguaagccucuaacagcaaagauuucacauccaaguccuagaauuuuaaaacaaaacauuugagaagcugauguucuucuguuccagaaguccucagggaaaaguaaaauaaaauaagaaccuaagaauaguaucucauggccuagucggccaucacugggaagagaggccccuugguauugccaaccuuauaugccccaguacaggggaacggcaggaccaagaagugggaguggguggguuggggagcagggcggggggaggauauaggggacuuucgggauagcauuugaaauuugaaauauaaauauauauauauaugcgcaaaaagagaaaaaaaagaauaauaucucacuaaaagcucauuugccaacauacauuaucugauucuugcccgacaaaaagcacacccacuggcuuuucuguauccuaaaagagccuaagagaccacgagcacagaaauaagaauucaaacauggucaaagacauaaaaucccagugacaauuaaaacauuucuuauagccaaguucaaaacauauauccaucuuaaaacucacuguguguaagauggguuuauuuuuagcuaaugugaucauuccuaaccaaugucccaaguucuucagcaaagaacgaucugagaaauuggccgcagcuuuaucagaagucagcagcaccugcgauaauacagaauuuauaaauaagugaauaagcauauaaaagaaauucucaauuucguauuugagaguuucccuggccucucuaaaagaaaucaauucugagcaccuacccaaagcagaccuaucccguguaucccauugguaucuuacugcaugcauuagcaaacugucgauacuaccuuugaaacagguuuuaaagagcucacgagguggaauacugaucuaccaugucuaagacccugaaucugaaucccagcaugacagagaaagcaaacaaaugaaugguuguuguuugccucagaguacguaggaaauuccaaagacuacagaacuccuuccuagaaaagauaacgcaagcuguacagucaugucccuuaacuccauaaagcaacagcaaaauggcaucagucagcugugcuacaaggagccaggaauucuuuuugcacuacagcguaaccaagaauggggaaauuucccauacauagguuuaaauauagugcuaguuccuaagccagccccaaguuacucagaaaugaaagaccccaucuccauccgguuugcacuguuucuuuacaaagcuucauauuuaaaaauaaaugguagauuagaaauaaaauaguugaacuuuauggaacaaguauaagaguuuggccuuauaccacauaggaucccagaacaaaaagcuauuucaaauaggacugaaaucgagauaucuugacauucaaccagcagaaugaguuuuucuguaagaccauuuauuaaaaacaaggauagagaccugagaacuuguaccuagucuccaaagauaagaaagaaguggucacacacgcacucacacaugcauagacacaacucacacaugcauagacacaagucaacaagaugccaugccacaaaaauacugaguauuguuccuuaucacagaaaaaccuauuuuaaagagggacuauacuuacauaggguuaugucuaaaugauuagauucuugguccaguaagaugauugggcaaguaaaagugacaguuaccaaacuaacauucugauauucugaguuugaaaaccgccccugaaagcuauccucugagcacaaacauauguaugacaaucgcacaaauacgauuuuacaauguucaugaggcccaauaguaucauuccaaaccaaaccuauggcacucuccauggacaccuaacagagagcacagagaaaaacacaaaccuucccauguuccaccugcaagaucaacuuuaaagcugaaggaaauguaagaacucuucuuacuuuaauguuucuguagguuucauucagaaccaucuuguuaaauucaggauucuucaauguaucaagaaaguuugaauacaggcuaugaaaguuuggcucaauacugacucuuuucauaaccagauacugggaaacccaaggcauaaauucuuccuucacaguuucuuuaagcucuucaaccuagccaaucaacaugacaaagcaguagagaauuaguauuuaaaaacaaaaacaagaacaaaaacaaaacaacaacagauaaaaugaaguccagguucucugaaucacaacacacagcaucuggcuuggacuuccucaugacacuuuaacaacaaauaaucuucagacuuuaacagaugauaugugcuucuuuuaaagucaggguuuuccuaugcaauagcucaggcugaccucacuuaaaacucuucaucuuucccucagccucucaagugcuauuauuacaagcuuacaccacaaggcccaucauguuaaaguuucagaaaaaccuacuugcucuuuuuuuuuuuuuugaggcagggucucucuauguagucuuagguggcuuagaacucacaauauagaccaagcuagccccaaacucacagaaacccaccugccucuauuucaccaugugucaccaugcucagccuaaaagccacugucauuuugaaguauuauuuuaggaggcaagcaucauuccuuauucuuuucaaagcucuaccucaaggugcucaugggguauaauaagcaauuaaaguaguuucuggaggaacauaaaacaaaauuuuccaucaaacauaggcauggugguauguacuuuuaaccccagcacuugggaggcagacagaaucuagaggccauccggguuaacagugagcuccaggcugguccaggcuaguuaaugaguccuugucucaaagcaaagaaggaaaaaaaauaacacuucccuucucaggagagcauaacacuauuucaaaaggcuacaacucacugcaaaacaauacuguaacuaaggauacuguuuaauuccuauaaaaauaaucuuuaaaaaaauuuuugaagucaugugccaccacacccagcuaaaaucauaccuuuucgacugaguuugugggcuuuuaauuuuagaaagggucuguuaccacugugacagaaaaagcuagucucagacuccugaugcucacggcagcuuccugacuuacuggauucaaaacaaaacaaaaaaccaaucccgccauucaucaaggagaaggagagggcauuucaugucauuacaucaugcuuaccuucugugucauauuugacugggagagauuguugaaaauaaaagcaauuuucucuugaauauuuucugggggcuccacaauccucucaguuugaucuguggccacaagcaauguaucgauauuuguuguauuuauagaaggcuagaaguaauaauaugcacuguuaaagaagccgagguguuucauuggaaaauccuagaaaacagaagugcuggcaaguguugccucauaacccagccuacguucaaucccugggaccugcacgucagaaggagaggacugcuuaucaccucugaccuccauacacaucauagcacacagacauacaaacuagacaauaagauauaaagacaauaaauaaaacauuuuaaaaagauuauagauuuccauuagcaugaaaaauaaacaugguaugacuacacugguaagaccauuaaacccauuacugaauuauuauauugcauagugcucucugggaaauauagggagaaaugcugaucuuuaugcuuccaauaaaauaauguacaaauucucuacuacauauuuauaccaacagauccucggaaagcaaaaagaccuacuuacuggcacaucuuucuuaaagcugacucccguuggcuuggugacuguaaccguuuuagcaacaguggugguuguugaggugguuaccauuguguuaaccugaccggcaagaggagcuuuugcuggaaccugggccugagccugggccugagccagugcaauacuuccagggguaguaauagagcccugcauuuucacaggaggaucucgagacugcuguccguacucaauguacuauaugggcacagaagcaaacauauagaggcaucuuaauagaaaucaagaauuucuguccugguaagaauaauuuuacuucgccuuuaauucuugcccaauauuggcacaauaccuaagaggauacugugcacaccaauaaaguuaaaucaguaugguaaagugcuuuaaacuagccuggcaaaacaauuuuaaaaagcagucucaguuaaucuguaaauaaaauuccuugucaggcagugguggcgcacgccuuuaaucccagcacaugggaggccgaggcaggcggauuucugaguuugaggccagcccggucaacagagugaguuccaggacaaccagggcuacacagagaaacccuaucucaaaaaaaaaauccuaaacccuuuaaaaauuucaaaauuuaucucaagcuacauuugauugaacuucaucauaaacauacuacauuguguuuuauaugcccauaagacuaucauuaugaaacagaacuauaacugcaagccagcuuaaguagaaccaacaacauuaaugaacaguuucauuucagagcucaguuagaggauuggcauggaguucugauguugccuaaaaucauccuuaccugaaaaguaaaagcacaacauguaacuucuugcuaacugaaauacugucugucuguauucuucuaggaaaugggggugggggugggggaggagaagagacuggaaaaagcucuaugaccuaaauugaccugaacucaagagacuugccugccucuguauucccagugaugggauuaaaggugugaagcaaccauuugcagaguaaaugauauuuuaaaggccauuuuaggacuacagucugguuuaguguuugguuagcuccagguguaaauccaggugcaugggagcacagcuuuaaccccagcagauaguggaaacaguaauggggaucacugagggcaaguaaagacagugacaccuuauuuguuuguuuuuuuaauaaagguccuugucuuauagggcauaugcaugagaaagggagucagucuuauuuggucccuagaaucaucaacaggaaggcaggacauuuaaaaaaaaugugcaauauuuuaauuaaaauauaauuaucuuauguaccacccuuacaacaucaaauucguggccucuaauuauuaucccccaccccacauccauacaaucugcucagucuauucaauauugcuuuaguuuuuaagauugauuacuuaauacagaguaacuaauugacuaauuaggaagcaaucccuugggaaagacuaauucucccucucagcaaucauuaauugccuguaggagcugccugagaauuuccuuucccacacuguaaucacugcuggcagacuaacauuuuaaaugugauaacuguuauuccuuacagucuaucuacuguauguaaaguuuuuguuuguuuguuuuuugagacaggguuucucaguguagcccuggcuguccuggaacucacuuuguagaccaggcuggccuggaacucagaaaucugccugccucugccucccuuguacugggauuaaaggugugcaccaccauguccggcuacuguauguaaauuaacauuauuuuaagagauuaaacaaguuucauuucaaacugacuauccaaaugcaagccaaaggcauaauuaauaucuauaauuucaaaaauaaccacuaaaaagguuucucaaauuuuaauaguacacaaagaauaauaugcauuauuucauaggucuacuuuuguagaaauugacucccagugaauuccuccacagaaucuaagcagauaacuuuaaagauuuuauuuauuuauuuaaaguggaugauuuguaaaccaacuuuggauuguguaauucuguccuggguguugucuguuuuugagacagggucaguauaaagccuuggcuagacugggacuuacucuauagacuaggcuggccuugaucugagaugcaguugcuaggacuaaaggugggugccaccaaccuuugaacaacauuauuuuguaaaaucauauauacaaagauauauacaaagauucacuaaucuaucuacuguucaaaaguaucaccaggccacaagaacuaguaaaagccuuuuaauucaaccaagaaaaccacagcucaaaccauuacaccaugaaugucauuuuuaucugguuuauuauuaagccaaaaaaugcgcaaggaacaauauacagaucaaugaagaaucuuaaucuuggcauugugucauauaccuuuaauuccagcacuuuagaagcagaggcaggagaauuucugaauuuugaggcaaccuauugaauucuuggcagcuagauguacacagugagaccauguuucaaacaaacaaacacacacacacaaaaggcaaguguuauggaacaauaaggagagcauuugcccaggaagcacaaggcacagcaacugaauucuaacaacauauaagugaguugugauccacaaaguguacucugaccuccguacaggccaugaagugcauguucucauacaauaauacaacaaauuaaaaagcaaaaagaaaacaaaacaacaccuuaaucuuacuagcauuucucacaaaaucuccaaucaaaucaagggugaucuagccucuguccacuugacaggccauuacagaucaaggcacuuaccuccugcaaaugaugugggaacugcauaaaguggcugauagaagccaggugcugacaauacugaggauaguccuucaaucugccaaaauaaauuguucauucaucauuucauguauguacagagaaaaggugggguuuuuucagacacuaaaauugaaaaucauuucuguuacuuugaagagaaugucaaauggaagacuaccagccaagaguaguacacacacacaagcccagaauuaacaacagcgacacaagcucaaagccaaccuggccaugucucaaagggggaaaaaaaucaguaacauggggaggccaccaaaaugggaguaggguagaaugcacucaugaaccucacuccacacaggaaagaaaccaucauggagguguggucacacaggccugcaaucccagcacuuggcacagugaaggagaauugggauuuccaggccagacugggagagagccaaucaaaauuuuaaaaguaacuuaaaauuauguaauucaaauuaaacaaagucaauaucucugcuuaaaacaaacaaacaaauaaaaauaaacagaaaaccaguuuacuuugcccaaacaguggacuuaguuguauaggucaguauauauuuaauguugaaauguaugcauuguguguaauauacacuacugcuccacaaaaaagauauuaccaaagaaggcugaaaagggaaaauaccaaaucucacugcagguuggggaacaagagagaaagaagugucaguguaacuacucaccuauuuuuaaaucuaucuagugcagcaauaccaaaauaauacauuuuggauccaaaaggcuuccguaaggcuucaagaacauaucgcagggccagacccaaugccauguaagugaccaguccuuuuucaauuaugccaccaaacaagcaagcuguuauauguaauucuuuaucaggguacugagggaaaaaccgguauucuucaaacaaguuccucagcauacaguuaaauacuucucguucccuuuuuauuguagagucuuuaaaucucuguagcauuucuaauaccuagaaaagcaagauaaacacaauacauacauacauacaaguaacuuuaccgagaauuuuccuuauaugccuuauaagacuugcuacgaaaagcauuuaccaauacaaaaaagagcuuaacacaaacauuaaaauuucaaaagauuacaacauuuuaagagacuuucuaaaaaccuucaaagucuccuuauuucgagucuauaaagacacaagaaauuagggauccuagacacucaccucaucaacagacaugguuggauguggugggugauuauauauucgcuggaaauaacuguuugcuucaucaucaauuucuuuacuaaagugcugauuugccucuggccacaccugagacaagucggcuguuggggaggaaaaggcuaucaguuaauuguuaagucauagucuuucaauucccccagaaagcuagaaagacuaauaugguuuuaacuuugggggggggggggcauacaaaagaaacugaagguucaagggucaaaugauggauuuuuauggccagagcugucuaggcagacaaggaagacuucuaaauaaauugcuuuacuuaguucugcuauaauauuuuguacaucccacuacaguaaaaagcucaauaggcuacaacuccuaacacauuuaccauuaacaaacccacucaugacucauaauuaagucuuuauugccuuguaauaaauauacaaauuaacaaaaaacaagacacacacaaacacaaagcaugcuacaaaacauuaacauucagacaaaccuuucacacuaauagugucaagucaguggggaggaggaggaggagggagaggaggaggaggagggagaggaggaggagggagaggaggaggagggagaggaggaagaggaagaggaggaggagggagaggaggaggagggagaagaggaggaggcagaggaggaggaggaagaggagggagaggaggaggagggagaggaggaggagggagaggaggaggaggaagaggaggaggaggaggguuauugggaggcaguaucucugggugcccuggaccucaauauguuaucucugacuggccuugaacucgagauucaucugccugugcuggaauuaacggccuguaccacaaacacccguccugcuccccacccuuaaaaaauuacuuuucuguguauugauuuacuuguuuugucuguaaguauaucuguguacaugccuggcgcccuugcagaccaaaagagggugucagccccuaagaguuccagacaguugagaucugccauguggguucugggaaaggagccuagguccucugaagaucacucagaguucuuaaccaccuuuguuuuuuaagaaaaaauuagaacuaguauguauaaaguaaguuagcccaggguagccuacaaguguacaucuuugugcuagcucuuucaauucuucuagcaucaauauuuggccccaggaauaaaacaaauaugcaaaucaaucaacuaagcugcuagauauauaaaaaugaguauuuuuuuuuuguuugggcaauauuacuacaaaaaugaaccauaaauauugauccuuauccuuauuucacagugauauuuaugagacaaauaaaacugcauacacuaagaagguaauacauaauuuacuucaaauuuuugacugaaacagaaaucugaaauguuggccgcuccuccacucauccgguuccuuccuucuuucugucgcaugagaaagggucucucaaugcaguucucaauguccuggaauccacuugccuagacccaacuggccuacaacucaggaaauccacuuuccuuaguuccugggauuaaaggcauaugacaccacaccuaauagauuugugugugauguguaaaauuuguaugaaaaucugacauguuccaguuuuccccuuuccuacaccuacccguacucucagcgugguauggugaggacaccuuuuacuaucauuuuguucugacaauccagaguacagguggagugagagcuuuaguuuuauuguuuugaauuuguguauucccacaagucuaaggacauaucuaaugcaaccuauuaucaacauacaagucaguauuagcaacauaauucuaaggauaacagaaaauaaaaugaaauuuuuacauuugucagucacacuucacaaucacagacaacacuaccacuuacaagguuucaucuuacucugcuggaauguaggcugguugaguccagaggugcccaguuuccucuguacaaaaggaucauuguucacugcaggaaguccaagggccccaguuccuaugccagucaggcuuccugugccaagaccaccuacuagagagaaugagggcagccagaaguuuagucaguacuucauuucaaagaacaguuaaacuuauugugugcacaugauggacgucugagugcagguaugucagaggcugguacaccaccacaccaaugugggggugagaggacacggggcagaggagcagacucccaucuccaggcuccacguguccaagagacuuuuccacagagccauuccaccagcccuaucauuuauaguauuaaagaauuucaugcaauuguuucacaauuaucaugaguuaggauuucucuauuuaaucaucucaacucuaacccaaaaacuaacaagcaaauaccaacaaugaaaaccacaaaggcuaauaauaguuacaucugugcuaagaaggcuuuaauaucacagugguuucagcuuaaguaaauuauucaucaggucuaaagccauccagcagcaguaacuaagacugauccuuuacuccuuggcuuuaaugugcuaacccucagagccugcccaagagaagcauguagaaggagaaagaaauauaugaacguuuacuucaauaucaaauuacaaaucaacaagaucaaggagaaggaauucaaaggguuuuaaaagauacaacaguauuuucuaugugggcauuguauaaauaaguuagguaaaacaaaaacuugaauuugguaugcacagucuuuucauaacgcugaauucauacaauuagcacgugaccgccccaguauuaaauaaccagcaccccccccccaaaaacacacaaaacauaaaaucauaaucacuuauuuccauuaaaaggaacaaaauuagacaguauguuuccuucuccccaacguaggauguagauauacauagcuuucacauuuugccuauuuuccuuucuuuuaugaaucauuucaaauccuuuaguacacgcuaauuaggcacaauaaaauauauacaaaugauucugaccguacccaacuccccucaccuggaagcugugaggagaguccuccaaucccacugaaggccguuguuugauuugggguugaaagugguggaaaugcuuuugcuggugacugagggguacugaacgcagaacccagauuuggaggaaaacccugcaugcucugggugugaggggcagccgaaccaccuauacuaagagaugccauuccagcaagagggucaaucuaaagaaaaacaaauguucauuacacauguuuugaggaaaaacaaauuacggcagaagguguauauuaagucauaauaauagcuuuauacuuugaaacacuuuaacacucacagaauuguauaacaguaucaagaagucugcuaaucaguucucauacaagacaaacacuuaaagaguuaagcccugccauaaaguaacagagccauaggagaugacaaaacugacaagauaacuauccucccuauuguuugacuacuaaacuuuuaguaguaacauggggcaaguguuacauuauuauaaaucaaaauuaauuccagccucauuuuacuuacaaaagaauauuucacuuaaaacacaucaucaaauuuuauaauuuucagaguucaaaaagaaacaacaaaaacaaaauaugcuauuugcagaaauuuuuuaaaucuaguaacagcacuccaagcacuguaguugugacgccaguucacacccucaugaguaugggaaaugacaagcaaaugccuuaggagggagacacugaagaaagagucucuaagagcuuuuccuuccuuaaaccccaaucugccauuuagugcaucugaaaccaaacuggaauacguugcucccaaagagaauggggugggcggugucagggaguaacuuaaauguaccuuguuuuuaaaagagcaguucaguugcgagcugaagagcccaguuauaacaaguccuuaugcucuaguacuguugcuuggcccgugaagcuacaaacaagacacaucagauucaaaggcagugcuuagucucccaagaguguaacucuaauuuuaaaaagaaacccucuucauuuaccuauagaaaugauuuuaucuuuucucucagucauguucuuugugauuauuaaagucuauucucaguuauacugccuauggaaggaucuucuuucaaauauguuacacaugcagguaucugaaguaaaauaaacucaagcuguuacuaaagaugcagguguuuggucuauucucaaucuaugaacaaaaauaagaagaaacuguuaccugaacaggagaaauggcaucuaagcugcuagcacuaggagggcgaccuuuuggcauaacuccaggugguggcugucuggccuuauucauuacauuacugcaauuggcuaccauggugaggauggucucugauaacucuugagaaacacuccuacaaggagaagaaaagugagauauacuugcuauuucccagaaugccuaaagagaccacucugaucaacaaaaaccaugcucugcagcacaggccuacaacuguccaccacccccucgcaucugccacuuaccaacaugauuuucucaacacuagguuaucuucaaaacuucuggcaaaaacuguaucuugucuaagacauuucagcuacugaauaaaagauuuuuuuuucuuuuuuaacuaguggucauuggggaaugggagcaaaacaagccuaaauaaaagcucuagcagucaagggucucaagccaauauacugcuuaaauccaagcugacauagcaagaccuugauucuuuaaaaugauaacaguaauaaccaucaauagcauacugaaaauacagaacuaccauaugaucuuaauauuaagauucaaaagcucacuuccacaaucuuacuaacauaagagaucacauacuacaagaauaaaaacaaaaaucauuugacaauguuaucaaacagcacaaagaucuuuugaccaaacgcuuucauaauaaccacauaaacuaggacaguaauccucagacucaggagguuaaggcaaaagaauugcuuuaguaguuagaagucagucagugaaaaauaguugagacuuuaugcaaaugccacaaaggaaaaauaagaccuccuccuccaaaaaaagccuaaaaggcagagggaauuuauccugaacaacgaaaccuaugaaaccccacagguaucaagaccauaaaggacuugacacuuuguccaaaaucaggaacaggacaagaauuccuaccauuuaagaaaaauaauaaaaaaaggggggguggggggugggcgggagguggcucaguaguuaagggcacugacugcucuuccagagcuucuaagcaaccacauggaggcucaugacugugaugggaucuggugcccucuucuggugugucugaaaacagcuacaguauacucauaugcauaaaauaaaucaggaaggaaggaaggaaggaaggaaggaaggaaggaaggaaggaaggaaggaaggaaaaagaaaggagaaacacugggccgggaagauggcucagugguugagagcucugucugcucuuccagagguccugaguucgagucccagcaaccacaugguggcacacagccaucuguuaugggaucuucuagcauguaggcauagauucggauagaguacugguguauaaaauaaaaaauaaauaaaaucuaaaaaaggaaaggcagaaagaaagaaaugagaaacacccagauuauaaaaucagaaauugauuuggaagcaccuuuaaucccagcauuugggaggcagagacagguggauuucugaguuugaagccugccugcucuauagaguuagcuccaggacagccagguauauacagacaaacccugccucaggaaggaaaaaaaagggggguggggauuugucagaaagcuaucuacauuuacagauaacacaaucuuguauaaaauauccagcaauaaauauaauuuuuuaaauaaaauuauuucaaacaaagcuggagagauggcucagugguuaagagcacugacuucucuuccagaggucccgaguucaauucccagcaaccacaugguggcucacaacuaucuguaauaggaucugaugcccccuguuggugugucuaaagauagcuacaguguacucauauucauaaaaaauacauaaaaauaaauaaaccuuuaaaaacuguuucaaacagcaaagaaguuuuguacaucaaaaauaucaaauuaucaaagaacuaaaauacaaagacaucccagauucguggacugaagguucuaauuuuauuaggacuacaauuuacccccuaaccuguuuucuacaaacuuuuaucuguacaucacuccuaguaaaaucucaaucacuuguuuuaaaauaguucuucaaggcccugcuaugagcuaacaaugaaaaacaucaacugugacucccaaagcaucucugcuauucuguagggauguaccaaaugaccucgaaagucucauaaaaauucaaggaacuuaaaaaaaaaaaguuggaaggcaccuaauuagcugcaauuucaguguuuaucaaaagggugauuuaauuaagacaggaugguauagcaauaagaagucauuuauguaauuucacagaagaauuaaucuauaaauaaacccauauaacauggcuuuuuuaaagaagauaggucaaagaaagccaacauucucauucaagaguggugcuacaacacacuguuaacacuguaaugcccugggauuaaaaaccauaagauuuucuuuucuuucaagacuaggucucacuacucuccuuggguggccaccugcccuuggucucacaaugucacuuuuggaccaauggugauuagacauaauuuuugauugguugucuugauuaagacagugccuuuccacauaccuggcaggucaugaauucaaucaagacuaaaauaaacuggccucaaaauucauaaugauccaucagugucuaccuccugagugucucgguaauaacgcaauuuccaaguagccccaagcauauucuucuuacccugcacaagccugcagacaagccaacauuguugccagaguuucagcgggaaguugagcacuuuugggcugaucuuucucuggggcaaguccacccaaaauagaagggcaccuucucuuuaaaaaagucauacaugcuuguauaaaaggcuccuaaaaaaagaaaagacuucaguguauuuuacaucuauuuuaaaaacuuucuaaacacaauuaacuaccaucuacaaagaccaacauuuuagauaucaucuuaaaagggguacuuuugaggguggggauauugccuagcauguaccaggucaugaguuuaauucccuaacauccuuuuuauauuauuuuuuuucuaagacaguuuagauaccaguuuuggaaagaaaugaacauuuccugcacacugcuuaccccaugcucucuuaucuuaucuguuagccacuugucaaguuugagguauucccgccgugaagcgagugcagcaaggucaaugacaaaagcaaauggagugccguucagcagcaucgacagggccuaaagagaaacgugcaaaguccaguaauagccauuucuuuguacuacuuucuaauuccuguccuaaaaacaugucuauuaaaaaaaaaaucuacucuuugcuuggucaguuuuuuaagggaguacucuauuuagaauuaaagccuuauuuaaaaaggucaacucaugccuaccuucauaagugaacuacuuggcucuuuuuuaguuaguaauaucaagagcaaagcaaggguacaaauacugucccuucccgaauuuuagcaucugcaugcaagcuucugauaucuaaacacaauuauaucacuuauauuaacagugauaaauaauaccuuggauaacuagcagaauacugcaacaaguuugcaaaggaguugaaauuaacguacuuuugacaaaauuauagauuauagauuacucaugaccaaagcccaaucaucacuugcuuuaaaaaaaccucuugcaagacucguuauacagcugggugcuggagugcuucccuaccaugucuaagugccugauucugaaugccaccaaacaagcaaacgaaaccagccuuuaggacugacuuaccuaucuaaaauuauucuccuuguuaccuuucaauguuuaagcaucuaaaucuuaauucaaaugagcuaguuacauguaaauauuccuaacccauuuuaguaaagcacuguugacccucugaagucaccuucaaguccugggccacgucaaguauucgagacaauuuggccugaucauacugcuccccucucauguaccauucugccauugcaugcauuauaaguuggcgaauugauggagacugccccuaagaaaagaggagggaacauuaaacaggaaccauguuagccauuugguauuauuacaccuaccuagcuaauuuuccauguucuacucaugaaagaaaaaugugucaauacagagacugacagucaggcucaagcaccaauuaauuacaguaacauucuuuacaucuucccaaaccuggucaacaacucaaaaaaaaaaacaaaaaaaacaaaaaaaaaacuacguuuucuaugaacauauaagucugcuuauuuauuuucaaacacaaaaguaagauauaagaagucaagugcccugcugugcaccugucauuucagcaugcagcauaugagcucaugauuacucugaccuuagugcuucuauuugacgcaucaagggacccugcaugaaaagacuuaaaaacauaacaaaauaaaagagggggaaauguuaaggcaggugcacauuccugcaacacuagcacucaagagaguuccagagcaggcagagaucauuuuuuuccuuugugggggauaggggcaaguuuagucuauaaaauuaggggcguagggacagagaaaccauucaacagguaaaagugauugcuuugaaaacaugaguaucuaagucugaauuucaguaccugcaugacuauaacccugcaauuuaagaguggaaacaggacgcucgcugggauugcuggcugccaggcuagcucuagguuaaaggaagagaaagaugaagcaggguaagauagccuaauccucugaaugcaugcauguacacuaugcaagcauauacacacuacauccacaccaaaaccuagagacaaugccucgaaaaaguaauacaaguguuuuuauuuguucauuuauguuauuuguuauuauguaucuaauuaggaaagaugaaaaguggcauuuaaagcuaucucugggcuaggggauauagcuaaccuacuuucuuaacaaacuuuaaaaccugugcuacaaaaugugaaagucaucauccuucuacauaggaguuuccaguccagccuggaauacaggugacucuugacuccaaaacaaaggauucuuuugugauuuuccuaauuuuuugcugaaauuaggaccaggaccuuguacugucauaguaaauaaguaagcucuucauggaugucaaugggguaugugucauaccaaguagcaaguuuuaaggaugcuaaauuuuaauaucuacauagaaaugacaauaggaucuaagauuaaaaacauguuugaugauaauaaaucggucuauuagaacacugauauuuuucgguuuuaaauuuaucuuaugugauuguuagauguuuugggcaucauguguaugccuaauaccacuggaggucagaagaggaugcuggcugcccgagaacuuguguuauggaugguuguuagcugcugcguggaugcugggaacugagcccagguccucugaaagagcagcaagcagucuuuaacugcuacaccaucacuagaaacaggaaacuccaagauuuaagacugucaauaacugaaaugaagaacugcuuauuugucuuaccugcccaugccaugcauagugcaaaauaauggcagaguuaggaugguuuccaaggaaaauuggcaucaaaguagagaugaguucauggcguagggugugccaggaaguguugauuugaaguaaggccaauaccaacaugucuggacaguguuugauagggaagcugaagaguuguuucacuugcucauacugcccaaccucugcaagccucagcagagauucaaucaaauccaagcuuuuccuaagaaaaacgaagaggaaaugcuugagaucacugacaauauuaacuauaucuuuaaaaaucccuuguuuucccugaauacugggcacuaaauccauguccuuaaaagcacuuugauaaugagcuauaucucuagccuucaaauucacuccagacgaggugacauccacuacagaauuuaacuacccacaucacauuucuaccaagccuugguauuagagaauauucuuaaguggcugcuguggauuuuuaaaacuacaugcuucaggggcuacagcaagggaggaaaacacuugccuaaauguguaaaguccuugguuucagaaugcauuggguauguuggaagggggcaugcugcuaugccuauagauuaauuuuaaaagaaaugaaacuaacaaccaauaaguaauuugaauaaucauugguucuuuacuaccaagauuuuuaugaauggaaugaaaaaacaaaugagauuucacaaaagcuaaauauccuaaauaaauauauuaauaagacauacuucauaugauaaaguucuaucaaaaauacaacccuaacacuuacuaucauaauggaaagauuucaguaugaugcaacugucaaguccauaacaaacuaauuagaaucuggauggcuuaaauuagaucuaauaaucuaacucuacauuuaguccaugaagaaaauagaaagacauggacuguucuagaaaacaaaugaugcaucaauggcaaaaaauaacuugagagaacuuaauacaacuaaaaaauguguuuagccugugucugcauucugucacugaaaugcauauaaaaauaccuacuaagccaaauagaucuaaauguggaaaauaccuaaauaucagccucacaaaaacaaaaauuuaacuagugacaauaacuaaaaaaauaauuuuuauucaacauucuuuauaaaaaacuuuauuaaaucacuucauuaaaaauaaaauuuccaagcuggaaagaugauacauagguugagggcacuuaaccucuggcuauucuuccaaagaucaugaguuuaauucuuagucaccacaggguggaucacaaucaucuauauugagaucuggugcccucuucugauuuguaggcauauaugcaggcagaccacuauauauaauaaacuuuaaaaauaaauuaauuuucuuugacaguguuacaugcucaguaugagcuuuuguauuucaaaagugcaggaauuuuuaccauguggcaauuucucgauugucauccucugguggugcuuucaaaauaucaguggcaacagugugacagggguagucagcaaaacagaagaccucuggguuuaucagggaaugcuggaugaaggagagcuggaaaagaagacaaaguccuuaagugccacaaaaauaugaaccacuuucaugaagcucaucucaagguuguuagauaaauguccuucaaaaacaaggcaguagggagcagggaauaucugcccuuugaaaaccagggaauucagaaagguggaacagaacaguaugauggccuugggagauagacaucaucaaauuagaaaaguuuggcuacuacaccuuaaagaacucugaucaguucuaaaacugugaaaauacaaauauaaaccagaugacaugcaacgcuucccugaccugugcaaaauaaauuaaauauaauauugcaaucaauagguaaauugcccuaagauuuuuuuuuuucuugauucuauagcuaagcaucauucuauucuuaccuggccuucugcauguuuccaaggccuauauauaaaaucuacuggaaacacuuccaugcccagaccccuuugaaugccauaaaccacauugugaaguccuuugcugucacgaaucugaaauccaggaugguccaguucauaaguuacuuccuugaaauucaaacucggguucuauaaagaugaaaacauuucaaaguuaaaggaacaaauaugggcaaauauucgugcguuggccaggucaaaauaauuuugaaauucaaucagaguauucuauuuagaauauccaucaauaccgaagaugcacaacagauuucaacaaucuucuuugugagguuuuuuucgugucuuuucauuuuuuucccagacuggauuuuuuuuuuuuuuggagacaggguuucucuguauagccccggcuguccuggaccucacucuguagaccaggcuggccucgaacucagaaaucugccugccucugccucccgagugcugggauuaaaggcgugcaccaccacgcccggcuggaucccauguuauguaaaaaauuuaagccugacagccuauaacucacuauuugaucaggcuggccuugaacucagaaaucagccugucuccuccccuaaguguugggguuaaagguguuuaccauuguggccuguuucuuauaaagucuggaugcauguaccucaaaaaaauuuuguuuuuuuuuuuaaaucugcaucuaacauuauugaugcauuaucugcuuccaaacugaagcacaaugaaagaggaguaaaaugccacaggccuacuucugguaagguugccaauuucucaaaagccuuuccaaagguuuguaccacugcacuauguauguguuacaaauuuagugugauuacaagucuacaugaagccgggcugugguggcgcacaccuuuaaucccagcacucgggaggcagaggcagacagauuucugaguuugaggccaaccuggucuacaaagugaguuccaggacagccagagcuguacagagaaaccuugucucgaaaaacaacaacaacaaaaaauuagcugggcauaacagcaucuuuauuauuuuagcauuuaguagaaugacaaggaaaaaaaaaucaagagcucccacuccgcccgugcuacagugggaccgucucaauauaauaauaccacuauagucuaaaguuauaauagauuaaaauguacacauuuuaguggagcuggagacugaaccuagggccuuauucaugguagaugucagugaauuauacaucauaaguucuguuaaaaaucuuuuaaaauaaagauuuucuuuucugugaguacuuugcuugcauguauguaucauguacauguacaguuuccauaaaggucagaagaaggcacccaauacucuuaaacuugaguuacagacaguuaugagccaucacauaagugcugggaaccaaauggaggucuucuaaaagaacagcaaguccucuaaaucucuaagccaucucucuagcucaucuucaaaauaaaauaucuaaaaagucuaacaagccagguaugguggugcuaaucuguguaagcacaacaccccagaggcagagcaagacaucuuugugaguuccaggccagccuggucuguacacaaguucaaggauagccagggcuaccacaaagagauuccugucuaauauuuaauaaaaauaaaaaagagggggaagaauuaaccaaaaacagaagucuaauaauaaaguauacauacuuauaaccugagccuucacaauacaagugcacuacugcuaaacuauauccacagucauacuuauuuuuucacacuguaauuuuccuauguuugggaaaacaacuacaugccauugugguacagcuauccacaguacucagaacaguaauguacuauuugaauaugguggaggaagagggaagugcucagcaauauagacuauuccuccuagacuuguauuuauuaguacacacuauucugauugcagugagaagauuaccuaauaaaacaauucucagaaugucauuccuuguuaagcaacagagaaauacugcuaagaaauguggcagagcucacguaggauuacaaguucuaagccaccaugggcaacuucaggaauuccaucaaaaucaaagucuuaagaaauaaacauaaagcaacaucaaaauaccuaagucacaucagauacuguuucaaaaacaaagcaaaaaggaaauaaaaaauacguuuaaaaauaaaaggaaaaagaaaaaaccauaaggaacuacauacagcagcacuuuucaaccuguggguggcuacccuauccaaacccuuucacaggaguugccuaagaccauuggaauuauucacaauacaauuuguaacguuacuaaaacuacaguaauagcaacaaaaaugauuuuaugguggugguggggaugacaccacauaaugaggaacuguguuaaagggucaaaguauuaagaagguugagccuaaggagagaucucagcugaaagucaaagcugggcauaaugguguacaccucuaaucccagcacuuuggaggcaaaagcaaaugagcccucucucaaacaaagcauugcaugucuacaauuucagugcugaagaaauagugccuagagcucacuggccagaaaaccuugaucagcucuaggcagaacaaguaacccuuuaaaaaaaaggggggggggggaaugaaaggcuagauaaauggcuaaagagguuacuugcuuugcacugaguuugaaacccuagaaucagugauguuacaauguaauugcuccuguaaucccaguguuccuucagcaaaacuggaaacaaagucugagcuacccagacuggagacagcaguagcaaacaagaaaaaugugguaucuagccucagacaagauagaaagcaaugacuaacauauaauguugucuucugacugucaugugcaaugugcaagucugcauucauucacacacacacacacacacacacacacccauaaaguggaaagcgauuucugaagacagcaucaacaacaaacaucaacccugacuaccaaacagacacaagugccuauuaacacacaaaacccaaggcguuggcuuugaccccaauacuaugaguaacuaaauaauuggaauacuaauucuguuaguagcgauguuaugagagaacaccaugguucucuguaacugggucuucguugaaaguugcaaacauagaaaacuaaaaaugagaaaauaggccagauaccucgauaccuuguaaaaauaacauauaugaagucuuagacucaauucuuacuaacccaccaagucuauauggauauugcuaggcuuaguggugcgugucuguugucccagaacucaggagguagaaucaaggugcuccaagagcauuccguucuauguagcuucaggccgaagauuaagguuugucuucucugcuaugcugagacuaagcacagcuuucagcauguuagcugaguuaaauucccaauuccacacuaaguaacagaaagucugaccauuuguucaauuuuucccauaugauggagccuagguagccugaagcuugcuguguagaucaggcuggucuccaauaguacaauacuccuaccucacacuuacagccauguaucgucauuccaaacuauaauuuguaauucucacaguuuguccuuuguaucaguaaggaguuauauuugaauccacuauucuucugcugcauaaauggcauugacccuuccuacucguagcaucuaauuugcccuuuguguuuuauuuaagcacuuccacauuuucaucuguuuuuuuuccuuugcauggaaagccaauuaguuucugaauaaucaaaaauagaaaaagaucaaucaauguauaauaaaaacuguuuuguugaauuuauaaaaagaauucaugcuaccuucucaauaauucguuacuuauuacuuugcagugaguuagccuaucucagaaccuguccaaagaacagccuuauacaauauacugccaggcuguggugguucaaaaaacaaaaacaaacaaauaaacaaaaacaauuuaccauuuuaauucagaaccguaaaaguagaaucuacagauagcuuacuugugccaguuucaagaacaaaaaaccuuagucuaacaccuagcaccuccaaaacauuuggacauggcugcauauaucugccaucaucaauagacgggugggguugggacaacacaagagguaguagaucuauggaggucacuggccagaaaaccuaccuaaagcaauuguucuaaauucagugagauaguuucaaaaagagggcuuaaauuugauuauguauugcuuaaaauauaaucauuguaaaugcucuuguugcuuucugaucuaauaaagcugaaauaguacaaaacacuuuugcucuuauuuaacugccaucgaauuuauaaaacaaacaagaaacaccccccccccccgcggguguauauaguguaauaugaauccaaagaccugacgacaacuacucaccagcucuuuaagaacaucaaucaaaaccucgacauuccacgugugugccugugcccccucgcuuuuaucuuuuccgucgcuccagaucccacugccaggagcagagaugcucuguaaaagugaaacuauaauuaaguaaauccaacuaacaugauuuccucucaucuuuagaucaaucaaucauacugcacuuuaauaaacagaauaaaaagucuuuugguauaacaguugaauucaacaaaccuguaauggaauaccgucuguuaauccugaaugaguccgagccaucauucccaaaacccuggcaaccugggcagcugugaccucccgaacaccaaacugcaugauuauauugcgacauucuucaauacugaaacaaaaauauaacuuuaaaaauaugcuaccucccaccucacacaccaugacuaaaauagacuacuaauaaaugaagagguaguaugaaggaugcacuuaacauagggaaauuuaauguuuuguuuuacuuuuaugcaacuagaaacaugaaucauuagcuuaaaaacaaccacccauaaugagaucugacacccucuucuggugugacagaaaacagcuacaguguacuuauuuauaauaauaaauaaaacuuuauaaaaaaguaacuuccauuuuuaguauuaauuaacuucauuuuuaaaauuacagccugugcgcgcgcacuggagcauacacauaagcaugcauacuguuuuguguggauaucaggacaacuuggcucaagucuacucucuccucccaucaaauguguuccaaagaugaaacacaacaccuuucucagcugaguucucuuaccaacaucaaaacaaauagcgcauauagaagugaaucucuuuacucaauacuugaaaacccuugaaaauguacccauccuuuucauguuacuucuagaaauuuaauuuaaaauaguaaaguaugugcaugaugauaaaauaggacuaucccagugacuaaaccaagaccaugguuccuaaauuuuagaaucugguaugucuuccuaccaaccuugcacaaaagccauagcccacuuccugcaugaagucagcuagcgagcucuccaucaugguuuuagcuaccccuccagaaucaggcaaaauccuguccauuagaaugucccguuuuucaggguauaaaaguggugcaagcaccacaggacagcgcucuuggggaaaaucuggagagagagagagagaaugcaacuauuaagcaacuaaaaacaacaaucucgaggcuaagaaugcagcacaucauacuccauaugauacccgaggccuugggugcaauguucagcaacacauaaauggaaaucucuccuguuauuuccucuaaaaucucuucaaucccaauucugcaagcucauucucaaaaccaagcaguuuagggcuggguguggcaggacacucaggaggcaggucucugugaggucaagaacuacauaaaaagauaaccgccaccaccagggagugguggcgcacgccuuuaaucccagcacucgggaggcagaggcaggcggacuucugaguucaaggccagccuggucuacagagugaguucuaggacagucagggcuacacagagaaacccugucuugaaaaacaaaacaaaacaaaacaaaacaaaaaguauugaauuucccuaagcuaagccacauuaugaccucaagccaauccuaggaucugaaucuuuggguaucucagagcaacuccuuacguauauacuuuuuaacuuuuccuguguagauuccaguaccuguuuaucaauucauuaccauauauuaagcuuuucacagcaaaauaaugaggaacagaauccauuacaguaaguuucuugucugaaaaaguugaugcagcuuaaacuacacaaacaauaggaaguagaucauaucuauauuuaucuuuuugaaggacuggaggcuggggguuuauugauauugaauuacaaagccaacugccuagaaaauacuacaaguauuaucaaaagaggucaaccuagcuuuuguaauucaauuuuuuguaagccucuaaucccagcacuggaaagacagaggcaggcaggaagaucucuuacguuucagaccagccuagacuacagaauacggaggacagccaggguuacacagagaaacccugucccaaaaaaacaaaaaggaaaacaaaaguggccaaccuuucaaaucaaaaguagccuguuacuauaauguagucuuccuauagaggagaaaaggcagcaaagagcauugccuacucucacagaugggaguaaggcuuacuuuaaacuuauucuuuaacauaggucuaguagcgcuuuuaaauuuaaaauuccucauuuguuauaggacuaaaaacaaggaacaggaaaucuucauccucacuuauauaccaauaugccuuuuuuuuaucguagcuuaugaccaccgaugauggcuaugccuuaccucugcguagugucuuaagaaaggcgucuaucuguuccuguccaacuccaaaggcucccuucugcccaaagaggagaugggagaguaggagguguaggaccucuauugcuauaucuuggaagccaccuucuugauuuccacugacgucugcgucaauguaagaacgcagaagauccggaagcuucuguuuaauaaacugggcagcuaaaagucaaauaaaccaaguuacuuuuauacuauaauagguaaaaaauaaauaucuaaauaaccaccuuuuguaugcaccauaauucacuuugccucuccaaugcuuucacauagcucuaccauuacuauuacuuagacagugacugaugaacgggaagaaaaacuuaaaagaugaaaagguugugaaaucaguuauacaacaauguaaacauaacacaacaaaauuguuaaaaaaaacacaguuggagucagauaugguaggacaugccuuuaacuucagcacucaugaggcagugggcuagaggaagaggaagaugaagagaagaggaggaggaagaggaaagaaagaagaaaaaagcagcagcagcagcagaagaagaaaaagaguugggccaggcaggcauagcagcacaugacuauaauuuuagaccuuaggaggcuauuaaguuugagaccagccugggcuacauaagcaaaacauugccuuaaaaaaacaagagcuacagagaucguuccagcugggcagugguggcgcucaccuuuaaucccagcacacacacacaaaaaacccaaaaaaccagagaucguucugcaguuaagagcacuugcuacucuugcagaguacccagguucggcucgcagcaggcacguggcaucucauaaccaguuccaaagggccugacacccuuuuauggucuccucagguuccagguauacaagugaagcacauacacagaagcaaaacauucacauguggauaaaugauuuaaaaaaaaaaaaaaccuagccagguagugguggcucacgucuuuaauccuuuaaucccagcacuugggaggcagaggcaggcagauuucugaauucaaugccagccuggucuacagagugaauuccaggacagccagggcuacucagagaaacccugucucgaaaaaccaaaaaauaaaauaaaaccaaauauauagaacacuaugaaaaaaaaaaaaaaaaaagaaaaaaacaaaacaaaaccaaaguaacaaaacuaagaauccaggaauguagcucagagguagaggccuugcuuguauaacuuguccaaggcccuagauuugaucccuaacaccacaaaaauaaaaaagggggggugggggguggaagaaagggaaagggaaaaaaaagaaaagaggaagggagggaggaaagaaggaagacgaaagggggaaggaggaggggugggaggaagagucuuauacucuggauaaagugacuuaccaaaaccccugagaucugggcuagaagaauucaaaagggcaagaccaaaaaugaccugaaacaagaaggaguuauauuaacagagucaaaugucugcuuuagcuaccguuucugcccaggacugucuugaaacacuuaccuccuguacuuuacuuagcuugagaacuuuacucagcugggcaaauaaguggggugcaggcuuuaaacucugaaacguaacaauuuuuaaaaaagauuuaacuuucauuuuuuuuaaagauuuauuuauuauuauauaugaguacacuguagcugacuucagacacaccagaagagggcaucagaucucauugccgaugguugugagccaccaugugguugcugggauuugaacucaggaccuuuggaagagcagucagugcucuuaaccgcugagccaucucuccagcccuuaacuuacauuuuuauuuuguuaaggaugcaaauguuuuacagaguuuuaauguaguuaguucaucuaauaauggcacaauauacauacaacaugacucugggucacuacaagcaauauaauauauucuagaacuauaaacugauacuuaauacuugacccaaucugaugccgggcgugguggcacacgccuuuaggcagaggcaggaggauuucugaguucgaggccauccuggucuauagaaugaguuccaggacagccagggcuauacauagaaacccugucucgaaaaacccaaaaaaaaaaaaauuaaaccaaucugguuuuaguaaguuuccacuuaaaaacaugcaacuuccuuaauucucucagaaagguacaaaagaaagcuaauccuucaaauuuuaagauaggacaagauuuuuuuuaaaaaagaaaaaguacagaugugguagcacacaucuuaaaucccaacacuccugagccauagucagguaguucucugagcaccaggguuacauagagaucgggucuuugaaaagcaaagaaaaugaacacaaaccccccccccaccccaucaaaggcucagagucauuuuaaacaacauauuaaagagcacacucaaguugaguaugguguuacauaucuacaacagcccggcacugaggcagaagaguagccuggauuauacaaaaagacccuuccucaaaaaugaaagggagaaauagauauuaucacacucuuacuagagauaaaaauauacuaaccuucugguagugcaauggauuaucaauggcauaugacaauguugagauaaaauuuggcuuuguaaucagcgaggcacacuccugaaucagaaacugugucuucaaaaagguaaaaauuaaaaaaaaaaaaaaaaaaaaaacuucuauuagcauuaagcaucaucucacauaaauaaaaguagaacuuaugaauauuagaugcuguaaaauuuuacuaucaaaacuaucucuuuuaaaaucccauuuagguauauaaaaccuaucagcaacaccaaaauauccauauuagaguucauuaauaagucacaaaacaauauaauuaauucuaacaagacuaaaaaauaucaagccaaagagauuccguucagauucugagcuagcccaucugcguuuccagcaggcguccccucuccugcuuccuuugccaggcagauccagcagcgggucccuaauccuaaauuagacugcuaucagccuauuagccaggcggauuauuagaggacagaugaauccccaauacaucuuagcuacaauuaauuguaagauuauguuuagauguuauucuguaguguucauauauuaugcccaaaacugcaaauuuacaaagugauuggggguaacucuuauaaacucuguaaucccuaaauaccugauggaaaucuuugccacugcuuuuaccaucgccacugaaauccacaugugaaaauaggcagcguaauaaaugccugucugccucaggaccgugccgauucacaaucugaaacacaaaaauguuauaaguuuaaaggaggguuuuggggaaauggcucaaugguaagguggcacuugacuacuaugcaugauacucuggaucuuauucuccacagcaaaauuaaauauacuuuuaggaaaaucagcuucuggggaauuacugaaacaacugcugagcauaguggcauaagccucuaaucuaccucuugggauucaaaggauggucaugauuucaaggccacccucaagcuagaaggaguuugaaacagccuaaaagauaaaagacccuguucucaaaaacagaauuauaggaaucacuuaaguacaaguaacuauacgcaacaauuacuuaaauuuauucuuuuugaacuggcuaaaacaggggugggggguggggaacugacaggcaagagaaucaauguuucaaugcaagagacaggaaaaagcucaagaagccacuuaaaaugaaccuaguacaggcaggcuuuaggaucuuuuaacagcacagacuucuuuugugcuuuuuuucuuugggggaacugagugagugugggugaaccagagugcuugugaggguugguuuucuccuaccauguaggacucuggggacccaauucagguuaucagauuuggcagcaguuuacugcugagccauuuuguuggcccucuugucucugugugggugacuaugcgcgcgcacgcgcgcacacacacacacacacacagugucuauugauuguguagaagacaggcaucaaugucagguaucuucuacugacaccaacuggacaaugagcucugcagcacccaucagggccagggcuauaaaaacacaaacuacaacccauaccaccaagacugauucuucucagauugugcaaaaaguacuuacuuaauccuccgggaccugauauggacauucauauggcuaaaaaauaacuaguaacaauaauuacaaaauuauaagaaaauaucugguaaaaacuagauggcaaacaaaaaauacuugggaagcaaagaugggcaaaugucucuagaguuucacgccugucucagagcauacaugcucaagcagugucaaggcagcgcacuugucuagcagucacaaacuccuagagucuaccugaaggcacuaauccaaaccccucaucaccaacuuuugcauaaagcaaacaggagaaaugugaauguuacaugauuuaauagcacugcuauuuugaauuggcaagauagcucagcagguaagaugcuugcuaccaagccuggcaaugcaaguucaaugucugggcccaacggguacaaagagaaaacuaacuccuacaagcuguccucuaacuaccauagucacugggugacacauacaaccugacccuauagagaauucauguaaaaauggcauaaauaacuguuuuuuaauuuuuuugguucuuuccucuacacuuacauaagggaucgccaccuuuuuugcaagcaccuuuaaucacggagccaucacaaggucccccaaauuuuuuuuucagaguuaauuauuuuaugagugcuuucccuggaugaauguauauguaccacauucaugcugagagaucaaagagggugcgagaucuccuggaaacgggaacuauagauggcugugaagcaccgugugauauuaggaacccaaccccagagccuuuccaauaaaagcaucaugccagguccccaaacaauuuuaaaagaaugauuacaauguuaaccuuugaauaaugucacaaaaaaaucucaccuaggaagcaaauuuauuuucucauuuguaagauauugagauaccaacuaguugacaugauuaguaaaugcauauaauaauuucaguaaaaucccaucuuuccaucugucaguagguaaaacuauagaggaaaaacaucguauuaaagucuggggccuggucagaccuaaccacaguaaaauauaccuggucuccuuguacaauagggagagcauucauuucauaaaauggugcugagugugucuccagguuugcaagaagcuugcuuacguccuucaccaaggaaaucagcaagggggcaacaaagagauccuugcuaucaucccaggucuaaauaccuaaucucugguguuaaaagagguuauguacaagaacacuaauggaaacacaacauuuauguguuuuaauaaccguguacauugugaagccucagcaaucaaauaaacccagacaugguaacacaugggagcaaucccaguucaaggccaucuuagaauauacagaaaaacuugaucucaaaagacaugaaacaaaaccacauaaaauaaaugacuaaggaaauggaucagcaaguuauugauuuuguagagaaccauggguucaguuuccagcacacagaugacagcucacaaguccuguaacuucaguucuacaagaucugauagagacccucaggucucaacaggugcacauacucaugcacacaaacauacauguuuauuugaccagauuuauuuaaccauuaacuaaaugucagacauaagacauagauauccuuagaucucaagaacuuauaaggaaaacugaauaaaccaacuauaauacaaccaaaacauguagggcacugcuggugucacuagauucucacuuucaaauaauuucugguagucaacaaccagcuucuccgggauuugccucaguugcagaauuucagugucuaaauauauacccuccuguggcagccuuccccagcagggcccuuugagcccacugugguaccuugguauaugacuuagaaauggccauauaaucuuaaccuggguuuaacugggagugaacuccagcuccccagcaaaccuggugucuuagucucaucccacccuguuuucauuacacccuagccugcagaacugacacagguuauauccugcuuuccagauuccagggaauacaaccucacccguaucauaggcccaguucaacaagcugagcaguaaaaagaaccaugcaaguuuguagggcaggcuuaguaggugcacaugcauaaccaguuggaaaauacagucagauuuaucuuuaaaaaaaaaaaaacaaaaacaaaaaaaaaaacaaaaaacaaaaaacaaguggggcuggagaggcagcccuggauggucuuaacagaugauccaagcucaauucccagccccaacagccaucaaguuccaaggguuccuaugaucuuuucuagcuuccaaaguccccaggcaugcucaaaguaccaaaacacaagaaaaaauauucauauaaaauuuuuaaguuaaaaguggcaagguggcuuuguugccaagcaguggugcccaauggaggcagaggcaggcagauuucugaguuugaugccaaucuggucuacagauugaguuccaagacaaccggggcuauacagagaaacucugucuugaacugccauacccccccaaaaaaaacaauagcucagaggguaaggauggcugcuaugaagccugaggccaugaguucaauccccaacaccuacaaggccaaaaaagaacugacucuuguaaguuguccuguggccucacauaugugauuguguguguaggccuaugugcuccuauuacuuuuuuaaacugcuaaguguuagcaaucccuugaggcuccgcucaacagguagcaacagcuugugucucucccugccagguacaagccaggacucaggcauaugagaagaccacucauuaugcccucucccccauguguucccaaagagccucucccccccuuucucuuuuccucucucuuucugcucuucucuaucaccagccuuucucuaccucuaccccucuuuuccacguccccuucccaucacaccaauaaaccuucuuuauauuaggugugucacaugacugauuuucgggagaaguccuuagcagggcccacugagguacucccucccagaucacgaacuccccaaagaccucaaaaucagaugcaaaauguaaagucuuuaagcucagauguuugcaaaccucuccaacacaguggauggguauagaaggccuggagcugguaaggccaugcuuuuuuaucaugguuacaagcagggugaagggcuuuccaauuuggcagcuacaugauuagcuaccaucuaaagguuauaagcuuggcacaauuccauuggcuaguaaugauuucaaauggcuaugagcaauggggggucagcuugaguaaucuuaucuggaauguuagauacuuaaguggaaacauaaggauuuuuuggaaagucaauuauguuagaugguguuuugcuagggcaaacacuugggaguguuucuugaaauggacacagguaaaaggcuaagacagacuggugaaggaacguuucacuaaagcagacaaaggucaaaggauguucuguuaaagcaagguggcgaaaggacacgugauggauucuuaauaacacacauguauugguucgccuuacacuguguaacugguuccauuuguugggacuccauagagagaauacauaccaaaaaacuuuugguggugcacuguaguuucaugcccuuccucggacuugggcugauuggcagagugaugucagcugagacaagauacauguugaagcaagaccaugggaagaauguguaguguuuggagggcguauaaauagaacuugaugaaugaugagaggcugagcuaggcuugcuuauagagcuagcuauacaaugcuugguggucucucuucuaugcugaucuacauuucgcugagagaggcacagccucagacuucucuuaacacucuuguugguaccuccuguuggcucauguggagacugagaccuggcuguuccugcucaguugugucaccacuguuaacccaacacuacugaauuagaccacugguauuucugugacaugugugugaguggaucaagcugucacuguugacuucugugaacugaauugucacagacaacauagaugggaauuguucuaaagacuaucucuuaacaggucggaccauuuccccuaugucuuagucaggguuucuauuccugcacaaacaucaugaccaagaagcacuuggggagcaaaggguuuauucagcuuacacuuccauacugcuguucaucaccaaggaagucaggacuggaacucaagcaggucaggaagcaggagcugaugcagaagccauggagggaugcucuuuacuggcuugcuucuuccccuggcuugcucagcuugcucucuuauagaaccaagacuaccaguccagagauggcaccacccacaaggggaccuccacccuugaucacuaauugagaaaaugccuuacaguuggaucucauggaggcacuuccccaacugaagcuccuuucucugugauaacuccagccugugucaaguugacacaaaacuagccagaacacccuauauuuauuuuucuauuaucucuggugaaugguagacuaaaagggagguuaaagcauuuaagaaccaucauuaaaaauagguuuuuaaaaaaguaaaguuacagguccugcuugauacuaauuggccguugcugggggugggggugacuaaguguggagugguuccuggaacaauuucaaacuaggggcaaacuaaacauaaaaggaagucuggguacaaacuguaaucuaguaggcuaaagcuagaaugguaacugggcucuuucugccagaguccucuguucucgacggucugaaaggauuuguaccacacagaugucuggucacuucuaugucccugcuccuguagcucuaggaacacucuccagauuucauuucugucuuaacucacucuugcccuucucuuaacuucuacuuccuaaaaaucucuuaucucaaauuccuuuccacccugugcaccugcacucucuugcucacucaaguguucgcucucccucacgcugucucuguguguguguguguguguguguguguguguguguguguguguauguguuuuaauuaaacagucugagucagcacaaagaagugaggcccucagcagacugagaacugcaccuaauggacccugugccucaguaaggaacuuuuggcagcaguagcuguuggcaucaggaccucccaaaccuaugacaucacauaggugacagcacgaccuacaaaucuguugccaagacaacagcuaucauauucccagaaaucuuuuggcucaccuccuaccuuuaccuucguuacgucauuuuccauauaaaucagggaaacaccccucccucucucccucuuuugccccuucucuuucugccaccaccucuuccauucucuuucucucccaauaaaccucucacacauggaacugcuugggcccagugugcuguguucagaugagaaccccuauucuaacacaucaguagcaguggagguaggauaccagcucgccaugcaugccccagaccagccacaccugccagguaaaacaugugucuaagcauuugucucucugcuagugcacugcuacugcauaugcuuguagaauugaaugcuguuccauggaaccaacacacagcuuguagccaucuuugcuaagggcaagaaagggcaaagagcuguaucuucagcgccaucuugguugccagccaucuuuguuguggaaaguccuagcuucacugcauucuugcuuaagagcagcaacaugugaccugaacagaccaaaauuaagucuccaaagacuucugaauugagguuaagguuuuuauaugguuccuauccugccucaguaaauuguuauaauauugcucuauguuuucacuuuuugaaagaugauuuuaauauuacuuuaaagguuuacauuuaaaaaguuaaaaaucacugccuuaaagauauguuuagccuuguuuuugcuaauguuacuauagauuucuauaauacaccacauggggaucuaagguuaaucuuuuuuuggacuguguuuauagacuuaaaaaucuuguuuugauagaacuucaacucaaaaaucaugaaaucuaacaggcuuuaguaucaaaagccacuauuuaacaguccuaaucucaugaaaacuacuauaguuaagugcaaaccaguccuaaccuuacaaaugacauucuuuaaugugcucaaguauuuaucuaaagccaugcuaaaaaccaaugcaguuaauuauaaaaucaaguuuuagccuucuguuuuauguuugcuaguuacagcuagagcagguaacuaaaaucagacacagauuaucuaauucaauagauucuagcucucaauccugucagacagagaucugcugaauaugucacuguuuaagcuugcuaugacaaagacucucaaauccuaacaguaauccaacccaggguuuccaaaaagauaugggcacagccucaaagaacucuacuuggauuguaguauaccaaccacuggguggcacugccagugcugugcccccugccagugcuugaccuaaacuguggacagaggacaccugaagaguugaaugucucauauuaucuaagacaaggugaggucaucucuuccauguuccaccuucauggaaaaaagccugucaucuucugagccugauugacagacacagacugccucuacccaaguugugauggacaccacagggacuugggaaaacugucuagguaguggacuacagacuaaccucugucauuuuaauuaaaucuauggcaucuagauuauaauuuauccuucuuagguuucugauugacaacuaagcuaacuauagcuugaccagcuagagaacaggcaacuagcuccuuaccccaauguaauccaauaauguguuaguucauuagucaauuuaagacaaccagaccucuuauuaaaagagcauacagguuugccuugcucacaggcuucaugauaaaagacauuaaaguuucagauauaaccuuuuacuacucccauaucuaaaaaacucuacugcuccccaaugaucaaccaccugugucucaugauaaauuggacaggaaaaaaaauguaaacuuuauacaaggugcaaggauauaaaagcucaaguuauaaggacuaaaaaaaauauaugagggucuaggaaggaguuuugggguuaguaauucuaagauaugaagauuagaaaacaaaacguggauggugauagaaauacuucagauuucuuucccucucuauaccacugucauauuaggaauucaaaaguucagauuucuaacauuaaucaaugaguucugauaaauuauuagccuaacugauaaaacauuccacuauacaauccauuuucauaagcacaaguucaagauuuuuuuaagugcucuuugauuguauucuaaguauaaaccuaaagggauucucuugaagaauccauaagaucaccuaucagagccacaaauucaaguuuucccuugguuugcuuucuagcuaagaagaacuuaagaugguucucauguaaaucuauacuaucauaguauacuaucuuagucacaaaguccagauuucaaguuuacuuugauugucuuuucuucugaaccuacuuaacuuuuauuuucuuccucuauuauauguguguuucaacaucuugacaaguuaaaguguuuacucaaaaucuacauccaggacagccccagagaagcaaaccacagguauuccagaauacaaccccaaacacacacacucuacugggccugcauuucccuagcuacacaugguuccacagaccccagacaacaauggaacagccagcucugccaggacuuggccagcaucauuaucucaauucucuucaguucccagacuacaaccaucacuacaaagucagcaggaaggaaagaacacugcaacccacuucugcuccaucaucaccuuuuccuaguuccucauuuuuaauuaaaccaaaauggaggaauguuagacauccuucgaggcuccgcucaacaguuauccggcaacaggugugauccuguagccaagcauauaagaccacuccuuaucucucucccuugguauuaccuccccagguguuccugucagccucuucagcagcacugaccacucuucugaaggcccugaguucaaaucccagcaaccacaugaugacuaacaaccauccguaaugggaucugaugcccucuucuggagugucugaagacaguuacaguguacuuacauguaauaaauacauuauagaaaaaaaauggcucagcguuuaagagcaccgacugcucuuccgaauguccugaguucaaaucccagcaaccaaauggugacucacaaccauccauaauggaaucugaugcccucuucuggagugucagaagacagcuacaauauacuuacauuaaauaaauaaauaaaucuuuuuuuuaaauggcucagcaguuaaggguguucuuauaaaagaagaggauucaacuccuagcgcacacauggaggcucacaaccauccaucaguuccagaggaccugaugcuuucgcaucuccauaggcacucacacauauguggcacacaggcauacauccaagcaaaacacucaauuuuauguaauucaaaaaguaacaauaaaaauuuuuaaaaaggaugugagaacugccacuaaaccaccuuaaaaauaccuacacaaauaguaaaacauguugcuaugaaaagauguuaauuuuacacagaaugacucaaaugcuacaagcuuugcauuuuuucuuucaaccuuuuaagagccacccaugauauucaaaacaauaguuucaaugcuuauagaauagcccugaugaauccugagguuguuuccaauauggacauaucaagauacaagucuugugauagauguaaaguacaagccuagaaauagagcuguguucaguaacugagaggaaagugaguaaaagcuaucacuuagcuugauugaucuguacgaauauacuaaauagaugcucacuuaauguaaacucacuugcacauggcaugugcccuacuccauauguacaucuuacuuuuuaaaaagguggugagauuagucagguauggugaugcacaccuaucauuccaauacuuggagggcuucaaguuaaguccagcucuaaaauacaaugagaucuauuugaaaggagggagagagggagagagagagagacacccaaccuagggaugagacaugaguccucucugaguaguuagaagaucugacuguucacagcuagagaaaggacuggguaguuaagagcauuuacugcucuugcagaggccccagauuugguuguuagcaccccaaggagggauacaaccaccuauagcgccaguuccaguacaucaaugcccucgcuuuucugaccucugaaggcacuagguaaaugcaggguacauguuguaaguaacacucauaaauaaaacuugcuuggccuaguggcucagaccauuaaugccagcauuugagaggcagaggcaggcaggucaaggccagcuuugucuacauaggaauucgaggucagccagaguuacauggugaaaccuugucgagaagagagaggaagggaggggaggggaagggagaggaagggaggggagggaaagggaggggaggggaggggagagaggggagagagaggagaggagaggauuuuaucccuuuuccucauuuccccuacaacccccccccccccguuccaccucccaucccccugcugacccacccuuucuggcuucccugucuuggcauuccccuacacuggggcaucgagccuucacaaagacaaaggccuuucuucucauugauaucccacaaggccauccucuguuccauaugugacugaaaccuugagucccuccuuguguacucuuugguuggugguuuagucccugggagcucuggggguacagcuugguucauauuguuguuccuccuauggggcugcaaaaaccuucagcuccuuggauccuuucucuagcucuuccacuggggaaccugugcucaguccaauggauggcugugugcaucuaccucuguauuugucaggcacuggcaaagccucucaggagacagcuauaucaggcuccugugagcaagcacuuguuggcauccacaauagugucuggguuugguaacuguauauggaauggauccucaggugggaaagucacuggauggucuuuccuucaguuucugcuccaaacuuuguuuuuccucccauggguauugugaucccccuucuaugaaagaccgaaguguccacacuuuuggucuuccuucuucuugagcuucauguggucugugaauuguaucuuggguauuccgaacuucugggcuaauauccacuaucagugcguacauaccguguguggucuuuugugauuggguuaccucaggauauuuccuaguuccauccaacugccuaagaacuucaugaauucaucauuuuuaauaguugaguaguacuccauuguguaaauguacauuuucuguauccauuccucucuugaaggauaucagccaggcuucuuuccagcuucuggcuauuauaaauaaggcugcuaugaacaaaguggagcauguguccuuauuacauguuggagcaucuucuggguauaugguaauacguccaauuuucugaggaaccaccaaacugauuuccagagugguuguaccagcuugcaacccaccaacaauggaagaguguuccuuuuuuuccacauccucaccagcaucugucaccugaguuuuugaucuuagccauucugacuggugugagguggaaucucaggguuguuuugauuugcauuacccugauaacuaaggauguugaacauuuuucaggugcuucucagccauuagguauuccucaagugagaauucuuuguuuagcucuguuccccauuuuuuaauagggucauuugguucucuggagucuaacuucuugaguucuuuguauauauuggauauuagcccucuauaggauauaagguugguaauuuuuugaaacaaaaguuacaggaugggcaggucucaaacaauccugcuuccgucuuuaggaauucuguuucaaucuccaugugggagcacaucacacuuagcuggcuacuuuauguucauaaaaauugaauaaaauacuaacacauguaaaaucuacacuacugaaaguaaggauuuaaagagcuggcuucuuauauguauguucaugugugugugaacacaaggacaucagauacccuggaacaggacuuaagugggguuguaagucacccaaugugugugcuacaaaccaaauuccaguucacugaaagagcagcaggugcuccuuacugcaaagccaucuccccagcuccagaaggaaaaaauuuaacagguacuucccaaagaugcagacuugauagugggacacaagcauucagcaccauugcuugugacucaaagcgucccacccaggaggacggcuagcagcccaccgguaacugucacugacuugugcuaaacaagcacuccaccgcugaguaucuuacgccuccagugcagcucccuccuuuuuucuguauacauggauuugugagcacacacacaccaucacagcugcaugaaugugagggugccuauagaggccuaaauuugccauuagaugucucccuccaccacacuuuacugacugaggcagggucuguggcugaacccagagcucaacaauuauggcuaguuggcugaucuacaccgcccaggaagcuugucuccaccuccagagagcugagauuacaggccgacugccaguucccugcucucucaugggcuaaagggauuugaauguucaucuucacgcuugaacacaaguacuuuauccacugagccauucccucuuaaugcugaagaggaaaaagguggaacuagacugaacccagugagaucauguuucuuuacugaguuuuuugcuauuaauguuuguuucucagacagauuuuucuuuauggagccuuggcucgcuggccaagaacucaguaugcugaccagacuggcaucaaaugcacagagauucaccugccucugccuuccaagugcuagaauuaaaugcauacuuggcuucauauuuguucaauagaaaaauuaaaagcugugaacguacccauagacugauauaaggucuuuuauguacaguucuaaagcaaaauaacacaaagaagcagaagucaugaccugucacacaaccuaguaacauaaauugccaacuugguaucagccggcucuuuguuuugccucacugcuguuacacucugaaggaguacucacaugcuguauuuccugcuggcuggcucgguaguuuuucuugguuaaauuguccaccagguagcugauuugagacaaggccagcgagagcgagucaagauucauugcugguuggggcggaagcaggcggccgagcccggcgcaaaaucaccauuauuccccuuuagucaccucagaggcagguuaaugcuuucuuuguaauuaggcuaucucuguuaucuguaaaugucuucaguucuucuuuaccaagugucuuacucuguucugaaacauggcaccuguauaaauacaaaauuccagaauucaguugugggggaaagguuaaauaacuuucauuuaaaauguuaaggacacuuuuaaaaauaauuaugaugucuugaccagugaagauaaaaaugccaucucuaaaucuuccaaagacaaaucuuccaagaguuuaaauuuaguaaauaguaaaacaaucggaaacguuugagaucucuauuuuaucaauaucaucuaacaacugcagagcaccaggaguacaccgagucagggcugugucugagacugcuuccgacucagccugagggugugagcaaacuccccucccuuuagugccuucccacaggauacacucauucccaagacuccacugccucacuugacucccacacaacuguacaaucccacaguuauacuucagguugcaucuuguaggaauuuaaauggcuaauugaaagccaaggaagaacuccagaagcgucaggcagugguggcacacgaugccuuugaucuaagcacuugggaggcagaggcaggaggauuucugaguuccaggcgagccuggucuagaguugaguucaaggaaagccauggcuacacggagaaacccugucucaaaaaaccaaaaccccuagaagccaauguugaaaguacucauaagaaaaauuuagacccucagcagccagaggcagaaggaucucaagaauucaaguccagccuugucuacauauuaaguuccaaaaaugaaugaaugaaugaaugaauguagagccaggcaguggcugaucuaaauaaaagauggcgcacaccuuuaaucccaguacuugcaaagcagagguaggcagaucucuauuguuugaggccagccugaucuagagugaguuccaagacagcuaggaauacagagaaucgaaucccugucucaaaaaaugaaauuuuuauuuuuaaauuaaaaaaaaaaucuggaaaggaaaaccccaaacuguaauaaagcuaaaauggcacguugaucacugguuuauccccagccauuacucuaggcaguuaacgaaaucaaaaacaagccuuuuucucuggaggccagaaaaggucccaggaaccccuugagcuggaauuaauagaguugaaaguagccucauguaguuccuagagaccaagcuucaguccucuccaagagcaacaugggcucuuaacaacugggccaucucuccaggcccaaauucaugaaaauuaagcuuuuaucuucuuacaaauuaugaaacauuuaucacccuaauaaucuugaaccuugaaauuugauuaagacuauauuccuggggcugaagagauagcucagagguugagggcacugacugcucuuccagaggacaugauuugauuuguuuuauuuauguguuugcaaugucuuccuacucuuaacugacacuauucuuuuaaagauuuguuuguuuguuuguuuguuuguuuaauguaugcggguacacuguggccuuacugaugguuguaagccaucaugugguugcuggaaaugaagguugaucacucuaguaggccccgcuuguucccgccuauaauuuauuauuauaucuaaguacacuguugcugucuucagacacaccagaagagggcaccagaucucauuacagaugguugugagccaccaugugguugccgggaauugaacucaagaccuuuucggaagagcagucagugcucuuaacugcugaaccaucucuccagccuguuaacugauacuaugaugucuuaaauuauucauaacaagaucuuuaacuaccuccccucccuaccauccuccuccuaccaucuuuaaauuugauaaucuaaagaccauuuugucucucaacagaauuacuaugauauacacuuguaacuaaucucucagauccuaucuacuauuguucuccauauucuauuauauuaccaaggagaaauguuuuguguggauguguauaagucaggagugaagucaagauaucuuccuccauuuccccccuuuugagagacuggacucucucaacuaaaccuggaacuggaauuaugcuaaaauuucuggaccaggaagcccuaaugggauggcagaucaaaugccuagcuuggagagccauacucaggucaucaugguuacuuggcagcacuuuacccaccaagucaucuucuuagcccuaaaaaaccugaaaaaacaugaacaugaaaaacucaguuacccugugccaaguaugguggcauacaccuuuaauucuggaauucaagaggcagaggcaggugaaacugaguucaaguacagcuugugggagucaucuuugucuuuccaccacuaagaugagucuuagauguauaucucagaaucaaaaucauauuaucagacuuagcaguaagcacaccuuuagcacuaaaccaucuaccucacuagcccaugaauuuuaauaaauguaaauuuuaauuuaccagcuucuauagcacacacuaacuuccaguuaagcucuaguuccauaaauguauccauaauuuagaucacauuuuguuauacauuaucuauucugaauacuguaauauaaaguaauaaauacaaagggcuggugagauggcucaguggguuagagcacccgacugcucuuccgaagguccagaguucaaaucccagcaaccgcaugguggcucacaaccauccgaaacgagaucugacucccucuucuggagugucugaagacagcuacaauguacuuacauauaauaaauaaauaaauaaauaaaucuuaaaaaaaaauaaaguaauacaaagcuacaaaacuacugcuaacaagcucuccacuaaacauuuucuguaacuguuuuguuuguuuuggggggcaauuguuuaguuuucacguuuuuugcuuugaugcaauuucuaauuuuuuaaaaaagauuuauuuauuauauguaaguauacuguagcugucuuuagacacaccaggagagggcaucagaucucauuaggggugaacucaggaccuucggaagagcagucagugcucuuacccacugagccaucucacuaggccuuaauuuuuuaagaaacuaguagguuuuugagucugggcuucucuguagcccuagcuguccuagaauucacucuguagacccugcugcccucaaacucagaaaucccuguguagcaagggcuaguaaagguguguucuaccaccgugugauuuaacuuaauuuuuauuuuaugcacggauguuuugucuucuuguaugucugggcaccacagguguucaauacucuugaaggccaaaagguaucagauuuucccugaaacuagaguuacaguuggguuguaaacugccaugugaacccagauccucuggaaccugaauucacugagccagcucuuaggcugggcuggugaaauacuugcugauaauuugaguccacucccuacaaaagaggacagaagaaaagcagcuccugaaggcuguccugacuccacagucacaacaauccacaacaaacaccuuuacaaaacaacaaaaccuuuacaaaauaagcaaaaccagaaccugaaaggagaacauucaaaggggaagagcgagaugaccuagcauuaagaacauguagagcagggcuggagggacagcucagcaguuaagagcacugaccgcucuuccagaaguccugacuucaauucccagcaaccacauaguggcucacaaccaucuauaaugaggucugaugcccucuucuggugugucagugacaguacacuuacauacaggaaauaaauaaauaaaccuuuaaaaaaaaaaaaaaagaacauguagagcagggcuggagggacagcucagcaauuaagagcacucacuggcugcucuuccagaggaccagaauucaauuccuagcacucacauggcaguaggaucugacacccucacacagacauacaugcuggcaaaaacaccaacacacaugaucuaaaaauaagucguuaaaaaaaaaagaacaccaagaaacccuuucuugagaaaacaaaacaaacaaggaggaccuuaguucgcacaaaaauaauacacacgacaugcaacacacucacacacauuuaaaaaaaaagucucccccucucccuuaaaacacauuuaugcauccaccuaaaccucacaugauuugcugugaguguaccacuagaauaagucacauugggaauaacuaccuauacaaaacaaccacacuaccugcaaccacuuaacccauuccacaguggcaccauucuccuuugcuucuuuuuuuuuuuuuuuuuuugagacaggguuucucuauguagcucuggcuguccuggaacuuacucuguagaccaggcuggccucgaacucagaaauccgccuggcucugccucccgagugcugggauuaaaggcgugugccaccaugcccagcucuccuuugcuucuuaauuugaccaugcuguacagggcaaaauggcagggcacugacaacuugucaugauggagcacuucuguaauuuauauucuagagcagugguucucaacuuguggauggggaccccuuuagcaaguccccaucuccaaaaauauuuacauuacuauuaauaauaccaaaauuauacuuaugagguagcaacaaaaacuuuauaguuaggggucaucacaacaugaagaauuguauauuaaagggccguagaauuaagaagguugaguuuaauucuauguacugaauuugaggguacagaugcuacacaagacuuuuucucaaaacaaacacacucacaaaaagaaaccgcacuaauaugucacagcaaugcaacacaagucaacuauaccugaagaguaauacuguuaaguaaaagccuggcguggugucacacgccuuuaaucccagcacuugggaggcagaggcaggcggauuucugaguucgaggccagccuggucuacagagugaguuccaggacagccagggcuacacagagaaacccugucucgaaaaaccaaaaaaaaaaaagguaaguaaauguaaggcaugacuauucagugggcuggagauaauaguaauagagggcuggcuggucugcccacaaaagcccuggguuugguccccaguaacaucuccucccccuuaaaaaaacaaaacaaaaaaguaaucacugggcuggcgagauggcucaguggguaagagcacccgacugcucuucugaagguccagaguucaaaucccagcaaccacaugguggcucacaaccauccguaaugugaucugacucccucuucuggagugucugaagacagcuacaguguacuaacauaaaauaaauaaaugaauaaaucuguuuguuuuaaaaaaaaaaaaaaaaaaaaaaaguaaucacaggggacaaagacauuuugaguaauucuccaaaaacaguaggaauaaccagaaaucccacuggcaccaagguuaucugcaguccacagaacuuuguccaacagcaaaaaucaccacuuaauggaguuuucucaaaacacucacuuugucuccuguggaaugaaagcuuaagaaagaacauucacguuuucacuggagaacaccaccuaaaagaagaaucucuugaacaugagguauucuaaacaaugccuaacagauaaucauagcuaccagauguuaauguaaaccauccaugucguuaugggaaaaguugcagaacugaauagaaggaucacaggcuuuuuuuuuuuuaaagauuuauuuauuuauuuauuuauuuauuuaaguacacuguagcuguccucagacacuccagaagagggagacagaucucauuauggaugguugugagccaccaugugguugcugggauuugaacuccugaccuucagaagaucagucagugcucuuacccacugagccaucucaccagcccaggauuacaguuuuauuguguuuuuuaaugguaaauauaaaaacagcuaccaaaugccggggccuagcaaacacagaaguggaugcucacagucagcuaauggauggaucacagggcucccaauggaggagcuagagaaaguagccaaggagcuaaagggaucugcaacccuauagguggaacaacauuaugaacuaaccaguaccccagagcucuugacucuagcugcauauguaucaaaagauggccuagucggccaucacuggaaagagaggcccauuggacacgcaaacuuuauaugccccaguacaggggaacgccagggccaaaaagggggaguggguggguaggggaguggggguggguggguaugggggacuuuugguauagcauuggaaauguaaaugagcuaaauaccuaauaaaaaaauuuaaaaaaaaguauaacuacauuucaucaaaauguaucauuuauuuuaacauaugagguuguuacugcuacguuuaauugagcuaauaaaaaaucauuuaaaaaaaaaaaaaaaaaaaaacagcuaccaagcacaaauuuguuaaaccaaagaaaaauguggucuugauuaacagugauuagagacuuucacucaaaauccucuaggaaaggcaaucuuucuaauaaucuacacucuucaaaaguuucuaauaacauacaaaauuauugucaacugcaauacuugucagcaaaagaauacucauggacuggagagcugacucagcgguuaagagcacugacugcucuuccagagguccugaguucaauucccagcaaccacaugguggcucauaaccauuuguaaugggauccgauguccucuucugguuucuacaaagacagcuacaguguucucaaauaaaauaaaacuuagacagagaaaaugaaaauacccaugagggcuggaaaagauggcuuagcaguuaagagcacuaacugcucuuccagagguccugaguuuaauucccagcaaccacaugauugcucacuacuaucuauaaagggaucugaugccuccuucuggcccacaguuguacaugcagauaaagcacucauaaaauaaaccuagccaggcgugguggcgcaugccuuuaacuuuaaucccagcacuugggaggcagaggcagguggauuucugaguuugaggccagccucgucuacagagugaguuccaggacagccaaggcuauacagagaaacccugucuuguaaaacaaaaauaaauaaauaaauaaauacauuuuaaaaaccuaaaaaagaauacccaugagucagugacugaugaacacacauuccgggcaauauacauauauguaauauguauauuagucugcaucuugcuuaagcauuuagaguacacacgacuuaacaaauggcuaagaaaggcuuggaagagguaaaucagaagcauacuaacuaaacaugagcuaggcuggcacagaggcacacaccugcaauaucaaggaggaugauuauagauguguagaccuuuuuguaguuuuuuuuucaagauuauuuauuuauuuuauguaugugaguacacuguagcugucuucagacacaccagaagaggacaucagaucccuuuucagaugguuaugagccaccaugugguugcugggauuugaacucagaaccucuggaagagcagucggugcucuuaaucacugagccaucccuccagccccacuuuuuguaguuuuuuguaggcccaguggacauauucaauuucuaggcuaguaaaacacaaccugguaaagucucuuucuaaagauauguaucacuaguagcuuagacagacaggcaauuucuuccuguuucugucuggagagccacaaaacuacagaugcgcauuaccaugccccauugaaagaugaggguuuuuugguuuuuuuguuguuguugcuugguugguugguuuuguuuugcuuuguuuuguuuuuuucaaggcaggguuucucuguauagcccuggcuguccuggaacucuguagaccaggcuggccucaaauucagaaauccaccugccucugccuuccaagugcugggauuaaaggcaugucgaaucacugccaggcaagaugaggguuuuuuguuuguuuuuuaaagauuuauuuauuuauucuauguaaguauacuguagcugucuuuagacacuccagaagagggagucagaucuuguuacagaugguugugagccaccaugugaggguuuuuuaaaaagggaaacaggggcuggagagauaguucagugguuaagagcaccgacugcucuuccaaaggucuugaguucaaaucccagcaaccacaugguggcucacaaccauccguaaugagaucugacgcccuuuuccggugcaucugaagacagcuacaguguacuuagauauaauaauaaauaaaucuuuuaaaaaaaaggggggggggagguuggagagguggcucagcaguuaagagcauugacugcucuuccgaagguccugaguucaaaucccagaagcacaugguggcucacaaccaucuguaaugagaaccuucuuccugaagguagcuacaacguacuuacuuaaauaaauaaaucuuuaaaaaauaaaaaaauuuuaaaaaaagggaaacaagccgggcgugguggcgcacgccuuuaaucccagcaccugggaggcagaggcaggaggauuucugaguucgaggccagccuggucuacaaagugaguuccaggacagccagagcuagacagagaaacccugucucgaaaaaccaaaaaaaaaaaaaaaaaaagggaaacaaaugacuagagaucugccucaacaguuuuaauagcaguuguugaggacacauaauagugguggcucaggaccacccauaaacuccaguuccaaaggguucgacaucaacauccucuucugaucugaaggcuccuggcacacacauggaaaagauacauacuugcaggcaaaaaacauucacacaaaguaaauacauuuaaaaaacccaacaacaacaauguagucaaagucugaaaauguuuugucucugaggcccauucaagaaacgucuuuacacacauucauguaucaauaauguuacugauaacuauguaucaccagccacuagggccaaguguuauggcacacacuuuaaucccagcucucaggaaaagaggcaggcagaucugaguucaaggcuauuuugaucuacagaguucuaaacagcugggacuacauaaaaagacgcuaucucaaaaaaaaaaaaaaaaaaaauauauaacugaagacagaguaccaacaguaaucuuaauaaaccaagaggccaaguggcuggaaagaugacacagaggaucugggucuaacucccagcacccacaugguggcucacaagcauuagugaauaccaggcacaaaauggcacacacaaaacauucacacuuagaaaaagugugaugaugcguagcuguaguccgagcuacuaggaggcuuggggggaggaagauaguucuuagguuuagagccaaucaguuuauaauaugcuaagcccuguggccagaugugguggcauacaccuuuaagcccagcacuccagaagcagaaguggaugaugggaguucugugagcuagaaccaagcccauucuacggaacaagacccaggccagucagggcuagagagagccuuucucugaaagaaaaaaaagucuguguguguuggaagguagagauuagccacugaaaccaaagacagguaaggacucaaaaggcuacauacacagccagggcuacacagagaaacccugucucaaaauaaaauaaaauaaaauaaaauaaaaauaaacaaaaaaagcaaaacaaaaaaggcuacauacaaauauuucaaagcuagguuaguauguuuaaacaaauuagugccaauuaauuuugaccaccagagauaaacuaaaaccucagaguucuguucucagcacccacagaagagcuaugggaguaaaacucuucuggcaccauaggcaaccagcacucacaugcacauguaacuuuaaaauuuaacacuuucauguaacuaugauguauaucugcuugaaaaaaagaaaggguuacauucucagaaacaccccaggcagaacaaugaaugcaugcacugcaucuguaacccugccagcccagcuaaaaagcaauuacacaaaugugaagaaguauauaccacaugcauccaaaaauguuggccuuuggauacaguagauauagcacuggccuucauauauccaacaugugauccacgcacaucucugccucuuaaguaaaugggauuacagccauguauccucacauuccgcuucaaaaauuaaguguucuagugagauaggaugccuccgcagugaaagccccgcagugcauugagagagagaacagcgucuuaagcagcccucugaccugcacuauggaugccauggcacaugcacacugucuuuaguuaugugcucuugaggcuguaagagggcucacucaguaaguacuugccccaagcaugaaaaccuaaguuugauaccagggagccacauggugaagagaaccaauucccacauguuaucucugauccccacaaggacacuggagcgggcagaguaccuccccuaauaaaaaauuauaacauugugaauguuuaaaaauccuauucuuggguuuaguaacgccccgugccagaaauauuuuuaggaaggcugggaugauggcucaaagguugaaaguacaugccgggcaguggugacacacgccuuuaaucccagcacuugggaggcagaggcagaaggauuucuugaguuugaggccagccuggucuauacagugaguucuaggacagccauggcuacacagagaaacucugucucgaaaaaacaaaaacauaacaggggaggggaggagaggagaggggacuugcuucucucggaugauccaaguuugguucccacgucagguggcuggcucacaaccaccucuaacuucagcuccaggggacccaacaucccuggucucuaguuacacacacacuuuaaaaaacagggcugagaaaugacuacauggguaaagcacuugcugcauaaacauuaggaccugaguuuaaaucuccagagcccacauaaagcugagcaugguagcaggugucuguaaucccaaugcuccuacagcaggaugguagggagaggugggaaauccccugaagcuccuagcucagcuagccuagcaucauguacagugaacaaagaaacccuggcucaaagugaaaggaaaacacugacacccaguucuuccugaccuacauuaccuucaagcacacucuccuguacaaagacagugugucucagugucugucugucccucccccccuccuucccacuauccccccggaaaggaaaccuggaccuaggaugccauacucuucucagguuguuguugagaaggaagcagauguuccuaacaagugcuuaucaaaagcagucccauguacuuccuaggagaaaauggcuuccucaguacaacaaaaauacuggucuacccuucaaggggcccucucacugcuaagucuccaucugagcaaugagccuguugaguguggugaccaccaugaauaaauacgcagagaaccacugucacccaccaagauuaccucagcuaugucuaaaaccacaauucaacaagugccacaagaacacgucugugcaccugucucccugcuucaagagcaugcagauaagggauuggagagaugggucagugggucagugggucagagcaauggcuauuccuccaaagaaccugcauuuuauucacaacccccauguggcagcgucucaacugauuaacuucaauuugggaaauaugaugucuccuucuggucuuuaagaguaccagucacagaugcacacaugugggcaaaacacccauacaaaugaaaaaauaaagcccggcagugguggcgcaagccuuuaaucucagcaguugggaggcaggggcaggcggauuucuaaguucuaggccagccuggucuacagagugaguuccaggacagccagggcuacacagagaaacccuguuucgaaaaaccgaaaaaccaaccaaacaagcacacacaaaaaaacuucauuauuggcuuguuguuguuguaaagauuauacagaucauuacuaugggugaaugcagacccucgagcaagauaaugcaauucaaccuauucaagaucaccaagguuucuagcauaggaagcaauuguauacagcuggacauggugaugcacaggccuuuaaaucucagaacugaaagaggcaaauggaucucugaguuuaaggccagccugguuugcaagguaaguuccagagaaaccuuguaucagggcacuggagagagggcucagcgguuaaaagcacugauuuuucuuccagagguccagacuucaauccccagcaaccacaugguggcucacagccaucguaaugagaucugaugcucucuucuggugugucugaagagugacacuguacucacaaaaaaauaaaucuuuaaaaaaaaaaagaaagaaagaaaaggauaaaagaaaccuggucucuggggggaaaaaagaaaaccaauccuguaaauucuaaaaggacuauggcuaacucuccaaagcauacacaauuuaaaaauaaaaccaaagcagcccaaggguauuccucccuugaaaccccucccaccucaagacuucucaauauaacaaacacuuuagaagcaaacuaggcacagugaaacacaccuuuaaucacagcacucaaaggcaaaggcaaguagauaccuagucuacacaaugaauuccaagucagcaggggguaccuaauccccucaccccaaaagacagaagcaaacauagaguugcaucccuaugcccaggcggccuaaggcaguaaggcuccaguuguaggcccagagacuaaaucacaacaaggcuaucucagagagaaggaagaaggaaaaggaaagccaagacuguagguggggguggcacagcaguuagggaagagugcuucugcucuaacaggacucagacucacugacacccacaucuagcagaucaccuacaacccuugucaugcacaugcauacacacacacacauauauguaaucuuaacaaaauggaagacaguguugugguacacaccuccaaucccagcaugugggaagagcauuccaacucugaggucagccuguucacaucacaaauuccaaauuagccagagcuauacaagguggcucuauuuccagaaagaaaauuuacauggugagcugguuaaaagugcuuccuaccuucacaugaggacuugaauuccaaucuccggaacucacaguaaaagcuaggaacuguaggacccaucauaauccugguguagaaagaaucccgggacuugugggccagcuggccacauaugcaguagaaaacaacagacggucaaaguggcaaguaaaggccaacccuugagguuguccucugacagccacacuaaugccaaggccauuugugccugcauucacacaaucuauguuguguucuucaaaguagcaucaaucacucaacaucuccuguaacaaggugaccaucaccuaccacacaaaguucugugucugaggcaggcuuucacuuucaacuuucacguugcucuacuacucaagauaucagucucagcugggcgugguggcacacgccuuuaaucccagcacucgggaggcagaggcaggcggauuucugaguucaaggccagccuagucuacagagcgaguuccaggacagacagagcuacacagagaaacccugucucaaaacaaacaaacagauaguacagucucagccuccuuggugaauggacuacaaugacaaccagcguugcccuacaguuuauugucuaauuaaccuuaacccaaucucuaggaauugcauuuuaacaaguauaacaaaaucaaaccacauucuagaaguugagcuuuccacaugaaagacugaaauguuuuguuuuugauuuuugaagauaggaucuuaauauggagauccuauaagaagaagauccucaucuuacuauggaaaucugguuuuccaagauaggauguuacuaugagcucuccugacuuagcuugaaauuuaauuguuuuauguguguauaacccaugccacagcaaauaugugaagaucaauggacaacuuugcucccaacuuuccccagugaaccaucuccaaguccuggaaauuaacuuuuuuuuuuuuuuuuugguuuugguuuuucgagacaggguuucucuguguagcccuggcuguccuggaacucacuuuguagaccaggcuggccuugaacucagaaauccgccugccccugccuccuaaaugcugggauuaaaggcgugcgccaccacgcccggcuggaaauuauuuucuuaaaccuacacuguccuacccuuccagaggcugcuugcagaaacccuaacacaagaucucagauuaauuacuaccuucucaaaaaaguacuuuucaacgaaugacuuuuauuuguuuugauauauucuuacauauaaauauuaacauaaaaaacuaggcacagugaaggucauuuuggccuuugaaacaugcuuaagaaccuugagccagcccaaucugguggcuagcacccuuuaucccaacaccugagagcuggggcacugugagauccaggccaguacuuucuacugcuagugcaauacauagugagaccccaccucaagauaaaaacauugaggugccuggaugggaaaagacugauaacuugaguucauuucucaggacccaccagaugagaagaacugacuccuacaaagaugucuucuggcuuccaaacccacacauguaauaaaacugaaccaccagaaaagcacuguugggcucccuauaaacgacaccuuaacauaauauucccugggagcugggacuguuguuuggcagcagaagauucccugguauaugcuagaucccagauaccacgcccagaaccacagaacaaaaaccuuacugggauuucacuuugaaacaggaaaacuuacucagugucauuuaagaaguguacagcuaauuccuuuuuuccuuugagacagggucuccugaaccaaggcuaauugugaguugaagcuggccuugaacuccccaucguccugccugagccucagugcuggagcuauaggccugagucacuaggccccaucguuuaaguuaauucuuuaucuuuuuuucuucuuaggauuuggugauuaaggcaagaaggcauacuuauauacacauauaucuuuuauuaaaaauauaccaaaacaugccagguggcggcaaaccuuuaaucccagagcuuugggggaagaagcaggaggaucucuaaguucaaggccugccugguauacaaacugagccaguuccaggacagcaaggucuacacagagaaauucugccuauaaaucaaucaaucaaucaaucaaucaaucaaaacaaguaaguaauaaauagacccaaaacagaagugauggccacuggggcuggagauggcucagagguuaagagcacugacugcucuuccaaagguccugaguucaaaucccagcaaccacauggugguucacaacuaccuguaaugagaucugaugcccucuucuggugcagcugaagacagcuacaguguacuuacauaucauaaauaaaauaaaaucuuuaaaaaaaaaaaagugauggccacauuugggaagcggggcagcaggacaaguccaagauuagcuugugcuucacaaugaguacuugggguggggagagugccaacaaggagcaaaacacacagcucagggguagagagcauuugccucaaauguuaaggucuuguguucagccccaacaacacauacagagugugugugugugucagcaaacacgccauuucaaaagggcaaauacuauuuugguuaauucaagaagcaucaaauggggacaagugcagugcacuaguagguagaggcaccugccaccgagucugacugccugcggucuaugcuugggaccaaaacaguaggagagaacccacucuucaaaguuguccucuacccuugaugaguacugugggauguacucaccauaccaacauaaauccacucacacacgauaaaugugcuuuaaagagacagaacaggguuauguggugaagagucuauaaguaucuacaaucuaacacugcccuacugucacuuagugaucugagacaggacucugaacuugaggcuacccuaacuacaagccaacccaaccauaaucccacuuccacagaacccaacucccucugcugaacucuucaacacacgguacucauacauaugaacaacacacacacaaauaauaaaauaaagucaccaagaauauaaagccaacuucuaagacuauaauuguuaagggccucaagauggcucaaaagguaagagcauuugucacacaagcaugaggaccugagauccauccuuuacauuucacuaagcgucaaaauacugacuccucauauucuuagaccucuccucgcaugagcuauggcacaagaaugcuaaacucacucacucguguguguguguguguguguguguguguguguguguuauucaacaaauuuuaaucuuggguuuaaaaaaauacuuucagguauuagugacuaggauccuccccacucagccuuuguuuuuucccacuguuuuuguugcugagacaaggcuuucacauguagcccaggcuguaaagaaaucacaaugagcuucaugccccauucuguacugcugggauuacaagcagccagugucaccacacccggcuaaaggucagauuuguguguguguaugugugugccucgauucuagacuugcuuccacuaaacaaacagccaggaccaggugaaaaagaaccaaauucccaagucagacccucugccugcaaaaagaaccuuuacuaacauccugccugccauucaggccaaggcccugcuugcuaucaucaggucuuccugccaugggacaaccaucuguaauguccucacacagcacugaaaacaggucccauuucuaccuccaccauuuucacacauguauacuacuuuuccaaagagaggucaggagggaaaugcugguauuuucucuaauaagcaguacacccacucaauuauuggcugauuguuguuggguuccccccccucuccauuguaaucacaagggaccgaacugcaacaaaaccggaaaacucaaguacuguuacucgguuuugaauagagaggaaaaagaaguauauaggccccaaagaaacucgacaucuggggcuagagcucacugauacaaggccugccuggauuaaauguccacggaaggugggacuguaauauuugucgaggugacuucuggggaacguuuaccucucaugaagcuuaauuuuccauacaacacuuugaaaagcacuucuuuucaaaaccuacaaagcacuccuccugcaaguaaugucugugagcacaggugggugagcucccucccggaccugguggcauggccaaauguguuugcuuauuagccuuaggcuuaaccuaagaucucuccaagaucugcaccaaaucaagacccacaagcauucugcucacuggugggcaucugccgguaguugccgguuggaggguugggggcguugggacaggcagaaccaacacuaccaaccgcacagggaccuaggugacuuaaguuggggggcuaucgacuuguuagaaagugcgagcgccggggcgcgcgaguggaacaaaaaaccuguagcgagaaggguaacacggaagugcucacucccgcccgcccgccccucccaccgccaagcagccaaaagcgaggggcuugacaacgugcuggggggcgcaggaggggagggaguccccggaaagcgcuacgaaucggcagcaacuccaaacccgcccccuggcccgcccgcccagcgaggaaccuagguaggccgcgggcgcccgcgcccauagccccccauccgggagcccgggaggaaagggacaguugaggagcucgugcgcuccgaggaggcugcagcccugcgcgcgcggcgagccgaggcccugggauccgaacugccaccuccgccgccgccauccucgaagccuccaggcaaggccuccaggccgagccgcuccggagcugcucacccgcgcccgggcgcuccgaauccaggaacgugagcccccggucucccuucuccaagagagcaaagccgccgcgagcgggccgaguccguccccucccgccuuggcuccacgucuccggcucgccugcccgagucccgacgccccgggaaaaggcuuccaggguccccaguccaccccacccccgguaccgcucccacccggacccgcgucccgagcuugacacucccagccuccgccaccuccaaccgcagccccagcccgccucaccucagucggcucccgcagcgcuggacacaggaaacuccuggguccucgacuccggcucuccucgaccccccucuucgguuaacuccgcuuguuuucucgacaaaauggcgcccgaggucgcgcgcucacgucgcg

SEQ ID NO: 4676 - RNA, 15015 nt, Mus musculus
aggggcuugacaacgugcuggggggcgcaggaggggagggaguccccggaaagcgcuacgaaucggcagcaacuccaaacccgcccccuggcccgcccgcccagcgaggaaccuagguaggccgcgggcgcccgcgcccauagccccccauccgggagcccgggaggaaagggacaguugaggagcucgugcgcuccgaggaggcugcagcccugcgcgcgcggcgagccgaggcccugggauccgaacugccaccuccgccgccgccauccucgaagccuccaggcaaggccuccaggccgagccgcuccggagcugcucacccgcgcccgggcgcuccgaauccaggaacgugagcccccggucucccuucuccaagagagcaaagccgccgcgagcgggccgaguccguccccucccgccuuggcuccacgucuccggcucgccugcccgagucccgacgccccgggaaaaggcuuccaggguccccaguccaccccacccccgguaccgcucccacccggacccgcgucccgagcuugacacucccagccuccgccaccuccaaccgcagccccagcccgccucaccucagucggcucccgcagcgcuggacacaggaaacuccuggguccucgacuccggcucuccucgaccccccucuucgguuaacuccgcuuguuuucucgacaaaauggcgcccgaggucgcgcgcucacgucgcggccuuuccccucccaguucccauuucaccauucgcugcccgcuuuggcggagggauggcccuagcgcccagccaauggccgcgcgcugaccgcaacggcgguccaaucgccgauggguacccgcggauuuaaaccaaucacacacuaaucacucgcagaagucgaggaagaaaccaggcuccugcuagcaaccaccaauccagacuccuaguuugcggggcucaggccaauugccgcucaucagcccugggacuggguccgagucugggcgccugcgcacccggguguaagccaaugguuagacguugggaacuucgauuugggacucgaagacauaagccuucgagguguucgaccuauggggacuggcuggucauugccuccgggaaacaaaaaaauacggaagggagcucguuaaugcauugccacccugcgcacaaacuacucuaacuuagagacagggugaugcucgucuacuuuccuucgucuuucgaaaugucacgguccgagaggcugugcggguucccagcggaagcauuguccaccccucggaucucuuuagcaaggagcaccagucaucagaaggcgucagacgcggggcaaaguugagguccuuugcauccuggguuauguagucgcacgccccgccuauuccugucgcaaaaguaacguggucucuuccaucacugucugcgcccuagagcagcaaugcaugcuggagaauguagucucccagaugcccaccuaauccuggcucuuuuaaaguuuguuuuccauuugucuuuugaagcagggacgcuuugcagagauauagaaacagaaguucuccuccugcucuuggcuauucucaaggaugccaaugccuuuugcuucuuggauaaaaggcuacguuauccacuguguccuccuaucuuuuagacuuuuuguuugaguuuugaaacaaggucucuuucaguuaacccaacuguaguccaggcuggccugaaacauacuaagaagcauaaauugaccuugagcuccuugcaaucuuccaaaauacugagaugauaauagacguaaccucucauaccaguacuauuugaacuuuaaagagauguguuaaagacuuuuauuacuuauuuuacguguacaggcguuugcuugcauguaaaucuaugcaccaugcauguacaauguccucagaggucagaagaggaugcccgucccucuggaagugaacgguugugagccacuggguggguccucuggaaaagcagccagcucuuguaaucucugugccaucuuuccaaccccuagaugaaaaaaaaaaagugucugagugcuugccuauauauauguucaccuagagaguguggaccugguacccaggaaggcauuggaugccccgggacugagaugagagucucagcaguaaaguuguaagcugcucuaugagugcuggaaacccaccccugcaccucugcaaaaacagcuccucuccagcccccaucuugaacuuuuuuuaucaauguuuuauuugugcaauuuagcaauauggggguuguuucguuuuguggguuuuguuuucuuuuguuguuaaagaagaagagagacaaagaugaacugagacuguucuggagaagggggagggggacauacaagucaacuacccaagaucaauucuguaauucuacaaccaguuuaguucaagcuucaauugcccccaaacugaagguaagcugaaauaaagcugauauaaacggggccuccuagaggagauucuuaagcucacugcccaucucuccucggagguuauacaucacuacuaaaaucugacagccauaaaaacugagccaggauuuucacaaugcccuaaaggucaaaguccuuugacuguguaucuaggcugggugguucuugucuuuccuaaaauggcugagaagaccuucauaaaggaucuagaagggucaccuucuaacucagcaauuacgaauguuugcuuucaaacauccuuaagaacaggauguccuaacgagcagacgagcucaccuggcugauucucagccuucuucccacccucccuguccgacuuucacaaaauaucccggggcuaaaguaaaauacaacagaagaacuugguguuaaaaguaaaaaaaaaaaaaaaaaauuucuuaaaaauuuaaaagguuuauuuauuuuauguauauggaaguguagcugucuucagacacaccagaaaaggugcacccaaucccauuacagaugguuguaagcuaacaugugguugcugggacuugaacucaggaccccuagaaaagcagucagugcucuuaacugcugacaguugauggcuccuggcguauauagagaguuuuauaaguucacugugcuccagugaaugcccccucauccgugaguacgcaggcagaucaaauuggucucaaaaaaaaaaaaaaagaaagaaaaaagcaggcagacagagugucucauaccucaugaccugagcucagcacucacauuuaagacauuuaagcagaagcagucagaucucugugaguucaaccagccugguuccaggacauccagagcuacauagugagacccuaucucaaaggugguagaggggagagacagacagacagaggggacaacaaugacacacacaggcuaacaucugggcaggggccuaagaggugggauaaauaugauaaaaauacauuaaauacauguaugguauucucaaagaaguaacugcaauauuguguugguuuuuuuuuuuuuaagcccucugaaacaaccagaaacccacuuccuaccuggacuauaucacuagcuuccugaguuacgcugggugaguuacuuccccuccccagaggggagucagcacagagccucuagugcuagucaagugcccuggcccauuuauuuguucuuuuguuugcuucuugcauagcucugcuguguugccuggguggaacucaaauucucagcucuaccucagcuucucaagugcccggaaucuaggcacagagauagaggguauacuugcuagccaagaucuguagcacugaguuccaacacggcccugucuuuguuuuuaaucagccaacuuguucuaaaaauacuauguaaucucauccacacuuuaugucccagugagguaggggcugaguuagucacuguuuuuucuggaucauaaaacugaggcuuguaguagagcucuuguuuuguaugccagcaauaacaagcuaaauuuaauuuugguuugccagguuguuuguuuguuuguuuguugagcugaggacugaauccauugccuugcuucuuaguccuaugcucuaccaccgagcaaaauccccgaacucuuucauguuuuaaagacuuaauuuuaugauugugaguguugugccuguguguuuggauauguaccauugcaugccuggugcucaaagagccagaagagagcucuuguggguaccagaagaaggugucagguaccucaacccagaacuggaguuacucugugugggugcuuguuacccaggucucuugggagcagcaagugcucuuaccugcugagcacuggguccugguuguuuguuuguuuguuuguuuguuuguuuguuuaaauacagucuaauguaguccagggcggccuuacuuuuuaacagaggcuggccgugaacuccugauaucccuuucucaugugccagcaauaaauggaaagguaaagaaguuaaccuccuggccaaaauccaauucugaucaaugacaaagaauuaaagcacaaguuuuguguggcucgcuuuuaaaaccccaggggcuguggaaggaacacaugauuccuccgaguaaagaugcccaauaguccccauuaaccugaaacuccaagagacuuuggaaacuggggacagcauuaccauuggcuaagggagcugccacauuggggaagguggcaaagaaaugaaccacaaccagaaaaagcugccccugaacucuaggcuccagcugggagaggagcggccuaacuuuaggguaggggcaucuggaagcugagcauuuggagggcugccuucuuugugagcagucaagcaagggggggaauggacaaggugugugggcugucacagugaccugggagaaagcuguuucugugguaugaggggccaacagacagagcuaagugagucuuggaaaggggaagauagcaagagcuggaagaaagaggaguuccagagagauccacacguguuuaaaugugcuuagcuuuuagaaaaaaauuaucuguagacuagggauugacgugaguccuggguucaguuccucucauccaucuguaggugcugggaggggcucagccuuagagagcuggaggaacaaugcauuccuccuuguucuuugaucauccugggcccuccuccucuugacauuucuuuccugguguggaaugcuuuugggagauuacccacuuugagcaccccauaucccagcugauaaccacuguaagaaugaaaggcugugacacaccacccugucaacuggacacagccuagaucagauuggccuguagacaugucugugggagguuuucuucauuguugauggagggcccaugucacuguguggcaucauuccuggugcaggugguccuggccuauguaagaaaaccuaaccaugagcuugugguccaacuaccuagcagcaucccccaugguuccugcuacaguucuuuggcugugaguuccuugcuuaaaggaaaugcuacauggaagagcaagcuaucaucaguuuccugcuugaauucuuaccuugagugcccucaauaaugacugugacuuaaaguaucagcuagauacaucuuuuccucaguugcuuuuggguccaagcauuuuaucacagcaacauaaagaaaacuagaacacaccacaaugucacccacacaccacagugucacccucgcuccccagaaagacuugccuuuucccuucucuguugauauagggaauccaaauaccuguuuccuccaagaaauugcaagccaggucagcaucuuccugcaaacaaaaaagcccagaggucacgcugcagcagcccguauuguccaguauggacucagggaaacugguaguccuggggucuuuuucaauccugccuucaaucagccaaaaguggcccuuugcugagccugucccacucccagggucacaacugcucaacacucacccuggaucagaagacccucaccuccguugucucuucaucugagcaugggucucuccuccuccucuuccuccccuccuccuccuccucccccuccuccuccuccuccuucuuguuuaaguuuuuuuuuuuuuuuuuuuuuuuuuuuuuugguuuuucgagacaagguuucucuguauagcccuggcuguccuggaacucacucuguagaccaggcuggccucgaacucagaaauccgccugccucugccuccccagugcugggacuaaaggcgugcgccaccacgcccggcuuuaaguuuuuuuuuuuuuuuuuuuuuuuuaauuuuauguauguguguauacuguagcuguacagaugguugugagccuucaugugguuguugggaauugaauuuugaggaccucugcucgcuccgguuggcccugcucacuccucacucaggucaacuccgcuuacucaaucccugcuagcuccagcccaaagauguauuuauuauuauacauaaauacacuggugcugacuucagaugcaacaguaaagggugucagaucucauuacggugguugugagccacccauguaguugcugggauuugaacucaggaccuucggaagagcagucagugcucuuacccauugagccauuuugccagccccgaucucucucucugcuugagacaaggucucccuauguaacccugugccuggcucaucuuuguaaguuauuuuaaaauuuuauuugguguaugugcgugcaugucaaggucugagaacaacuuucuauaguuggaucucucucucuccuuacacuugguugagggaggagcucucguuucuaccccucugcgugcugcaaccucucuggccccggaguucccaggugauuuuccugucuuagagaugggagccacuucacccagcuuuuuguggguuccaaggauugaauucagguugccuuucuugauuggcaagaacuuuugcacagugagccgcuugcaccugugagggaggccuagguggagaggagccaugagggauuccccuugaggacacagaugaagaaggaggccugggcacgaccaagaugucaggucaugggacacguagcuggaaaguaggcugggaaauaggccaggccaggauacaguuggguuagaagagcuuaguauaugcccagcuauaguacauggagcuuauuaauaaauauaccaggucuccgugucauuauuucagaacaagggcaggcguagaaaagcccugaaguuuuuuucuuucuuuuuuuuuuuuuuacagcacuggcuguccuggaacucucuauggagaccagguuagccucaaacucaugguuccgccugccucugccugcuggguugugggauuaaagaccugugccaccaugcccccagcuuugcuagccucuucucucugaaaauagucuccugcuuucacgagagcauauucauuacccucacuuuuccccucccugcuccucaagaccuaccucuucagccacucucauugcccuauugauuuauuugcauguguguaaaauauguguaugugugugcuugugcauauguguguagagaagauggaguuuaaugucagaugguccacucuguugcucuucacuuuuuauccuuguuguuguuuuugagaacagggucuuucacugaacccauagcucacagacuggcuugacuagauggccaacuuagcucuugacguguguuuguuucuaccccucggucccuagcacaaggaucacaggcacacaccacugcacacauguaggugcuggggaucaggacacagagcuucaugcuugcaugacaagugcauuccugacugagccaccugcagcccuuccuagucuuccuuucuacuuucaugucacacacucacuaacgucuaaaucuaguuuucauguagaagagaaaacaugcaauacagcucucugagaguuuggcuuauuucacuuaacguaaugcucuccauccagguucaucacuuuccucuggauguggguuuuuguuuguuuguuuguuuugguuuuuucgagacaggguuucucuguauagcccuggcuguccuggaacucacucuguagaccaggcugaccuccaacucagaaauccgccugccucugccucccaagugcugggauuaaaggcuuacgccaccacuaccuggcuggaugugauaauuuaauucuuuuuuuuuuuuuuuuuuuuuuuuuuuuuugguauuuucgagacaggguuucucuguguaacccuggcuguccuggaacucacucuguagaccaggcuggccuugaacucagaaauccgccugccucugccucccaagugcugggauuaaaggauuaaaggugugcgccaccaccgcccggcucuuuuuuuuuuuuuaauagucaacugaaauucccuuguauaaagcaaaaacaaaugaacaaaacuuccauguauauguacauguauauauaugcguauguguguaaguaugcauauguguauguauaugauauauucuucuucuucuucuucuuuuuuuuuuuuuuguuuuuuuugagacaggguuucucuguauagcccaggcuguccuggaacucacuuuguagaccaggcuggccucgaacucagaaaucugccugccucugccucccaagugcugggauuaaaggugugcgccaccaugcccggcaugauauauucuguuaccuguucuuuacucacuuguggaccaauggacaucugggcugaccccuuuucuuggcuacugugcaaaaugcagcaauaaacauggaagugcaaauaucucuaugcuguucugacauagaauacuuggucugggcauaguagcacacgccuuuaaucccaacacucaagaggcagaggcagguggaucucuguuaguuugaggccaaccugguguacagaguguuucaggacagccagggacacccugucucaaaugaacauuuauugaccaucuguaugucuuccuuugagaacugucucuucauuggucuaguuagugauuggguaguuuaacuuuaguauuuaaguuuuagaguucuuugcagauucuagguauuaaucugucagauauauagucgacaaagguuuuucucccauucaguaggcuuuucauucugaugaugguuuccuauaccaugcaaaaagagcuuuuauuuucaugccacccaauucaucaguucuuaggccuauuucaccagauuuggaguccuuuucagaaauccuugcauauguuuguaucuuuuugugauguaguuaaccagugaguuuaauuaagguuacucaggggguauagguaaaauuauuuauagaagcuugagcaacugaaauaagaguauaacauauacuauacuauaaucauaugauauauuaauuauauaauuguauaauaguaccacugaagaaaaugucuuucccccaacaaccguuggcucccuauggaucuucagggaaggguggggcuuuguuagucccucacccuuagcaacugugguugcuaagguuuaggaguggccuuacuggaggaaguguguugccugaggguggacuuugaaguuucaaaaacccaagccgccagccauaggagcuagcaccucucucucucucucucucucucucucucucucucucucucucucucucucucucugccuacagaguagcucucagcgacugcuccagugcagugaagcugcggcgcuccccccugccuugaugauacuaaaccucugaaacuguaagcaaggccccaaugaaauguuuucuuguauaagcaugaccauggucacggugucuucucacagcaauaaagcaguaccuacagcccucaggaaaggucccaugagcccugccuccuuccaggacaggaugcuaaugagcucuauccccucccccauuuuuauuuuauguguguggauguugugcuugcuuguguguuuguacagccagcuccucugagguaucacuauugugaaaacacccugaaguuuuuacuuuuauuuacuuguuauaaaucaaauccacccugcucauccuaaaacuagaagcagcugcucuacaaagugaguuccagaucaucuagggcuguuacccagaaaaaaacaaaaauaaauaaauaaaaauagaaucagagccaagcauggugguacauacauguaaucuuaacccuugggaggcugagacaaggcagaggccaggcucgguugcucgaacuaaguucaaggucacaagguaagaggccaccaacccaacugaagugucuggaugucuuugcuuuuuauucuagugcagauggucaccgugucuuuacccccucuacuucacaaucauucaugguuggcuaaguuuaaaaaaaaaaucagugcaaagcaaaugaaggaaagaggaaggggucagccauucaauucaccgaaguuagggaaaugugccugggcuuuugugugaacaagguuuuaucugguggccggcaacaaggguuuaccuagaagucuucuaagguaaagggaauacaaagauuuuaauuauugguugucaaugcaaguuuuacaguguuugauagaaaacacuaaaauuuaauauuucuuacagggcuacaccagaacaugcuacccuaaaacagcagaaaccaaccaacuaaccaagcaaacacacagcaacauuggggcuggagagauggcucagugacacuggcuucucuuccuaaggucccauguuccauuccgucccggcacccacaugauagaucaccgcugucuguaacuccaguuccagaagauuccacagccucuaugggcaccaggcauaaaagucacgcagacacacaugaaggcaaaacuccauauacuuaaaugaaauaugacaaauaccuacaauaacaaaacacccaccccgaccaaacacacacauaagagcuaaccuagucacacaaugcugaaguuugcaggaauccgcugcuccuuucucucugucucugucucuccucagaaucugggcuggccuuaacuuugauauguggcauacagggauuuggugacacacccacacuugguuccuguuacacuggcugcagagcccagggcuuccuuaggcaagcacuuccuuaggcaaccaccugagcuucagccucagcccaggagucccuuuuguaaugaaaucaaagccaauucagugagcuacagauuccuggcggcuaguguucagauaugcacaguuuugggggaggggggaggagcaucaagacagauggauggaggaguuggggacauccuaucucuccuggcagagugaauguucccucugauaugaaacaaggcuccuacccucccuguuggaccaaggccuuucuuugacugaagcacagugggaguaccuggaguggggagguuacacuuccccuguguuucuccucucgaggccgcaggugacaguuccugaggcugcaggugacagugccuccacuuccccaucccuucuccuucuuaaaaaaaaaaagaaagaaagaaaggaaggaaggaaggaaggaagaaaagacuccaaacaauuguauuacuauguuucuacugauacugacaaugcuaagguccagcuaaaaaaaacccugugagggcuuggggaggugaagugucugcugcacaagagugaagaccuaaauuuggaucauggcaucaaggaguacagcaccgccucugucacuucaguguggaggggguggagagggaacaggaauguccccaaggaucccuagaguuuacuagccagccagucugacugauggguggagcuuggguucaaugggaagccugucuaaaauaauaugcuucagagugagagaaggugccuugaacaugugcauuuggucucucucucucucucucucucucucucucucucucucucucucacacacacacacacacacacaucuaucucuauaacacacucagauuucuaguugccuuaaaauaauuuuaauuccauggacacuuuuuaggaauaacaaaagauuugggucaguucuucuuaucuagauuauacaaggaaaaaaaaucagucaacagcaacauucuugguguuuuauguuuuauaauauaagaacccauuuuuuucuuauaaaaacauuuauuuaguccaagcauaggacaggaucaucuaggaaugucagcuccuuccccguucagaguuugaaaguguaggcccacacccuuggguuugaggagacuacauaagaaggaccagaccccucccuacuuuuuuauuuuccaugcuuugagguagguuccuguccaggcuuccacacaggguuuucuaucugagaucacgcucuuaggcuacuuccucacucaucacacaucgucucugcauccccuucccuuagcuucuuuuacauucaagauuugggaggccauguggggggagggguacacaugcuacagcaugcauguggccaucagagcacagcuuuuauggaggauucucuccuucucucuuuacauagguuccaggguucaaacccaggccagcaggcuugaauaagcaccucuuucuuacagacucagcuugcagcccugaacucuaagcucuugauuaaauauuuaagauguccuauaguacaguucucuggcauuuacaacauuggacaacauucauauuuuguccaugaaaguuaaguguguaauauuacaaagacuccuauuggaguuuguuucucuuccuaauuauaaacuaagaaauagggcaggggaggaccucgagggaagggcgcuugccaccaagcccgaggagccuaaguuugaacucaggaccaagguggaagaagagaaccaacucccaccaaguugucuucugaccuccacaucugcauaacagcacacaccccuuccccaccuccccccauauacacgaaauaaauaaaguagaagcucuaacaaagauguaauaaauguuuaaaauaguuugccaucucuauaagaccuauagaaucucaguuucucacaaauaucuuuuauucuauccuuauuuauauuugacauaugaaaggggaaacuaaaggaacacuauauuacaaucauauuucuuuuuuuuuccuuuuuuuuuuuuuuucaagacaggcuuucucuguguaguccuggcuguccuggaacucacucuguaaaccaggcuggccucgaacucagaaauccaccguauuucuuuuuuugauauuuauuuauuuauuuaauguaugugaguacacuguagcugucuucagacgcaccagaagagggcaccugaucccauuacagaugguugugagccaccaugugguugcugggauuugaacucaggaccucuggaagagcagucagugcucuuaccuguugagccaucucuccagcuccauuuuccaaucuuuuagaacaaauucuaaccgucuaaaacuacacagaacucaagguaaucuagucuucuaccugagauaagaacaaacuucccuuuuccaaucuaacauaauuccugguauuaagguaaaucugaauucaugugauacaguuugucaaacuuuucccuaaaaucuuaacccauuuaaauuguuucauauauauauuuggauauuauuuuaaagaccuaugaugcauuugugggguuaaaaggccuauaauggguccaugauacuacucauucuacaaagcuaagaagugcuugucuguaguguguacauguuccugaaugaacaacaugaaaugauuccagaaucuacacacauacacaaauagcauguguucacaaguuaaucucacuuaaagaaaaccuagucuuggccuggagagauggcucaacaguuaagagcacuggcugcucuuccagagacccugaguucaauucccagcaaccacauggugacucacaaccaucugucauuacacccucuucuggugugucugaagacagugacaguggacucaauuacauuaaauaaauaaauaagucuuuaaaaaaagaaaaaggaaaaaaaacccagucuucucuuuggaggggaagccucaaagcaaugcaauguagaacagguauccguguauacagguaugugauggguuuucacugcucaacuucauuucuuggucuuucccacaaaaccaaaacccagacccaaaccaaacaaaccaaccaccaccaaaaagcuacucauaccacugccuccuuccugacugucuuugacccacauaucaaaugcacgcagcaauagccaauaaaguaggggcuagaaggauggcucagagcuuaugaggcgcacugaguguccagaggaccuggguucuguucccagcacccacaucagguggcucacaacugccuggaacucuggcacucauaguuuuguggauuuuuguuuguuuuuuuguuuguuuugcuuguguguuuuguuuuguuuuugagacaguuucucuguguugaccagucuggccuugagcuuagaaaauccaccugccucugccuccugaguguugagauuaaaggcauacgccaccacucauugcugauguuuggcuucuccaggcacaaaaugggaugcuugaccaacuggggaacugaagguugcaugggggguggguuaaagggagaaguuggggggucaggggggagccacacacuugcuaagcacuuugcaauacugacaguggagaacuugaaugcugggagccaaaguuaccuugggcucuguugacccuucuguagguguuuaucuccaaccucugaugugacccgauggccucgugacuaauguuaaguccuucuggaauggacaaacauaccucugcaucccaccgguucaaaggcuaagagugucaucagauaacgucuguggccuaaaacagagauuucccuucuucacuggagucaaucgaccugaugcccccaccaguguauuuggauggaaggugccuuggugugucauuuucaugaaacuguuaccgcauuggaucaugguguuugagauaaccugaguccauuaauagacaucaacuauucauauuugggcccagaauaaacuaucucuuuuucccuugaag

SEQ ID NO: 4677 - RNA, 1273 nt, Mus musculus
agaaguccugaugaggauccaagauugaugguaucacagaagccagagguuuuuuuuuggggggguggggugguucaagacaggguuucucuguguagcccuggcuguccuggaacucacucuguagaccaggcuggucucgaacucagagauccgccugccucugccucccgagugcugggauuaaaggugugcaccaccacgcccggcugaagccagagaucuugaaccagacuuugcaaugaacagcugcaggugaagaugugugaccagagggauguacugugggacacacuacagcuuccacgaugagaaguuuucuguucuuuguuuuguuguuguuguuuguguauguguguuuuauuucgagggggcgggguuucuaggaugaggggauagggagaugagcaaucaugcaugauuugaaaaggugucacaggacuagcucaugcucgccgcaggggucggaggucagggcgagcgucucccgggccgaaggaggaagauggcgguggagucgcgcguuacccaggaggaaauuaagaaggagccggagaagccgaucgaccgcgagaagaccugcccgcuccugcugcgggucuucaccaccaacaacggccgccaccaccgaauggacgaguucucccgcgggaacgugccuucgagcgagcugcagaucuacaccuggauggaugcaaccuugaaagaacugacuaguuuagugaaggaagucuacccagaagccagaaagaagggcacacacuucaauuuugcaauuguuuuuauggaucuuaaaagaccuggauaucgaguuaaggagauuggcagcaccaugucuggcaggaagggcacugaugacuccaugacccugcagucacagaaguuccaaauaggggauuaucuggacauagccaucacgccuccaaaucgggcgccgccuucgucagggaggaugagacccuacugaagucuauugacuuucuugaaguuauuuuucagccaguuuguaaaauaaacuuacuuaauccuuucuucccccggacuuugccauuaagccuuuaaauuuucaacaaauuguaacacauuuauuuaggaauuagaguuggauguacuuugguauauuaaaguccauauguuuuaagcccuuauguaaaauaugaagaaaagugcucuuagcauucuguauaaagcuguauugugaaauacauguguucaaucaaaaaaaaaaaaaaaaaaaaaaagaaaaggugucacaaagaaucaauuuaaaggu

SEQ ID NO: 4678 - RNA, 17622 nt, Mus musculus
caugugauucaggcucacguguuacuugagucggcuccggaacaacgccuacaagguaugugaaaggagguacgggaggugcaaggugggguuguaggguucuugggucuucagaguuccccaucacugcugagaccagaucccuguagggcuccacagccgucuuugccuguugcuuucugcugcaccaguccagccacaccuuagccugacggcucuccacucaguccuaggccaggaucgaguuagcuuuggaguuaaaaacgcaacccaccgcuuuuucgccaggcuuggggcucaucccaacccacccuggucaggugcucgcugucccaccuccuaaugcaauccaaaccucguguuucagugcuggucccgggcuggucugggaaccaugugagaucuguuccaucuccgaccuaauaaauaaugugcaucgugcuuauagcucuggccccgccaacugcucaccgugacuuuaauguaaccucuuuccuucguguaccuuuucccuauuugaacuggcacuccacuccuugcuauagguuauucagaaccacucaguguaaucucccacccccugcccugguagccagcugcaaaaggucaaacucuucucucuucugacugcagauuuuuagauaaagccuugagaagaacuugaggccaaaaggggaggugagggggcucugaccccauaccuuuaggcagaggaaacagcccucuucuagauuagcagguaaguugggcuaaaugauuggggccgagguaaaagcucuuagagcagugagagugguccaagggaugggguugcucguccugagcuuuugugugguugcaggagaggcugggcaaauggccgaggacuggguaggggugccaaaaggaaaccugcuuccuagagagacuuagggucacgggaccuugaaguauguuuuucugcggugugagcaauguggaagggauggccuuagaccucucuggagcaaugccuggaccaggggaguccccagacugccuuuacuacucaccacugagauuuugcugaguugcuggcugggaagggagauugcgucauaagaggaagaagucuguggccagacugguguuucugauucuggccccagcagagggccccagcacugggacugugucccuuaauugcuggauggcagaugucccagagcacuugcacuucucucuucuuuccuggguugauguucccagcuuuguccaucauuagaaggcacaucugggaagcauccucaggggccuauguacuguucuagaccuccuccauugcggugggcugaccuuaucaggaggguuggagagugguuguggcugaaucacugccuuuguggggaggaaaugggauuuuaaaacaacaacaacaaaaaagguuuauuuauuuuauguauaugaauacacuuucgcucucuucagacacagcagaagagggcaucagaucccauuacagaugguugugagccaccauguguuugcugggaauugaacucaggaccucuggaagagcagucagugcucuuaaacgcugagcugucucuccagcccgggacuuauuuauuuauuuauuuauuuuuauuuugguuuuucgagacaggguuucucugugugucguccuggcuguccuggaauucacuuuguagaccaggcuggccucgaacucagaaaucugccugccucugccucccacgugcugggauuaaaggcauguaccaccaccgcacagcgauuuuuuuuuuaaacuacagaaaauaagaaugugaaugaaugaacauuccauaguuccuauauggaggucagagaccaaccugcccauucuuucuguccacugaaugggucccagggaucgaacucaagucauuaaucuugauugcaaguacuuuuacccauucagccaucuuaccagccccaaaguagagguuguuagggaccaucucccaagccucaucuauguuaagcacaggcugcaccaggcccacccagguaaugcuuacuaauaucagcauacucuucacaagaaagcuuacaccaugaaaacgcuuggggggcgagggggggggcuaaagugacuuacccaaggucacgcagguaggaaguggacaggcuagcuuuuggcugagucuaagacgagagcauagccccucccaacucaggugugugugugugcauguuugguugguuuuuugagacagaauuauacuauauagcccagaacuagcuaugugguccaagcugaccuugaaaucacaccaguccuccugccucagccucccaaacacugagauuacaggcaugagcuuccuuaggguugcucuuaagugugggcuuagcugugucuguuuaagaaacguuauuccucucggagguucagacucugcacugcagugagaacacugaggauugguuuucagaagagugagccuccugguuuucaaggcaaaaggaaagccugaaguuagguuguguauaacccgauagugaaaacauucgaaugagaagcccucucucuaaguccagccagcccaggaaggaggcagaggcaaacagaugaauguucuaggccauauaagaauguucuaggggcuggagaaauggcucagcagguaagagcacugacugcucuuccaaagguuaugaguucaaaucccagcaaccacaugguggcucacaaccacccauaaugagaccugaugcccucuucuggugugucugaagacagcuacaguguacuuagauauaauaauaaaauaaaucuuaaaaaaaaaagaauguucuagaaauguuauuugguuucuauucacuuauacauucauucaguguguaugucugucagucagucaguguaugucuguguguaaaucugugugugggucagaggaaacuuguggcaauuguuucucuccuuccaccaugugggugccaggagucaaaccuggucaucaggcuuggugacaggcaccuugaccugcuaagccaucucagccagccugguuuugaaucccagccacuggugacuucugcauggccaacagggccuggcgugcacagggccugggcaucuguaucuuugguuauagcagcaguccugucuacucaauuguggcucauaguaacaaacacuuggcaaaagcaagccuagaaccagcacagggcuagcacccaaacaaaugacgggaggaaaugggacugaguagggccaagccccguaaugccuccaaaaggacucagugaguggcccaggaaaugggggacaagcugggacuuggggcugggaauauuccaaacacaauuaagaauucauuuccuggggguggugagauggcucagcgguuaagagcacugacugcucuuccagagguccugaguucaucauauuucuuuuuuuuuuuuuuuuuuuuuugguuuuugguuuguuuguuuguuuuuuucuuuuucuugagguccugaauucaaaucccacaaccacaugguaacucacaaccauccacaaugagauuugacgcccucuucuggugugucugaagacagaaaaagaauuaauuuccuggcccaguguaaaagugugugcuguuaagcuguaugaccuaaggcaauccccuggacccacuuaaugaaagaagagaacuaaucccacacgcagacauaaaacaaaucaauguaauuuuaaaaauuauuuuccugcugggcuugguggcacaguccuuuaaucucagaauucaggcaaaggcagaagggucacugugaguucauggacagccaggacugcauagagagacccugucuuuaaaaaaaaaaauuagaaauuaaaacaaguuuuccugaggacuacugugacaggaauugccacaagggaaaaaagagaguugaucugaauuuuuuuucuuuuuuuuuucuuucuuuuuuuuuuuuuuuuagauuuuugagacaggguuuuucuguauagcccuggcuauccugggauucacucuguagaccaggcugaucucaaacucagaaaucugccugccucugccuccuaagugcugggguuaaaggcaugcgccaccacugccuggcggcgacguuaaucugaauuuugaaaggcuuugaaagaaggcccgcaguuugacgucuggguugcagggaagcaugcuggucuaaagcgcauggaaacauccauaggucuuggcagcagccccgguggggacuguguguuguccagacaaccuggggagucuggugaucuagguccagaccguguuggggcuugcccauagaccaugcuggcuccgugcuuugaauucgcugaaccuucugaucacaagacugccagaagaucagacgaucuaagacuugccugugacacaucuguccccuggggucucuccaggugcuaggauuuuaguaccccuuucuuccguguccuuuauucuccuugcagugcugggcgucgguagacaagugcccuaaugcugagucauauccccagcaucucaaacucuuuuauguuugggucuuauuuaucucucuggccuauaauaaugaaaccaguuggaugugcagcugacgugugucugucugcugcccacacugugaccucagugcugugauagcccggcaucuuagcaaguggcgcuccugcugugcacuugaugagggccugguacuaguauccuugacuuguggucuugggaaaguugcuucaccuuuuugugccccccgagucacuguuucaggauaaacauaucugccuuugucuugccuagguugacaagaguuccccgagauuagaagcccugaaggagcgggcauccucccagcuaccccaggaauguggucgugaggcagagcccgcagcuuucagaagaagaguagucuugggccauggcccaggucagcaucaacagugacuacagcgagugggcuuccagcacugaugcuggggagcgggcccguuugcuccaaagucccuguguggaugugguaccuaagagugagggggaggcgucuccuggagauccagacagcggcaccacuucgacgcuuggagccgucuucaucgucgucaaugccugccucggugcgggucugcucaacuucccagcagccuucagcaccgcugggggcguggcagcuggcaucgcccugcagauggugagugagugcgcgcgugcgcuggcaucggagguaggcaggcaacuccgggccucugauuugcaggggaggcuuugaaucagagaugagccauaagggacauaugucgucauccuucccuccccuauaaaugacuuuaucagucuaucccagaacuuccuguguagccauggaugacuuuuaacguuagaucugccugcuucuacaucccaggugcugggauuacagauaagugccaccacgcuugguuuuaacgaaguacugagggucagaccugggacuucaugcacgcuaggcaagcacucuaccgacugagucccaacccuagucccugcauauuuaaguuuuuagguguuguuaugcugauuuuugugguuuuugucuaaauaaucguguuuuagaauuauugaaauguuuauuaaugaaguaaaaagaauauuuguaugggcuucaaaauacaauggaaaaauaauaaaauggugggggggaggaaucucagaacucaagagguugaggcagaacccucaugauuccaaggccagcauauuauuuuccagcuugggcuacaaagugagauuuuaucucaauagacaacaacaaaacaaaauaagaaaacagaaaaaagaaagacgcugggcgugguggcacacaccuuuaaucccagcacuggggaggcagaggcagggggauuucugaguucuaggccagccuggucuacagagugaguuccaggacagccagagcuacacagagaaacacugucucaaaaaaaccaaaaaaaaaaaagaaagaaagaaagaaagagaaagagaaaagaaaagagaaagaaagcaaagaauuauaaauuguuuuugaaacugaguuugaagcuguuugagguccccccuaauuguuugcuuuuuaaagauuuauuuuauaugugaacaguacauuguagcugucuucagacacaccagaagagggcaucagaucucauuacagcugguugugagccaccaugugguugcugggauuugaacucaggaccucuggaagaggucagugcucuuaacugcugagccaucucuccaacaccuuguuuguuuaaaaauuuuaaugaaacucauuuuuuauacuucguuuuuguuguuuuuuuaaaaauuauuuuaaggggcuggagagauggcucagcaguuaagaucacugacggcucuuccagagguccugaguucaauccccagcaacuacaugguggcucacaaccaucuguaaugggaucugacgcccucuucuggugugucugaagacaguguacuccuauacauaaaauaaauaaauaaaucuuaaaaaaauaugauuuuaugugugaguguuuugccugcaaguguaaucauauaccgcaugcaugcaguaccaguggaagccagaauaaggugucagauccccucgcaguuagaguuagagacauuuguugagccccaguguagaugcuggauauugaccccagguccucuaaaagagcaaccagugcucuuaaucauugaaccauuucucuagcaccugaaauucauuuuuaaagaaaauuucaacuuggcaacaucucguaaucuguugaaauuguccugggagauaagacccaauuuugaaccugcuuuggacauugguguaagaaaugccagcaaggugcuggagagaugguuuagcgguuaagagcacugacuacucuuccaaagauccugaguucaaaucccggcaaccacaugguggcucacaaccauccguaacaaaaaucugaugcccucuucuggagugucugaagacagcuacaguguacacacauauaauaaauaaauaaaucuuuaaaaaacggggcucagcaaacgucucuaacuccaacugcgaggggaucugacaccuuauucuggcuuccacugguacugcaugcaugcgguauacgauuacgcuugcaggcaaaacacucacacauaaaaucauaaaaaaaaagaaaaaaaaugccagcaaggaguuuaccaugccuuucccacacccucucccuuguucuucccgcagggcaugcugguuuuuaucaucagugggcuggucauucuggccuacugcucucaagccagcaaugagaggaccuaccaggagguggugugggccguguguggcaagcugacaggugugcugugugagguagccauugcggucuauaccuucggaaccugcaucgccuuccucaucauuauuggggaccagcaggacaagagugagccacuccccgaaccccagugcccaccuccucuuuuuucccuuuuccugaggguccugggguagagaggaagagugauacaaacuagaucugcccucucugcaaguccugcuucuuaggaccuguugacauggaaggaccacacccugaauggcguggcuugacauucccuccuuccccaugcaguuauagcugugaugucgaaggagccggauggggccagcggcagccccugguacacagaccgcaaguucaccaucagucuuaccgccuuccucuucauccugccccuguccauccccaaggagauuggcuuccagaaauaugccagguucggaggucccaacccagccugggccagacagagacucugaucaaaggcaaccggagagccauuucugguggggaacccgucuccuccauagcaucuugcuuggggagcaagaauaggcaagccagggcaaaccagagcuggcaggaaccucggccgggacuuugcuuuucugugucuaucagggaagauagcggcccuuuguacuguugaaagguugugaccuaaauguccuugucagagaaggcauuggggauggcuggcagugucacagcagaugcuggccugggcauugguuucccuggaagcugggagcuggugaucuugauauugugggcuugguggggggcggggggagggggucuucccuggagcuucauagcuccguaccugaaaaucucugggggucgggauguuucacacuugaccaucugcagaguuuccuuaauguuaguauccuaguauccgcacucucccccuuggcccuagagucucucaguucucagagcccaggcccaugggauggccagcuaugaucccuugccacaucuggcugcucaggcugagcuagcuuauagcugugcuuuggagccccguccguggauguggucucuugagucagugcaugugccccuggcugagaugcuggcaagcucccuccuucccguggcagaucucucugacacuuaucucuccugaaucauuauuugauggagcuuggugccuagaacaaggguggcacuucuggagauggaacuggauaaggcggggcuggcgcuggggacuaggacucagugucuacuucuuggcagcuuccugagcgucgugggcaccugguacgucaccgccauuauaaucaucaaauacaucuggccagauaaagagaugcgcccgggggacaucuugacuagguaggugagagucccugggaaauacaugggauagaagcuguaaaggucuggcaucucgguaucacacucguguccuuuccuaggcucauuagcacauuuauacuaacucaccaguuguaggaaggagaugaaagggucuguucugguuuggggguggagauuauguuuguuuguauguuuguuuguuuuuaccugaaugaaagaauaacagucugggccgccaggaggagucucuaccaccaacaucuagcagaugccacugugccaugcaaagucccaccauggggagacuaugagggaaaauguacauguuuuuucaauuacucagacuggguaccacguagcccaaacuaggcuuaaacucacuauguagccuggccuugagcuccugauccgccugccucuaccucccaagugcagauacacaccaccacgccuagcuuuccagugucugucugucugucugucugucugucuauuaauuuuaaagaaacaucugagaaaagcaaugucccaguucaggagccaggaagucuggccucugguccuaggauggccucucagagccugucuccugaguuuuaggauagacacguccucugcccaugugugaucaguguguagaaugcugguuguugagaguuggugagugagugaagagugggggcgguggggacgguugauggcuccguaggauucacagguucacacuguguuugcccacagaccagcguccuggauggcuguguucaacgccaugcccaccaucugcuuuggauuucaggugccaccaccagggucccugcugucccauuagcucagacccacaaaccccccagcacugggaagggacccugauuauagacaggaugguuggaucccuggggaaauggaugaaccaaggacaccuggcuugccccuuaucccugggaccuuugcccccaagcuuccucucuuugagaccuggggaugaggccacuuccccacugugaccauacccuuccuccggacagugucaugugaguaguguacccgucuucaacagcaugcggcagcccgaaguaaagaccuggggcggaguggugacggcugccauggucauagcucuggcugucuacaugggcacaggugaguguuccccuccaggggccaggcucggaugcucccaccucuugagucuccaagguuucuagaccagcuuuccuagagaagcucuguacucuuaacucagugaacacuugaguauugacucgaguugagcugcccaaggcaucaggaugagcguguuccaucugcucauugguccuaaacugaugcugagugauuaucagaagguguucccauuguaggguugcugcagggacacauggaacuggccccagcccuggugggaugacagucuuggagaaacaguuauguauaaguaauaaugaaaacauggaauuuuaggugggggcaggugucaucaugacacugaaaccaggaaguagggaacgggacugaauaggggcggcauucccagaaggcuucucucugaguauggggugccugaggaggcccacgagggauaagacagaugguaaagggcuggguggggaggagcauuccaaggagagacugacuguaagugcagggcuucugagcagaugugggaggaggucuguagcugggguguaagaaacuggugcuuaugaggcugggcagccaaggggaagacaguagaugcugccaggagucugggaggauacauuucuuuuucuuccuuuuuuuuuuaaugauuuauugauuuauuuauuucauguauauaaguacacccuggcuguuuucagacacaccagaagagggcaucagaugccauuacagauaguugugagccaccaugugguugcugggaauugaacucaggaccucuggaagagcagucagugcuuuuaaccgcugagccaucuccccagcccaagaggaugcauuucuuggaugggaaaugaccaggcaaagaaaccucuggcugcugcguggauuugggcaagaggucagagauggaccgggaguucccacccuccugugguaugggacgaggacaggagcuacccggagagugcugugucagcaucugaagcaccagcaagaagcacaagagucccuucugucaggggucccauguucugaccggggugaugggcaauuuagagagaggugauuggggacuagaacagggugguaagcagguaucugggguggggcugacugcaugggcaaguccacauucucugaggaggggacaacugaacugagacccgaggcagcaacggggcuguuugagcagauggaaugguuaguauagaaguuagaaggcaugugcagagaaaugugggggcuggugggcccaccaucaaaggacaucuacgaaggcagacuuuucuuucugaggcccaggccucaucucccaggcugcuacagcauucuuucugaaugacauugcuccuagcaggaguaggcugcgguccaccacuuacccuccugcgauugcccgcccucaccccgucccuggucuuugccuacaggcaucuguggcuuccuaaccuuuggagcugcuguggaccccgacgugcuccgguccuaccccucagaggacguggcuguggccguugcccgagccuucaucauccugagugugcucaccuccuauccaaucuugcacuucugugggcggugagccccuuccccacccucuccagagcccccugggagccagcacgauacauggccuuguauggaaccuguuuuguagcagggaaaacugaagcccacagaaaagaauguguccaggaugcccuucccccauacucgugccagaucuguuguuuccagaacauucuguaagcccugugagggucuccaguccagauccuuuaaugagcuuuuaugugaacccagccagcccuuugaauacuccaaacgauuccuuuuauaaagggcauagugguugguauccauauucacuugaagaggccaagccuuucauaaacuuaccugcagcccauagccaccaaggacagugcuggucacacaugaggacccaggcucagggaccacacucugcccauugaggagcuccuccccgugcacugcacaaagcacccugagccccuccucaugugagcagggcugugguggaaggccuguggcugcgcuacaaggggaugcccguggaggaggaugugggccgggagcgccggcgccggguccugcagacgcuggugugguuccugcugaccuugcuacuggcgcucuuuaucccugacauuggcaaggucaucucggucaucggaggccuggcagccugcuucaucuucaucuucccagguacacaccccgggugccgccaccacccccacccccaccaccacacagcaggaucuacauagcucagccacggacucaaaaccugccaguaagaugagcaguagucucuguugcucacugacaugggcucagcuacagugcugccaucucagcgcugacuccuagagagaaggugugaucucuguuuuacugaugagaugugaggucagagcagcgggccucaacccuggaguugaauggccguuucauaggggucaccuaucagauauccugcaucaggucagauauuuacauugugauucauaacaguagcaaaacuacaguuaugaaggaacaaugaagauuuuuuuauuggcggucaccacaauguaaggaucuguauuuuaaagggucacggcauuaggaagguugagagccacugagcuagagaauuuaggccagcggcuaagaagcucaacuauggacaauccauuugaagcccuauaggcccagguccagggucucuauuugaacccuucauucaaguguguacacuguugacucucaggaucugacuaccuuauuccaguccagagggaaggaagccuggccguggcaccuuaagguuggagucaagagacccaagccgacguaggucagcugcagauccccagaaaccugcccugucugcguggcuaugaguucugcuggucccaguuuguuucuguaucggggccuccucaaagcccaucccacuggacauggagcaagggagccaugccugcucuggaguaggcaagauggcaugagccauuccugauucccuauucauugugccccuuagcucugaguccugaauauaucccaagcggugcuuguuagccgcuggccuaucaugggagagcagagggcaggugucuagcugggcguagcuugaggcuggggaccuggauuucagacucaccgguaaacaguccuuucuccaucaccaccaccgccucuuggcuggggaggcugggcugugggagggaaucccugccucuuccauacucaggauuccgucuuucuuucuagggcugugccucauucaagccaaacuaucagagauggaggaggucaaaccugccagguaaagcagggccagagagcccaacagccuuucagggagguaaagaggggccuuaacauagagaccugaacauuugaaauuucggggauuccugggaacuggcacacguuguugccuccacacucagaggcuaaggugagguugcuagggguuuggagucccugaugcugugccagugacuuuuuguaagaaacagcuuaaaaggaaaagaguccucaacucaugguuugaggacacagcuggucccaguggcaggagugugugaggaguuuggacauguguccuuggguaggaagcaaaguagugacagggacucucagccuaccuucuccaucauuucuucuuagucagucugggaccucagcccauggaauuguuugggcccuauuuaagguggggcuccccuccucuauuaaaccucucuggaaaugaucuuacagacccacccuuggcaauuccaaauccaaucaaauugacaauggcagugagccaucgcauuacauagugagaaccaagccagccagagauacacagcaagacacauacacacacacacacgaucucaaaaagagagggagggggcuggugagauggcucagccgauaagggcacugacugcucuucugaagguccucaguucaaaucccagcaaccauaugguggcucacaaccaccuguaaugagaucugaugcccucuucugguaugucugaagacagcuacaguguacuuauauaaauauaauaaauaaauaaaucuuaaaaaaaaaaacaagagggagagggagggagggaacuggaggauggcucaaugcuuacaaaugcuugcuguucaauccuaaagaccaggguucagauccagcacccauguaacaaaccaggcauccugcaaacuccuguaacuccagcuucaagagaucuucuguauucuucuggccuccacacaugcaccuauacagugcauguaacacucacacaggcgcgugcgcgcacacacacacacacacaaauaggaagguuuugguacuuggaaguauaauuuaauagcaaacccugugcuugucaugugugaagaccuggguucaauacccuaguauugcuuccccaaauuauggggguuuaauguacauuuaugcaauggguaaccugaauuacuuauauaauucauguaguagugaaaggcuuuagaagaaaaagugggagucccacgccccuaauugggcauaucccuaaucucgguacuuggaagccugagacgagaauacuuguagaguacgaggccagccugagcuacaugaguucaagcuagccuaggcuauauagugaaaccuuuucucaaacaaaacguuggggugaguuucuucucuuacagccccucuccgcuuacccuucuccuaagacaucucuguuuucccugugggcuguaaucuaaacugguuuugugcuuguauguaucuugacuacacagagcuaugcaguguagacagacauagggguuugcgugugauuuuguuguuugagguaggaagguugccgggaguuuaaagccagccuggacuucagagggagaccuuggcuuaaacauuuaccacauauaagucaucggaugagggaaaagcacauugcuucuauauauguauguuucccugaauaauaguugagggaaaggggguggguucauauuuuaagaaaaauuauuccagagcugggaauguaguucaaugggcuagugcuugccuacaacauacaagacccuggguucaaucccuaccaugacagaaaggggagagagauagaggaagaggagagagagagaaacauaucucuuuuuuucguuuuuucgaaacaggguuucucucuguagcccuggcuguccuggaacucacucuguagaccaggcuggucuugaacucagaaauccaccugccucugccucccaaguacugggauuaaaggugugcgccaccacaucccggcuuaauuuuuauuuucuuaagauauguuucucgaugggcaguagugagugguggcacacgccuuuaaucccagcacuugggaggcagaggcaggcggauuucugaguuugaggccagccuggucuacaaagugaguuccaggacagccaaggcuacacagagaaacccugucucaaaaaaaaaaaaaaaaaagaaaaagaaaagaaaaauuacccuucaucucaaugccagugauaaguuccuggaagguuuuuuuguuucuuuuuuucuuuuuagcacauuguugcagcugucugccuucuauuucuuuuuuauauuuauuauuuuaaauucucucucucucccccuccuucucccuuccccucccccucccgcugucccuccccccucucucccucccccucccccucccucucucccucucccucccccucccccucucucuuucucucucucucccugccccuguuuucuguucuuuuaaaugaagcaucucauucccugucaccugcuuuuuccugagcaucuucccacagggagacuugccuuccacuguggugguccgucuucagcauuagccccucuaggucuugguccccuuaacagugaaguagggucacaggccuuuguacgggaaaguccuugggaagccuggcucgccuugccuccagaaguaagaugacugauuaucuuggcugcuacagauaugagccugaagaauuaggggaaaaaaaugacugaagcauucucuuguccucugcccuacagcuggugggcacuggucaguuacggaguccuucuggucacauugggagccuucaucuucggccagaccacagccaaugccauuuuuguggaucucuuggccugaacucugcuuccccagaaacaugaggaccgagcaucgcucagagcuguggagcugcccaagucccacgucccauuccagccagugagaugacauguggacuccuuuccccauggacagucaugagacaaucagccgcagaucuguggacggcucccgcccagcugccuugcauccugaccccacguucucauggauggaggucccauaucacaggagcuucuuccccuuugcucggaucuccacuucaagccuuugggacuugaggauggagagggucagugggucucagaagagagagucuauucugacuucccucuggaaaaagaacaacaacaaaaaaaugcaucugcagagggcuggcguccuccgcggagcguggcaggacugugcucaguaccucgggguuuugugccugcccaugucucucagaagccagugacaacuucuccugggaccuggcaacuuccaaaggagcugcugacaucauauaaauguccaaauuccccucuugguccccuaugagucucugguagcuucgcaagucuuugggcucccuacugugacuuuguccaaacaaagugguccauguuggguuugcuucugcuguguucccggacaucaccaagucuaauguuuacaaagccagccuggcuucggagcuaggggcugccaugccacggugcucugagcacuccuccguuagcucuuuaugcaugggcagagggucuguugucuuuuucagauuccagauaagcccgucuuuucagagguuuaggguaggaucuuuuagaccauccuuccaggcagggaugcucaagguccgggugaaguucugccucacuccuccaagccuguccucucucuucucccgcuaaacccagccccagaacccagaaggaguuagacuggggacccuggauguuucccuuccuguuuccaucuuuacccauccccacauggccaucccucucccccaacccuaucucuucucuuucuucauuuguggguuuuguuauuugguggggggggggggggguguggcgccagacccugucacaccagcuugccuggcuccacacgucugucaagccuggccuccaugccugggaauccugcugaaucauacccaccccaggugaggucagcauagacacuucucucuugacugccuuagcuucgaaccuaccccugcucacuuuuguaagucccaaguacagaauuggucuuuauaaaucuauucugucuaaaacacuuauccuaggagugaaagggacccuucccagcagacuacccccugcccccaacacaggucaguccuguugaggcaggaggcuuagcauccagacuugcugaauuguuguucucccauccaucccugguacuucuggucccgcuacacuguuuuccccuagccccccaacccccauaagccuccaagugcugccuuucacagugaccaaucacagagcugggcauggcuuagagacgugcuagcugggacaguuggcuagaaccaggcuucagcuuguccucaggacccccuuccuccguccccuuugcccucuguauccaguuucuugcugguucuuuucuacucaagcacacuuggagacgugaggaugauuaauaaagggacuuacacugcuaaac

SEQ ID NO: 4679 - RNA, 24418 nt, Mus musculus
uggcugggucuauaguaauuuuauuguaacagagaaaccaggcggcaguacgucuacaugauuagagcagauggugguuaucuuucccaagggcggagucugagccgggcuggcagcacacaaaccccagaguaucuccuucugauccuacccugcacgucugacucaugugaagagacaggcugugcagccaggauggaugaagagguccagcugggcagaggccccaucccaguaggagccaaucaaucaaugacugaagaggacucugaaaucaagggcagggucucucucucuccacggcucuuugaugagagaggaggcuaugcaggagcagaaaaccuaugcucuccauucuuauguaacuccccccauaggcugaggcggauguuugcaguagaacgggaugagacucuaggcucuagaacagcaaugacaaggggcaggcggacacgacacuacaucuucuacugucccuguugaaguggcaacagaccuguugguuuuuguaaagcauaauuucuguaauguggucugcugacacaguuugcuccacaccaagaggacgaacuugaggacaacuguuaaugacagaacuaguuauuuuucucuuauagccucuauuaggggaggcucuacugggguccacgggggagccccugauaccaccugaggcuuuagguaaagcgucugaccuauuccagugccauggcugacagguguuuggugcugugauuuuucuugcguguguaaacuuucagaaaagcuggagacaaaaggaugagggaguuugguuuagagccgacgaaguuccagauaccagccgaggaagccucugcccuaccucucuuccgaggagcgaguucagucgcugaguuaugcaccgugguuggaaaccggaucuauucaccaccacccacccucccucacccugcacgugacgcucacgagcgcaaaggcugucgggaaaguggucucuguuccuuugcaccugggaauuacuuggugaccuggugaauggcaugggcaagguagcccacauugccagaggugaccccugccacggagauucggccauccuuugucauguagaccgagaacuccuuggucagccgcucuaccugcagaaagaaaagagcuagacaaccacuucuggugaggauauuauauuccagcuuugacagggcacccaauagccaacuucuuaaauuuuuuauuuuuucacuuuaagauagaauuuaguguguggauuuuuauuuuuuuaagaguaagagaauaaaaagcuauuuuaaaguuuuaaaguaggaacuggggugugugagauggcucagcaagucaaggugcuuguuaucacgcccgaugacccaaguuuauuaucaaaacuuagaugguagaaggagaaaaccgacuccugggggcuggagagauggcucagagguuaagagcacugacugcucuugcagagguccugaguucaaaucccagcaaccacaugguggcucacaaccaucuguaaugagaucugaugcccucuucuggugugucugaagacaguuacagugcauucacauauacauaaaauaaauaaaucuuaaaauaaaagaaagaaaaccaacucuugaaaguuauccucugaccuacacacgugccauaguacacagaucaaaaaaaaaaaaaaaguuaaaaaaguaggagccaggcauaauggcacaugccuuuaaucccuguacuugagaggcugaggcagguagaucucucucugugaguuagaggccagcuugguuuacauaaugagacucuguuucaaaaaccaaaccaaaccaaacccaacccaacccaaccaagcacauaaaaacauuaaaguaggauuaugauuucuaaggcauaaaaagguagggagaaaaaaaauacccucaaaauuaagcagccucagaauucaguuauauaaccgcucuuuccccucuuccuuugauauaccaggagucaucauaaguacgagaaaaacaagcuauuauagaccauguguaaaacccggcaccacaaaaaaacccaaaaaaaccucaaaacaaaaccaacauaaaaucucaaaacaacaacaaaacaaagaaaccccacagaaguccuuuucugccucaagccauuacuaucaucaccaaacugaaaaacaaaacaaaaucaaaaaccaaacaaaaacccacccacccacccaaaaccugaaaccaaccccuaccccacgguaugcacacuucagaagacugcagcaucaccgggacacagacagaaaagcaagugauaaaagagaaaacaaggacaggcuguguguguguguguguguguguguguguguguguguguugggggcaggggcacacacccaaucucagcaugcuauauaggaaaaccuuggagagagagaaacagagagcgugagagcucgcuggaaaacaaagcaggcagucccagguccaggaugagaugugggugcuggagccugaggcaacauuaauaaaaccucaccucacaacacagccccaccaccaaaacccaaccaacaccacccaggaaauaucucgugcccccuuuaccuaaaagggcucuaaauuaaggacacuugaauuagcaggugaccucggacaaauucuggcuugcaaagggcggggguuggcuguggggaaccagagcccacucaccugcucuggcuuuaggccggugaaacagaacaugccgaucuggucggugaugugcugccaguugugggaagagcccucuuucuucagguuggagaccagcuggguccucaugcugaugaugcggucagccaugccuuucaccucuugcaaccugugaggaaagcagagggaugccgugcucuggcuacgccccaacacggaagugagaggccgcacacucuuucgcuugagcuuucuccugaaugccuuaauccuugcuccuuacacagugucugguggagacauuuuuauuuuuuaagcuuuuugguuuuuauuauaaaugcuuugauuggcguaagucagucugugcucggugcucuuggaggccugaggagaacguuggauuuccuggaaccaaaguuuauagaugguugugagcaaccauggagaugcugggaauugaacccagguccucuggcagagcagccaaugcucucaacagcuaagccaccucuccagccccagauaguuuaacuguuauuguuaagcguucuugaguauggagggaaguuuaaauaucauuugaaaauaggaacacuaauuuguuggucaaacaguaaaucaugacaugauuuuaaccuugguggaacugacauuccugccuucacgauggagacaauggucuaggccacauagcaggugcugaggacugagcuguggucauagcccuaaaaugguuacaguagaggucaaaggccaaacuuguuagagccauggcggcacaaggcagcaaagagcacugcaggccugcagggcugucacagagaagagaggggacaggagaggacagcucaacuugcucaguucucaacagucuccccuguucucagaacugccagcuacaauccauucccuuggcccugcaggagauuucuuuuguuggcuuuuuuucuuuuuuuguuuuuuuccaagacaggguuucucuguguagcccuggcuauccugguacucacucuguaguccaggcuggccucgaacucagaaauccaccugccucugccucccaagugcugggauuaaaggugugcgccaccacugcccggcuuguuggauuuuuuucuuaccaacuggaccacucugacgacacugaaaguuuaucucuccaggguuguaugcucgcuuucaucaacaaucucucuauuucaucaacagcaucaugcacggcuacaucagaggugacagcugccaacuagagacuaaauaauguuuuuauuugagccagugagcugggaauggcgguaaacaccuguagucccaguguagugagaauucuggaauccugguuucuuuaaagaacacagaaacauuaguuauguuuucauuuuaacccacggggcuguggggcugcucuggacugacugcagcagcugauuaugacuuauuugccuugcgcucuagcagaggcgugguuugccagcuguagguaguuugagauugugugauguuuaggaagcagaggcagguggauuucuguguuugagaacagccugagucacaguguaaaauguuaucgcaaaagaaggaaaacaaccaaccaaacaagcauaaagaaguagugggcagcagcuggcuucaccucagcaacauuaauccuggccagggcaggguugcuccuggccucugagugagaucagaauuuuaacguucggugacaagagccacccaacuuucuucacucugaagaccuggguccuagcgggucuaagcaugagacccgugugucucacgugcauugcucccuuagcaaaacccugccacccuccagagaaucaaguucugacuucucacaaaaucaggauuucuucucuaacucccuaaaugcuacuuuguguuguuuuugagucagcuaguccaggauagucucaaauuuacuuuguagccaagguuguucuucccugggacuggaguuauaaaugguuuugaaccacuacaugggugcugggaauggaaccuagguccucugcaagagcagaaaguguuccuaacugcugaaccaucucucuaguccaaaauaaauaaaggcuaaaaaacacuauuaaaaaacagauuaauaugauugaguaucgauaauaaaaccguaaguaugcagaaacacugauucagugcucacuagugggacaaaguacacaggcuggggauccagcacaacacaugcuugucuucauguaugagacccugggucucagccaggcgagguggugcacggcuuugaucccagcacuugggaggcagaggcaggcaaauuucugaguuugaggccagccuggucuacagagugaguuccaggacagccagggcuauacagagaaacccugucucggggggggggggggggggggggagaaagagacccugggucucaccuccagcaucacaauacaaaaauaucuuuuggaggacguuuccugugcuagguauuucaacugaacuugaauucaaggaagguagguuuuauuuacuaaaugugagaugccagaaugaaagagccugccguuucugaauuuauggggaaauacuagacuuaucugugccaacaaaaugcacacuuccuucucuuccaucugccuuuuccauucauggagcuguagcacggaacagcuaguaaucguuaccauugcuuccgcaagucuggagaagucaggaugguugcugcgauccgggccccauugagagguggguuggaauacaggggacggaucaagaucuucagcugugacuccacccuuuuggcuucuucugcaucuuugcagaccaccgugaaggcucccacacgcucaccugaaaagacagaggauacugucuucuagcaggcugaaacaaauagugaggacauuugcuacgugguaucugcuucugucagaagaaccacaacaguagcuuguuuugagacaagaguaucaacacucuguagccuaggcuggcauggagacaagugauucuccugucucagccuucagagagccuggauuacaggaaugagcuaccacaccuggcguaauaguuccuuauuagaaauaaacaauguuugaccagucagaagggugaauuuugaauugagucacaacugaaagcguucagggucuuuuaaaaauaccccccccccccccccgcaaaagaggguuucucuguguagcccuggcuauccuagaacucacccuguagaccaggcucguauuaagcucacugguauucaccugccucccugccucuaccuccagagggcuaggauuaaaggugugugccacugugcuuggcauuaccauuuuuuuuuaaauuuacuauuucaccccaccccccaccccugggcugcuguggugcaccacuguguguaugugaaggucagaggacaauuugugggagucagucucuccuucagccauguggguucaauuuggucaucagacuuaguggcaagcacuuuaccuauugagccuuauugcuggcccaggaugucuuuuuaaugucguauuuaucuccuuagcucucguaucaauuauuuugcaugcagaaauaaccaacuuuuaaaaauuauuuauuguuuauguaaguacacuguagcugucuucagacacaccagaagaagucuucagaucucauuacagaugguugugagccaccaugugguugcugggauuugaacucaggaccuuuagaagagcagucagugcucuuaacugcugagccaucucuccagccccuucauuucuuuuuuuuuuuucuuucuuaauuauaggaauuuaaagacauugaagauaugucugagaaaaucuacaguacuuucccccccaucuuaggaauacugcauauuagcaacaugcaaauucagguaaauugucccuguagagucucugcuuuguggcauucuccccaagcucuccuuugagaacacaccuuacauugggcccucuggcuuaccguacaggcccauguucuuggcauacgauuggcagaggcagacauugaugcccugcucgaugaagugccgcacggcccaggcauccuuaucaccaucaccgcuggcaaagccuugguaggccaugucaaagaaugcgaagagauucuuuuucugggaaggaaugagaagaccaguguuugaggcaggccaacugcugaugcccgacuaccguaugugcugugagcaccaugauugccuacuucacccccaacacagccaaccgcuucuucacacagggcaguaggggagaugucugaauuccaguuaauugaucaacauacuuuaaaguuuuuucuuuuuuaagacuuuuauggccaugguucuucaaaaagagacccuuaaucuuuggugcaggaggcaucccuaaggucugggaucuuacuuuugggcaggacuagcaucaaucuuucugauggggcacuguccuacacccagggcucacaagaugaccuuaugaagcgcucucugcuggcugcuucugggccuuacucugucgucugaagcugagauuugauagaagcaguaagaauggggggcagaggaugaugggaauauuucucucugggaauucugauuagugucuuucgucacaggcagcuccucucaaagaaaaggcaaugcuagcugggcgcaugccuuuaaucccagcacuugggaggcagaggcaggcggauuucugaguucgaggccagccuggucuacaaagugagcuccaggacagccagggcuacacagagaaacccugucuugaacaccgcccccccccccaaaaaaaaaagaaaaggcaaugcugagcaagcaaaagaggggacacggaaaugugccucaaaggacgagcaaauagccacugaucggaacaaauggaggagccaccggcaggccccugggccacaacagcugcugugccagagacaaauuuuugacaguuucaucagacuucacuauaucugggcugaaggauuauucacauaaccaucgauuaaggaaccccucccccucccuggagcgaauccacguguggguugggggcaggcucgggguuaagcaaccagcuccugacgcuucauccuccucaccuucaccacggacgcuaucuccuuccacugcucgggacgcggguccacgccggugggguugugagcgcaggcaugcaggaggaggacacucugcucugggauuuucuaaggagaaacaaucgagauuuuuggcugugcagcuucaaaggaaacagccgacacacuacaggucacuguuagccgagaagugagaaggagaaccuaggagucaguuggccuccucuaagucagacaaugaaaguggcugggagacaccagaagucgggccuggaaagccacacuuacugauaugucuucuagggcuccagagaagucaaaaccgcaagucuuggggucauaguagcgauaaccuuggagcugcaugccggcaucccugaagaugggcgugugauuuccccaggaugguuugggcagaaagacaucucggcugaacuuaaaaaaccuuugcuaaaagacgggauaaaagggaaugagaaaaugaagaaagagaacaaaaugcuaaugcuuuccugagaggaaguguuuuguuuguuccuacuggcuguagcaagauggccuggguuggaggccaggcucugugaauuauucuggcugagguaaaacaccugugcaggccccaccaccugaaagucccuuacacgggaauuugcuggcuagucuuaugucaacuuacacacacuuaaaauuauuuauauuguuuuacuuauuaugguuuuguuuguuuguuuuuucaagacaggguuucucuguguagcccuggcuguccuggaacucacucuguagaccaggcuggccuugaacucagagauccgcuggcuucugccuccaaagugcugggaugaaagguaugugcucuuuauuuauuauauuuuaaugugagaucuuguggguugugaugguuuguauauacucacccagggacuggcacuauuagaagguguggcccuguuagaguagguguggccuuguuggaauagguaagucacugugggugugggcucuaagaugcuccuccuagcugccuggaagccaguauucugcuggcagccuucagaugaagauguagaacucucaguucggccugcaccaugccugccuggacacugucaugcucccacuuugauaauggagugaaucucugaaccuguaagccagccccaacuaaauguuguuuuuauaagaguagccuuggucauggugucuguucacagcaauaaaacaguaagacagaagucgguaccagggacugggguauuuaugugauaggccugaccaugcuuuuguuuggaagaaugugguuuuuggggcuuuggauuuggaaagcaguagaaugcuuuuauuggggcuuaauggcuguccaaguaggaauauggaagacuuuguuacugagacugacuuaaacuaugcagaccuggucuaagagauuucaguggagaauuucaguauguggccuagagacugucuuggugguauuuugaugaagaauguggcuacuuucuacccuugucuaaagcguaggugaaucuuaacugagaacaugccuucguaagauccagcugaaagguauuuucuuaauuagugauugaugugggagagcccagcccauuaaggguaaugucaucccugagcuggugguccuggguucuauaagaacgcagguugagcaagccagggaaacaagccaguaagcaggaccccuccauggccucugcaucagcuccugccuccaggagccugccaugucugaguuccuguacugacuuccuucaacgaugaacagugauauggagaguguaagccaaauccuuuacucuccacuuaguuuuugaucaugguguuuuugaugcagcaacagaaaaccugacuaagacaugaauuggguaaguuuauuaaaacacaugcucucuacuaauacugcaugcaugcugugcugcugggaauaguggcccacaccuuuaaucccagcacuugggaggcagaggcaggagggucucugaacucuacagaguuccaggacagucagagauacauaguaagaccucguucugaaacaaccaaacaaaaacuccaaaaccaaacuuaaaaaccaaaaaccaaacaaacaaaaacuaaaaccccguuauaugcucaauauacuuuauuccuuauaauuuccccauagugcuuucuuucaccagacgacgggaaacuugccaguucugugggaagaggaagccuggugcugggugagcagccacacacaggcuaggaagugcuauuaaccuccugcugaaaguucaguuuuuaaaauuauuuuauguauaugaguacacugucacucucuucagacacaucagaagagggcauugauuggauuaccaucaaaggugguucggcaccaccaugugguugcugggaauugaacucaggaccucuggaagaacagucagugcucuuaacugcugagucaucucucugcaccccccaacccccugccacccccaaaaguucauucuugaaagaguuccacucaccagaaaacuggccccgacccuuaaggcuccagucccggaaauggucugcacagugacgaacugcaggggauacacagagucagucucucuacccuuuacacuucagaacuucauucuuuuagcuauuuauuuguauagggaucguuauuugauaguuguauagggauauuuauuuacuuuaugaauaucuugucugcauguuuguauguacaccaugcucaugccuguugcccuagaaaguccagaggcaucagguccuuuggaacuucagaucuggaguuacaguugguugugagcugccaugugggugcugggaaucaaacccgggcucucuagaagagcaacaaguacuauaagccacagagccaucuucccagcaccuguuacuuguacuguauaugccccguguauaugggcaugggguauacgcauggcauggcaugcaugcauauguguguggggaagacagaagacaaugccuuggagcuuguuuguuuuuccuucagccuucauugugggaucuggagacugaacccaaaucaucaggccugugcagcaagcacuuuaucugcuaagccauuuugcuggcccuacaagugaauucuggauggugaauuccauauaaccaucuguguuauauggaaaauuuuaggauauaaaaacucuauaaaaacucuuucuuaauagaauaaaggagugguuucugcacacacacauacacacacacaaauauaaagacauuaaaauagucauuauauucaaaugcuaguuuagaaauaaacaguagucaacaaguauauuauucuuuguagugcugaggacugaaccuagggcuuuuacacauucgaggcuaguauuccacuagugagauauuaauacuucaugcuuuuaaaucuuaggcagaaaaauaaauuugaaaguauguccauuaagccacaucuucccuuuuucuuacaaaaagaaaguaacccacagucagugucuuuauuuuaggaucacggccucucuguccaugcccugggacagggcagcagaggacagccauaccagcccugcccccauacucauggcugcuucucccgucuaagcuggaagcuuaacacaugauuguggggacuaauuauaggcccagggaggcauuuguaacaaaaugcgguauaaaaaacacgaaagucaucaacaccaccaccaagcagggccaagguuaucggucaaauucugucaaaucuucaagauaaucgauaucguuaaacuuccuaucaguaagcguggucaccauuacacacauauuaacugaguuaacauuucucguaucaagcucaagcccgacccgcuggcuuacccggccgcuuuucaacacuucauuguucucgcccagggccaguucugcagaagccuuacagaauucagccagucccccaaugggcagguauucuuuguccaaauuuuuugcagcaaucugggccucugccuagacaagaaaacauaagucuuaguuuuuucuucugcccucguccuacugaaaugacaauaaacgguuucugaaguaaaugucagaggccacguugcuauuugggcugccuaugaacuccugggccuucauggucuuccugcucagccgggacuggccacuuggcaagccuaauauuccauaugaaguuacuguuuaaggauaaguggaauaguugacauuuuguaucauagaacagaaauaacuuuuacuaguuuauauuuuaauaucauuuuugugaaauaaaauuguauuuauuuugagguuuccuuauauguggauuauuaguaaagugguuuggaugagaauguccacaggcucauauguucgacuacuccaucccagcugguggaacuguuugggaaggguuaggaggcguggccuuguuggaggaaguguguuucucugccucucacuugcagauugaguugugagcucucagguauucuucaccacggagucacucugcugucagggacuuacccucugaaaccauaacucaaacacuaugacuugcuugaugucacuguuuuugucacagcaccugaaaaguaccuaagacaucuagucuggcuugagccugccaauaacuuguuucaaccucccaaguccugagauuuuuuuuuuuuuuaaagauugauuuauuuauuauauguguguacacuguagcugucuucagacacuccagaagagggcaucagauuuuauuacggaugguugugagccaccaugugguugcugggauuugaacuucagaccuucagaagagcaguugggugcucuuacccacugagccaucucaccagcccaaguccugagauuuuuaagauuguuuugagacaggguuucucuaugucgaaguaggcuguccuagaacuuucuauauagaauaggcugaccuugaacuaccagaaaucuaccuguguuugcccccugagggcugggauuaaaguaaguaccaccguguccaggacaauuacuggggugugugccaucauccuggcuaaaggguuuuauauggaaaggaaaggucuuucuugguuaucauguaacauaauagggcucucuugcaauacaaaauaaugaaauuuaugagcaaccuguuaggugugugagaugacaaaauccaacuaaauguauaaaaggaaugcaggucaggguauaugccagucguuguuggggaacuuacacugugacagugggagagauggucccccuuccugacucaaagggcuguggugaacuguugagauaacagauagcagugcuugguuguggucuagccuacaacaauagcuuaucaaucaccgaauacauuuuuagaauucuugugaugugauguguuugcaugccagaaaacacucuaucacaucuaguaucuccagccucgaauaacuucugaauguaacuaaaacuggagaaugaaagaagcuguaguucaugaaggguggauagcacaagccucucugggugaggauuucaccacagcaaucaccagagaaauggaacuaagaguagcugcacccgcagcuggcuauuucucuccuuaagagaggauguuaaaauugucauccccuugugcccccucaggauuaggcaccacaccugacuuauaaucuuacaggccuugugguuuuaaucugcuuucucagggaaggaaaaucauggucuagaaaagccaggugauucacaaagccagagccaggaccuaggggggcggggucucggaguccugguccagcacuccuuuuggcucagguuccacauccuagcuggcaggagacgagugccaagcucaccuuccggacacuggggagcacguaagguuuuccguuaucaucccgguaggcaccaacucccagguucaucuucuugcuguugguaucucucuugaaggcuucgguaacgcccaggaugggaucuggaggucccauuucaacauggguccaccaggagcugaaaugagaaauagguuaccccagccaugagcucgauuccuacagccagguaugucucugcucugccaaagauccauguuggcauguguguaucacagaacaggcaccagcuauccaauagcacaaaagccuucagaagacuggagaucagcacaaacaugaaaagaugcagaaagauagcaccaaguuauuuuggguaggauaggguacaaccacagcuuuaaaacauuuuuuucccuucagcuuauuaaugaauaaugaaggcguggcucauauacaucggggcacguuauccagcuguaaagaaaagugaaaauuaaaguuucagguaagcggacaucaccaguaaguguuaugagugggguaacucggacccagaaacagacgcugccugcauguucucucccuagcucagagucuuuagaugcacguguaaaaccuggagccaccacagaaaucaggaagauaaaagggaccauggagacccacugcuagagagggggacuggaaacaggugcaauaaaggggggaaugggaaaacaagggagccguuuuaacugggaagcagaaagggagaggaagccaauaagguggggguggggguggggaguugucuaaaaggcuugaaaagccauagggaaacaguuuucauucgguuuacauagacacuugccaaggagaugccauuuguaugacaaugcuccucaagcacauuaggcuaccuaacaagagugccaggcacgggaaaccuuccuuuggcuuguuggucaggcgagucuaagagacucccaaacuaagauggcuagugcccuuguccuccgagaaacugaaaguaagcuccccauugcugaaaauagcaccugccagacaaaagccugggagaaagugaucuggaagccgccugcuuucucaucuuagccuaaaaggcucuggcaagcugccaagggggaggagcaaucgccaguccuauucagccuuaacauuuacaaaccacaacaaugaccagcaaaggcaaaauaguuccaagcucgcaagacugauacuguguaucuuguggcaauccacagcuguccagccuaucugaaguuucaccuagagaauucaugccuuguagccggugauuguuacuuuguguagggguuucuuuauuccaccuuucccuacccguuuuccuuccacccuuccacccccuaacaccugagaagaaugauagcuaggaaaggaaagagaucccugaauaaagucaaggguuggaaaggggguuagacuacuuccugcugacuaggggugucaaguuccuuaggggcaaguuugcucuuuguugucaggauaucaaauuuguuucuuacaccuuuuuuuucuuuuuacacuuuuauacuacuuaacaaaccuugaccaacagcaaccaacaacccaccucuuggggggucuaguauuuauuuauuuguuuauuuuucaagacaggguuucucuguauaguccuggcuguccuggaacucacucuaugagcaggcuguccuuaaacucagaaaucugccugccacugccucccaagugcugggauuaaaggcacauaccagcacugccaggcuauuuauuuuuaaagauuuuacucucuauauaugaguauacuguagcugucuucagacacaccagaagagggcauaggaucccauuauagaugguugugaacuaccaugugguugcugggauuugaacuuaggacuucuggaagagcagcugguacucuuaaccgccgagccauuucuccagacccugggccuacgauuuauaugcccucugaaaagucuccagaauuccaaacaucacacaauugcacaaaguaucugcagcuggccaaaucaugcccugccagagaagaaagcaaaucaugguugcuguggacaaucugaggcagucccacgugccacaccugggauuaaaaugaaaacauucauauauagcccagaaaacaaaugaacaaguacaccgguaugccuagcuuguguaguugcuggggaucgaacccaggccuuugugcaugcuggacaagcguggcuaccaguugagucauauguccagccucuggcuugaaaucuaggucaggugcuucuguguacuggagcuuacacuaggauuucugcagcuuaaacuacaaaacaaagccuacccuuacuaugugucaauaauauggaaagacuaagugccugccugacauguuuuccaccucuggacgguacuggcagacuagauugcaaaauccuaguucucaguacuuaaagcaucaauucauaggcuuccuggcaaaugugaaaccacauuucuacuacuuugaaugcacuaccuuaaaauacguuuugcggcuuguuucauucuuaaccaguguaauuuuaggaaaaacauguauuagaugaauacuuaacccaggugaaaggcauaguauuuauuauuaauauauauuuuauuucuauuuauuuauuuaugguuuuucgagacaggguuucucuguauagcccuggcuguccucgaacucagaaauccgccugccucugccucccgagugcugggauuaaaggcgugugccacuacccccggcauuaauauauauuuuaaaaagaauuuauuuuauguauauggguauauuuguagcugucuucagacaccagaagagggcauuggaucccauugcagaugguugugagccaccaugugguugcugggaauugaacucgggaccucuggaagaguagucagugcucuuaacugcugaaccuucuuccauccagcccucauuaauauauuuuauuuuuaauugcuagugaaggguucuacuacugggguauaagucauaacccaguuugaauuuuuuaaaaaauauguuuaggcuuagaggaauugaacaggucauauuucucacccccuugcuagcacuaggaguuacuaaggugcauuuguuccaguuacagagcccuagagauaccuugcauauuucccuaguuuaguuuaagucuguuucuguucacuuaacucucuaggaaaccaccuaucuccuuaggcuucucuuggcuguggcaguuuccauuuccuugguuuuggugacauugaugcuuuugguacauucuagccaaauacaugccaccggccucccuuuggagguuuuucucauaaucauauugggguaaaguguuucuucugggaacaauucuauuucguguuauugaagacaauuucuaauaaccuuuccauguucaaacaguguguuaacuaaugaacugguucuguaacuacagauaauuucugacagacaaugaauucuaaguauauuuuaaagucuuuugacauucucuauggagucauuuuaugggcaugcgcucuggcaccacuuuaauaggggauaaaggacacauguacuaaacuaugucaagugcuuucuuguuuguccguguggggauucacagcaccgccuccccccaccccccauuuucacuggaaacagaaguuaaaaggaauuuaacaagugguugaaaacacuccacuaggagaaauacaacuguuuuuuuuuuuuuuuuuuuucaaggagggaaaaggccguuuguucugaacccuuuaguuguugguucaggauucccuuuuacucuuaaaacuuugaggaaucuaaagaacuucuguuauuuuucuccuuaccugagauucaacuauacaaaugucuguagugaggccugggcaccuggggucauaggugcagauuggcuucagccucuggcuggagaagcccacuugguacugugggcuaaaugcucucucuauucccucucacuauguagcucaagguggccuggaacuacuaagccacuugcccacagauccccugacugcugggauuacagugucuggcaguuagcacaguuccugagcucgcagugggugguguauguuagucggagcuccuaguugcagcuccucccaaagcuuccacuugcguggggcuuagcuauuaauauuuacuguguuggggacuaaacuugagaaauuuguuagcuauuaaccaucugaaaacaggaaucauggaaaaccaugugcauuaccauaaauaacaccuuguauugcuaugaaaauaguuuugacccgccaggugugguggugccugcuugaagccucagcauaugauaguaucagauauaugaaagggcaugugaggacaaauucagauggcgaauccuguuuccaucucucucucuuucucuccuuccuuccuuuccuuugugguuucaagguuuccucuccagugacuaucuucaggcuuuugagagugguaauggggaccuaggcaaccagagggggaagcccucauugcaucuucagaacaagcacagagcuuuguacggggacccucuuuaugcccuggcagacagcuuuggggaacuuagcaucuacuugcauauuggaguuccugucuccuucaugcaaauguucagguuuccagugaugagugcacuugccagugucgacuguauguucucaggccacgguuuugaugcugucgucacagcagccuuccuaacacucacuugggcaggaaccauccugccaggcccagggugggaagcaaguaucggagagaacguggcgagcaguggugccugguugauaacugaugcgucaacguguuuagaguuuguucaaucuggauggccuagguugccugguagugauaacuuuacuugcuaccacauaaaacacccuuuuuuaccuuuuccaaucagcucagacaguagagagugugcuuuccuagaugguuucccuaaacuuaaggcugacuccauuaugguccugauuaaacccagauucucuggcuaagaauuauuuucagacuuauguuuguguaugaguguuuugccugcauguguauaugugcacagugugcaugccuggugcuaguagaggucagaagaaagugucagauccuguggaaccaguuauggaugcguguaagacuucauguugcugcugggaaccaaaccuggguucuuugcaagagcaacaaguacucuuaacugcggagccauuucccuagcccccaaugugaagauucuucacaacuacgcugcacauuuaguuuuaacgguuuauugucauuuuuggauaaacagguaaaggaugguuguuccccagggaaucaugguccuauuucaauuacaugaccaaacuuccccugcuggcucuuuacgauuccuaaaacuggauaugaacuauaacuaaguagaauccucaggcuuucauuuaaaaccguguuuggaauauccugaaaaauauuagcuuuccuuaugauaaaugcacccucuuggcagaauguaacugaaggcuguuacuucauguuagacuacuccucugaggaaaaguucauuuuacaguuuuucuuaggagagauaagcaagaagccuuuuauaguuucauuuuauauaaacaaaguuguauguauguauguauguauguauguauguauguguggggugucuacaggcuggccucaaacucauaugaagauccaguuggcuccgaguguuaggauuaaaggugugggccaucaugccuggcucuauaaagaaagucuuuaaggcagugguucucaaacuuccuaaugcugagacucuuaaauacaguucuucauguugugguaaccccccuccccaauaaaauuauuucauugcuacuucauaacuguaauuuugcuacuguuaugcccccugccccuggcaggcuguggaagugggugagcuaacugggggcuagugcuggaaagcucacccuugaggugcccgcauaggagagcugguggggccgagcaacucagcuaccacccaggcccagauccagggcuuugaguuggccuguucacugcuggaguaugugaaaggccuguuccugcagaugcaucucuaagauacagggcaacauugggauauacaaaaggagcuccaguaaggauccaggauugauaguguagcagaagccagagaccuugaaccagaccagcgacucauugcaaugaacauucgcaaauaaagaugcaugggcaauaagguacacuuugggacacacacugauacacuacagcauauauauauauauauauauauuuuuuuuuuuuugggggggugaggggagaagguugcaggggcagagggguagacaugaacggacagggagaugagugggacuggggugcaugauaugaaauucaccaagaaucaacaaaaaguuaaagaaaaagaacagcuguagguuuaagguguccuaugguggugcucauaaacuggccaugugcuaauguucuaggaguuaggacuguaaagaguagaauauuaaccaauauuccuaagagauuagauguggggugaccagaagggagacauugacagugcagccuggcugugagucacagugaugacuuugggauagggaacugagaauguuuuuggcgaagcccccagaaagaaaacccaaguccuugaaggaaaguuguguguguggggagugggggcuuccgggaggaggggcccuaugagcugaaugcuaaggaggagagggguaggaggaaaacugccuguaacacaggcuuaggaaugaaggcgggggugggggugggggggugggagcugcacgcugcacgcugcugcaguagaaacccggagguacggaaaucaggcuccgggugacuuaggagaaauguccaaguucuuucaucugucuagcuucugccaaacgcuccagcagggcgcagugaauuauucacuaggauuuccuagccagccaugucccgugaaaagugcagccaguuaguacuccuaggcagccucacucacgagugauacuaguggcaggcuccgcccaaccugguggggcucucaaaggaaccugugcuuggugagcugcuaauucugcuuuuuaagagcagaucccccccacccccggcuugggauuucccaggguuuuacuucuuuucaguggugucuuuuaauagcuuguccuggccaaacugcugggauucaaguagcuuacccacuuaugaacugggugaguagaggcaagagaaagggacuccaaucucaggaauccucaucuguuagauguggcuuaacaguaacgguaucuaucucagagggucggcauuaauaaaaacacagucagaggcgccaggcacaguguuucugaugggcacuggcauuagucuugaagucauuuacuacaguuucacuugucaccauucagccccugcgauagagcccugcaagaccaauauguggagccuucaaacagcauguggccauaggaacuuauggccaaaugcaucucuuucuggcuuuaaaauuauuauuauuuuacauucucaggugacgugaccuuuucccauucuuagcucgaggcaaggaaugaaaaauuauuccuuagccauguaguguuagagcacaccuuuaaucccaguuacacaggaggcagagauaggcagaucucugugaggccagccuggucuacaaagcgaguuccaggacagccagugcuugguuacacagagaaacccugguuucaaaaccaaaaccaaaaccaaaccaaucaaccaaacuaacaacaaaaaagucuucccuuuccuccuguuagcaguuauuguaagcugugagggagaaaaacauacuuugaaacaacucaaauagguuuugguuguuucucauccccagacagaagccaugcagccaccugccuguccacaucacugucauuaagcauggagugaaaugaauacuuugacugucaagggcauucaaacguccagagaaggcgacuuucauguuuaaaaaaaggcccuuaaacaaugauagagcugccucucgaaagggcaggaguuaucauuccuguuuaacugugugaacaacacauauauaaaauauguagcagauaaauucucuagaagccucagccaugaauauucuugcauaauucguaaaacaaacaaacaaaaaacccaaaaugccccaaacaauuuccaaauucaugucaagcaugcuaagcaaagggacaguaauccuuugaucagcuaugacugaucaaaugucagguucucuaugucccucauuaucccacgccuuaaaacugugaagauuauagaccugggagagcucugcuauuuguaaagacauagcauuaguugaaaaccagagugcuccggggguaaacugauaacccauggccuacaaaaugauucguacaaugcccuuuggacagagacuugcagggccacaaacauugagcaacggugaccacucaaccaaaagaugcuagguacaaaguauucagauaagcauuacaaaggccucauauucccagagguuuaagcagcuuuugaaacguuuucuuauuuacagucccacucuagcacaggcuggccuggaacuuuuuuuuuuuuuuuuguagcuuaggagaauggacuuuaacucaaagcaauuccccugucucaugccccuaaauuuuugguuuccaggaccauguguagauuuugaucuaaaaaugaaaaaaaaaaaugcuguauuuguuuauaaaaugagggcuugaaauaaaaauauacaaagugaaaggcauuucacgggccaggccuguaucucuggcacagugcuugccugguaugcacugaggcccuggguucuaucccugggggaagggagaaggaagcuguaguaacauuagaaagcuacagguaaaaugacugcagcugugucccaggcaggccugguguacauaguaaguuucagacuagccagggcuacguaaccccgacacagaagcaagcaagcguuuagauacaacucagaacuaaguugccaaggucucugcuaucccuuaccuuaaauucuaacugggaaaugacagaaaagaaacagcagucaggcucucagacugaaaucacuaagcagucacauccaaggggaaaccgggccaagcaguuuaagugaaggucagguauuucggguauauagauauacauuacaaacagggauauuucaagguuaaaauaacgggaaaacugauuuuccuccuacccauacaaguaccucauuuuuguucuccaaauugcagcauaaauaacucucccccguuucuccuccccuucagguggguaggcguaaaagggcacccauuggcauggagccaaaaaaacgggcucugggaaggacagacuguucuacuaccuugaagaugcuugaacacauucaaagggaagaaggcaagcauaaaaaguuacguaggcuucgcucccaguuaguaugugccccggggaggugucugccguacuccaggagacugucucaaaucugcucuucugaggcccaaggaagaaucaggaguuacuaguucccguuuaggccuggcacuuucaguacaccuuaguuuaagaugacucauuugucuuuuuuuaaaaaaggaagucaguccucuugucuugcucacagcugcaucaccagcaacugguccagugccuggcucggagaaacuggguuacgaaauauuuuaaggagcaaagagccgacugaaaugcagggaaagauugauggcuuccagucaacagaaucucccaaggguuuaaaacaaagaaaguacauuacacuucaacccuuuuccauccaaaggccaggcuggucugucaggggauaggggaucaucaggcacuacuguggugacacugaaggaugcacuacgccaaggucauggaugcacaccggaucuggacgcccccagaaccuccuugcauguggucacauuuccccccgucacgcacgcugcuucuacacagcacuggcagauuuaacccucuggaccccgacagcuggaccuguugucccgcagggcagcuggucaaggacaugcgcgccccccugcaccacagccaaucagcgacaggcagcuccggcaccauagccaaucggcuagaggauggcccagcgccaccgcccacgugcucaccccuugccccgcaccccacugugcugaguccacaucugggaccccccaucacccgcuagaaugggauucugggugcagucgagaaccacaauucccaccucgggggcuacgcuggcccucuguccggagauacaggggagggaugagggguccuggggucaccccggggcgcagacacuggacucuaagacucgggacagucaacccuuggggacacacgaggugcgcacguguguccgaucgcgggguggggugcagguuucacaggguccacaguucggcugggcaggggcaggcccgcggugccgcugcaucucuguaucccucggcucaccuggcucuggcagaggcugcagcagcuaggccugggugaaaggcagcagccaucccggagaggaugcggcuggagugcaggagggccauggugggcgguaagacggcaguggauggugguagagccgagaucuggggaagcguccgcuggaaccgaggcgcgggcuccuaaaaggugaggacagugacuucccugggcguggcuagagcggcccugcgccuggagcgaaucaugucgcagcggccccuugcggucggggguagaacgacgacgccuccacggaggucauggaaacucgcaagggcacugcuaaucgcugccuauaaauccug

SEQ ID NO: 4680 - RNA, 2013 nt, Mus musculus
uaauuauaggaauuuaaagacauugaagauaugucugagaaaaucuacaguacuuucccccccaucuuaggaauacugcauauuagcaacaugcaaauucagguaaauugucccuguagagucucugcuuuguggcauucuccccaagcucuccuuugagaacacaccuuacauugggcccucuggcuuaccguacaggcccauguucuuggcauacgauuggcagaggcagacauugaugcccugcucgaugaagugccgcacggcccaggcauccuuaucaccaucaccgcuggcaaagccuugguaggccaugucaaagaaugcgaagagauucuuuuucugggaaggaaugagaagaccaguguuugaggcaggccaacugcugaugcccgacuaccguaugugcugugagcaccaugauugccuacuucacccccaacacagccaaccgcuucuucacacagggcaguaggggagaugucugaauuccaguuaauugaucaacauacuuuaaaguuuuuucuuuuuuaagacuuuuauggccaugguucuucaaaaagagacccuuaaucuuuggugcaggaggcaucccuaaggucugggaucuuacuuuugggcaggacuagcaucaaucuuucugauggggcacuguccuacacccagggcucacaagaugaccuuaugaagcgcucucugcuggcugcuucugggccuuacucugucgucugaagcugagauuugauagaagcaguaagaauggggggcagaggaugaugggaauauuucucucugggaauucugauuagugucuuucgucacaggcagcuccucucaaagaaaaggcaaugcuagcugggcgcaugccuuuaaucccagcacuugggaggcagaggcaggcggauuucugaguucgaggccagccuggucuacaaagugagcuccaggacagccagggcuacacagagaaacccugucuugaacaccgcccccccccccaaaaaaaaaagaaaaggcaaugcugagcaagcaaaagaggggacacggaaaugugccucaaaggacgagcaaauagccacugaucggaacaaauggaggagccaccggcaggccccugggccacaacagcugcugugccagagacaaauuuuugacaguuucaucagacuucacuauaucugggcugaaggauuauucacauaaccaucgauuaaggaaccccucccccucccuggagcgaauccacguguggguugggggcaggcucgggguuaagcaaccagcuccugacgcuucauccuccucaccuucaccacggacgcuaucuccuuccacugcucgggacgcggguccacgccggugggguugugagcgcaggcaugcaggaggaggacacucugcucugggauuuucuaaggagaaacaaucgagauuuuuggcugugcagcuucaaaggaaacagccgacacacuacaggucacuguuagccgagaagugagaaggagaaccuaggagucaguuggccuccucuaagucagacaaugaaaguggcugggagacaccagaagucgggccuggaaagccacacuuacugauaugucuucuagggcuccagagaagucaaaaccgcaagucuuggggucauaguagcgauaaccuuggagcugcaugccggcaucccugaagaugggcgugugauuuccccaggaugguuugggcagaaagacaucucggcugaacuuaaaaaaccuuugcuaaaagacgggauaaaagggaaugagaaaaugaagaaagagaacaaaaugcuaaugcuuuccugagaggaaguguuuuguuuguuccuacuggcuguagcaagauggccuggguuggaggccaggcucugugaauuauucuggcugagguaaaacaccugugcaggccccaccaccugaaagucccuuacacgggaauuugcuggcuagucuuaugucaacuuacacacacuuaaaauuauuuauauuguuuuacuua

SEQ ID NO: 4681 - RNA, 691 nt, Mus musculus
uagggcauaaucugcuaaucucacaaguuaauacucacaacugccccacaaaauaugccuguuguccucuaacagggacaugaaagcauucugaaccuugagagacuugcacuuggggaaacuaguggguugaaaggaaaaccacacuggagcauuaggaaaaaaaaaaaauacuuccucgggucaguuuacauuuuuuuccuucuuucaaacuggcacgcuaggcagcugccucuagcguagcggaugauuaacuggaagcagagcgcugagcacuguggacugcgcauccucacauacaagcuucacaggauuuauaggcagcgauuagcagugcccuugcgaguuuccaugaccuccguggaggcgucgucguucuacccccgaccgcaaggggccgcugcgacaugauucgcuccaggcgcagggccgcucuagccacgcccagggaagucacuguccucaccuuuuaggagcccgcgccucgguuccagcggacgcuuccccagaucucggcucuaccaccauccacugccgucuuaccgcccaccauggcccuccugcacuccagccgcauccucuccgggauggcugcugccuuucacccaggccuagcugcugcagccucugccagagccaggugagccgagggauacagagaugcagcggcaccgcgggccugccccugccc

SEQ ID NO: 4682 - RNA, 1598 nt, Mus musculus
uuuugguuuuuuuuuuuuuuuuuuuuuuuugccuuuaggaacacuuuuacuuggaaaauuacaacacuaguacaagucaagucuuacaaauuuaacauuugcuuguugaaagcaauucauaauaucaaaauuaaucguuuuacuuuuuccucacaagaacacaaaaaugaagggaaacuuaaaacagaaaauuuaaaaagucacaacuuuucuuuuuguaguccuuguguaguuaugacagaagacuuuccaucuuuuguuucuuugcauggagaccuugauccaaagucuuauuuguuucuaauaucugcuucugccucccccucuaucagaucggcucccuccauggccaucuccucuuggcgcuccucggcuugaacugcuguaggaaucacguggaggaggguacccccuuuccauagaagggggaagcccucguucuugucugccaacucgaucacggccacuugaguaacugucucgacuuccaccguagccaucacgugagcugcuguaaucaucauagcagcuccauaagauggugguggcccucguguagggggugcacugcgugaguuuccauaacucucauaugaaucucuguaggaaccuccacuuggaugaucugaauagucacgauuccgaccauauccaucucuaucaccguagccucuugauggauagucaucacgggaacuggaaugacuguaaucacgguaaguauaaucucuugguggcggugcauaaucucuggugucucgggagcuuggguaaucuuugcuugaauagcuaucuuuuguagaauauccaucaucucuuggggacaaauaaacaucucugcgagaugguagggguuaccuucgugguggacccccguagcuaucucuuccacgggacacugguguucuuccgcccauuccacugcugcuucgaacugguccggaagguguugaucuuuuaggagggggacccccgcuucaugguggugguccucucuuuacuggaagugguccccuggaagaacucacguuaaaguucauggaauaaccaccaucauccauguauccuccacgugaaggggguccccuaguuccuccacuuccuccucgaagaccucugggagggccccugcuucuuggagguguaggugguccacgccugccacuuucaaaagaugguuugguagcuugcuccaccuugauggcuuuuccauccaaggacuuuccauucauaucucuagcugcaucuuuagcaucugcugggcuuucgaagguaacaaaagcaaauccucuugauuuguugguuucccggucuuucaucaaaaguauuuccacuauucguccauacuugccaaauacugcuucaagggcuuucucauuuguuucuguauuaagcccaccaaugaagagcuuuccugggcgaucugcuucaaccaucuugccuuccagcugagagucggaggggacgugaaggucucaagcuccuccuacaagcucaccaaaucggccuuccaaguagcucaccggugacagccacggggcuaacgcuucccuaacuaggaagccgcuuucccgcgccggucgccacacgcgucuucu

SEQ ID NO: 4683 - RNA, 1598 nt, Mus musculus
agaagacgcguguggcgaccggcgcgggaaagcggcuuccuaguuagggaagcguuagccccguggcugucaccggugagcuacuuggaaggccgauuuggugagcuuguaggaggagcuugagaccuucacguccccuccgacucucagcuggaaggcaagaugguugaagcagaucgcccaggaaagcucuucauuggugggcuuaauacagaaacaaaugagaaagcccuugaagcaguauuuggcaaguauggacgaauaguggaaauacuuuugaugaaagaccgggaaaccaacaaaucaagaggauuugcuuuuguuaccuucgaaagcccagcagaugcuaaagaugcagcuagagauaugaauggaaaguccuuggauggaaaagccaucaagguggagcaagcuaccaaaccaucuuuugaaaguggcaggcguggaccaccuacaccuccaagaagcaggggcccucccagaggucuucgaggaggaaguggaggaacuaggggacccccuucacguggaggauacauggaugauggugguuauuccaugaacuuuaacgugaguucuuccaggggaccacuuccaguaaagagaggaccaccaccaugaagcgggggucccccuccuaaaagaucaacaccuuccggaccaguucgaagcagcaguggaaugggcggaagaacaccagugucccguggaagagauagcuacggggguccaccacgaagguaaccccuaccaucucgcagagauguuuauuuguccccaagagaugauggauauucuacaaaagauagcuauucaagcaaagauuacccaagcucccgagacaccagagauuaugcaccgccaccaagagauuauacuuaccgugauuacagucauuccaguucccgugaugacuauccaucaagaggcuacggugauagagauggauauggucggaaucgugacuauucagaucauccaaguggagguuccuacagagauucauaugagaguuauggaaacucacgcagugcacccccuacacgagggccaccaccaucuuauggagcugcuaugaugauuacagcagcucacgugauggcuacgguggaagucgagacaguuacucaaguggccgugaucgaguuggcagacaagaacgagggcuucccccuucuauggaaaggggguacccuccuccacgugauuccuacagcaguucaagccgaggagcgccaagaggagauggccauggagggagccgaucugauagagggggaggcagaagcagauauuagaaacaaauaagacuuuggaucaaggucuccaugcaaagaaacaaaagauggaaagucuucugucauaacuacacaaggacuacaaaaagaaaaguugugacuuuuuaaauuuucuguuuuaaguuucccuucauuuuuguguucuugugaggaaaaaguaaaacgauuaauuuugauauuaugaauugcuuucaacaagcaaauguuaaauuuguaagacuugacuuguacuaguguuguaauuuuccaaguaaaaguguuccuaaaggcaaaaaaaaaaaaaaaaaaaaaaaaccaaaa

SEQ ID NO: 4684 - RNA, 1707 nt, Mus musculus
uagcacuaaagugaauuuuuuauuuuuuuuuuauuuuuuuuucccaaacuuuuauugaaaaauucaaggcauauacuggaucuguuuucagaaaagccguuucucguacgaauggaggcuguggacgccaccuuccaccugagcagaggauguccucuucucaaauuuaagcucccccgaguacaucauggcucugacuuggguuaaacucuuggcaccaauguccugacaggaaugcuggaugccagcaaucagguaaggaacgaacuuguggauagaccccuuguccugcacugccccugaaacuccuugggccacuuugauuuugucagcuucacugaaguaucgguucuggcugcugagauguuuguccauggcaucaagagaacccauaccucgguauuucuucagccggaucccaucugagaagaaguacucgccaggggccucagugguggcagccaggagggagcccaucaugacuguggaagccccaaaagccaaagcuuuggcaauaugacccacauuuuggauuccuccaucagcaauaacaggaacaccaaagcgacgggcauacucagagaccuuguacacugcuguggcuuggggccgcccacaggccaacacuuccugggugaugcagauggaaccacuucccaugccgacucgcaaagcaucuacaccugcaucuaugagguucuuggcuugcgcagcagugacuacauugccuccaaugaccugcagacugggguacuucuccuugauguauuugaucauauugauuuggaagauggaguuucccugggaagaguccaaaaccacuacauccacaccagcaagggccaguaaguccagccuauacuugucauccucaugagugccaauggcugccccacacagcaguugcuucuuggcaucuuuggaggccaggggguaaucacgauucuucuuuaggucuguccgggcaaugauggcuaccagcucaucauuuucauucacaaugggcaacuuucccuuuuuacuucgcugcagaaucucauuugccucuuucagagugacgccggcaggggcgaccaccaaaucuucccucuuagucaugaucucuuccaagaaccggucaugcucuuccuccuugaggaaaucaaugucccuugaggagaugaugcccaccaaucgacuccccauccggccuguaucugugauggggauaccacagaagccaugccuggcuuuggccucaaaaacaucgcguacacgauccuuggggcuaaggaccacggggucagugaugaaucccuguucguauuucuucacuuuccgaacuucauuggccuggaauucaggugugcaguugugguggauaaaaccaauaccuccuguaagcgccaucgcgauggccauuccagccucugugacaguguccaugggugaggaaaccaauggggucuuuaguguaaucuucuuaguuagagcagacgucaaguccaccugaucugcagugaagucgauauacccaggaagaaugagaaaaucauuguaggugaggccguccccgcaguugaagagcugcugcgcugugagcccgucguccggcacguaagaggugccuccgcuaaucagguaguccgccaugaccacggaggaagacagacgcguggcuccgagaaccgcgccgcuccgaggaccgcgccgcagaggccucuaaag

SEQ ID NO: 4685 - RNA, 1150 nt, Mus musculus
acaucuuuuuuuuuuuuuuuuuuuuuuuuuuuuuuuuuuuuuuuaagagaaguaagccuuuauuuccaucuuucucaaauuaagcaggcugacuugguugcuuugacggauuagucgaagagaccgaaucccauauccucaucugauuccuccgacucuuccuuugcuucagcuuuggcaggggcugcagcagccgcaggggcagcagugguggcagcagcugcaggggcagcagccgcaaaugcagauggaucagccaggaaggccuugaccuuuucagcaagugggaagguguacucagucuccacagacaaugccaggacgcgcuuguacccauugaugauggaguguggcaccgaggcaacagucggguacccgaucugcagacacacacuggccacguugcggacacccuccagaaagcgagagugcagggccugcucugugaugucgagcacuuccggguuauaaaugcugccguugucaaacaccugcuggaugaucaggccgaaggagaagggggagauguucagcauguucagcaguguggccucgcuggcucucaccuugucuccagucuuuaucagcugcacaucacucagaauuucaauggugccacuggagauuuucguggugaugcccaaagccuggaagaaggaggucuucucgggccccagaccaguguucugagcuggcacagugaccucacacggggcgauggcaccagcccgagcagcagcuggcaccuuauuggccaacagcaugucccgaaucucagugagguccuccuuggugaacacgaagcccacguucccccggaugugaggcagcaguuucuccagagcuggguuguucuccagguggccccugauggccuugcgcaucaugguguucuugcccaucagcaccacggccuucccucggagggacaugcggaucugcugcaucugcuuggagcccacguugucugcucccacaaugaagcauuuuggguaaucauccaaaaguuggaugaucuugaggaaguaguuggacuuccaggucgcccugucuucccugggcaucacggcggugcgucagggauugccacgcgggguuuaaagacgaugucacuccaacgaggacgccuggcgagagagcagccaacauc

SEQ ID NO: 4686 - RNA, 1111 nt, Mus musculus
uuuuuuuuuuuuuuuuuuuuuuuuuuuuuuuuuaagagaaguaagccuuuauuuccaucuuucucaaauuaagcaggcugacuugguugcuuugacggauuagucgaagagaccgaaucccauauccucaucugauuccuccgacucuuccuuugcuucagcuuuggcaggggcugcagcagccgcaggggcagcagugguggcagcagcugcaggggcagcagccgcaaaugcagauggaucagccaggaaggccuugaccuuuucagcaagugggaagguguacucagucuccacagacaaugccaggacgcgcuuguacccauugaugauggaguguggcaccgaggcaacagucggguacccgaucugcagacacacacuggccacguugcggacacccuccagaaagcgagagugcagggccugcucugugaugucgagcacuuccggguuauaaaugcugccguugucaaacaccugcuggaugaucaggccgaaggagaagggggagauguucagcauguucagcaguguggccucgcuggcucucaccuugucuccagucuuuaucagcugcacaucacucagaauuucaauggugccacuggagauuuucguggugaugcccaaagccuggaagaaggaggucuucucgggccccagaccaguguucugagcuggcacagugaccucacacggggcgauggcaccagcccgagcagcagcuggcaccuuauuggccaacagcaugucccgaaucucagugagguccuccuuggugaacacgaagcccacguucccccggaugugaggcagcaguuucuccagagcuggguuguucuccagguggccccugauggccuugcgcaucaugguguucuugcccaucagcaccacggccuucccucggagggacaugcggaucugcugcaucugcuuggagcccacguugucugcucccacaaugaagcauuuuggguaaucauccaaaaguuggaugaucuugaggaaguaguuggacuuccaggucgcccugucuucccugggcaucacggcggugcgucagggauugccacgcgggguuuaaagacgaugucacuccaacgag

SEQ ID NO: 4687 - RNA, 266 nt, Mus musculus
aaugggagaaaaggaagugaagaagaaggagaagaagaagaagaagaagaagaagaagaagaagaagaagaagaagaagaagaagaagaagaagaagaagaagaagaaggagaaagagaaagagaaagagaaagagaaagagagaaagagaaagagaaagagaagagaaagagaaagagaagaagaaaaagaagaaaagagaaacaagugugcccucucauuuauccagguccagauauuuuaugaacaauauggcauucucuaau

SEQ ID NO: 4688 - RNA, 551 nt, Mus musculus
cagcccucaagcugaugugaauaaauuagacuuagaaaaggugggaaucucucaauaucucucucucucucucucucucucucucucucucucucucucucuccuucccuuccccccccccagcauuauucugaaacuccuauguugggauugugaccccgagcaucauucuccauuuaaagucaaccuacccucugacuggaaccccaggccucccugccaugugacuuguguugcugggguucagauauucaguguucuccugcauuaaagacuugguccccaggaaauggaaaaacgauagaccguuggaggggagggggccuucucaggaagccuuuaggucauugacagaauuggagguacccaagucucuuccuuuuucccuuucccuuucaucucccagaccugugccugaaguaguuuugcucagccacgcuucuugccauaacguguuaaccucagcgcagauccagagcaacgugaccaacugauccuucaaacgggaaccucaaaaaccaugaacccaaauaaaccuucucuucucuaag

SEQ ID NO: 4689 - RNA, 551 nt, Mus musculus
cuuagagaagagaagguuuauuuggguucaugguuuuugagguucccguuugaaggaucaguuggucacguugcucuggaucugcgcugagguuaacacguuauggcaagaagcguggcugagcaaaacuacuucaggcacaggucugggagaugaaagggaaagggaaaaaggaagagacuuggguaccuccaauucugucaaugaccuaaaggcuuccugagaaggcccccuccccuccaacggucuaucguuuuuccauuuccuggggaccaagucuuuaaugcaggagaacacugaauaucugaaccccagcaacacaagucacauggcagggaggccugggguuccagucagaggguagguugacuuuaaauggagaaugaugcucggggucacaaucccaacauaggaguuucagaauaaugcuggggggggggaagggaaggagagagagagagagagagagagagagagagagagagagagagagauauugagagauucccaccuuuucuaagucuaauuuauucacaucagcuugagggcug

SEQ ID NO: 4690 - RNA, 16960 nt, Mus musculus
uguguguggcccugggcagcucucagccugccacauuuugagcuucagcuaggacaggauuuggaucuaaagguacaugcaccccuaacuccucuucuugagcccuccauguuuucaucagcguuuugucaguguggacauuggaaggguggaaccccaucagcuaugagcuggccucuuggggcuuucuccuuucuuguagcucaguuuagcacugagaucuguuccuagggcuuccagaccuguuccuucccugggacuggcuccugguuugucuuguggcugugcucccuucugaaucucccuugucuaggcucuucuuguagcuuuuccaccucugcagcaugaauccaagcugcugagccagccagcagcaaguuagccccuccaauucuucuaucuucuaccuuccuaccccauuuccagccaugaggcaucuuaaugguuucuaaaaugcacaaugcuuguccuauacccaacgugcuggaguguccuuccuaguuuugcucucugagugagugcagccccuggccaccuccuccaugaagucuuccaauugccaccaacucccagcccagccucugcuuccuagccugagcauucucuucccagaaacauccaggcuccaacucugaccuacagccuaauguucggguacaugaacucaagguaggucuggagucuggugguguagaaucccccagugacucagucuccuauccugaaacugcuucugggucucucuucacucucagggcuuaaaaaccauguauauuugcagacagcaccuugggugugucagagcaaaugcuaccugugguuuaacugaacaaaaaaaaaaaaaaaaauaaagcucuugcuuauucccaaauagccccucuuacagucauccuauugcuaaaucccacuaaaaucugaucuuuuaggacaaugaaauaauuuucccuucaggucuucagagagaaaacacauaucccugagccgugagccucuuaaggcaaggcugccaaguuaggcuguugcuacucaccucuucccauacccguggcaggcaucacuaaucaaucacacuguucauuucucuguaauacaacuuuugagauagagacuucgaauaaaaccaaaucuuguuugcaauuugaaacugauuugcuaggucauuuaaacuagcucucugucuccucugggggaggcccaagcaucagacagaggacucuuucagccuccucugagcauccugacuugggguggguugguggagcaauuguggggcaucacaacaagguccauguuugucuguuugagccugaccuguggcucgugugcucuguggucuugggucugugcuuugcccucucugggcuucaguggcugcaucuguaauaaaggcaacaaacacugaaucccugggcaggaggacuagaauauacacagugaaccccaauauacacagacagcgcucccagauaugcaggugucuugaccuccuccucucuggucugugcauuccaccggcugccucacaucugaccuaauuuccuggucuugccguaggcucauccucccauuuccuuguucuucuccagggguaaauaucacucaccacuaucuguccaccccugagccccauuucucccuccuggccugugcaucugccaggcagucagaaucauccucugacacgcagagagacgggagaccaaggcugaguuuaugggagcugugcgagucuucccagaauuccagguucccacccuuccuucaagaaguucucuguaauuucuccucucaaugccaacuuagagcaggguuaugaugaacuuuuuauauuucuccaacaacaguagaaccauucucuuagggcaguucccaguuuauccuuauacuggcugugguggucuaaauuguauaugauugccucuucucuaaauuucaauauagaguauggcuauggggucagcccuaucccuuucccacuuuauacuauguggccacaugucuggcuagccucucuggauuccagaggucccaucagucacuugggaauuauucaugucaacugagggggugcuaaggaggugauggaagcaaccagaaaugguccacucagccagggguugagauuuuugcuagaacgguggcuggugucuccgagguucccgugcaacugugacucaucuaacuuugggagaaaaaaaguguggcccuucaggcuuccugcucuauguccgguucuuguuuagcugcacaauggucgggcugagacuacgggguaggcagguuaaccccuucaagguacugggaacuucuucuagcuccuaauugugaaaaguuagaauuugaaggacugcccugaggaucagcugccccuggccccuuggggucaccugguacuuuccaguccgcaaauggcugggcucaggccagaugcaggagaguuuugugucuuucuugcccacuaauuguucugggcugucaaaauccucucugcgacucagcauucaacccaguucuaaagaacccagaacccaccagccucccagacccuucaagcuuccaaccuugaagucauccacugucauuagagucuugcuugccugccacauuccuccagggguaacuaaugaacgcagaugcccggaggugcuugcagcagggguagcuaaguauauggccucucuuacucuggcccuuccuuucacaugggugagacccccuaacaggaggugugagacuugugcuuugugguuucaaaucuuugugguauucacagccaccuauggcuaugggguaguggguaaauccacucaggauucccuggcuaucuaucugccucucauuaggaguuaagcccagagccaagaguguauaucacaaguaaggacugaagauguuucuacaacuuuauggucuagaagccagagaccccauguagucacagguuccaggaagagcccgugcugaggaggacuaaaucuaaguucccaucgucauucugacucaauuuucacacuaacucuccucuggaucucuguuguugucucugaguacagaguuacccuaucuaccuccuugggacuggauaguaaauccaggagccauuguuuugucggaauauucuuucugcaugaaccaucuccaccgcucaccacagauugugaauagaauugcauccaaaaauguccucuccuaaugaagguuuggagaccuuagguuaccgucccaaggccacaccgaagugaguaggcugggaucagugccgagggucacugucucugagcugggcuuuuggcucagagguccuugucucuagggccuuccagagacuuugcugagcuguacggccacaagaauucuugagcucugggcucugaguaucugguguugggggagaaacuacaggcuaccuuccugccugcaacugccgaaacacaaagcaggcucugagagucuaggggagaugagggaagagggcucauaaaugggacuccaagugcccagagcugaaccucagaaggcccaucuugaaagugggagauauugacagagggaacgaguaccccuuucagcuccccaaaucccacccuagucccucgagguguuguagguagagauaacggggcaggggaauauaagucagaccuugggaaaucuaucucuuuagcucuggaccagauuguccuuugggcagaaggcagagcuaauccugguagauagggaagggaaucacagagccguuauuuguccaucccacacaaagcagauccuacucaaauccaagguccagacuccaguccucugcccuuguccuugcugagugacaguggaaauccuauccucuuugagccugguagucauagaagcuccaggucacuggaguuucccugaguacgacagucuacuuacaaggcugcugagucuuucuugaacauugguucugagauaaccguuuguguccuugcacacuaagagauaugcauuuuuuuuagcccuacccuggccccagcagagagacucaggcuccggagaggcuguguucccuugagaguccuacaguggccaucccauacgggcaagccaggacucucccaguuuuaucuccaugagacaggaguagagagggauuugggagucucacuuaccuuguccgugagcagaaggcucucuccacugcagucuguccagggccgagcuuuguggagagcacaguugauugccucaggaggggagaggggagccacacccaggcugggagggaggcagguuuuccaacuggcccuggcccacuuccccucgggaugguuuccuguuauuguuccuuugugagcugccugcagauaggcaagcccuacggugggcggccucagcuuggucagccugggcccguggaagccuuggaccugccugggguauucaacucauaccucaauucuaggucucaucggaggagcugugagccuagggguagcugugggggcucuaagcuucugccagagcauucagccaucccugggaggcaggugucauaucccccacuuuacaguucagaaagcagaggcuuagugggucuaagguacuuguuuccucgcuggacagaguaacccagacagaaacccagcuaccucagcuucuccacagagccggcuuuccguggcgacucuguaguaugguggaacgaaagggggcuguggaguucucagagucgggcagcugagaaacgugacagacaaucacuuucagcagcagauuuugccugucagauucuuccagguagggcagugugaguuucaguuccaagguaccagccuggcccaucucacuuuacaaauacugggugaugggcuucacgugaccauggaccaaccagggauccaugccucagucuccucaucuguauaauggagauagccauaggucugagucagcaaaaaaguaagaagagcuaagaagacagcaaagcaguagguagaccagggucccucaggaccaagaggcuggggagaugaggucaagauucucuucauucagccaggcgugguggcgcacgccuuuaaucccagcacucgggaggcagaggcagguggauuucugaguucgaggccagccuggucuacagaguguguuccaggauagccagggcuauacagagaaacccugucucgaaaaaccaaaaaaaaagaaaaaaaaaaaaaaagaaaaagauucucuucauucauuaugugauggguuaguaaaaauuucaggguucuggcucagaguaaaugacagacccccagaguguaccuuuuggcaaauugccuggguuucuucaugcauaaaaguuugggaaguccccaacuuguccugcuuuucagugaggcaaagagggaccauaagagagcagaucuuuccgggcauggagaaaauacuguggggguaggguggggugugguggggggaagaaaggguuuucuguuugggguagguaauguuggagaugcccauuagacacccaaguagagacaugggcuuggugaacgaaagcaaaguugguguagccaaucacucccuccagguccucugagaacugaacuggaacggaggcccagggaaaggaguguacauuaggauggaguauuagcguccugagaccaugugaagacagaugaggacaucagaguaaggagagaggccagggaacugucgcuggggcuguucucagcucugagcggaauccauagcauucaacuacugcgugcgugcauucgugcgugcgugcgugcgugcgugcgugcgugggcgagugcgugugucugugaacaaacagaagcuccacauuuuccucucugccacaaucuguucuguucccugcccucaaggugggcuggcccagcauagacagcuuccccgagagcugccugccuugguggucuguguacucaguggacacgucugccaggguagcacuucccgcugggucucauacucagcgcuggcaggcugccagggacagggccuguccggccaucaaugcaaacuccuuuuguacucuagcccugguggauauuucugccccgaacacagucauuguugucaucuguaaacaguaaacgauggacaggcaagccuuggaugugccccggacuccagggauggcaguggaggucuucauagcagaaguucagucccaaaaggccaggcuagugcucuucagacccccuguggauccaauaccugauuucaccccuuccucacccuuccuccucgcacuccaagcccacuggagucagagaagguacugggaggagggcgcaugcgcagggaguagcacugagcgugcuggaggcugccaggaagacaggaaacacgauggucugccagagcagauuagaugcaagcuggagaaggaagugguauaaggggccaggggacgcucaccuaggcuagcgaacucugggacuagauccugucuguguguccuagacucgccgauuggcuucucugagcagcucuccccgucucugaaaugaccuucaggccacacuuuucagggcuaggaggucagagggacacuggcaaucauuaacacaaguaaggcagacugaauaugugugcuucauaugcgaguggucucuggggcaggaugaugcuucaguaccuaagagcaucaguugcucuuccagaggaccuuguuucugcuacuaguaccuuucuggccacaaauaggugucuguagcucugguuccagaggaucuaaugccaucuucuggcucccuccugcacugcaugcccaugguugcacagauguauagagaggcaaaauaccaauaugcauacaauaaaaauaaauauauuuuuuuaaugagcaugguccucaagccucaggaucauuaggguggagagaggaguuggaaaugcagaucccuugcccucaccugagguauguggagacagaauggcuggagaugaacccccaauaucuacagucuggcagccccuuaggccuuguggcugagcgcucacauugaggagcucacgcgcggggcucccagcauuccucccagccccucccagcccacugcugccuugccugggagccaagugaucagcuguaucucguuuggccagcauuacugcuagcuugucuuccugccuuggucccuccccuccccuccccuccccuccccuccucucuuucuuuuucucccuuccuuccucuuucuccuccuuccccucccucuccccucccccuccuccuucuuccccccccccccacccuuuucccccagauagcccacaggcugggcacuaacucaugaucuuacugccucagucucucagauacugacuucacaggguuuacaccagucaugccuggcucuugaugcccuuuuguuuugucuuguuuuugccagugugggcugacuacuugguacuccugccugagcuuagugucgcugaagaacagggagcagaucuccuucggagaaguugucugguggcagcaaaccuccccauagucucucugcagucagguuuggcugcuccaaauuuucccuuuucuucauaugaugcuucugauaacagaagcuauucugaggcuccuaguacgacuccuacugugugccucuguguccuaggcuuuauaacuucucucagauaggauggccuugagagcagggguuggaucuaaucuauuacagcaccaaguauugcuucauguacuugugccuagcuccaacuaagcuccuuccuggauaugucugccuggccuugcugaacacaguaguucagcucaggauggccacacaugcuuccugccucugagcauuugcccaagcuguccuuuucuuccgagaugauuuuccuucuucacugugccagccaaggguugggagcaacccuuuaaugcucagcccaaaagcaguaccuuucaccuagucuaucugauucccauucccauuggaaaguccucccccaccccccaacucuaguccucaucuguccaguggcaaagccugcccccagagcucugugaugguuccucuucacuggcaacuugacuagauuuggagucaccuagaagacaaaccucuggaugugacugugagaggauuuccagagagcucucacuaaggagaaaggcccaucuuguauacgggcagcaccagcuuaugggcuggcaucccagacugaauaaaaaacaaaaacaaaaacaaaacaaaacaagcccagaccaggaaggagagagccuuuauuggaguuucuggaguucucagagagcugucacucauugaauugccugugagaucuggagucagucacuccaaaaguagauggagguagccugggccaccaggggaagauccugcaguuaaggaagcccugggccugcugcucucauccacugagcuccucugcccuggagaagcccacuuguuagcuuauuacaguucauggacaccagguccacaauguaggcuaacagaaacuaugucugcuuucuguguuuggauuucaguccucucugagaagugccaccggagcucaguacaguggcacuguuugucaauaucuucauuucccuagcucugugccaggcucaucaucuagaugaacuugagccacuuggaagggacccacacugguggcugcuuucauacuagguauugucagagagguggccugaugucccccaagcagcuuugaaaccaugggcucaaacuaagagguucuguuuuaggaagauuguccuguguagguuuugaucccccauggggugguuuugugugugugugugugugugugugugugugugagagagagagagagagagagagagagagagagagaacacgagagagcgagagagcgaaggcacacucucgagagcgagcaggguggggggauggggcaugaucuugaccaccgaagaggccagaggcuaaggcaguuaacgcugcagccucaggagccugaggaggaagagggguguugggcagucugucccaggccaggaaggagcagagcaagaacugcauuccugguggugagaacaauggccauuagagcggagggggacuagcuccucugagagcacuuucccagcugucuugcuuucucucagacauccuuucaauguuguugaggaaguggugccagaggaccaaggacccugaagcuggaaaguccaggcugaaaaggcucagcgcagagccugacaaggacuggcugggaucggcuuucucaaccuuccuaaagccacgaucccuuaguaccauauuucauguuguggugacccccaaccauagaaguauuucguugcuacuucauagcugucauuuugcuacugcuaugaaucauaauguaaagaucuauguuuucugaugcucguagguuaccccuguuaauugguuguucagcccccaaagggaucaagacccagaaguugaggaucacucaucuggcugccccagaccaacccuguagcuuuuacugucuuauuuucccuuucuguacaauggggagggugauugugugccuuccucauggguuguugggagaaguuauugagaauauuuaugcaaaguauacaguaguuacucaguaaguugggaaugagacagaagagguguuaauggagacaguggugaguguauauggaacuaagauugugcacauggcauuugucugauaaugugaaugugugaggccagccacagagcauacaagguauuucuguggccauaugcaguacuuggaguguaaugguacacugaaugguauagcugggaccagggagccccaaaucuugggcauuauucuccucaauuccucuggaauucccuucccaggcuagcacacagacaaagccuccuguaugccgucuccuuaagggcccagaaaggggaaagcauugauugggggugguccagcagcugggcaggacagaaugagaccaaggaccugccuuccugucuggagggcaggcgugagucuggcagagcuuggugcccggaagcugaaccuuccggucuccagggccuacauucccuuuccucucugucaaagcauccuggagaacaauggguaggagccuuccccaucuguggggcaggaagguggaucuggccuggccagcuugauggggcaaacagacucgguccuacgccaguuucucauccaagcaagucuuccagcucgguuugcaacuuuucccagacgcuccacugcuccacucggcgcagugcacaaagccuccuguggccugaggccuguccuuugagcacagugaggccagaggagaggcagugugagcugagcuguucuuccugcaagugcagcugcuagggagagccaaauggaaccaaauccucaggaugguuugggucuugaggaucgccaguggcccccccccccccuccaugucacugagacggaugggaaagcagacauaguuucuguuagcuuacauuguggaccugguguccaugaacuguaauaagcuaacaagugggcuucuccagggcagaagagcucaguggaugagaacagcaggcccagggcuuccuuaacugcaggaucuuccccugguggcccaggcuaccuccaucuacuuuuggagugacugacuccagaucucaccggcaacucggugagugacagcucucugagaacuccagaaacuccuaugaaggcucuccccuccuuggucugguuuuccugaaacugucaccaagcccagaggaggagccacaggugacaucaaagaggggcaggacuugagguagcacuaacagaggcaaggugaaaggacaggcauucuaugggaaccugacuuccuugaggauagucaggucaacugagaaggaagcaggguucuuuggucugggcagaugccugccucaugggaugguauucugcaccccuccuccccucccuaucugagauccuggcuuccucugggugggauuccccaaccugggucagagacaucaucucucagacugcuguuuucccaaccaucacacugcugucaggucacaggguauuuauuugcaaaggccaccuucgcugccugcugccuggaauuccacuccuagccucuccagccaugaguguguguguguguguguguguguguguguguguuguggguacauguuggaaguugacauugggugucauauuucuuuccgcuuuuuguuucuuucugacacagggucucgcacuaagccuggagcucacugauugggcuugauuacauacugagcagugugagccucaaggauccaucuauguccaccuccaaguugggauuaugugggugcugggaucugaacucacguccuuaggcuugcauagcaagcaccuuauugaugcagccaucucccugucccagacuccuuaacauucagccuaauauguuaccuuguuaaaaacauaacagcuuugggcugaagagauggcucagugcuuaaggguaaugacuguucuugcagagguccugaguucaauucccagcaaaccacaugguggcucacaaccaucugcaauaggaucugauugaugccgucuucuggugucucugaagagagugacagacaguauacuccuauacauaaaauaaacaaauaaauaaaucuuaaaaaauauauauauaacagcuuuauugaacuggaagucauauaugaagcucauccuuuuauuauaguauaggauucaguguguguguguguguguguguguguguguguacucacugauccucaguacuuaaagaguacuggcaucaccuccugaagaaucccaaccccucccccagccccuggugguaaucuuucuucugucacauggguuuucacacaaauggacucauguguaugagguggccuuuugugacugguuucuuucacacugcacaauguuuucaagggccauggugauguagcaugcaucaguaccccuacagagcauggucacuguaucggucuacccuaguugguugguccauccaucagcugauagauaucuggguccuguccucccuuucaccaucaugaauaaggcugcucugaacauggcugugcaguguuuuuugugugaacauuuuaaauucuuccagcacugcagaucuaacaguggauuuacggaaucaccgaacucgcaacuccguuuugaaucuuuauaggcuucaucaaacuauuuucccaagcagaggcgaugauguuucacuuugguguuucucugccucuucacugaaugcaugcuguuaucugucuuuuauuggacugcuccuggugggcucaaagucucauuucauugugauuuugauuugcaucucuccagggacuuuucguauguauaugaauaugcauagcuucucugggaaaauagcgacucaaaucgucugccuuuuaaaguuuuaauuggguuguuugcccgauuguugcuggguguuaaagaguuugcaggaacuggggaagguagcucaguggaugaguauuugucuagcaugggagaagccacaauucaauuucuagcacugggcugcuguugcuucuucuucuucuucuucuucuucuucuucuucuucuucuucuucuucuucuucuucuucuucuucuucuucuucugcugcugcugcugcugcugcugcugcugcugcugcuucugcugcuucugcugcuucuucugcuucugcuucuucuucugcuucuucugcuucuucugcuucuucuucuucugcuucugcuucuccuccuccuccuccuccuccaccuccucuuccuccuccuccuucuucuaaaguguccuggguguaagucugucauuaaauucauuaacuauguaauuauaaauguuuucaacuaaacuccaagccuuuuaauuguauugacagugucucuugaaauacaagugcuuuuaguuuuaaggaagcccaaauuaucuauuuuugcuguauuuugauauuaagggggaaaagaaauauuuuucuucccauuuuagguccuauaacagccucuauaggcugagauccuauaacagcgacaggaagauaaagaugaauguucauuugccguccaaggucauuaacugagggcguuuugccaggccugugcauucagauuccuuucugagucucuucugaaauaauggccccccuuugcucuucauauauggagaauacuucuuuuugauuauuuuaagacagaaugucccuauguagcccaagcuggccuuagcucuugauccuuuugccucuaccucccuaguguugggauuauagccuugcaccagcagacugcgcucaggaggggaggucuugcugaugaucuuaugaccuacuucagggagaggccuggagagaccuucugcuuaucuuucaaucgccaacggcccauguuuugaacuacagcauccguucuaaggagccauagucccaggaaaugaaggaaggcuguguuuguggucuguucucagugugaaucacccaggcugccaugaaccacugguucagagcuggaguugacuuugugggacugaaccuguaacuugcccuagaucccugguuaccaucagaacucgcuugaauuguugggugugaaguuggugcugcaaucagaaagaagauagaaauaaaaccagucagccucuuucgaggcagcccagcaccuugaauuccagaaauuuccccccucucuaagguggcucuuaaagccuggguugacuaacaacauuggcaaaucuugaaggcccaccaggcuugggcgccagggucccaggaagugagugacucuugggcugcaguagaauuguuggggguggggugagguuggcucuuucccccagcacuaggaaggggaugcauaucuagaaauucugacuuacuuagcaugggauggcuggaccucacugguuuuaaagguccgugcuugcuugcaugcgugcgugcgugcuugggugagugcguccuagugugcacccugaacuagaucccugcuggggaggacuggccuccaaggucaguccccugguggagaaacaucucugaaugaaggagggcaccgaggaggaaggaggggguaauaguccuaaauacugacauucuuucccccaucuuaacuauuccuuuauuuaauacaaacccggugagauuccacaggaguucauuugggagaagaaaaauaauuuugacaucgccaucuagcggccaguggugagacagacguuucugagaacugagucuaauuuacaaaaggcuuccuuugugaaggaguuuaaagacuggugauagggaugauaauuccaguuuguaggaugcuuguuuguagcaugcagaaagccguagguuugauccccagcgcuucguaaaaccuggccaugguggcgcucgccggaaacuccaucacuggggguucacggcugucuuuggucacauaguucaacgugugagccacccugccucagaacaacuaaacggaacuguagauaaagguccaggcugcacagaaaaugauggacacgcaccaggaagcucuuccuacccucagggcuaacugacauuccuuugacaaacagcuggaggaaggggcuggcuuucauaccucuggggagguguauagauuauuccaggugccucaaggagcaggcaaauggguugugaccagaaaaggcuuccagggagcugcgugggcggggcggggcggggcggggcggggcggggcgggguggggaagcaggaggagcaguggccuggccauggaaggaagcagcuccuagacuuuguguucagggucuugacaugggcucacagugacgauggcugauagcuccugcuggggccagacaagaguucagaaaggauuucaggacugggcugcuccagggucucacuccagaaggacauggaaaaaccaaaccaaaccaaaccaaaccaaaaaaaccccaaaacccuuucaggaggagaaaguggguguugugagccuggguguguacaaaggaagaggcgauuuuuuuuuucaauaaaaauaguuuaguguggacagaacugauuuaagagcuuguauggcuggagggaaggccugauauggaagucuccaugagauauuugcccuuguuugcuaacauuaauauuacuauuuuuauuuugucuaggauccuguagccccaaacacacccagcacuucgagggaggcaaaaauuccaaagaacacaguuugggaaacacugccaguaagaaagucuccaguuuugugcugggagacugugaagagucccuuuagacgaucaugcuucauuggugacuuagaagacgcccagugucuacugguccggucaauagucaugagaacccgagugggauggagauggaguuagugaugggcccaaaggcuuugucagggucaaaaguucaaugaagucugaaacaucgcaacugcggggagcugaagacccuaaacuuggcuuaaaaugcaaagucaagaguagacguaggcauucuuguaugcuuucuugcacgauggagacugaguucugggcccagcacgugccaggccagcacuccaugacugagcuacaucuccaguccuuaguauuaccauugagccccguucaccuacagaucucauaacuuaccuaagaucguccaaacuagcgagugucagagcaugucagggaccagacuccuucagggucugcugacucuggccuggacagaggccgacuuggggcaucaugcucauaccuuucugagcaagcagcgcauguguggggaguggaugcagguaagcuuaacuuagggcagaauaggggguaggagauagugagucccuuccugucagggcugcucaaugcaguugggagauccugccagagucagagagauggccacuggggagauggcucaggucauuuuuuuuucucugcaauucaguacuccuccccaccugugugugugacgugugugcacaaguucauguuuggguguggaagcuagaggcuaaugcugggugucuucccuuauauuuugagacaggguuucucacuaaacguggagcucacugacuagauuagacuggcuagcagcgagcuccagggagccuucuuucuccaccuccccaguacugggguuacaggcacaacccacugacccagcuuuucacguguggguuggggauccaaacucaggaccucagguuuuccugguaagcccuuaaccaacugagccacuuccccuguccuuugguaguuuucaaaguccuuauuaaguggggagaaugguaaguuugguauaggaaaguauacauuauuuauacuacguaaggguuccuccgaggauauauauguacuccugaguucugggaggacccgugacagauuucacacaaguguuuaggguucacccugcauuuuguucauuuuuguuuaggaugcaggaguuugccuguuuacacuaccuggaugcccagcuucugguagcaagauuggaugguccacgcugguuuuuaauggagucacauguccugguccucaauuugggguggugguuucaggaacugggcagacucauguugggauuagaaagcuguaaccacuagguucaaggaagucucacucacauagaggaagacaaacccaagcuauggacuuagcuuuucugugccucaguuuccucauuuaguaaggagggggaguggucucgaggcauaccugcugagggaugucugguguuaccuucugcaccugggaaauacucaggggccauguuccugcucacugguccuucuugacacggauaaugccaguucccaggccucagccuugaaggccaaggccauuugccuccugggggccucuggcuuuggaagguuucccaggaauccuugagcuaagcauuaucuuuucagccugugugagacuucugcuuggggcuuccaaacuaaacuaguuucgucuuaaauacaagaaaucaauccuugca

SEQ ID NO: 4691 - RNA, 21873 nt, Mus musculus
aaguaggacuugcacaucagccagggacuaugcugcugcggucgcugcguaguugggcugcccggucccugcguagcgugggcccggggagcuccgggagccccgggagccucgauucgggcgccgggccgcugugggcaccucgccgcgccuggccuccggguaacuagugcuuuugugccaccucguaggggccacacugaaccccgcccccucaccugcuaguccccaggaagggucuggggacugugggacccuaaugaacugucaggaucggcacuuaguggggcucaaacgcggcuucucggcccauuuuuuuaauuuuuauuuuuuauugucagauucuuuaggcuugggagguggcuaguuggggcacgagcuguauuuaaucagcucuuaguggaugcaggugucugcggaccuagggggcggguucaggcuugcgacuuucuccucuugcuggcagugcggaucuuucucuucggaaauggaagccaggugacauagcuuucauuggccucgggcugcugcugccagguggguuggcaguguugccagucuuggccuagacagccugggucccaacccuuggaaucucucagaguguagguuaucccugggugcgcugugaagauccuaagcacacaauccaggugaaacggaaaguagaauguaccgagcaaaggaaacuaagcaagcacacaugggccugggcccaguacagcgacacauacggacccaacuguagagagucccaagaauggcaaacauuuuuuguaagccagggaacacgcauacgcaaugacuguguggucauuuaucaggucagcacagagcagagugaauaauugaaacaucgauuuccuuuccuuuuuuagauaaagauagagaaaaugauaaggagaaaaaagcagugguaaguuucucuuugcaugcuuucuccagcguaauuucgguuugguuuuguuuuuuuuuuuuuuuuuuuuuuugaggcggagaacaaaaacaauggugcgcacagugaaaaaccaaacccaagacgauauccagggucacaaaucucucuuccuucuuguggcccgguuccucuccuuagauuccaucaccguuagccauuucuuguguguacgggcgggaguggggccucgagcugcauucagguaguaagcacucauguucagguguuugugaacugccaaagaugcugaccgagccaucuaaacggcuuaaauugcaucuauuugcuucacugccgauugccccgcccagauguggggggaaguguucuucucacuuccuucugcugucuaguggagaccagagaauccacgagggaccucaggguggccucagucaggaggugcuugacaggcaggcucuggggguuggggcugugaggucaaaggaagugcaaguuagacagguuuaaauguugcagcaguauuuugguuaccaccagcccaaggguucaguuucuuccuuugagaucaucucaccccaggcuggccucaaacuugugauccuucggcuucgaccccuccugaacacugggauuucaguugugugucacucccaaguggucagggcccguuucuguaagggagcugaaagccuugagcucagauggcuggggagaaggcagcuggagcaccuuagugccucuggaggguggaaggugugcccuccuguaccccuugguggggcaguggagguagucaggaggaaggcgugucccugggaagcaggagugacaucacaggaagaggaggcuugguuuucaaggcuggagaaauggcucagcaguuaagagcucuuguugauguuacagaagauucagguuuuuguuccuagcacucacgugacagcccacaaacuguuuacuuccaauuccaaaggaucugaccccgccucugcugcucuucauggacaccaggcauacacuggagcacagacguacaagcaggcaaaccauuuauccauauaaaauacaucuaaaaaguuagaggaggaagguggugguggcggcacaggccuuugaucccaacacucgggaggcaguucucucaguugaaggccagccuggucuacagagggauuuccaggacagccagaguuacacaaagaaacccugucuuaaacaaccaaaauaaauaaauaaaaugaaugaaggagagaaagaaaauauggauagcuagugacauagaauuuguauuuguaauuguugagcuaaccuugccaaguguuggaccuguucuggauauggucugaugcaccccuggguguacaguagcaguuuguagaaagugguaguguggagccuggucucaggcucaggguagccauuuaaguacauuuuugugugggaggcgcugggcuggaaccaugagacuugaaaacaaagccauuggcauugcgcacgguaaccugacagacgggacaguaaaaaggacaucagugaaucuagaaagcagugagugagcuuggggcuuugaggaggggacucaggacucugugcagccuugggaagccuugaugcccccugagagguagaggagaggggacuguaguuguaagaauguagagagagccguaggcuggcuuuauagucuguccuuagauaguggaggcuuggaaguguucagagaaauugggcuagaugccaacgucagagucaccaaaggacuucaccauaaacuguguaauuuuuacuaauuuauuuauuuauuuuuuaaguuuucgagacagggucucacugucuuaccacguagcccugucugaauuggaaaucacagauccuccugccuccgccucccuagugcuggcauuaaaggguguaucauguaaccuuugaggaguagaaauuuauuuguuucguguuucugggggcuggaaaguucaagguugaaggacuaauaucugcuggaggcugcauauguguuucaucccauggaagagaagagaagacaagaccagacccacuccacagaucaugccuuuuuuuaucaggaacccauccacugauaacugcccuaccuccacaauacuacucccgaauucgccuccacaagucacucuuugugcaugacugcucuauuugcagguacaccugcaugccagaagagagcaucagauccuauuacagaugguugugagccaccaugugguugcuuggaauugaacucaggaccucuagaagagcagccagugcucuuaaccacugagcuaucucucuaacccccaccagucacucuugauggcggaguucacacaaucucucugcaaggucuaaucucucaacacuguuguaccggggacuaaguuuccagcuugugaacuuuaggggaugcauucagaucguagcacugccacgcacugugguccgacuugccuuucagggugagaugguagggaucacagcaggagagcugugggguaagcugagagguacagaggaguagcgaggucucccucuaggaguaggagaaaugcuacuuguuuguccuugguuuucauuaaacauccaaauugauuggcaguucuguaggguuacggugaucauuacuauuguauugcuccuccccugacagggucucaacuguguccuggcuggccuugaacucacagagaccaccuauacaaugagaauguuuaacuuccuuuuuuugauauauuaaauguuacuuaaaaagaaagguguagaguuggguauggugguacaggccuguaauaccagcauugaggagacugaggugagagguuggagaauuugaaguuauccugggcaacagcaagacacucacauacauccccccccccaaauaaaagacuuauuuacuuuauuuauaugaguauacuguaacuaucuucagacagaagaggacaucggauacaauuacagauggcagaugguugugagccaucaugugguugcugggaauugaacucaugaccucuggaagagcagccagugcucuuaaccacugagcuaucucuccagccccccucugucucuaaauaacuaaaaaguaaaaaugagaguggguggauuuccgucguaacgcgugcuuagcaagcaucagguaaguuccauucccagcaccagagaaagaugcucacccgugccaguuacaguggcuggagaguggacucugcuucugggggagagugggcugagccgcggcacagacacagaacuuugagccaagcugccugcauccuacagcagcacagccuccuaucucuguaaucuguuacuuucuuugcuacccucacauuuacugugaacacuguugaggcugggaccagauuuuccauaugaugugcugggcucauaguaggccuucaagcaguugaaagacucaaaccugccugguuuacugccuugucaaaucaccacguauuggugguaacuucuagcgaggguguggagcaacaggcuacuugcuauaugguaggguaggcacuucucugugugacccagaggaugugcaagaagguucugaaggagcaaucugucuuagauugaacugugcaccugucgugaucugcuggagccaaaaccaaaauaucgauugagggcuucucuguacaagucagcaaguuggauccuagacggcaugcacgcgauuuuuagucucaaagccauugauaaaagucagguuaaggaaaugggacacuuuuauacuaacacagaacagugugaaggguggaucuagggaagggcucagaacuugacugggcagacaaguugugugcaguuuaggugacguagguggcagggagaaggguguguuguuugggcugaggauguaguccaggggcagauagcuugauugguauguaugaggcucuggguuugaccccuagcuuauuuaaaacaagaacaagcgggaccgggucagguguggauggaucacauggguuugucagagggugcggcaugagggaugcugauacuguguggugggaccuugggggauucccaagguaggguuuuagcuuaccucucaaaguccuggcccgaaccaagaaccuggcuauucaccugagccuaguucugucgugcuuuaucucuaugccuaauguacauuugucuucugccagguuuguauugagggcaauauugcaagugggaagacgacaugccuggaguucuucuccaauacaacagacgucgagguaaggcucuuacaguggguuuguaggaacccgaaacaccucaguggaguaaguuauaccgggcacagagagcccuguccagcagaaggcugaugcgagcugccagugagcugcacgucugauccggugccuuuaaagccucguggagugaagcagggggagcuguaagacagcccugaugucaauuaacaugucaacaugaagucaguguuaaagcaaugaauggacuguucacauucuguguuugauacucaaucccugggccuggaguucaguuaguguuuacagcuuucucaguuuggacucccagauaaugcccaaggcaugauuucucaacuccggauuuuguuugacuauaccgugcugccaaggcaguauacauucaguccaguagauuaguaaugcacuucagcucggccuguuuucaagugaggacacagcccccuuaaagaagaggcgcaucuguggucaagcuucaaggucaucgugguugcauguggcuuguggccccuguaugcagugguacaugagcucccaccauuccugucugagaagggaacuuucugugugggggcugcugaugcaaacaguauggaucauccuggacaacugcuugcuucuuggggagcugggcuuuuggaaugugccaggcagugauagucuguguaguuaugugaccccugagcuuccaggccuaggucaccuuuccugguagacaguacuugacauguguugucacaacuuguugcugggaaaauugagugugucuugugugacuccauugggcaaggauacuugggaguucuggcccaucucccuccagguacauccccugugcagauuuggugcugugaccucucauggcaguuaauauuggcugucaguguuggaugaugucucaucgaucaucagcgacccagcgaccggccuugaguggugacccucugaacagaacuugaaaagugcuuauauccucacuguagaccuuggggccaguuagcaacaguagccgcagcaguagcuaaaaugauccaaggcaccguguuaaguguuuauggcauaucuaauugauuccaugcuuaucugcuuaacaacccucugagguaagcacuguuaucucugcugaggcgaggaagcaaaggauaacuggcuuauagaauuuauauggugugauaguuaauuuuagguggcagcuugccagaauuaacgacugcagcagccucccccacucagcgugguuucaguuacccgaggucaaccaggaucuaaaguauuaaguagaaacuuugggauguauuuaaguucugcauuguuguacgauguacccaaagagaucucaucccgcccauguaagccauccugcugucuagcauaggaaagaaaagcauggcaaguguuaggcuuguuguaccugaagcuucaggcauccgcuggggaucuugcaaccccaggaacaaggaggcagcacugugccugggggcugaugaaguguuaccucuauacacguuuagagggugcuucuggagaagaccgauauguaaauuggcagccuuacuaauauauaauauaacaggucauauaauuggccacaguccuggauagaacaaaaaggaaagaaaaggauuuucccccccucuuccugcugugggacaccaaacugcuggcuuuccagccuuaggacuuagggacuuagccagaggccccaggcuccaggguuucagccccauacuuaacauuacgccagugaucucucuguuaucagacuuuagaccuagacugagcucugccgcuugcaucccugggacccaagcuggagacgaccugucaugacacagaggucuuggccuccauaaugguagagccaaucuugcucacgaauuucaucuuguaugucaguuucuauguucaugcaauuggaucuaccucugaggagaguccucaccuaucaaguagugugugucggggccagucccagcaaaggcuguggagcuucagggaugcuguccauguuugucuccaagcugugaagagcuugguugacuucaccgagccuauuccccucuagacugagccaguuugcagucagucacaggaaggacuuccccaccuagaaggagcuguggccguucaaggguucaucccacccuuggucuguagugcuugccugccuguauucuagauuuggcaugcugucacacguuugcucuccuuccagguguuaauggagccugugcucaaguggagaaauguccauggccauaacccucuggugaguaguuugucucuugcacaaaugccagcuucccugugagugccuaggagugcugguucugaggccugugcccagcacagccagucuguccccauuguucuagcucauucagaggaaaggggaauggcgagccagggauuucugaggccuggguggguuugcacgaagcccaggaaccucccgugaggugucuccaagguuccaaguggcuuagcuuuccuuggcacuuguuccaggucaccagguuucucgaugagccucugacuuggguuugggcuuuacauuaccgaggaauggaucccugugguuuacccuggagcuacccauguuccuugccaagguggggcuagagagccagggacuguaaugugcaugagccuucucccuccuacacucugaaagcuuugugcugccugcuugaacaaagacugauagaaagcagaugcuaccagaggggaugaagaaggacugugguccugggcucccgugcuaugguauggggugcuuaguauuucucagcuaagaaaacuggucauguagguuuagcagugccucgcaguaccucggcaauaccacguguagaguccauuagacucaggcccacagcagacagcacugugucugcuggaacccggcuuuaggacccacuugcucacucacucaggauuuauuacauaccuuuuauguggccaacacugcuucgcacucuaggacacugagcaauuuaauaaagccucuggucuccuggcccuaacauccacuguggagaugaaggagacagguauuagaaugugguggcgagugacaggagcugugaggagagcuacagcaggugaaaggaugcuaguuagauaagacagaagcucacaguuuuaaaauaggaaucgcacagagcugugacaggaaucucacuugugugcauguggaagaagauggauugucagccaucuuuuaguauaacagagauaauccauugcccuucauacuuucuagaagccagagagaacucaaggcuugauaucaaguaagacaaggguaguuuuagaugucugagacuaaaggagacacuucacagaccagaaguacagucucagaaggucgcauaacaaguguuauccuuaccaucucuucaucaucaucgucaucaccaccaucaucagauauauuuccacuccuuucugcugguuggaaacacaagacugcugcuugugugacaguuacuggcucaccacgcuggcuccgugaugcagaaagucgccuguuuccgcagucauccagcuucugacuuugcugagauuuucuuugacccauaacuaggaaagccuuuaguucucagugcugagcaccgagugcggaagugcagaaaggaagcuggcguccugucacaugccugugaucucuccacccgugaaagcugaggcaggaaaaccccaaguuccugaccauccugguuguuuaauaagacucggucuucccucuucucuccagacagaaccccauccuuauccguccaacacacaccagcacacacacacacacacacucgugcauaugcacacguacacccuagagagagaagcaaaagauuacuagaauuacuagagaguagacugcagcaggaagugcuuuuaucuguaggugacagaagauugagggcuggccucuauuuuaucaggguagguaggacaaugcaucucuaugaaggcgacauuugucagagaccuacaugugagggagggggcacugcaggcaccuggaggaagaguaaaagaggcaggugccagagcccugaggugggggccugcuuggcaugcuugcagagcacuaaggaaguuugugugccuggaagcugauuggccagagaaagaaggguaagagacaaguggaugaagguggguuucuagggccugugguucagauggggguuuagauuugauuugcacccaaugcaaagucccuagacgggagauguuagcaagcucauuuuggcugcuggauagagaacagaccacagggaaacucaaaggccaacuaugagugucuaagugccuuuuccucaggcagcacauccuggucuggcuguuagggggcucucuuauaguuguguucacauuugucucuguccaccuacucugagauuccuacagcuguccugaguacaucucuggccucagcccugccccuguggguuuccugaaauggcuuucacggacuucaagaccugggcccugccuguacuugccacuuggacacaaagugcuuugcuuuccucccugcagagccucauguaccaugaugccagccgauggggccucacacugcagacguacgugcagcucaccaugcuggaccagcacacgcgcccucagguaugucacaggucucacuuucaaccuuauaaacauccuucagauucagguguugucagauagggacaucauaguaaaugucccuuuggaccuuuaugcuguccagucuucugacuucaguaaggucuccuguccucacagguggcugugcuggugccauccugagcucacaucuguaaucugaugaaaaguugcuaaggauaacacacacaaugcaaccuucugagacuguacuuauggucugugaagugucuccuugagucucaggcaucuaaacuacuacccuugucuuacuugauaucaagccuugaguucucucugacuucuagaaaguaugaaggccggugguuuuucucuauuauaccaacgcaugcacacaagugagauuccugucauagagcugagugauuccagcuuuugaccauccuuuaacacagaaucccuggcuuggggcaucauugucaccugggggcuuguuagaauuguacauuucucaucuccuccccagaucuacugagucaggaaaucuggggcuaaggucuaggagccugcuuuauccagcugugcaggacuccuggauauguguucugcgugucuaccuguuugagagcagaccuuugugaggucuggcuuucagauucucgaaagaaucugauucaccuugggucacaaccagguguuggggcaggacaggacacacagcgauacuuagguccuuccauuagcaggagcagguugucuuaggaggucagguggcaagggugaccaugguugcuaccuaugggaaaagcuuuauacacagguagacccuuucccuguaggagacaggauaccccuauagccaguuacguuagcaccaucauuaggcugagcaguuggcuccaaguguggcucccugcagcuguaggugucauucuucugucgacaucagucuguaucuuuacaaauugacagaugggaauagaaucuuuagaagaauaugaauuuguccuuuccaaugguuuccuaagugacagagagcagaacaccugcaguuagcaccuuccccuugguuugcucugcuuugccuaagugggcauuuuaaauuauauccgaugaucugugaauauuaugggaugugggcugaaaucugcuaaggaggcaaaggcagagcuggcuggacucagcaggagagagauggcugaagagggagccggaaacagaugggaaagaaagauaggagcagcacgugcagaagggacagaaggaaaacagaugggugcgcagagccaggaggccgggagguaagcagcgagugggcuguaggcuugaacgugcucugggucacacugucuacuaggugucggaugggcaggucccuccugcucuccaaaaggacguaguagacgaagggaaagaugauccauggagggugugagcaacuugcagaaaggugaugugcagccucuucucuguuggucagaguacuuuucaguuccagcaggcagugccucccuaacccuagucuuuuggggcucugcuucagacacccaggucccuggcucagggcuccacucaccagacugugucagcggggcagcuuugccaacguguuccauauccuagugagucucccuucuccugugagagcaacuguggggcugcuggcagcccugggcccccacauggcugccuuuacuguccucuguccucuaaacuucaggauggcucaggucaggguggagggagacacacagugagucucauggcagauuuggcuucuguugacuguuguccucccucacagucucuguccagcagagauggaagggacccguaagaggacuggggcaaguucuucagggcuuccuguaccuuccuccucgccugagaguaaaucccuuuuuccauuccuuuagaugucaccuguacgguugauggaaaggucaauuuacagcgcaagauacauuuuuguagaaaaccuguauagaagguacuguagcuuguauagcccaucauuuauuaacugauuuuguguauguguguuuguguauauauauuaauauguauauguguguuuagguguaggugggugugagcauguaggugugagugcauagguguggguauguagguguggguguguagguguagguauguagguguggguguguggguguguaggugugagugcauaggugugggugcguagauguggguguguaggugugagugcauagguguggauauguaggcauguggaggccaaaggacagccuugggugcugguucucaggaaguaucuauauuacuuuaauuauuuuuucuuuagguuuguuuaguuuuauggguaugagugugcuuacauauauguauguguuccaggugugaucauggaggacagaagaagcuauuagauuaccuggaacuggaguuacagaugguugugagccaugugggugcuaggaccugaauccagguccuuugagauaguagcaaaucccugagccaucucuccagcccuccacugugcuuuuugagacaggguugcucacuucuuaguuaucgcuucuaggcuaggcugacuggccagcauaccucagggaucugccuguuucuaauuuccagugcuaaaauugcaagcagauagccucaugcccgugcuuuuacaugggaucuggcagcugaacucggcuccccaugguagcacaaauacuuuaccaucagagcugucucccuggcccuaaacuauugcugguggaguuaguugccuaguuaccugacagauucggaguaccaacaguauugaugagcuucgguugcuuuauaauguuguguaacaaccaccaacccacuagugacagccaccuuccuuuauugccaggucaguuugggaggucagccaaguggcuccuuuuaccuuggcugggcuuagcaaaaugccugggagugggcuggacuagaauggacuugacccaggugguccaggcaacucauuucucuuccucucaccugucauccccucugggaccagaagcaagcauaggcccugucaucucauguguguggcauagggcaaaagucccaguggacacacagcggcaugcuuacauuuguuguuccgcccuugcccacaucccauuggucccaugccuagggauggcaggcgagagggccaaggggguccauggcacaaugcaagcuucugggaagauggagauuugggaugcuuagagcaguuagucugccccgugcuuaugcuguguauagcuucuguccucaguuaucuagacaguuggaaggcuucaggugcccacccgggcuuagggcuccagugugggcagggccuaaugucugcucagguuauugauaauuugggagggucuuagaggaaacagguugcagacugaggucugaaguuucagccuuuucugagcuguuuccaucuucauagccauguaucuuguccucauguccuugucagugcccgauucuuaccaccucuuccugcucugagccugcagugccacugccacuucuuaggcaguccugacacuuguacagaauguuccuagcuucccagaccccucccucccaucacagcuguccuuaugguucugucucagcccuucaugugucugugugucugugugucugugugucugugugucugugccuggugcccauggaggucagaauaaggcauuggauccucucagacuaaaucuauguacacagcuaacuccauuuccuagguggaagcagcaaacaguucaagacaaaggauaauuaucuacaucuugcuaguggggcaagcaaggugugcggaauagugagaggcuccgauuucucuuauucaggucaucccucaggcaccacugaagccccuccucucuccacacuggcuuuacucaugcccucuauuaccauacugagcaaguccccuuguacugaggccgcccagggcucucuguguuuaucaggcaccuucugguugaggacugugauguaaacgagguccaccagagggcagccacugcguaacuacagggguuccugcaucccuaugcuuuagcccuuuuccugccggggaggccuggccuucuguccugggaacaagacugagcucugagaguuguccuugggauugaggguuuauggugcaggguuuccucuguguuguacucagccuguggguuccauuucacacgugggaccugagguuuugcugguuggguuuuuacacuucuaugguaaagagucccagguuuuuguccaggucuagaguggagcagcugucagccaaaggcuuucuguuuugacagugaaaaggguuuugaucagagcuucagaggaccaauaggaggagaagggaguuugggguucuuauacggucacucuccucguaacuccagcaugcccagugcaccggugucucacagggggugcuauagagaaaggaaauugucuagagcuuucuaccuccuguucccaucucaucgagaauuagucaccuuagguagaaggugcugaaaaaacaaagaggcugauagauccaggacugugcaaacugcaguuuauuagggacuugggggcagaagcgugccuugggugacagcaagauggaggauggagcccagcgcccuaaagcagggagagaaacguauuuguucaggcuggcgauuggauagguaccuggcuuuucuuaaaaacaaaaaacugucaggguugcugggugugguggugcacgucuuuaaucccagcacucuggaggcagacgcaggcggaucucugaguuugaagucauccuggucuacggagugaguuccaggacagccagggccacacagaaaaacccuguuuugaaaaaccaccacuaaauaaaccgucaauguguucugugucaguuaagcaguuugggcaucagugaccagcauacaucacccuugauagcuaucugaauaucuauuugcuccuuagggcuugaaauacacgccagguucucaugguggauaaaauagaguuacgacaaacauguauacgagccgucaacuuguuuccagccugaaagcugguucuguaaugcagaauuagcuuuagugguauccuuagccuguauuuggacuaaaaugucuugguucuuaccuguggaagcucagcugggcacugguaugcuuccccacuuccugugcugcccauggcuugcuaaugugcagugguggaaagcccuuucauagacgggucuagucauggcugaccuggcagugccagguucaucuuuuccccagggaucccuagacccuuugcugaggaucuggaggugggggccuggcucugcaaucuguaauugaaagguuggguuucuggagaagcccacagauaugaauugguguucuacauuuccucaaagcaaaauuucuccguguucuugccuuugggaucuugaacaaguaacugcgaaggagagacauaccucuucuggugagguaggaaggcagagugagcucaguuacaucacuagcaguccgagagcuuuguguggauuacugaagaggaaggucagcuuucaugcuguccucagaaacaggaacugagcugugugcacugggcugcaaugcagagcuaaagguggcacagaagcguuauggccaaagaagccacgcaggcaguuguguaguaagcucuguggcugagggauugagcaaauguuuuacaagacugcuuggucuuccuuuccuaaggucaggguagaggaauggagugggugcagcugggaacauggcguugacucaccuggcacaugggaacaaugggcagguccucccuaccucccugcccagccccagaaccaggaggccaggccacagaaacacgggggauccagguuagccccucagggaggacaacaaaugcaguggagagcaggugggacugagggcaaggcucugcuggaacacagggcuagaagaggaaacaguguauuuaaguaucagguuucugucuuaauuuguuugaaauaguguguuauuguguagccuaggcuaaucuggaacuaagaauuuuuauguagcccagguuggugucaaucaugagaucauccugccucagccuccuaagugcuaggauuacaagcaggugccacuucaaccagccuuugauuugguuuuuugagcaucagguacuuucaacugaacuaaauagaaacaugguacaaaguauggugaacagugggacuguccauggcucagcuaaggaguugaauuggacucucuguguuuuggucaggguuacuauugcuuaaugaacaccaugacccauagcagcuuggggaagaaaguauuucacucacaguuccauggaucagcucagcaucaaaagcaguuagaacaggcagaaacuuaagcaggacaggaaccuggaggcaggagcugaugcagaggccguggaggggugcugcuuacuggcuugcucccaguggcuugcucagccugcucgcuuauagaacccagcguguaugugugcucauuauacacaaguguggagcccagauaaggacacagucccugcucuaucacauuuauaccuucuucucugagacagaguccuugacugaaccaaagcuugcuuucgguuagacuugcuggucuaggagcucuaucugucccagcaccacagggcuggguuuagaggcucagggccaugccuggcuuuuuuuuuucccuauggggacuugaacucaggcacuaaugcuugcagaguaggcacucuuauuuacugagccuucuucccagcauugcuuuuuuagucuuaauauuuaaacuguguaauagugccgccucacucuuguucugagcacugauacuuugcucaaguuuaaaaaguaaagagccaaggaggaagagucuacagucugcagcucagagagaagcccugcaagcauuucuguguaucuuuucaaaugaggacauauguuuuuugugugguugaggcauaugcauacaauuuagccuccuguauccauugagcagcaucaaguucagagucuuuccccugucugcguaugacuuuccuacaucauccuucagcuacugugugcuuuugcugcagagauagaucaagacuucauuucucacaaugcugaacaguggugcauggcgagcauccaugagcauuuucacagagaaugaguucuagaagugaaaaugauuggcugauccacucccaacuugaaugaugucuccacguguagagggcagacuaagaugcuuugucuccuuggaguucauuccagaguaggcuccaucagucacugcuggggccagcucccaucucccagugguggaaggucagacagacagaugcucaggguccuggcaguaccaugugggcaucaucuguggaccacacuaugcaacaugcucuuggugcugcccuuccaaacaaaagccaccccuuaguccuuugggggaaugacacagcacaugggugaauaaaaaucuuugaccucugauugcagugggaagaugcccgagguugacuacgcgauucugucugagugguuugacuggaucgucaggaacauugaugucucuguugaucugauagguaagacagucucucucuguccccuaccuggaggcuucccugggcacagcugggguauacuugggagguucuaccuuggaucgacagaaggcagggacaccuaucaccugugaugccuccucuaucacagcucaccaaggcaggcagcauuuaggggguucuucuguccaugaaggaacucuggccuugguuccuuaaacuuccuucuucugggucaacuacuucugguggcccccauuuguucuguuuugauggcuuuucaguauugugugggagggacagaaauugaguaguggcuaaagccaauggcuugccagacccugucuaagaauggaauuccuuuaagcuucaugaugauacuguagggcugaggacaagaaaggggacuggggccugagggucgggaauccuguuggucccacagacugagcaggcuuggugaggcuccugcacgcuccaccccaggccuguguugcccuugucugcucccacaccaggagcacagcacucagucgcuugugguuuuacuucucaguuuaucugcgaaccacucccgaaaucugcuaccagagauuaaagaugaggugccgggaagaggagaaagucauuccgaugguaagagaccagagccaccuccaccucauccugccagcccucuccuuuccuccaccaugacacuaucacgcuuaucuggagcaaaacccaggaaguacgacugaggcagcucaggcuuccucuauggcuuuggagcccuugugggucccagggccacuuuacuuccuauguuuccugacucaggccucugcaccuccauguacacacacacacacacacacacacacacacacacacacacacacacacacacguacaggcacaccccccccccccacacacccacuguguauauacucauuuguucuguacaguagcuugucuucacacacgcacaugcaugcacucacaccccauggacuuagacaaaugugccuuugcauaguagcuucucuucagcugugaugucacuuuccuggccuuccuuacauugccccuaggccuccuauggugauagcccucagaacagcauauuggcagaguuuguucccauuuaucuuuacaccauaaacacuuuuagauuuugguuuuauuucuucugucuucaacauguguccuggggccuagcaccuagcaguugcuuaguuaauacuggacugagugugaguacuuuaugugcacaguuguccuugaaggauagauaggggcaggcucuuuugggacaucauggugcucugaaccuaggaugagaccuaaaagccaggugugguggcacacaccuuuaaucccaguacucuggaggcagaggcaggcagauuucugaguucgaggccagccuggucuacaaagugaguuccagggcuauacagagaaacccuaucucgaaaaaccaaaaaaaaaaaaaaaaaaaaaaaaagaugagaccugaaagaccagucugaucccuuaagcucagccagguuuuguuuuggacuaacaagagacaucccagccaugaaggccuaggccuugcucugggcacuucguuugaaaucucaaagacaggagugauagaggauggagcauugugggcugugcuguaaugaggcuuggcauuuagaaaugccaugucuggaguucuuccaauccauuauccaagggguugccaaggucuuuaggacaagcuuggcucuaguaccagggggaguccaggcuguucaugucacuuccuaauaguccuugagaauucugccccgcccugucccugugagacccuuggugggugggauuccccccuccccucucccuacagcccuuguguuuccauggcaggaauaccuccaugcuauucaccgccucuacgaggaguggcuggucaacgggagccucuucccagcugcagccccuguucugguaagucacugucccucccagagaaugucaccuggacagagacucagagggacucggacuugaggaggcuaguuauuuuaguaacaugucguacucaucaucaccacaaagaaguccucaguuacucuggaccuggguuugcauuuggaccuuuggggaugaugguguccauucuucagugggugacacggagcccaucgucacccaucgucauaguuaggugacugggcaucuucugaaggcaucucagugguuguccucaguugucacacaguggcaccucaggagcugcugagguguaaaagugccacgcuccugcugccuccaagcugcaggccaauguagcagugcugguguguccuaccuauccauauguccuacuguguguccugugccccagugugcuccuccugaauuuccucaggcaggcagguguacuugaggccgucucacauccagccggugaucaugggcuuuuguuuaugcccuugggcuguaggccacagagacauccuggugcuaagagacaggugauaagggacaugucacugugggaacuuucagaguuuauuguuuccuucacugugaaaagcaaaccugagagggcugggaaaguggcagaguggcagagaacuugucuagacauuggaguccccggguuuagcccccagcagagccccaacuccugucucagugaaaagaaaaggcauuguuggugggauguggaaaucugguugagagugucaguugcccuggagccagagugugugguucugacccucuuggccucucagccucuugccuccccaguggggauggagauggccagugcagccugugaccuguuuguuuuauuuccaggugauugaggcugaccacaacuuggagaaaauguuagaacucuuugaacaaaaccgggcccggauauuaacuccagagaacuggaagcauggacccuaggacugagugaucuacaagacagcgccaggaacagcccagccagggccagguuagcugcuaggagcauuuggaagaaucuacucuuaggagggucuguuaucuaaucagaucuauuuucucaauggucuuuucacugcaguacaaauggcuuuugucugucagaugcuugcagcauacaucccuccuggugccccuccugguggcuuccuaacgaugaagcccuguguuaaaaucacugacuguaucccugggguuguucuggauccucugcaucaggucaccucaugggugagggagcagucuuccaccccaggcaaggauuugaagcccagagagguguggggacucgucaagccagagcauuguggagggagcugggaccauucagauaccugguuugggcugccuccuccuaagcuguuccccaccgcccugcugcucugagcaccagcccccgccucugugagaagaguggacaguuugugaauuccaucaucuuucaguaccgggccaguucaaggagaccagacaucacuagguguuggcacaccucucuuauuuggcaugagcccaggguguccugguaugaggguacugugaccucuauccauuccuuugucaccuggaccucgguguccacuggggacuccuggaucggccucugcuuggugccagaguccuugaggaugaguccuccccagacucuaccaguucccugucguuuugugucagaaaaaaggggguuaugggaccuggacacuuuacccuuugcugagcgaggccaagggcagccagcugagcuuccaagaccccaucacucucuccuguccuugugugaggagcaguguccccuugcuccagggagagugacaguggccuuaacuccuuugaaguguuuuuccaucugagcagaugucauggaccacgagcaugaagaagucaucucuauuggaucagaaaauaccuuagcuuugcugagccguaacugugcacugaaggugcagcuguuacuugaaucagucaugaccaagagaggccggccauuccucaggaccgugagacuggaaagucaugguuugccaacaaagacaauuuaagccuugcugcucuugacauucuagaauggauggagugcaucuggaaaagacuggacacagaugauacaggggaaugaugaccguauacccuggagaagcacagcacaggcuggggagggggcugcaggggagcccugcuccccuguuuagcugccugggagcuagaaagagggccaagaguccagcucuugguccuuucuguuuggaccaauucuuggcccuuuugguaguaugaagaguagcauccagggagauuguccaucagcaccugcaguccagcaauggauaaaccugagaaaggcaggaacuuugaaccagcaguacucaugggggcaucuuuagaauuugcaaacgaacagucuaguacuugcccuuugcucuaccagaacacuuguuuuggggagaaaugugcuguuucucuuucucucuaguagccaauaaaauucuacagcuaaaccaugaugua

SEQ ID NO: 4692 - RNA, 14078 nt, Mus musculus
ugggcggcccgcgcuagugcgcaggcgcgcccggacuuggccugagcgcggugccgcaggcccagccccggcaguugagcugguggcgcgaguccuggaaagagccauuaaucgagaaggcuugaaagagaggcgugacuguugggucugugggcaagauggagacuccacggccggucguaagccgucggcccuucugcuguacucugaaaugcuuugugaaguuccugcgguuggugaggaccagggcgggaaugcagggcggucgguagucaggagugcuccgggguagagaagacuggguucggaagccuggagcagcguuugcucggccaccugguuuccagccacgccuuuccagacgcaaggcauugauugcucuguggcucaguucgaccggagaagaacuauaggguagaguggcuuccuccuucagaugauguagggacacgcccaugggucuauccgaaaacccuucacuuguuuuacgaacuuggugauaaccucuaccagaccaggcgcuguauagucucaccacucaaaagucauaaauauuuuuuuaagauuuuuuuuuuaaguugguggucuuuuacuguaagucggacauuggauguuaccgaacuuagagcggauacaacccagagcgagagcaaagaggaaacugcccguauuagggcuccaagcccuaacaggggcauugcagucuguucuggacagcacuuuggagaaaggagaucauuauuaaaggguaauguucucagcucguuagagaaguacaaacggccagggacuggguucacucuguaccuguagcuccucccagaacuucucaccccgccccuaccuuaaaccucuccagcccagaggcugggauucauuucccuucucccagcuucucauuuccauauaaacuggccaucucugcagacucucuugguaccccacccccuucccccaacacacacucuccucuccugguccucuugauucucucccucuccccgucccccucucuuccucuuccucucuccccugcccucuccucucauggcucaauucaaucugaccacuuccagauaccucugacuguauccuccgucauaccuacaauacaacuuucuccucaaccauaccuaaaagcccugguuuucacugaacuaccauauuaaaaggaauguaagaaaacucaaagaaaaguuaagccguucaaaaaauuuggagagcugaaaugagaugguuaaaaguuccaaggguaacguuuccacauaacacgaagaguuuauuauauugaaggggcgacaaacuuaaaugaccgccagagaagacaguauuucccugacuacagaaggcacgggugggcacuaaagaggauguuguaaaggagauucaaacuucaagugaaugaggaaaauuaauugcauaggaaaccuuccccgugucagaaauccgugauucggagagguagcuccaaauuaugauucauaugagacauucagaaaaagacucuggagcagagggagagguuaccuuugccuuauuuaaucaagaaggugacuggccaccuggaguuuuacauuagcuccagaacauugaaacagauagauaguuggggaggggggaggaguuuaaguuuaauauaacuuguuuuuuguucuguuuuguuuuuuuuugguuuuggguuguuguuguuuuuuuuaaagauuuauuuauuuuaugugaguacacuguagcugucuucagacacaccacaagcuggcagcagaucccauuacagaugguugugagccacaccaacugguugcuaaaaauugaacucgggaccucuggaagagcagucagugcucuuaaccgcugagcugucucuccagccccauuuggguuuuaacagguucgcauagcaugucuuuggcuggucuugaaaaacucacaagcauuucaucugucucuaccacccaaccacccagaugcuugcuugcuuuauuuauuuauuuuagaucuauuccguuuaugugagaguguuuugccugccuguauuuauaugcaccacacgaguguuuggugccuuugaaggucaaaagagggcaucagaucuccuggcagcagaguuauggaugguugugaaccaccaugggaugcuggaaaacaaauccaagcccucugccagagcaauauaugcccuuaaccacugagucaaaucuccagcccugauauuaccgcucuacucagugugagagacuggguaauggcucagugccacagcuacugcccugacagagaacgaguguucaacuucugguacccauguugaguugcuccuggccaacuguuuaacuccagcuccaggagauaggaugcccucuucuggccaccaugggugcugcacaccugagacacaaagcuguacacgaugugacuauuuaauguguuccagcuucugggcugguagcuggaagaaagagcaaccaagacaaaaguggauuccuaacucacagaauucuuccauuuaguuaccaagacagaaaucccugaaucauaaaacuuuuauauuuagucaccaaaauaugugacucuucaggagccacccacauuggcuuuugagacaggguuucucauuggccugggcuuaccaauuagguuaggcuggccagcaaacagucuccaacuccacaaugguaggauuacaaggauaacaggcagaguuaggguguucuaucauguccggcuuuggcuuuuuguuuguuuuuguuucuuuguuuguuuguuuguuguuguuuuuaauauuaguguuauacuauucaacaagugcuuuacugacugagccaugucaccaaccacaaaauuucucuuuuuucuuucuuuuuuuggggggugugguagugguuuuguuguuauuguuguuguuuaaagauuuauuuauuuauuuauuuaaugugaguauacuguagcugucuucagacacaccagaagagggcaucagaucccauuacagaugguugugagccacuguguggcugaugggaauugaacucaggaccucuggaagagcagucaaugcucuuaaccacugagccaucucuccagccccuuguuuuugugguuuguuuguuuguuuguuuguuugagacaggguuucucuguguaacccugacuguccuggaacucacucuguagaucaagcuggcuucaaacucagagaucugccuccgccucccaagggcugggauuaaaugcaugcaccucuaugccaggcacagaacagaaguucuugccucauagaaugcuuccauuuaguccaggacacaaacaugaaagcaaagggguacuauaugugauaggauaaagguaggauacagaagcgagacauauaccagaagaaaauuucccaaaagaacccacgugaaugaaggcuaguaagaaaaccuuaagaaucucugcucugaacaauaagaaguuuggugcuucguguacucauccaacaagcacuuacugaaugccugcuguccgcagugaacaagacauuuacauauugggaugggagauagggcagcagagucaagcccagugcauuaccuggcaucuuaagccuaagugcuaggggauaagagaaauaaaaggcagagaacggaacgugaggaggaggaggaggaguuugacaaagguuucagauuguagucuugggguuagacuuugcugggaugguaucggucagaguuaagugagacggagugcuagugaugagaauacguugugaauagaaaaagccagugaugugaaguaaaugaggcgggaauguaccaggguuacagcucaucgcugcaagacacgccaagcaagcaagggucgggugacugagugcgcagcaaauagcaaauagucagaucagggaucuacagauuuccuaucccaaaugcuuaagaccagcacugucuaggauauuuggaguaucuacaaguguguaaugagauaucucgaagauagaacccgacuuuaaauacagaauugauuuacguuuuauggauaccucguacacauagccugcgggguaguagacaguguuuuuagugauuucauacaugaagcaaaaguuugugcacauuaaaccaucaaaggucagcugucacacacagcagucaacauuuuugcauuuugaccaggcacagugauacuugccuuuaguccugguauuugggaauuuaggggccuacacauaugaaaaaguguaggugcgacacacugguaucagaagcccugcaggagaagcaagugugggaggaggagcaggcagcuuugaaugcaguaguagauuagagauaccugugagagccaugaguagcgaaacugaacuggauagagcuggauuugggugagagauggucguauugaaagucaagugguggguggagucaugaagaaagaaauuuaauagaagauacaaggggaugugugaacucuagcagucugugagcaguaaaggcagggcagggagaacaugcaaagagugggagggaguuguuagggagguagaagaagauaagucaggguguccugggugcuaagugaagaaacuugaggcugugaucagcugcauuaaacaccagggggaacagaaguaaaugaggccugggaagugaccacuggaauuuucauggacaaauugagaggcgaauuuuugcuacaguaaaugguagcugacuuugagauacaagacacauggugaaagggggacuauauaauagagaaaauguagacuugaauuuuaaauagacaaaggaugugaacaaauuuauguuuuagaaggucguguugccauaguugaugggaaagacacuugcauuuccagugugugugucauuggaucaauuggacacagauauaaccaaugaaauuaucaccauaaucaggguaaucaauacagucaugccuggcaaacuuucuuagguaugggcugauugcuuauauaucagcagucccaugagacgaugucaccuggugauaucagcgccaucuuaguaucuguauuuuuaugauaacuugcacgacaaaaucacucaccguauuucccagaguggaucuauuuguuaaguggcacaugauuggcucccaaaccccuaaaauguuccucauggccacgauaaucccuucuuccugccuacucuagccccagggguccacucaugugcucucuguaacuauauuuucuauaaaauuuaguucuguuuuguauaaauaagcuuuuucuguaacugcagaugaccuuuuacuuccuagaauuuucuauaaauagcaugauguauacucaucuugucaucuuucauccaucuaauuaugagagucaucgaugucauaugucaauaguauauccauauuaauacuucaaauuuuuuguuccuaacauuccauuauggauagaccuauuccccugccuuucaugcauguaugcacuugaguauguguguguguguguguacaugcguauauguauguuuuuguguguggguguauacauguauguaugugguauguguaugcaugugcacguccauguguuucugggaauuaacaaaggccaucacaugugcuaaguuagugaccucucacaccaaucauugagcugcaucccagcucugaucacaugcucuuuauccauucacuucugggugucauuuagguuguuuccagacuucagcugucccuuaauucuaauggcaauguauuuaguaagaggacuuacaugaaaaugcacacagguuuauuuuugcuucugacaauguuucuauccaucuccuccuccucugccacucccacccuccccuucaucuugccccucacggcaacauucaacugaaguccaauaggagauugcagauuacugagcguuaaggaguuaugagggaguggauggugaagaauucaggcagccaggaugcagauguuuuugagaagcagcaagaagcagaaaaccaacaaacaagcagaacagaauaggauuugucuggggaagaggugaaaggaaagggcuuugggaggaguguuuuacagaagacaaccuagaugucuuagaggaagacgaagagaugagcuggccgaggagggcagaccgagagggagaggagacaauuggaggggacagaccugagagcacagugcagugauuagcugcacuugaacaggucacuuaguccucuaaaccacaagcaggacucaguacccacguuagccaugccucuccuuucuacaaugugugacagaaaucuuauugguuuuagaccucauuugggggcuagggauauguguaacuucaugguacagcacucacuaccugagacccuggauccaacccccaguaccacacaugcacccaaccuccccauaggaacuaaacccauuguaugaucaaugacuaagucuuuguuuucuucugcuaggugguaacugugacaucuaugaucuuuuucaucgugggacaagccccugaaccauauaucgucaucacuggguuugaagucaccguuauuuucuguuuccuagucuuauacacguguggacuugacaagauaaugagaucuuucuuuuggccuuugcuuguaagugaugaacuucaaccuuaaaccuuaacuaccuuuccugccuuaggaagacaccuuagucaacuacuuggaucuccuaaauauuuaaggugaucucugcucacugcuaaucaauccaagcuugggggaugcucucagggauucaggauacccacagaacauaaauucucuuuauuguuuguaccaguagguauggcugaccuuuccauuugaagaauucucuuaaguaugaauguccuaaagaaauuuagauuuagagccaugaaccauguuaauaaauuagagcauguuuuuaacuuuuggcccccccccacuucuuucugcuuuuuuucuuuuauuaaaaauaagccgggcgugguggugcacgucuuuaauuccagcacucgggaggcagaggcaggcagauuucugaguucgaggccagccuggucuacagagugaguuccaggacagccagggcuacacagagaaacccugucucaaaaaacaaaaaaagaaaaaaacaaaagaaagauccuuuucucauacaauauauucugauuauaguuucuucuuccucugcugcuccgaguucuucccuaacuccccuccuucuggauucacucuguuucugucucucauuagaaaagaauacacuucuaagagauaacaaccaagcaugacaaaauaaauauaauaaguggaagcaaaagcuaucauauugaaauuggacaugacaacucaacgggaggaaaagagucccaagagcaggcacacgagucaagagacccacucacaccaucgaggacgcuugcaccaucaacuguuccaguggcuaccacagcugucaaaacagacaaauggaaaucaucgggugaggucuagguggcccuucagcaagagauugcaaaguuaguucuagaaaaaaacaaaaacaaaaaacaaagcaaaguaaaacacagcuuaauuuuuaccucuucucucccaagucacaucccagaaccucgucucuccuggucugccuugugcgccccccgacucuccaucccuucuuuggcuaaacaggaagcugcccccucuuccuccacugcacuugucauguccucuuggauucugacgugcuuauacccaagcugcuaacuaaggagaggagacuucggagcuguucucaaaccaggagcaugcuuuuaaaugguaccuucuggaaccaucauuggaagcaagugaugagcguuucaggcuggagguguguaauucaguuggaagagugcuugccacgcaugaauacaucccucgauuugaucccuugaauagcauaaaccaaccaugcgagcacacaccuauccucagcaucucaggcggcggaggcaggaagaucagaaguugaaggucauucuuggcuacacagagcgaugaaggggaacccugucucaaaaugauagcacaauacagguuaaaaauaaggcccaacuagaagugguuuaguuuaaagagaucauuuaggccguugucauaauccagcuguaaaaugauaaugguauggacuaagauuauagcuauaggcggagagacaggaguucucuaaugaaguuccuacaacuuaugacuggaugcaacaucugcuuucugcacaacugucauggauacucuacuggggaguuuuucuaccgccacuugcauguuaaacacugagcuacaucuccagcccucuuuuuacuguuaauuuugaaacaaggucuuugagcaaacuguguugcccaaauuggccaugaacucacccugcagcccaggcuggccuucaacuuucagucauccugccucagcuuccccaguguaaauaccgaccuuggaggaguguuuacccaccuacugagggaggagaauaggcuaaagagagccugguggcgucuucgagugaaaauguugacgacaucaccagcuuugguggagaauaagagcugaagugcugguacugagcucagaacgaauguaggaagugaagagaaccggccaagaaaggcagggagggaaccaaggagcccaagugucacugaccgaaacaauacaggaauagugaaaauugucacauagacaaaaagaaaaguacuaaaaugugcaaaccucaccccccaucccuggcuguaaucauagaaaggcccuaguaggcucucuucagaguggcucgccaugauuggcaaguacuaggaagacugugaggccaggcgugaaaggaagacaacuuauaaccaagaggccaccacugcucuaauuuccuauuuccuauaggaauucuacagauagagguagcaauccuggagccgcugcccaguaagcaggagagugaucagacacucgcuagcauuaaagggcucugagguucaaaaugacuauaugaaaaugacuauaugaaaucuccacuuucuuggcauuaaguuugcuuccugcugcacagcauauuuggaauuuggggauuucuuuuuauuuuuguuuucugacagggucucucuagcccuggcuguccuagaacucacuauauagaccaggauacccuggaccuccuagagaucugugugccucugccuccugagugccaaaguuaaaggguaucccaccaugccugguugcauuuuuaguuuuccauguaaagacaguguuucaaguugggugugcaggcucacaccuacugucucagcaugcaggagacugaagcagggggccuuggggcuggaaauccauuugagcuacaggaugaguaccagaccagccugggcuacagccugaaacccuggcucaaaacccaaaaauaaacaaucacaauauucuaaacuuccuguggugagcagagguauucagacauaaagcauaucucauccugcccuccccagccccgagguucugugcacucccuagaauaguacuuuuguaccaagccaguuacagccugacuuguagcuauugcagcugcuggcugggguggggcuugcggcccugaagccaagcauccagccaaggggaguuuacccaagacauccagucucauuagccacugcaacauuuuuccuuccuuaaagcaaagcucuuuccucuuaauuaacuacuuuucuuuuggaaucuacuaugucuucaugacuuccucccugccugcuuauugaaagccuccauagacuauugcauguugaagacaauuuaauuucggacaauccacaucaagcaagaaauguaacuugcucaugucaaaaugcuucauuuuggagaagugauuagaagaaauaacaauuggcaagcuacugcaugacaaauguagagaaggcuuauccuggaaaugaucaguuuaaaugugugcuauuuucaguuaagggugagagauaggauuuguuuucuguuuguuuguuuguguguguguguguguuuguuugucuuaaaauggggucucacuguguggcacuagcuggccugggacaccaaguagaucaggcugacaucaaacuucugugugcuggaauuaaaguuaugauccaccauguuuguuaauggcuucauguuuguuaauggcaucuuagaaacaaauuugacagcaaauuuaucauauugccuauuaaaaaaauaagcauuccagcuuccuaaggaauucucuauaaaacuucuacauaauuaucuaucuuuccuaaccagaggauuucucccucuagcuauaucuauguuaagugaaacauauauauaagugcuuaaauaauuaaauaaagucauguguucuaagaggcccucgagguagaucguagagcaauuauaggaauuauuuuaccauaauauuuuacuuuccuaaaagacauugaugucugcaaaauuaaauaaaacaagcuuaaaaauauuuuuagggaauugcucccagcuuuuuauuuuuauauuuuuauuuuuacuuuuugagcaguacuuguuggaauugauccccuacagaccccauggaauuccuaauccagagcucugccaggcucucagcuguauuugcagucuuugacaacaagcugacuucuccauucuguguucuuaggauguuauuaacucaaugguaacagcauuaugcaugcucauugugucuguguuggcucuaauaccagaaaccucaacaaagacaauccuuggagggguaaguagaagucuuccagguuucuuccagcuggaucaaaaugcaaauuaauuuggaaaucugacaugauccuggacuggccuacaguaccuacuggcuuuauaguuugugugagcggauacauucccugauuagcauaaauagacaggguuucauacugaaaucugccaaacauggagaucccugcauguuucuuacagggcuauacaaucugacagagagaaucugcuaaaaucggcuaccacgcuuagcucuaaaaaaccugauguuagaaaggaagcgugaucauuucauaguucuccuuuugaaaggauccaucuagcaguguuaggugagacagacuauucccauaacucuacagaugcaauuuaacagauucccuuacugcaagggauaugguaggaagccuugcaaaccaagagcuauucugaguacugccuagagagaagcaagucggcuuagaccgacaagcccacagugagcucacuccaccuccaccugcuuuucuccugagguuuggccaucugccuuuccuaggcucugaucuagagugcugacuuaaaaacaucuuccuuccuacuuucuuguucucccucagcaagggccacauagaacugaccuugcucugccaugacugucagaacccuggacuucaacucaugucggcacuaagcaacuuccugggagacuagggaagcuuucuagauaggagguaugcugaaauaccaaccucccaaguuguucuaaagacaguccugucugucuacucuuuuaaaagaugagccagucacaggacuccaauucaugugccuuucuguucucccacuuacucauugcuuaaaugaugacagcguggaguccuuucccagcagaguggcccauggcuguguggcuacugagcagaggggaugggacuaauaugacuugagacaaacucugacuguaaaauacacaacugaauuucaaggauuuuauuuucuccccaaaagaacauagaauagcaaugaucugucaagggaugcagccagcucuagguaagccauuaguggagugcugcccagcccagaggagaggggguagccacuuuucucuggcaugggaacugcaguuagcucacuuucccuucagcucagugucauuuuccucgggccugucucaacuccucugcccuacacaaaugugugcccagccuuugaaagcucacucuggagauuccugucgcuccacuucuacaaaaguugcaucccaacuaugguccccgggacuuaaucuccagcugcugccagcaccagcucuuuccccagaugagucuggugauagaaaaagcaaagagcugacuacuggagagagaaaugggggcugggggaggggguugauagcuaaauauggucaguagggcuuuaaagaacucaugagugcacacauccacauaugcacgcaaugcacacaagcaaacaagccagugcaaaucaagauggagaggcaacuugcacuccaccucaggggcagugaguucugcucacugcaguugucuuguccuuuacucugaguggcuauggggaaaaccccgcgucccuucccacucugguguuggaugguagcacagagagcaagcucccuaccugggaaggaaaggaauccauugggcagaugacugagaauuuacuugccagaaacugacgacagugucucuguuugcagguguuugguuuccugacaguaacauguacuauugccgacugugcccuuaugugccagaaacuucgguuucguccacgucaaccuuaucagaaaaagucuacuaaugacaucgaugacagagaauaauuuuguacuuauuuuuuacuacuuauuaaacuaauuauuuauacauccauauauuuucugcagaucuccuuuccaugugagugccggcuaguuucaugucaacuugacccaagcuagagaauggaaaggcauccugagacacaggaauucaggaaccacauaccucuacaaggagccaccucagcagaggccguccagccccagggaggagauccccagcugagcgcaggacccucagccacucuccuucucuucauuacuuuuuuccuucauggcuccuccaaggagagugucacaccaagaagaaaaucucaugaaagagauuuauugggaggcccaugguguauagcugugaauccagggauagcugccggagcgggcagcacagauugggacaaaggggcagugcuuauauaggauuucugagggggcagagcuucucuggacagauucaagucaugagcuugggguacucaagaauugauagguuuucuuguucagagauugguagcauuuuucacccccuucccccugcaucuggcccauggguuaggguggaaaguccuuccuggccugagcuggcuugcgcugagaugacaucucuguggaacugcuggggucagaggguacuagagaaguggugcugcccccaaagacggcuuuugagggacaacuuuggcugaggcaagagaggaaaugggccaccauagacagcuccuggguuggccccacacugaggagauguaguagugccucauuuuaaccccaggcacauuuggacaucucuugugggguguuuuacugcaguggucguagacugggauguggaauggccucugcuuucauggauuuugcaccaugcccuauagacacuauacauacccccaaauaaccccagaaccccuuuucucuggguuggcuggcagcagcuccugugcaugugguugcugggucuugaguuuucaagcuaggcauggcgccauuuucccacaacgaggacagcagauugcuaggcuaggcagcagccaucaaaaaacaggugcacgcgggauagacugccagcagccguugaagacaguuucccagggggccaucgcccugcggccacccagccaaccggaggugcagggccagccugacauaaugaggcuuggaacccaccaugaauccugcauccgccaggcgugaguccagcggggauggguccaggcgugaguccagacgcucaacuuuacgaccucgaguguuggaugcuuccucaccuucggauucacaggcguaugcugccucugcuccaccucaccagggaccuucaguacccgggacaccaaccagccagggaccuucaguacccgggacaccaaccagccagggaccuucaguacccgggacaccagccagccagggaccuucaguacccggaacacuaaccagucagugaccuugaguagggaccaugccaucuaguaaguucaugcagucgcugcacagagaucacauugccaacaaauuacaaaaaaaaaaaccaaacaacaaacaaa

SEQ ID NO: 4693 - RNA, 14093 nt, Mus musculus
agugcagacuuagugguauuaagagagcauccaugaugggcuagccgugggggagaacaaggauaauuccagaucucugguuaguccagcacagaacgaacccaagccuugggcagcuaacgaaagaggccaggaaggaggaugggcuggcugaggccugacaggagcguggccuguaaaauagaggaagaugggcaagccaagaacuagcgggaggguggccugggaaguaguaggaaaacucugagaggagccaagaaggggaaagcacucugaaagaacugaucucgccugguuagagccaagccuggagaggacuuagcggagaugggggugggguaugggggcagugucccuguccuggaguugucuaggcaguaaguuacuucgagcuuaaagagcagaaccgcugagcaaggacagguggucgcuuuagggggcgcucagggcagauaagugggucugugucagucaggacgggggggggggggggggggguaaggagucaaacgacaaaagaagacuccaggccagccacacagagcaaacagagagcuggagugcgaggggacugggaggaucuggguacagaaucugugucaccccgggacguagcagaaauagugagugcgggagguggggagguaggugcuagaaggcugcaugggaaggggugcgagaauggggcagaagauagguggggcagguaaaggaggugggggggggcaguagagggggugaagaaugagaagugaccggaggauagagggccaaggauagucggaggggcaguguagugcaaagauucauggguggggaagugagaagagcagggucggagggacuguggggugcgccgggguuggugggcgggacaggaucgagggggaacugagaaugaaaggacaaggugcagggaaggauccuaaggcuagugaagaggcagaggaaguaaguggaaauagagaagacagagagagacagacuggacuacaucugaggggcaaugaggagugguuggaaggauggagcaggauaugggcaggacguaggcagagggggagugggggaggaggagaugggaggauccacaggacggauggguaaggcagcguccacggaacacgggggcugcguagagaauggucggagggaggaugggcggggcaggguucgaggggcaguuguggguggggaugggggaggugggcgggacagcggaggaugaguccccggccuagucuaacuccacuuuuucuucuuccgcacagcggguuuccgcuucccuccagggcggugggugaggcagugaggcccaggcucgaccagauagcgccgcuauguggcccccggacgcagagccagagcccgauccagaguccgcgcauggcccccgaaguggcaggacagugccgggacuccgagcccuguugcccgcgcgcgccuuccucugcucucucaaaggccgccuccugcuggccgagucggugagugcgugugcuccccgggugcgugaagcccgguacccgcgccccagccuggggccuugcaccuccagcccaggagaauuuggaccaccgcccccaagcuugcuacgacuucucuguagcggagcucgagucagaaucaggcccgagccguguucuucccggauucuccagucugcgaggcccucgaaagggaccagaagucaaggguuugggguccugguccccgcuggagccgcagcucggcugcugugugaccucgagcgccuccgcccucucugaguccccgggacugcugcgcucgcuaagcuucuucuggccucgcccgcccugcacacccucccaccuccuaggcugagaccuagccgccuguguggugaagauccuacggagugggaugugcccccggggagugggugaggcaggggccacguagugaagacacaggcggaccacuguuucaggguggcgagccugcggggugacuucaugcccuccuuccccccucccgcgcuguacuccuuccuccucccugcuuguccccacccggauaggaaggucuccuuuguccucccaacacucaucaucacguguggggcgggaacuggcauggagccuauggagauggggagaggggugggaggagggacgguggaaggaggaaacagaccauagugacagccacuuguugcucagauaccuagcaacuuaauauccgaccugcucccacuucgaguuggggauaggagagacagugucuuuaacugcuaggaaacuuggcaggugacucauccagugaccuugaggauauccuugagggcaaaagggggguucugccccaggaccucuccguuguaccccaggaccuacuaaggagcaucaacccugaggucuccgguagaaccuaauacuuuguuccuaaaugaggugccaagcggaccuagagcccauuuucuggccguuucagaucucuggaagccucugggaggcguggggcgggucuuugaaucuacuggccacuggcuucaguccuaccugcccaguaccccuucauggaaaaggagugagugccaaccagaagucacaagauguccuugcccuagcugggugccagaaagacaggccuaagaaaauaugaaggguaguaagcucauaggguauaggggagccucccccagucauuccucccccuuggucucaugcaaguagggagucugaccuggauagaaagcuggaggaagaagcagccaccaagaacuggggagugagaaaacaggagugggggagggaggagguuggggcaggggagugccaccagaaccagacuuuuucuuuuuuuuuuuuuuucaaauuuauuuauuauauguaaguacacuguagcugucuucagccaggccagaagaggcgucagaucucauuauagaugguugugagccaccaugugguugcugggauuugaacucaggaccuggggaagagcagucagugcucuugccugcugagccaucucgccagcccagaaccagacuuuuuugaggggaauggguacagaaaagaggagagccauacgagcagccuuuggcaaggaaauacaguaggagcugauagcaaccucaaaacgccuuucucuaagccuuaguuuccuguuugcccaaaggaagcuccucuucccccaugacuuguucaguaaaagagaugggaguggaguuccugugaucaguucauuugucugaagcagccaugguauuuccugcaggacaccuggguuucccuuacagccucuuaaacuacuaagcuagugauaggcucaaagccguccguagugauagaugaagggagauggaggccucuuaugaccuaaguacagauucugacgcccucuuacuaggcugggugacacuaagccugcuucuucaaaagagaggcugugaggagcacgcaaauguucagaaguggagaaguccagaaaucuuagcaaggacugggcuugaaaaagccacugaccuaucuucuucaucuuguuuccccgccaugcacaaagucugcaguacuaaccaggagccuuagcguccgaccugcauaccuucaguuuuguggcccugguuuccggucaauaugguauggcuagccccaccuuucaaaugaacuagugcucucuccgagacaguuaggauuuugucgagaucgggucucacguaucucaggcugccuaaaaccuuagauauaaagcugaggauggcuuugaaccucugaucugcuaaaauuacaagcuuguaccaccaugccugguuuagacggugcuugggaucgaacccagagcuuugugugcacuaggcaaguacucuaccagcugagcuguaccccuagccucaugcauagcuguugcuguuguuuuaaugaagauucgcagaugcaggaguggcaaaagauaucugucaacaccccugcaucccccccccccaacgguacaguggcuaacacggcucuaucacccguuucuguccaccugccuugugcuuucaaccauucaaacucaacugcagacaucaguaccauuucaauuuuaacugauucggccugcacaucaucauuaacaaaguuuuuuuuuuuccuaguuagguguugggugugacuuuuugaaagcaguagauuuugauucuggcuugccccuuguggacacagcuaaguuggcucuguucuguccuagagccaagagaggucagcagccccacaagguggccugcuagggaggcuggggcuucaagaugagguccuagcaaggauucagcaagggcuaggacucaggguuauguccuggccuggggguagaauaaggguuugaguccccuugcucuuccgcagggucuuucauucaucaccuucaucugcuacgugguguccuccgcaucugccuuccucacagugccucugcuggaguuucuguuggccguuuacuuccucuuugcugaugccaugcagcugaaugacaaauggcaggguuugugcuggcccaugaugguaaggaucgggggacccaagaggaaaggguuggcuguccccugaagaaucugggguuccacauuucagcccuggcugucuccagccauggugagcagucugaaagcuucggauaacucaggacgcucacacaucucuaccccugcccgcccagcagcacugcgaccauggacggaccugaugggugguaggagccuccugagcuggucugugaagcuaggcacacggauggcuccuggccaccagguggagcuguugcucugaccuuggaggagggaugugccucagccacaggccauuuccagcaggguaggguaaccaaggacuugggacuuccuagagucuaguaaucaggcaccuggcuuugugugaccacccgaagaccuugcagucuugagagaguuucuuuaaugcaucacugaaaaaaggcagcaaagacuugggcuuggccccugcugucuagacuuuacucuccaguguccauguaaccaccuggugauagcuaccagcacugcagccuccccugagggaguaagcagagacugugaccauaaacggaucucacuguggcaaagccaagaguccuggagagccagauauucuccacuucccauuucugcggagcaagcuguagccgagccuauacacauuugcuauuugcagagaaaauacagcuggaccagggauggggcaguguaaguugcuggagaccuucaggacacagaaaauagauucaggacuaggacaugcaaguacagccaggacagggacuuccugggugcuggggauggguguguuggguccccaagcucuaccccacugugggaggucaaaacaguguggacaucccccucucuccucaggacuuccugcgcugugucaccgcugcccucaucuacuucgucaucuccaucacugcugucgccaaauacucagauggggcuuacaaagcagcuggagugaguggcugcccuaccccucucugaugauacccaauagcaccccucccaaugcucuagaccaucacccuuggcacccacuuccacaguggaaccucggcacauccugccccugccuaggcccugggucccugugugggucucugccauuccagucugcuaauuagagauuugcucugcccucaguugggaggcuagugucuaccaggcccacagcccauuucccuuauuugcuguaacucaagggcugugucugcccauuuguccuggucaguauauuucucagugcugcuugcuuuugcccaggcuccuggucucugaacccagaaagagguccuugcaauguuucuagccauccugucuguguccccugccauaugccaugcguguaucccacagguuuuuggcuuuuuugccacaauuguguucgcaauugacuucuaccugaucuuuaaugaaguggccaaauuccucaagcaaggagacucugggaaugagaccacagcccauaggacagaaggugaguggccaaucuguguggugucugauuaaagaacugaccauuuucaggauagcuguaggguucugcccuuccuuggggacaccuaagggccucagcuuagcaagagggggaaaugagugaauaccuguaccucuggaggcucccuaauaugcccccaaggcagcgaguuaggacaucaauucaucugggaccaaccuacuagacccagcuuccuuccugcuuggaagcucacggcacccaggcaaacacuggcacugucuggccuggcugaguuuguuuuugaaaagggacuucagucuguauagcuuaaaguggccuagaacucacuuuguaccccaggcuaaucucaaaacucguggcaacccuuaccuggcuugguuggaucuuuuuuccaaagaaagcgcaccugagcaagugcuuuccuggagccggucagcagugcuguggcuagacaagaguucucagggcaggucuuggcccuaggaucuucuccauuaaguacuaaaugacugaaguaggaccuaguugguuagauuuaggggccaccagcuucccaccgggagucccagacacugucucagugcuaaaaaaugaauaccaucccagacucauuucuggucuguuaguuaaaugcuccuggaugcugucugccuucaagccuuuguagcaaauguuggucagccagcucagagaccagagcauaaauguccaugaacauacauuuugaauauuguaugguuuuaauguaaaauaguuguuuugcaauagaaggauccuuggccuauauguuaaauaugaauauagcaagccuauccuacuuguaccucccuggcuaauggauaaggggggaagaaccagggcucggcaagggacaggacaaguaucagaaaacagccauagcacuggggacaggcauuagagugcagugcuuugccucgugaggcagacaaugccagaaucauccuuauacauagccaaacccauaaaauagcuucgcuugcccuaugguucuguguauuucaguucagggauaagaauuacugucuuugccuuguccuccugaauaagaguggagaaaggggugucaguguacaacucugccauccucaggggagaggggaugccugggaaugccugggccaccugggaaggaagcaucugugcugugagcuaaguagaagggccugaucuacccuaugugugccccaaggcccagccugccacuaggaugggagaggccggacccaggucuccuguuggcuggcuggcugcugguaccaccaccacuacuccacagcccaaggacugauaaccgcacccucugcuuuccuuucagaagagaacuccaacucggacucagacucugacuaaaggccugucugagcuuaacaacuagagccacucggcccucucacccacgcuguccugacggggcuccuggagcauggcaggaaugcccaugggagaacagaccgaggagcccgucucucaagauuacacucccgaggccucacauucaaaauuggcugugcuggcuuggcacugcugagcuagcgugguagggcacguugacaagccuuccuucuccccuuucuguccuugagccccuuuaaccucacugcccccaccgaagcacacaucaaacggagccaaucacuacagccaaucauguggcagcauggggguggggugggacuuucuguuacuaacagggacagauaaaaccacagcaggcuggaccaccagccccaaaccugcacugcauugagaugacuuucaggaaccuuuuauucaagaaguuucccuccucacugugaaauagggagaaaccuagcuagccaagucuuccauuagaggucugaggccuuuucagaaacggacccaaagauuuguuuacuagggcccagagacagggagccaaccaguauaguggcagugaccaagucacaaguggcugggcaggcccagccaagcacucucuuccuggggacccuaaaagacaaagugcuuccucuggacaccugggcaggaccacuggugacauggacuucucuguagucccuugggggcgguuacugugugugucuuugaugguguuuucuaacuuuuuuauauuuuuuuaauacaaaaacaauguaacaaauggucuuuucuguaaccuaagaggccccaugaauaagggcccaugucuugggcauuuguaaccuuuuuaucuugcaugugaauucccucccuuuaaaaaaaaaagucacaauggauuaaaacaaacugacuacaugcuuggagugcgccugacuaagaacucaccacugccugcagacacacugugugcccguuuccauacaagcaagcacaggagugcugacagcucugaacucaguugugagaaagcacuuacugugcuggguaucaggguggcgggugacacugcuggugccuuuacucaaccccacggucgaggcacuaaaggguaagcauacauucucauuaagauggcguucugcaacagccacaacguggggcuccaggguuuagaaacuaguugagcaagggaccucagagcaguggcuacgaggacauucuggucauugucacugaacacgcacugaaaacaggcgggcagucggaugcgcagaggcagaggggcugugcagugccacacagccuagcaggcugguccuuccuucuccagccgcuuacagccugcugacugugcuccagcucgacccacagggcaagccugcugcaaaagugggacccaaagccucugggagagaaagaaaagacuaaagcgcuuuuguuuguuuguuuuuuuaauauguccauuuauuaaacaagaacuccuucuugacaauacaguauucauuagugauuaguauugagaaaaguauuucccucuacauacaaaaauacagauuugaacaauaugaaaacaaucaagacaaguaccaugaaaaauugguccuucaaaggaaaguggagaggcugagggcagggugaggcuuugccugcugucuagcaaaucaacggggcaaaugccauccauggcucccacaucauuugcagugcacaggguccagccugggggucaggggagguccauccauggcgacaaugucagaugggcccagaugggaaacucaguacugcaaacaacacaaauucaagguucuuaaacggcccucaccuuggaauucccaugccaaacaacuuuagcuagacauggugguccacuucugugugcuaucccagcauuuaggaggaagaaacagggggauugcuauaaguuagaggucagacaggacuaccuagcaagacccugccucaaagaaaaccaaacucaagaaacaaaaugugguaacuauuaacauugucucccaagagugccacuauuaaauggaguggcaguggccaguccuggcagaaagcugucauuuggccacauaauaacuuguguugucacagaauuacguuuugacucuucaaaggacaaaaaucacagagcuacaaguuccuaccucagaggagccguaccuuuacucagcaauggcucagugaguuuuuccugaccagacaacuccauggugcagggucaggaaaacagaacgguggcuagguuauccugugcccuggcuuucccuagcccuccacagcacaggaccuacugcacucaggcuacccagaaacccaccagcggcagccacagugucaccuaaauccaaguggggcaaaucccagagcaagucuggggugcugccaggacacagcggcacuuagccuaucuauccuaggagacagggcagacaacagccgggacugacuggcuagggugggagggccaggagccaaaugcaagcgcucacuagacccagcaagcaggaagguggcacaugguugaaacuugugaaaaaugagaccacuuucuucucacuguuggugagcaacaguucuuccagucuaacaaacagucaaacagugucaaacagaauuacaagaacgagacuuuuuucagaacuauccucugacuuacuucucagacuaaaccagcagaagugcagugugggaagaacacagugcaagggacaggacuugccagagggggucguuuugaaaaauacauaggaaguuuaagaggaaauggcccaaacgucaggaccgauacuguggaaagcaauauugaaaggacacaaucaugcuacaaaaauaguguuaucuguuaacuaaauguacauccccgccccaauuccaugauugacaagagugcuuaugugacacauggaaggcaccaaaggugaagugguuaucugacaaaauauacagaaaaagaacugccuacuuagaaagaaaaaaaagacagacagacaaauaaauagcuuaguguuucuccauggguuccuaaucuccuacgaacgucagcauacacagacagcuuugcucccuagcguucuuccacauggaaccacaucaaaaccaaguuaucaaaaagcaaugauuuuaggcaaaugggucaauuucauuauuauuugaauuaguuuuuaaauaaguuauauaugaaugaaaacaauuguuuuucauaaacaaguuaugaaagaguuggaacagguaggccuggguuacaauacgccuugcucuugcccucucugccccuugaccuagccaauucuuuaagcccugaaucacuguacccuucagugccauggaaaggggacaggguucuggaacuugcuaaaucaguucugaaagaacugaagcaacgcccgguuaguggaggaaggcagcguccggcagcaucgggcaggcccgcccugcccugcccugggcuggggugaccaugagucguccggcagcaucgggcaggcccgcccugcccugcccugggcuggggugaccacgagucuuccuucacugaccuuucuccaggcagauuccuuggguagcuauucugacgaacaaggaggggccagguacuuccugcuggguaccagaugcaauuaugaaagaaaacaaaccuuuuaccccugaaguggcuucagacacguucuuaccauaaucacagccaaacaaguucugcuagcucgccacaguccaagugauacuaaccacuaaccaaaggcucacuugacuuagaguaucagaauaaagagggagaugagguaaacuaaugacacaauacacuguucaagaaccuauggucuaaauuugauucugugagauggcuuugaacucaaugggcuugggucccuccaccccuuuacucuuaggaggaaacuagaauggaguggggggggagucccaaagccuaagaacuuauauccaaugcuauacugaccagcaugaaaucaaauagaacauuaucuuuuggaagaaaauucuagaucuaacacugaugcuauugucuuucagagacgaugucuacauaaacauugauaggucagacauuccaaauuuucucaaccagacagaacugguuauuuuaaagaugucugcugagaagagagaaacaauagguuuuaaggagucagaaaagcuaacgaagcccagaaaaggggucugcuacgucagcaucaccugaggcagccugucaccugcucuaguccuuucaggagcacgaaagaccucacucuucugaagagggggagguuaaggacacgcuuccaggucagcagggguuaugaacauaucaaacgcuaucuaugccaacccacugcugccgcuggagccucccccaccacccccaggccucggucaugcaaauuucauguguccaccaaacuagacucugugccuagcuagcccuacuauggggcuggugcugacaaaagcagacagcaagaggcaccucagagucugcaacuuuaugaggaacuaaaagguacccggaaaccucacacacuagaagcagcuuuuuuuuuuuucagcucaugaggaucagucaacaauucucuacauagaaaguguaugcgccccacccccccaaccccugcuguuaccuguuuaaugucacuauugcuauguagaggacaucuucagaaaaagacaguucggcaggagcacacuaagcaugggacuuuugugugcucugaacacagaugcugucaucacuggcaccaccuccaucacuacaaggauggacacaagucuccacgcuccuccgacugacccacagagacucugacaugggcggggacgaauccucaggccaccucuuagauaggcaagagaucuccuccaaacaguacaugcaaauccacaaggucacaaacaaggcuagccaagacucauucacagcaagaauucacauacaugcagggacaagagaguuaggccuucauuucuucuaagacugacugaaccaauagaaaaacuucaaagauaaaggaaacuugaaagaaaaagaaauguuuucaacugaaucaugaaauucucuccagaagcauccagccaggguggaggacaaggcauaccaggucugcccguaagucuuccugccaagaguccuagaagggcccuagggucccucucagugagaaguucucagagagugcucagaggguaguccauccuugcuggcucugcuaugcccaggcucugcccacacugcuguuuuagcauauugcuaagaaggauguaggcagcuuacugcauucuugcuuugucuguagacaaaagcaaucugcauuacauggcuaucuccuuaagcagaacuucucugaaaagaauucacuaccucacuguguuugcccuuucuaggagccaauacauaucuuuagguuuucuugacugcagucuuacccucugagccuuuggcagggaagguagagaagacugguaccuggcauucagucgagaucaacagggccaaaauacacuuucuccgaagacaaguuaauauccaucaagacuaccaagugccagagggugucaaccccaugucuccacgaacacaccacauguccccaacaacugcaugucuugccauguuuucuccacccaagaaagugaagccaucuccucaggaaauggagacggugaaggcucacguacaaugcuccaaaccuaagcaagcggcacugguccacagggggcuuaauaaacacaaaaauaugccuuuuucaauucacaggguugcuguacaaaccucaaaucuauuaccuucuguuugcacagaggcacaacaggaaagauacaggugucucugcuuucacuuauagacagccauauugucuucauggcuugugcucaccacacuggcuguaaaggugaggggccuguucaucacgcuaugagagcauguacaagccacuucuggcucuacgggagcuaguuaaauaguacaaggaaauacauauacaaaagccacgggaaagcuucauagcacaaaggauauuaaauaguaaccaagauauaaauauuacaaugauucugucacuaagaugcaaauugcucucaagucucuuaggcccuaagacaccaccacauuaucauuuauugguauucauggucucaaugggucucaggaucauuucuuucagccgacaacacuuccucagaaggccuccuuucaucacaggauaaaacggguuuauugaagggacuugggaaagcgagcagaaaccccaucugaaugcuucuuucuuccgccucacuucaaagguggcuuuuuccugaggcccagugacaugcuaaagcucaggguggucauuccaaguggggcucggauacagauggagucuuugcaaccccauuuaaagggaauucucugaggcagaaagccugauuuugauuauauagguauaccaaccaaggcaaaaugaccagguaaaacuagcauaaaaucaagaugucccccacuccccacacacaacgggcucagguuggaaaagcacaaugugcacaaugugccgacucacucaacucggccagcaacagaaagcucucccuccaugaggggcugggcaggggacagacccaggcugcccucuggaggagaagagaggcagagagggagguacacuggacuagcugggucauccucugaacaugggaacaugccaaccuggaacugcagcagaacuggauuauacuggauauugguuuuagggagcc

SEQ ID NO: 4694 - RNA, 42133 nt, Mus musculus
cuuuccgcugccgaggcggcgggagccgagccccagcggaccgagccgcggccgcagcgggcggcgggcgcagaggcggcggcggugggguggucuggcgacggcgaugcggcggccgcucugagccugcccgcuccaggcgccgggggaaccggccgcgcggggcggcagcaugcggggcggcgaggagcuggacggcuucgagggcgaggccucgagcaccuccaugaucucgggcgccagcagcccguaccaacccaccaccgagccggugagccagcgccgcgggcuggccggccugcgcugcgacccggacuaccugcgcggcgcgcucggccgccucaaggucgcccaagugguaggugccgggcggggcuccagguacgagcgggcgggucggcggccuagcccgcgccuucuuuacccgcacccggccgcgggggaaggcccggccgaccagagucggguucgggcugcgcgguccccgcuccgcgcacuccguacuccgagguccuugggcugcagucccugcuccucuggggaccgcgcccucggccggagucugccuuuugcagcuccgaagccucaggggugccuggugccugcacaccugcuccggggccuaccugugcccucccugcuucaucgacaagagguuggugcgcagagccgguugcgagggccgugccaucgccuggcuacuacugugcuuagcaacuuguagcagguuuuccggcucgcguaacccccagacgguucucugcuaacagaggccgggggcuguggcaugguuuccucccuggcgccuagcagggugcccagcagaugguggaugcucaauaaauauuuguugaauggaggcguguagcccagaugcagugggggaguccagaucuacccacaaagccuccagucuuuacugcggacguuggcuuccuucauagcauccuguagucucagcacuggugguggcuucuugggacugcccaaauugguacccagaguuaagucacucugggagggcggccaguuugggaggugacagauacggggaacuuucuguuggacuuaggcauucgagagcacauuucuugguggguccccccccccccgcgaccccccagaguguuugguucaggggcuuguggguucuguuucgguuuugugguuuuguagcaggucccuuugggcaguguaguuuaucuuugugguggacugggcacaguccaguuuaaaaaaaaaaccuuuguauuccuccuauucucugucacagguagccuuucaccgaggccucaaaacuuuauagacuugucacccugacagagaagcccuuugcacagaacugcaacauauuugcauuuuccuucugggagcggcaggccuguucggcuuauuaacugagugcauacguuaaucuuucuugggagaaauaccauauguggacacccuuuaaauaaaggucccuguguuuguagguuguagacucauggagaguuuccucucuucucugcggaaggcuuggucuucugaugccuaguuuuaaagggcauuagugagaaauaaguggagcaaguucccuaucuuuacauuuuaaaacacucuuaauccaggaaucuggaauguucucagggauaccaagcuucuguuagccauugcuauuagcagagagaaugucggugugggagcgauacguaauccuuuuuuuaaaagagcuagcuagcuaauguuugagugcgguguagauaaucagaaguaagaaaagggcagggcugaacuuggagccagaagguggacuccagggccuggucagggaccuucuuaguuuacuuagcaggccuuugaaaguaaggacaacucuuaacuugccucucaggauggagauggagugguuuguacagaacauuagccgcucacugcugggacuuggcugucugcaggagcuggagcuggagccggagccagccaugcuuccuccuuuggggaggugugguuguguggucauccuuacuuuccauguggaaggacuuuaggggccagccuuuaaaagcuuuccuaguugccgagugucuacuguggauuguguacuggcaagugaagagauggucacuugagugauguggcagucuauggucugcugcccucuggguucucagccuugcuguuaggaccuucagggugauccaccuucccucaagaaaacagacaaguuccaagagauaagacuugaaauuuaaacuggaaaauaaacaagaaguccuuaugaggguccuucugcgaugucacacagcgcagacuccgcccagagagaagggaagguacuaauucuuucacuucaguaaagucuggcuuuuaaaaggcuuaguauuuauagacauugugaggugaggccuaaggaaacugcagauccuugcuuuuucccacacuugguccaguauugccaccacccuaggccucugucgauucagcugauucagcgauucagacucucugaaaccuauuuaaaauuuuuuuuaacaucagaucggagcagaaaacaugauuguucaaccuacuuagguuuuuuuuuuuuuuuuuuuuuuuuuugguuuuuuuuugagacaggguuucucuguguagcccuggcuguccuggaacucacuuuguagaccaggcuggccucgaacucagaaauccgccugccucugccucccaagugcugggauuaaaggcgugcgccaccacgcccggcccccuacuuagguuuuaacaggaguuccuaggugauucccauguacacuggacgcuggagaagagggcuugcuaguuaagauccauugccauucuuccagaggaccuggauuuaguuccuagcacccaggucuggggcucacagccccuuguaacucuagcucuauaggggaucugaugccauguccugucuucugugacaccuagguggcauauacucacuagaccacauauuuauacauuaaacauacauuuuuaaaaucuuaaaaaaaaaaaauccagaaaaccuguugaugggugcuagcucuugucucuguccuagcagucagcaguguucgucccuuaaaagagugaggggguaaacuuugccccagaucuccgaucuuuaaaucucuaaacucugucccaccccuuuccucagucauagaaugagggaaaaugaccacgugaguuuuaggaauugcagaauuaaggaguuaagguaaccgaaggugcucucuuaggugacucagaggcaaaucugagcauuugcaucucagaguuggguauucgcacaucuuuugcuuggugggcagccuugucaguuuguaaccuggagccagucagcacaguuggagauuguuuuauuguauucuugagaugugugggaugugaugguaaaacagacaaaaaccaaaccugcauuuccacuaaagcccuacaggaauauaaagaaacuauauguagcauaaaacagccacaguuccacgccuucgacucugguaaacacuggcugcagccacugugcagagccuauuggccccagaucccagaguuacugggucugggccaguagguuuaauugugacagacuuugguguccucuccuuugaagagcuggucuaaagaccaggcaccagggccugggagauaacugucagaaaaugauugccuccaaagccugcggaccugugcuuguaaagccagcccuggguaggcagagacaggcaaaucccuggagcuugcugguccaucuuaacuggcaagccccaguuuuccgugaacauucacguggcggucauaggaugacucuguuagccgguucucaccucuaccuuuaugugaucuacagggauguaauguaaccaucaggcuugaauacucaaguggcaggcaggcaccuuuccucacugaucaucucaccggccgccagauucaccucuaauaacugcugucagcaaacguggaaguaaagggaacuuaguucuggaaaggcuaacugaaagcucuguagcuagcuuccuacuuauggaaacaaacaaaugcuuuccuuucagaugggggccaggcagugaugccugcucuucauagucagcagcauaccgaaagcucaaucugguucaaacauggaugaguggauggauggauggauggauagauggaugagugaauggauagauggauggaugaaggcugggugggugaguggauggguagaugagugaauggguaaauggauggauggcugagugaauggauggauagguggguggguggguagauggauggauggauggaugcauggaugggugggugaguggguggauggaugaauagaugaauggauggaugaguaaauggauggauggguggguggauggauggauggauggauggaugaaugagugagucgauggauggguggauggauggauggauggauggaugagugaguggauggauggguggguggguggguggauggauggaugggugggaaggugaguggguggggaggugaguggguggggaggugaauagguaaggauggauggguagaggugaauggagauagacuggaacuuaugugcaggugguaugaacaacucuguagaaaauuaucuggcaauaugcuagaauuaauagugaauuagcaggguuuucauacauaagaucaacauguaaaaaucaaccauauuucuguauccuagcaacaaauuauuagaaauucaaauuuuaaaaaauccugcuuuaguggcucauaccuguauguaaucucaguauugggggcugagcugggaagguuacucugaguuugaugcuagcuagccugugcugaagagaaaaucugucucaccaaaaaagaaaagaauaacaaaacaguugcuagcuuuggaaaggaugaaauacuuagaaaucuaccacaauauguagaucucuacuaugaaaacuacaaucacuggagaaagaaaucccaugugaccuaaguaaauggacagacauacuguauaauggacuggagagcuguagccauaaugcauuccaaaaacucaacaacguuuguguguguguguuucagagacaagguuucucuguguagcccuggcuggccuagaccucgcucuguagaccaguuuggccucagagauccaccugccucugccucucugccucucugccucucugccucucugccucucugccucugccgaguguucguguaaaagugugggccacuacugcccuucuuggcaagauuuuuguauagagaaaagcugagucuuuguggacaguccaaguggcuccagagguggugaugggagagagguguuuguguuggguggggugccaggaaguucccuugggaauggacuuugugucucuuaucaggugagagucuuagaaguugcuuuucgugccuggccacugcagagcugcaaaacucugggcuccuguucacgaagccucccgacacuugcuguggucugagugcugcucccgaaucuccaauucauauccuggaguccggcacuaaugagauggcuaagaggcagagccgagccuuagcagggugaggugcucuaucagcucugggcaggcugaggcaagaggauaaggagcuugaggauagccugggcuaaaaaaaaaugguuaagguuugggaagucuugagcuuaguccuuaggaauggugucaguagcaucguaagaaauggugagguacaguccauuaugugugggugcacagaaggcuuucaccacguacaaaaucugcuaauuccuuagcuuggacuuugcuacuuccagagcagcaguacauuuuuauuguuuaucuuagccaguguagggugccuuguuauaguagugugauuagacagcuguaucccuggucauucuuucucuggguuagagaaauggguggccagagccuugaguggcagggagacauuuuuugcuaucugccucccuuuccauauugaauuuuguucuacaugcaaguauuuucucuuaauaacuacugggauauguaaaagcuauauggccaagguauuuguaaauauauuuugaaucugaaucuuauuucugagagcagagggcugguaggaagaacgaaccauaccuaacuucaacagggauguauguguauaaaauuauauauaaauuaucauauauauuguaauauaucauauaacaugauguaugauauauaauagaaauguaauauauaauaguuauauacuacauaucguauauguacauaauauguuaguauuugauauaauugcauuauauauauuaauauguaacauauauaauuuauauuaauauauacuauguaauauacauauggagguaguucagucagcaagcaugggagaggaaguuuuuaaguaguuccccagaagccuuuugaaaagauaaaacuccagguguggugguggacacugguaaucccugcacucaggagguggcucauccuuggcucccugacuagccagccuagucugcaaguuucaggccagugagagaccaugacucagaaaauauugugggcaguauacgaggaaugacaucccaaguugaccucuggccuacacacacaaaugcagaugagcacacacaucugcacauauaccuguaacugcuggcauauaccuccacacagauauuugaaaaauaacuggcaccagcuuugccucagugcagauuaauuugaaagcuaauuuaucagccauaaucugcaguucucccuuuaccuccuccauaauuuggaggcccucagggagaauggcuuagguaacacugaacacuggaacaaacaagaagcuuaaaaguguuugguuaccccggccggugguggcgcacaccuuuaaucccagcacucgggaggcauaggcaggcggauuucugaguucgaggccagccuggucuacagagugaguuccaggacagccagggcuacacagaaaaacccugucuccaagaaaaaaaaguaaagccagagguccugaguucgauucucagcaucauggcucacaaccaucuguaaugggaucugaugcccuauucugguguggcugaauacagcuacaguguacucacauacauaauuuguuuaaaaaaaucuuaauaauaauaaaaacuuuguaaacccucccccccccauacaggguuucucuguacagcccuggcuguggcuguccuggaacucauuuuguagaccaggcuggccucgaacucagaaaucugccugccucugccucccgagugcugggauuaaaggagugcucaccaccgcccggcaauuuuguaacuauuuuauuuaaauauuaacuauuuuauuaaaucgauuuguuuuuguggugcugggauuaaggcauuuaccaccacacccagcaaacuaacuuuaaaaggaaauuaggaaaaaaaaaaucaucuucguaugggacacucagacgggcagaaucuuggguacuucaugagaggccagagguugaugcuagcuugcucuuugaucacugacccuccuguauauggaggcaaggucuccucucugaaccuagagcucacccauguaucuggaguuugcucuggggauucccucuuucccuuccuagugcagggacugcagguggauggccccgccuaccuggcauuuacauggcaggcaagcacugugcccugaaccagugcucuagcuggcacuuugccaaguuaaggagccaaacucuuaguccucauguuugugugcccaggguuuuacccacugcacugcuuccuggccuggaaugucuguaucugaaaggucacauaaguaaguaccuaagugucucugaaggaguccaugugcugcauucucgggucuucguugccgcugucugcuuguuguuaugaccacaucuguaaauguccucaugaaguagccuggaugcuucuuuugaaucguuacggaguuuguuguugaauuuccaggggugcaguuacuacuucaaagggcaauccucucacguuucuaaacauuacaaacccagacuuguuuaacacgucucagaaccuaugugaggucucuguguccccggucugcacugugcuuaaccauacacuagagacaugcagugaugagcucugucaguccuuauggcuuccccugggucaccaggcccugccaguucuuuccugacagcccuagaggcacuguguuccuaacugucaacaguucugagucccaggaggagaagcaagggugggguuaugcgcaccuccgagucccaggugcuucuccugcucaagagauggcugcucugugauugaaguauguccccaaaguuguguuauggguuuuguuucucagugccagagaguggggcgguggagucuggugagaaguguguggguccugggugcagaacaccaugaauggaugacugcuguuuuccagggagugcucugcucaggagacuggauuaguuucugugagaaugacuuguuacuaaaagaggcugccuccugcccccuccagcaugcccugcccuacacaagccugcugaucccucuucccaccagggugguagcacgagggguugaagucagaaugggggccuaagcauuaauuauaguucaagucuaguauacuauaaaccaaagcaucaugagguacauuucuuucccuugacuggaguuuuuccuaacccugauuuuguguugaucaggagccuugguuaccuuuuuguuguuucugacuuggagguacugcagggugggggugggggugggggugggguggcucagggccacugaaccacuaagguacacuccugcccuucccuagcaugucaguuaacauccuucuaccucgcucagugcugcacuugggcuuaucucucagcuguucuucccucugugaagauugcccucuuagcucuguuccucagguuaccuccugaucucugugugugguccccuccccuuccccccaagucuuugucagccccaugggaguacgguucuaaguuuuugcugugcccccagugccuagcacaucacgaggcacugacuaagcagaugaauauacguacuuugugaugaaugagaaaaaacaugggauaauuacucagcauaguuuauaagguuaagguuuuuaaauccaaggaauuuauaaggggaaauucauguauguucauaaacugccggauucaguuuuaagcagaaaauguuagggagaaagcauggaaauacaguggcauuguagugccuuuuucuuuguuuugaacuucucuugugaggagucugcugcuccugggaacugaagccuuugcuuagaagacggauuuuuguaccggugggggaaccauaggaagcuuugccaagcugcuugcuuagagacguguaaaacgaaauccagggauccugcaauuauuauuggaguuguuugcuuucuaauaacucuguucagagagggagccgcuccugucugccaagcugggguccuuugguaccccucagagcagaguagaugcuugcagccaagaguuaggcugaggggcaugguggcucucagaaaaccuucugauuaaaagcaaagaaccacagcuccaggggccuggggaagccauaggcggugaugaaguccaggaucugucucuggaggcuggagguguggcucagggcccuagcuuccuuccucagcaacacauacccaugcacagauacccaugcgugccccucaugcacuugaaaggaccggcugaguuugggaauugaguuaacaggcaccuaagguugucaggguuucaccaagcuauggcuaguucugggguguuucuuugcugccgcugcaguuugaugauggggugcaauggaagccuucauuuuugugguuucccauugauuccaguguagcuaugaaaaacaguguaaggcuuaaagauuucagugccaguggggagaagaaaaagaaaaagaaagaaaaggcaggcaggcaggcaagccaaaugcaggcucagggcucuucuucuggaaaucucuucagcugugugcgcccugggguuugugaguguguaaaacuugagauucagaccugugcaugguggcagaggcaguucagccacuaagugcuugucacacaagcuugauggccuaaguucaaucccagggucccaaugugaaggagacucaaauucugacagcuguccugugagcuccaggaugagggccauggcacauacaagcaacucuuacauagcacacacacacaugcaugcagaguaauaauaaacaagguaaauggauuaucacacaccugccuugugggcacuaggggccacccagggccuccugcacaccaggucagugcuuuaugcuugagguucaucuccaguccagagccugcacuuuuuuuuuuuccuuuuuucuuuuguuuucauuugagacaggguuucucuguguagcccuggcuguccuggaacucacucuguagaccaggcaggccucaaacucagaaauccgccugccgcugccucccgagugcugggauuaaaggugugugccaccacugccuggcaagccugcacugagauggcuggugcggagagcaggggagaacugucuccuuuacucucccuguccuuggggccaagggaccucuggguucuccucuuggucuaaauccugccauuacaaacuguccaugcuccuccagaauuaagaucguuaguuuuaaaggauuuuuuuuuuuaaagaugguuacuacaaaauauaagcaguucuaguagugaggaaacugguaagauguuacaaacuguucaaggaaauuaaaaaaucguuacaucccacuucuuccauaagauagauguagauaucacucuggguuuuuugugcacagauagaaaucauuuucagucaaacaaauuaguuccauacaguuuaaccaguuauaaaguaguucagagaugaagugugcaaauuccacagaaccagcuaguuuugaaacgcaaaucugacaagaucugauuuucauuggaaguauuuaggaaccuuuuuacuccacuucaaaacuguuuaguuuauccugagaugacuacucugaagggaaggaccuaugaaggcuaguuuuuuguuuuguuuugcuuguuuuaagacaauuucucuaacagcucugacuguccuagaacucucuguagaucaggcugguuuccaacucacaaagauccuccugccucuaccuuccaaguucuggguuuaaagaaguguguuaucaccgcccggugaggguuagauuuuuacccaugcuuauuaggcccuccagauuccaucugucccuugucccuuucuuccauccugaagcauugucccuacauaggacaggcauccuucggucuugagcgccccacucuagauuuccuguuuaucccugaucacuuuaagucucaaguuagaugcucacugcuguguguaagaccauguccucagagccuuagccuggccuggcugggcccaagugacucaugagaccuggccagucaggagucuaggugagagguugccagucaccaaaggcuggcugggaggugucgagccuggcacuuagcugugggcagugcuugguaaauauuagccauuauugugagcacucuggguccugucucaucugacucagcuucuuuuccuuuccacuucccucuauguaguccauggugguugaaagguucucauuucucuucaguagcuuuggucacacacugcugccgcauaaccccuguucccaaccugugaggccgagacaggaacccuguccucauuucugccagcuacccuggcccagcccuccuguacugguuuucuuugcuugacugagcaccucuguccugugacacuagcuugaauuguguguuucccuuucuugcuggucuggucccauuguuuucugaucauugcccauacuggaggacuccugacugcucagcaagcauuaucagcucauccaagcuuuggucuucuggauuguuuggaaaaguuuggaaaaguccugaguccaggaagaaaagaccuaccugauucaugccgaccaacacagcagugauagccuguguucagggugacuacaguuagacucucagccauaggaggagccugugugugccccucaugugugugugcccuucaugugugugccccucaugugugugugccccucaugugugagugcuuuccugugggggagacugaugaauuucagaggcucagguauuuuuagcccuguagcuuaggaagcaccguguauaagaagccaaguucucuauguguuuaaagggcuggcauugacccagcccaggaagacugccugagugagugucuuggaacagcuaggaggccccaggguuugcacugagguaacuccuugggauugguagauagaauuuugccuuuuggguuuuugacuuucugggucaguaaagcaaaagcauacuagugaggcagaaagcauccaugauccucguagaguauagcugugggauugaagcuagggaacacaguacauuguugcccauggcugugugugagaacacaaguauggguaggugggcuggugaggagguuucggugauauagccagccaggcugguccuacacacgucccauguaggaccuucacuacauaucugggaaagccacagcugcuggucuggacuuugaggcucaaggguugccaagcgaggagccuacagagaaggacugauugccagaaguccuuggggagucugcaggaucagggguuugucaaaacaucuguguuccauuacugguucuuggagguuuguuuguuuguuguuuuguuuuuaaaugaccaaaucaacauaguugaagaguuaaagaagaagaaucuagcuguuuaaaauaaaugucuuaguagagcauccaauccauaccugacaaguacagaauuuagccagagaggcucagccgucucucgcucucaacauccugcuacaaguagcuauggcuuaaguuggguaggcugugcacugcaugcucguuugcuggagggugaaggaaggcugaagugcaguuugcaugcucugauugcccagccacuggccuggcacuaggcagcgucugccggcagggaaggcugguuguugucuagaaugaaugugguuuuuuuuuuuuuuuuuuuuuugcuuguuucuucugagucagaggcucaguauagcuuagucuggcucccaguuaucaauacuccuccugccucacuguccugaguauugggauuauagauguccuugcuacaccugccuucccaucuuagagguucuggagggagcagugacgugugcuugcuuuuuguuuagggcgggggauugacuggucaaacauucucucuacagcuuguuucuuuuguuuguuguucuuucagcagcuucugucuuaucccguagggaaauuuauuuuagacauagcuugggccugguguuaagccagauaggagaguaaguucucaacuacgcaaagacguaaacucuaggcaucuuccagauauacuacuuaaaacagauuuauugugaauuaauaaacauguggcaucuugcagcauuuucuuugcugaaugcagauaauaguguauucaacaccacauaguugacuaaaugccuucaggcaaacgaguaagugauuugcuggcuuacuucaauaaucguuccuguuuguugaacgaacaguaguccccccaucuacccccccccccccccgcaccccgggcccccaggaucuuucucuguaacccuggggcuuguagaccagucaugcuggucucaaacuaacagggauccuccagcaucugccucgccccgaccuuuccucccaaugcugggguuaaagguguucucucaguuccucuuaaaacccaaguuauggggcgggauauagcucagugguagaguucuugccuagaaugcacaaagugcuggcuucaauccuugcuacccucucaggaaaauuucgaaguuaccagaacgucaaugaugugugguagguaguagaggcgguguggacagguaggagaauucccaccugcggcguaagggguuucuuccuuucuucuuucugccccauacccaucaucucuuuugcuguuuccuaggcuggccuugaacucgugaacucaaacaauccuccucuuucagcuucccaaguagcuagggcuccagggguucaccacugugcccauaccuuugcgggucaccaggcagcuuugcgguuacacucagcgcugggcuaacugugcugccuggcgcacacacacuuguugguugcaggcugcguuggagcaagcacccacagggucucuugaaucuugcagggcuugagccacugaucauuuucucucugacugccuggucgagggugaccugugaccccugggccucaguggcauagcggaugaugcauuugaacagaucucagcucuacccagcuuuguucuggcuccacuucugccugaagccagugggauacuucauucucugccaaccuggccaguuuaggaagggcauccaucagucagccuugucugguagagacuuccgagcauugacugccuuggacugaggaccuaggggcgagacugguggguagcuaaggggcugugccacuguggcacugccugucuuagagaggugagggcuggcuaccaucagccugaaagcaucuugugaguguuaaggauugagggcagaggaagcuacuguucuaaggaaggugccagccccugugugguugcugucaagccaacaaacccagcggggagaaugcuguguuuuaaagugaguggaauagacugcagggaguagucgggagaccuugcugccuugccuggucuuguuuguaggagcacagccuugcuccaaaugcuguauuaagaggccuguggagcaaagcacauuugcagcacauuuuggucagugcagggccguguucagaaugagcccugcucuccugcguuucccauuuuacaguagcacacaacucacacagcucuggugggucagagcagucggaaaggaguggcuaagcagcguucaagcaucccaguuuuuugaacuauaccuguaaugcauugugauaggugaugcauuuuaaauguugguaucugacugccagaucccgugguuugauccuagugagcacaaaaccgucucuguuuauaucuaucugggucaaguuagaggugccuggccagccugggugugggcguaccccauugcauguaaccccucagagucugggucuugagcauggcacaucaugugacgagcagucuggagucacucuugauaugauggaauaagugaccagcuccagaagggcgaugagcgagugugugggucuccaggagcugugcucugccuccaucacuggccuugcugcugcucucugcacacacaucgcuucagguuuccugcuucccaacuccugcuccagaccccccaagucccugcuuaaagccacuccaguuccucuccuacuccagccucacaucucuugaagggucuuuggggaaucuggggcugcacagggcuuacaggguuccuuuauguuggggaccucagaguugaguacgcuuguauuaggaauagcacacuguacucgaccgaaaccccacagaauaggaaaacaaccucuuaaauuaugugugccuuuaaaaaaagaaucaggcuuuuauagaaaaaaguguuuuuaaaauaaagcuugcugggggguuagagagauggcucagcaguuaagagcacugacugcucuucuugagguccugaguucaauucccaccaaccacaugguggcccacaaccaucuguaaugggaucugaugcccucuucuggugugucugaagacagcuacaguguacucauauacauaaaauaaacaaauacaucuuuuuaaaaaaguaaaaauugccagauuucucagcuaucaaggauagccuccucaaagaauuggguguauguuguguuagccuuauuccugugugcagguuacuuugauggcaucuguggaugcuguuucauaacuuauccuuggcuaugacagcuugaaaauggauuuacauuauuucucuuaaggacuuuccauggagcuggcucugugguaguaugcggcugugaaagugugaaaccccacuucagcucucuagaguucgccagaacagccagggugcagcagcgcuccugccuccuccgccugccucugacuggaucuaggggauggagccgacagaggagggguggcucuguagcucacuggccggcuagucuagcucaauugacaagagggccuuucuuaaaaaagaaaggcaaaggaugauugaggagagacaccagaugugacucaugaccuccgugccuguucaugcacgcgcacacacacaaaccuuucuauugaaguucagaguguauaggcacgggccccaacuguguguauguagcuucugguagaccacucuaaugggcucugucucauuuuggaaaugaaacuuuuguuuuaugauugagugacaaaaaugucauacuuuuuucucugcuaaacccagacacaguacuagcgcuaauuuuaaugucaugauuuuguauuaaaaauuaaauuaggagacacccagcauuuucuuucugaaaacauaauucuggcaacauugacccuguggggguuggauaugugcuggcgaggcugguggucugcacugugcugaguuggcacauggacuuguguguuguucugagugugcguacaagcacauucucacguagcuucuccacagcucgacuacagaguaguccacaccccucagcaccuccucgugcagccucacccagccuuugccuggcacucacugauuccgcgugccuacacuuugucuuuuccagaacguccugaaaguggaauuguagacaguauauuuuugaggcuaucuuucacuggcauaguguauuugaaacucauucauuuuguauuuuuugucaguaguuaauuucuuauuauuguguaguuuuugauuaugaucuauacuaacuuucuuccccuuuuccucucccuaccucucucccucaguuccguucccuucauuaagaccuagucuugccucagccuuacguacacauaggagacaggcacccagcucugcuagucucacuacucauucaccucuugggagccgcugcguugagauggauagauggauagauggaugauggauagauggauagauggauagaugguuagauggauagauggauugauggauagauggaugagauggauagagcugcugugguuggacauacacuuucuuuguguuuuccuaccugggaguggaguggagcuagagaugcagcucuuucuagaguacuugccugccauguacagaaagcccugaugcccauguggauauacccagacacacacaggacuuaagggaugaccgaauaguagagugcuuagguccugguucacgucacgcacaugcaugagcgcgugcccgccuguguguguauguuugugugugugugugcucacgcgcauguuuccuagaaagaugauugcugggucagaguauaaauguauguuauuauuauuauuauuauuuuuguuuuucaagacaggguuucucuguauagcccuggcuguccaccugccucugccucccaagugcuggaauuaaaggcgugcgcugccgcugccaccaccacccagcauguuuuauuauagccuuuaaaguuuuuauuuauguguauggguguauugccugcauguaugucugugugucauguccaugcuuggugcucaaggaggccagaagaaagcuucaggucugugggauguuaguaaugacugucauguugaugcugggaauugaaccuagguccucuggaagagaagcccaugcucuuaaccaaagguaacuuuuagcuccuuguucuaauuauuuaaggacuguguaaacaguuuucuagagugacuauauuuguuuguuuuguuugguugguuuuuuguuuguuuugagguaugugugugugugugugugugugugucugucuaucuaucucugacuguccuggaauucacucugguagaccaugcuggccuggaacugggagauccaccagccuccgccucccgagugcuaggauuaaaggcgugcgccaccauccccagcuaucauuuguauucuuacuagcuagucuaugacaguuguuguagguguacugcuuugccaguguuucauagucuucccucucuccugucuguuuagagguaggucuuacuguguaggccaagcuuccuugaauuugucauccuccugccuuagcuccuaagugcugggauuauagacguguaacuauguucuuuauauguucuggauauugacucauauauauauauauauauauauauauacacacacacacacacacacacacacacacacacacauauauauguguauauaugugauuuauaaaauuucucccacucuggagccaagccaccugugauuucaaggccagccuggucuacagagcaaauucugagacagcuaaggcuacacagagaaaaaagccaaaaagccaaaaaaaaaaaaaaagucuguaguuuuaucguuugcccuguggauuucuuuguguagaagcuucgcuuuaauauagugcuaauucucuauguuaacguguguuugcugaacucuuugguggcauaucaaagaaccauuagcaagucccguaucgcgaagcuucugccgccccuccuccuaaggcuugccccucagcacuucugcauucuugccuauuuuguuuacugguugaaaccaauuaugaggaaaagaauguugacuguugccucucugcuugugauaaguuuuugcuucguguguuuagaggcucuguuaguaguuguaugcacguuugggauugcucuguugggccuuuuguguaauguaaauucccuuuucuucauggcagcuuucagggugagguuuucuuugucugacguuaagagucacugcagcuuucugaggacucucgucuguauaaaugcuaacaucuggucuguuuauuguuguaaacaccacaguuucguaguucccuuuugcuuuccgcagaaaccgugucauagggagcuaaaauucuguacuuaccuaucaggcauauuuuaaagaagaagguuaugaauuacuggguguuuuuauuuguauuuauuguggguguuuuuuuuuuuuuuagauuuauuuauuuuauuauauguaaguaccauagcugucuucagacacuucagaagaaggcaucagaucucauuacggaugguugugagccaccaugugguugcugggaauugaacucaggaccuucagaagagcaguuagugcucuuaaccacugagccaucucgccagccccuuguuuuuuguuuuuugagacagguuuacuaaguagcccugacuggccuagaacucguguguagaccaggcuggccucaggcuuauggcuuucugucugucucugccucccugagugcugugccaccaagcuuggcuccuguucucuuuuugagacauggccacauguagccuagacugggcucuccaugugccuugagaguuguacaugcagugucugagugcccacacacagaaugaguaaguuaaaaaggaagccacgucugaggacuggcugugacugacagggagagaagcaucaucuaucugagagcugugggcauccaccugcucagugccucugcucagguuuggggaguaagaaacgagggacagcugcguccuugucauuguccuuguccacgagugugaagaccccugcccccugccuggauugugcaccugcuccucugcucugggucugcggcaacuuuaggucuaaccugggaacacuggagggaaaacagguuccugccucucgggugggcuuccccauccuccucuuaaagcuuccagaggccugcucugaaaaccuggcccaggcggcagucaugggaggcagacuggagacaggccugcuucaugaacugaacuggaaugucaaaaguugugauacuuggaugcuguuuaauuuguuuuuauuguguguaacugacagucuguuggcuugcuuugcucuguggcguugugauuuucauguucuauuuuuauaauaagcaaauguuuacaucacucuuggauggguguggcugugcuaggaaucccagaaaggaacccauccuaauaaggaggagcuuauuguucauaucugcacgguaaugaaugggcuuccauggagggugugagcacaagcuuucuagaaaagaguggugaccacucauucaguccaaaaccaaucuuuuguuucugcuuucuuccccucugacgcaugucccuggaucaccaggucgguuuucacuuggcugcucugcccucccugucaccuacuccugcugcugaaucuuugaaccuuuggcccaugcaggcuagaguucacuggcucccgggaggcugccgcagggccaggguaauuauaaauccuccuguugggugcuguuucaaaucuccaaucuauaaauagcacaggcgacgggccaguucugcagguuuucucuaauggguuuuagaaauguauguagcuuccccugggccugugcuuugggcugacacgggacauuaauuauagcuuguuagagauguccuguuaccuguggacaugguuucgugguugggucagggaugcuuuucugguugcuggguuagucauugcucagccgucuuacuacacauucagggcuagagcagggaaccagcuuuacauaaguccaggaauagggcacaggugacggcuccugucgcaagguagcaggugacuggagaggagccaagucccaggggugugugcugagugcuuugaggagaggccuggagcaacagaggggauuaggggaugguucccagaggaucucucaacuuuguagcuccuuguuauaaacuuauuuguuaaggaagucuuacaagcaauaccaauucaauuaaaaaaaaaagaaaaaagaaaaaaaagaaaaauccaguaaggcagaagaagauuucuucucucucucucucucucucucucucucucucucucucucucucucucuguuuuaagaagaagauuucuaaucugaaugagcagccugccgugugugauccuuuugucuguguguuuggauauacuggggauggaacccugcgccucggugcaugcuugcugugcaucccaccgccauuucccucaguuuccgcugagcccugucaaucauuaacgcugcuuccacauggcuuugcuuuccccagaacaucaccgucaauaccaucauaucacauggagccuuuugauuccugccuuaugcacuuacuauggauuaacacuaauccuuguuacagguguuggggauccguuccucuucccugccgagcagacaucuguuugauggacuuccgguugcucgcuuaccuacuuacugaaggacauuuggguuguuauuagaucugggaggucaugaaucgagucagcgugaauacuguauucucugggguaauaguggggcgugagacugccaggccauaugcuaugcgugugucuaacuuuauaggaaacugccaggccgauucagagcugccccaucgcccgcuuuccaguugacucacagcaccuggaguccuggccaucgcuuggcaguuguagauuggagccauggaguuaaucgguucgaagugucaguggcuugaacuugccuuucccucguggccagugguggcagugcugugcuuguuugucaccgguguuucucgucaaguguuggguuuuguauuuggaguggggacaugugccccugaaucugaggcagcuugugagagucucuccuucuaccacgagggggcaggaaucgaaugugagucaucaggcuugguggcaccccccauacucacuugaaucaucuuaccaguucucaacauucuacucuaaagugaacuuugugaaacagccaacuaacacacacuaauggaagagugaaacccauguccagaugcccucaccuugcucugaccgccccacaccccacucuguccccucacuuugcucuggcagucccacacccaacucucuguccccucaccuugcucuggcaguuucauacucugucccagcccuucuugcccuuuuuuguuauaacuuauuuaaaacuauauuuuagcuuuaaaaaauuuauucauagccgggcgugguggcguacgccuuuaaucccagcacuugggaggcagaggcaggcggauuucugaguucaaggccagccuggucuacaaagugaguuccaggacagccaaggcuauacagagaaacccugucucggaaaaaaaauuuuuuuauucacuuuacaucccaguaucacccaccccccauuucuucccaguaccuccuuauucagauccuccacacauugggaguccccucuggucccccaccacacacaaauaucaaaucacugcagaauuaggugcccaccgagaacucucccaccaagaccagacaagguggcucaguuaggggaaugggaucuacaggcagacagcugauucagggacagcccccaaucuaguuguugggggaccugcaugaagaccaaacugcacaucugcuauauuugugugaggcccuagguccagacuguguauuucagcuuuuaaaaguauauuuuauaaguguuuugucugcguaacauguauguguacuauaugugugccuaauuccugcagaagucagaagaggcuggaaaaggaguuacagacaguucaaagccacaugugggugcugggaacugaacuggguccucugcaaaagcucuuaagcacugagcuagcuauuuaucucagauaccauaacacuauaaauaaauacuaaguggacaucucuuaccaguugagaccuuucaacagcugcaauaucuguagcacauuuaaguucuaauuucuugaugucaucugcuaucuaacauaaacccacuuuguaccaguagccucaaaaauaccuuuugcuuuguuugaauuaggaucuaaacaagacccacucauuguauugucuguucuuuaaaagaauuauuuugacuggguguggaaacacaugccuuuuuuuuuuuuuaaagauuuuauuuauuguuauauguaaguacccuguagcugucuuuagacucaccagaggagggcaucagaucucauuauggaugguugugagccaccaugucauugcugggauuugaacucaggaccuccagaagagcagucauugcucuuaaccgcugagccaucucuccagcccccagcacaggcuuuuuuuuuuuuuuuuuuuuuuuuuuaaagauuuauuuauuguuauauguagguacacuguagcugucuucagacacaccagaagagggcaucggagcaucagauaucauugcagaugguugugagccaccaugugguugcugggauuuugaacucagggccuuuggaagagcagucagugcucuuacccgcugagccaucucaccagcccagcacaggcuuuuaaugcuagcauuugugaggcagagguaggcagacagacagaccucugaguucaaggccaaccugaucuacauagugaguuccagccaaggcuaucuagagugagacccugccucaaaaagcaaaacacccaacaaacaaaaacuuuuaaaaaugauguguacuuugugcauauauguauaugugaaugcaggugccugcccauggaggucgaggccccagucccuuggaucuggaguucuaggggugguuuugagccaccugcuauggguacuggggauugaacuugagugcugcguaagagcagucaguguuuuuaaccacucagucaucucuacagcccccauuuugugagucucggucuguagcacucccaucuucuuuggcacugugggggaggggcagcauguguggaguuagaagacgaccugggccgauucuugcuucugugcuguugcugaguuucuggggauucuccaccucccaucuugucucaggaacacuuuaauuacagaucuccuacugcauauggauucuguggcuucaaacucaggccucacacuggcacagcgaucaccgcacccacugagccauuacacccccacccccaccacugaagaaaugaggccguccaucugucugucccacaugucgucaucgucguccccucugcaugauuuaccauucauucuucaucuucucugaccugguaaaugcuagggcucagaaagcugugcccacacaccgugcccccugcggccauggggacaggcagugauggcugucucugucagaugacugaugcauacguauuuuaagucccccaagcauuuacauggggccucuaacagccauugacgaccauggcccaucagugguuucacguggccuugagaguuuugguuuguuucacuuugauuugagucagaguuucuuauguaacucuggcuuuucuggaacucacucuguaaaccaggcuggccuugaacucacagagaucugacugugucugccucccaagugcugggacuacaggcaugcaccaccaccaccuggcuuuuuuuuuuuuuuaaacuauguagccgugguuguccuggaauuuugcuauguagaucaggcaagccauggauggaaagagauugccugucucuaccucccaggugcuaggauuaaaggcuucaccaccaugccuagcaagaggagguuuugguauugucuauugauauguuugguuguuauaccaggaacuagaugcccacugacaccugcugcagagggaccagggagaccgauucacacggcaucacagucaggaugccgcucaaaacuaagaaugcccaauccacaaugucaguagggcuguuucagaaaucuuguucuagaguguaguucaugcucuaucaggaauuuggaaggauucccagugaccaaggacuagaacucugagccauagagcaagggcuaugggaccaggaagcagaggcaggcggauuucugaguuggccaccagccagggcuauauggugagauccugucuucaaacaaacaaacaaacaaacaaaaccacaccauacuuuagugaccuaaagacaagaauauuuucuaacacaaucaugguaucauuucccaaaucuggaagcagacacugagaaguuagagacucugucgaccucauuccuuccuguuuccccgauugucucaaagcucccucuuauaaggaagucuugacuuggaugucgaauuuaagcaucugucucuuuaaucuccucgcuucuggaauaguuugucagcucuuguguuucaugccguugacauuuuggaaggacacaggccaguuauuuuguagaauggcccucaauuuggguuuguugacguuuucugcuguuuggauucuggucacuuugugguacugucaggaagcccacagaaaugaugacgcauuccuuuuagugaucccagccuacugagagagaugggugccaggaguuucuguugccaagcuacacuuugcuguguccuuaauguucuuagggagggcacuguuagaccguggaagucuuuaagcucucaugcguuacuuuggaagacaccagaucauucuuacucaaaucaaguacuuuuuaugaugguugccaaaagaugauuuuaaucugcccuucuuccacgugaguugauuuuugacucuaaggaaggacgugggacuuggcuccucugcgcuagucucugacuugcugggcuugcagaugugugcugccgugucuuuucuuguguccauaauaaacucaugagcuuuauucauaaaccuggauacucuggggucuacacccccgagcuggacucucagcccccauuauguguguugaaacucagauugccucagauuuggccacggugagcuccgugugcacagagcgcauucccuuccuucucugcgcacagcgcagggcgucuggacucuccugccgcgguccugcacugcuccagaagcucugguuccuuucaguagaagagaugguacuuagaaaugaagguuuggauaugccucacacacgaugccgagcucucucucucacccucccuccuuucuucccuccuuuucucucucucuccuucccuucuccccuccccuuccuucuuucugcuucagaucaguuucacuaagaaaccuuuguucucuucaguagaaaagauauuuaaaguagccagucugggugcuuacacuuacuguaaaguguucuccugacugaguuugauuucagcucugcuaguaaugagacagaaagaucuagggcagguugcuagacaucuuugccucauuuuuauuuuauuaauaagauggaacuuaaaaacugauccccaacaagauggguagugggcaguugccauccauccugaugaccugacugcuuuggcuugcccacugccaccccugcccccugcacugccaccccccauacaaaugaauaaaaauguuuaaaaaaauuagaaccucuauaauccucacugggacuugcuggucaccagcucagcugaauaaaacaugagugccagguuagugagauucccugucucaagggaauaaggcaaucgauagaguauaccugccacccucugaggcucugcgcaugugugcaaacacacacaccacacacagaccacaccacacaaaagucaugaucuuggaaguauaacucaaugaccgugcaagcccagcaugugggaggcccugaguuuagaccccaguacuaaacaaaucaaaacaaaaaauccaagaacaucaaacuugucuuuggaagaagcaaaugguugcacucucaacugggaguuuuauggacuguggauuagaccucagcuaaaaaccacucagcugauccugaauugugcacgguugauaaagguuaaagaggaggauguuugagaggccaucucaguacaguggauggcccuacagaagcuggauuuuacuaaguaaggcugcagugucaccauuuauaaauacaguagugacuagguaggcaaggggacaaaguuuugaguauagaggcaccauguucagucagugcugcuagcuuccuaggcugggucccuucuuccauggaucagguggagaugcugaggccccaagaacagugggagauaguaaauugagcuucccucagcacacauacaccucuuagaacaguucacucuaccuucguccaucuuaagugggaugcugccacagccugucgacuuuuggucaauguccuguuuucacuugauuaagggcaugccaaagccagugggauggcguugguuaccugagauuaaagaggaaaggaagaggggaggcuuugcuuuggaaucguguggggauggauacgaccuucuggacuuucagcaucacccacgaagcugggaccacaaggaggaggaggugggaaggacucccaugcuagcaacaucucugaacacccuaggcaggcucugguuugaaggcauuuugcuuccugugugcucugcaagugugcuguuuugcuccauuacuaaucuaaacgaucuggaaauggaacuuuuggggcagaguggcauuugcuauaaaacucuguggguauuuucuuggcaagaaagaugcugaccgcucuguggcucucugaaauugugugcaacuauaucaucagaccacagaagaucuuccagguuuccuuuuaaaaacaagaaagagaauauuugcacaacacucuguguucccuauggaauuggauaucccaaaauaagcuuguuguaguuugcugggacugugauucccuguggcuagcccuuacugacaagcagcucacagguugcucaugaugcaaauauaaauagcuacauuuaaaauaaugcauuuuuaaaagcuccacuucuauggcuuuaggagaccaacacuaaaauuauuuauacaguggaaccugccuugaaaagccugucagaacacugguugagcgggcuuugguggcaagcaguagcuuccuaggucgccagccacugcacccuucuuuacgucccuggcugcccugagcccucaucccugguuacacugagcccuuggcaguuucccucuuuuguccucaucccuguauuaacagugugaaacucauuugcuucugacguuugucucuuuugcgcuguuaauugcugcugauuaauugcuucugaguguguguguguguguguguguguguguguaggggagugaagaggccccaggggcuaucuccauucuuaaagagcaggugcuuaacuguuccugcugccuuccugcuucuuuucucuuuuccuuuccuuuucuucaacuuuuucuguucuucuuucucuuuuguuucuuucucuugguuguuucuauuugagguggggucuuaauuguuucuuucuuuagauuuauuuauuuauucuauguuuauuuaucuggagaaaaauggagaacccaaaauuauccugaagaaaugacaauuugcaggcuagauaauuuucacuugcugugagcuccuguguuuuaggaaguaaccuccccacccccaaaaaaaaaaaacaaaaacaaaaacaaagagaaaaaccaagaaaacaaacaaaacccaacucguugcuacgcuguuguccgagugguggaggcacugucacaggacucgccuuccucaggagauggucuccguaagaagaagacacccauggauuuucuuucuuagaaaaaauaauguguuccuacagcaagcuccuugguaaaugcucaucacacauguacuuugucagacacucacuuggcacuggccacggaguuuucaugcuguguucuugagaaaacuguacugaugggcuuuuccugugcccuaaauguagaaaguuccaaauaagcucuguugggcaacgcauguaggagucuguggcacagggagaacuaaccuuggccuuggacaggccugagccauccauguaggaguaaggaugcuggaagguguguggcucagagcuggguagaugugccgucaaugugagcuguuguuagugccucgggccccucuacagacaugguguggcugaaguuuuuauuuauauauauauauauauauauauauauauauauauauauauauauauauuuauuacguauuuuccucaauuacauuuccaaugcuaucccaaaagucguccguccgugugucccguccccccccccccccccauggcugaaguuuuaagauccgcuguuuaaaagcauggguacauacagagcaauuucguggcucugcucuugacacagaaggguuggaaggccuggugccucuacugucuguagugcccggaucccaucuuccugugcccugcaaccagagccuggcuucuguacuguccucccugacuucuguucugcagaggcugaccccagccagguccucuagcagaagcccauaugauagcucauagcaguugcuaacuuggcagggucaagagacaaacauggaugcaugucucugaggaguuucuagauuagguuaauggaaauaggcugccccaaacaugugggcuggccuguagcacucaucucucucugcuuccugaguggauaccaugugaccagccaccucaaguuucugccuugaugaacugagagccagaacaaacucuuccugccuuacguuucuuuugugagcuguuuugucauagcaaagggaaaacuaacacugagcugauaaacaccugugucacccugucucacucucugugagagaggccuaggcagcaccgagugagcagccuugaacuccugauccuccaccucccugguauggagauuguaggugcugcacacugucuggacuggugauauuuuaacuuugagcagguuauaauuaauuccacuugcuuccgaaggccauggaggcacugcugcgcaugugugugugcacucgggcccuggcagccuuuuugccauugcugcccugcugggucaguggguugccgcgcuucucucuguaaggugugcgcggccugaccaggcugggggcugaccagcacaggacgcugcuuucccuuugugcaucucuauguaguuuuauuacgugugcugggaagcagggguggggcuguguucaagauacagagccccuguaucaagcagaggaaagcaggcuugacagcacauuuaagaaccaggaagacacuggugcccugugagcauaccaagaccagggauguggacauggccuugggcuuagccugagaaccccagagcuguguggccgcagugugaguuggggcauccuucacagcuggaaaccagagugcgcugcccagggagcacagcagccagggucucuguguaaaccagcuuccaaagggagucauuucagcaucucagcuucuguguagagcacgacuuucaaaagauguucuaaguggugugauauauggggcuugcaucugucacaucauguuacaucaaauccuuugaaaagcugaccugacauuaggauuuagacugauucuugcagguuccucugaagaugucagggccagugucuucccugggggucuugccuuugggcuugagagggaauaugcuggcuucuugcugggcuugcuuggucagcuuaagguacauugacagaugggagauggguguugguguggucaccaagcagccucuggagaggcugaacucuaacaguaaagaaauggaaucaacagacauguacagaauggcuuucguuucccauuaaaguuuuuuguuucauuuaaaauuauucaugaaugguuucaaaguaaauagggauugguucuuagaggcuguuaauguuuaacuccuaaauacaccuuuuguuuuuuaagucuuaggacuaagauggcgcucaguugguagagugcuugucuaguuucaucuccaguagaauggguaccacaugcuuauaagcccagcacucaggaggcagagguagaaggauucagaaaucaaggccaucuucagcuguauagugaguucaaggcuagcuggggcuacgugagacccugucuccaugaaaaaaauguucauacacagaacauuuuuuaaaaaagauuuauuuauuauuauacauaaguacacuguagcugucuucagacacaccagaagaggacgucagaucucauuacgggugguugugagccaccaugugguugcugggauuuaaacucaggaccuucggaagagcagucagugcccuuaccuaacgcugagccaucuugccagcccagaacauuuuuuuuuuuuaaauuaaaaauacucuggaaaauaaaagucuaaagcaauagaacaccaggagcagguaucauaugucuguaauuccaacauuugaaaagccaagacugggggaaucuuaaguuucuaggccacccugggugcacaguaagagacucucucaaaccaaccaaacagcccaacgagaacacuagcaaucauugaccugccacagucugccacguagaggaacggcuuguuaaccacaccuccugagcacugggauuguaggcuugugaugccaugcucagcucugugcaguaagggagacugaacccagcacuuccuacaugccgggcaagcacucggucauugagcuacaucccacgcugcacaugguuuuaaaaauggguuaaaugucagggaccucuacaaaccaauauuuuauuauuuuacugauuuucuuuaaacuuggguacaugcgaucuacuuuuuauauguguguauaguuauauauaugucuauaauuaggucucuaacgugagcacauuauaaauguagaaaugugaauucuaaguguauuucuuucccauacauucauauacccaauaaauguuuaaaauacaaaaagagaaaacucuuugcuacccugucccucaccucagucaguccuacacugcagaaguguuuuuuacuguaauauaaaugcuucaguauauguaagaauguuugugaauacaagcacccucauauuuuucaugcgucuaauuugcccaauguuauguguuaaauuuuguuuagcauuauguauauggauauguguaaugcugcuuauguguguggucaucugagugccagaguuuggauguggaggccagaggacaucuuugggagucaguucucuccuuccaccauggauccuggaaugaaauucaggucaucaggauugcaaggcaagcguuccuaucugcugagacaucucacgacuuguuuuuaagguauagcccaggcuggcuuccacuuugugaucgucuugccucugucaauuccuuauacuuuagugguaugccaccacacuuagcuuugcuuguuuguaacuuaggcuggucucagacuaauuauguacccgaggaugaccuugaacuccaaauccuucugguacuuuccuaggugcuggggucacagcaugcaccaccucaccagccuugcuacuuugcagguagcacgggcacacgugaugccaccccacuucucugccucagguuccuugcugcuuugaggcuuccgugugugcaccgaggagagggacgguugcuguauugacuuauugaugaauauaugugggagucaccggcacucauuucuucagacucuuugugaguuggaguagccuuguguaccauuuuccugggguuuguuggacugucagucuaaaaguggugcaguuucacagaccuucacucucucagacgcgugcuugcuguuugugauucugcuauagggucaugccccucgcauccuggaguaaguucucuucagagugcuguccacccaaaaggagagcagcuacagagcaggcuugugacuacauaagcugcaguaugcaguauaucuccaacguaagcuacauuaugcaguagaucaucuccaagagacucggcuucucagguugcagucacaucaggagucuccucuugcaaccuaacgcuugggauaagcagaagaacuucugagacaguugauggcuccauaggcuucagaccauauuucuccuccuauacucacacgcuccuaguuggcauguggaaggaauacccauuugaggaaaaagaucauuaacccccaauuuaauacauccuucacucaacuuccaguuaguugaaccccuugaaugucucugcuguuuucucauucgccacaaggagcagaauuuggaguggaagaagguggaggucugagugaaaguagcuagcuuucguaggcuuugcaagcacagccaugcgagugcguugcuggggucccucccaggacuuggcaagaggcagagacaagugaggagcucugcaguguugccuucaucuucuggaccacaccugcucauacagagccguccugcaguguggcucugcacagacaagagcugcuuguccuggaagauacugugccaggaaggcugucaccguugcacacaaguagcaccggccuucucacuacuuaagcagcacuguuggagcuggcagcuggcucugcguggagaggugugugcugcugaccugauuaccugacuuuaguuuccagguccaaccaacuccaugagcuccucugacuuccacauacugcucccuggcaaaggcacguucaaauacacacacucauuaucccccacccccacacuaggaauauaauaaaaauuuuaaaacuuaaaguauuauuaauuuaaguauuaauuauuaaguauuuauugaauauuauuaauaaaguauuaauauaauaacuugagcagccaggccuucccauucucucuucccuuccucuguuucgauaucgacagucacagccauagguaguaguggaaaccugacaaccuugucaauauugccucaccagucaacuuugaaauuauucugugggcugguugguccuccugaugagcaaaagcuguagcuuucuucauuuauauuucauaccugucaugguuuuaacaugaguaagauuuuacaucugcaagauugcugccaguccagaggcuuaauguuuugauugccuugacagcacaguggcugagguuucuccuucuuguuggcuaauaguggcuucaccccacagaugguuauuauguuucacugugcugggagacauuuuggcauuuucucugccuauuccuauccucucuccacucccagaaauauagugccaauaauggcagaguuucagaaaacaucuaaauagcuaucguuagggauccuuuaaauuauacuguauagagauugaccuuuacacgcaaauacuauauaaucauuaaaaauaauguguuucccuuauuuugaaauaccuguggauaccuguuuuucugaguuuaaaauuaacauuaaaaucuguaugggcugggcuggaaagauggcuaagugguuaagagcacuggcugcucucccugaagaugcagguucaauucccaguacucaaguggcaccuuacaacugucuguaacucugguuccaggggaucugaugcccucuucuggccuccacaggcaccaggcacacaugugauagacagauuuacauaaaggcaaaauaccuauguguauaaaaaauaaaaagaauaugugcuuuuguaugugugcacauguguagcacaugcgugcaggaggccuuggaggcuagagacugucagauccccugaaacuggaguuacaggcaguugugauccaacccuaggucguaugcaagaacagcuaccacucuuaacugcugagcuaucucuccagcccauauaacaugguuuuauucccuuauuuuuauacagcuuauuauuuauagaaacuauucuguauguuucuguuuggauuuggaacacauugagauauccacaacagucagcuaugguuuccaauaugagaaucgauaggacagaguaguguaagguaguaagaacuggcucugaauccuggccccgccuccuguuccucuuuaccucauaaaacuucuguguccuuaucuguaaugggcuaauaaugccuaugaagucuuugggugaaugguaaccagugaaaaugcccacaucguccuugauucuugguaaguagugaguagcaggcccugcuugcuaaugguagcucuguuaugaacgaggcuccccuugguguguggucuauuucugaauaaccaguugcuccagaagaguccuguuuccccagcuucuucugaggagcaaggauucuagguuagcugugguucccuucuguguucucagacaggauguuggcucccaggguggcuuuucaccuggcuggcagcagggagcuuuaggcuuugggucucuccauggcaguacccuccuccugcagcucacuguccccagagggagaaagaacaaggcagccuccacagugacucuucugauuugggcuaugaaaccaaguaccgcugggcccuguguuuugcgccacaggaacgagaguaagaguuugggggaugugugcacgauugugaccagcucggaggccggauuccacacucccguugaccuuugacuauacucacccuggaugcuagucuccaccucagcuuuccuuccagccugggcuuguuuccgcauuaccauguccuaagcuagagaguugacccuucccuguccguuucugccaguggccuccuuucagccacccaggcaaaccguagaauuacguuggccauuggccuuguuguuuugcacagccugucagcaacucccaugggguuuucccugaacauauguccccuguucaccaccucggucugugccaccagguuaccgcagaggcucucccuccaccugcucuccagucucugcccugguccuccccuucugucuucucccugcaggagacaaaucaagccgugcuuaaguagugcuucccugguacugaaagaaagagccacaggccuacugcagucccacaccuuggcucugugcaucuagccugccuuccugggcggcucccuggugcucuccaugcugcagccccagagaguuugcuccugacagcguccccuucugggccuccucuugcucccuccacuccuuuggcagccaggccucccagggccacacaagucuacagcuucugcaagcugccugcuggcuucacucuuucuccucuguucuuauccccaauuuagcuucccauguaaacuucugaacauuuauuagaucacaagcagggguucuugucuguuguauucauugcuguaaugaguggccuaucacauuugcacauccucgaagcauuuuaagaaugugggcauuaccuuuccaugcaaauguggucaaaguuaggguuccagaaacauugguaagccaucagcauacugaguuauuucuugcccaagauuauuaauaaaauccaaucacaaggguggaaaaaagacaaaaucauuuuggagcuugccuuaugugaacugaguugaugaacguuaggcaugcaauuuagucagagaaguaaggucugcugcggagaacuagaaggagugugugcugagagagccuucuucuuugucuauuggacuaagaaaacuuguaucuguugugugagaugcugggguucugaaaggugugugguuguggacuggcucaaguuuuucucuaccucuuagccauuuucaaacuggauacauuguuauaaccaccacagccaucugcugcacaguagaucucuugaacuaauucuuaaaugaaauuuuguauuccuuaacuaagaagucuauauccuguguguugccuugaaauagaaaaggaagcugacagugcagguuagggaaggguggcuugaggcaggaaaggcagagccaacucuuauuauagggggagucugacaaauucaggauggcaaggcuguuguggcgugccaaaucccauuugcucugugcauauuauagugcuugguggcauaguagggggguggccugaccuacuguauaggccaaccgccuguggagaagaauaaaaucaggccugguagggaaaugcacagggagagcuuggggaggaagcuuggaagggugugaaggaaggagccuucaggggagaaggccagagccugagguggagccucagguucacggugugaaccaucccauuuuaaccaaaggaaugaaugaacgcuguacugcugccucuggagggccuuggagcagcuugccucugcuucacugacccaugccucaguggagugggaccagagcugauaaaggacugacauggguaacuaugugagcagaggcuuggagccuacggcagcuuagucauuagauauuaagagcaccauuagcacaaccugggacccccuucuucucuuggacucuggauauucaucuggucaugucugcugggaucucuucaguuuaaugaucucugaauuuuugcgauagaauguuacuuuggcuuuucagaagaaauugauucuauuggaagauuuaaaagguugauauuuucucaaguaaacuaacagcccagcaauugaugaaacccagugacccacuuuccaaaagugugcaagcugaugaaggugggcuuucuuugucuguagccugugacagcuaaagagaggccaggcagcuucuaaagagguagcuaacacauugcagagaugauuccuuccuucuuugagagggccacagcacaccucgcugguugcagugugguggggaguggcccucacuguccuccucaggaaacugaccuucacuccucuuccucucauuguucggcuuaccaguugaagcaggucaccugcucucugcagaggagagccuggccgcucuguacugcucaguuguauuuaacacagcaggcaugucuguccaucagugcuuaccaaauguauacacguguguauuuccaauuuccuucccagauucuggccuugauugcauuuaucugcaucgagacuaucauggagugcuccccgugcgaaggccucuacuucuuugaguucguaagcugcagugcauuuguggugacugggguccugcugauucucuucagccucaaccuucauaugaggaucccccagaucaacuggaaucuaacagugagugugcgccagcgguugcuugugaggacugacugcugcuuggcucucuggggacguuggggucucauaucguguucauuuuggugcuuaaauauccccucauaacucagaacucaacuuaaguuuccuuauuggguugaguaaaauuacacaaguaaagugaauccuagcuuaauggcaaaacacaaugagcuuguguugguccuuccaaggaugccauugcuauuacacucaucugcaggacuggcuauguuguuauugcagaauauggagaaaaacagaauuaauacauuuauauauuuuuucagacuaggcuauuuauaaauauuauaaagagccauuuauaaaaauauuguuucuggcaaguguagugggucacucuuguaauuccagcacuuugggggcagagacagggggaucauuacaaguucaaggcccucaggucuuuagaaggaauucuagauuuacuuggguaacauaacagaguuugucucaacaaacaauaaaauauugauugugaaaagauuaagcauacgcaugaaaauagcaguagcccaaggauacugucaugugcagagccacugagggcugcugguuugacagaagggaccucucugugcuuuuuguucuuagccccauugggacccucucaucaguuggccugggaugcucagaacuggucaguucuagugacauggcagcuugagugucuguuaagacacuguguucucagugucugaacaccauguuuagaugucacacaggggaagaaaugaugggcaguugucccaguuucaguaccuguggacucuugggaagcuuggccuaauccaaaugauaugagaaccguuuuaaaggugauccuaagccaggugugcuggugcacacauuuuaucucagcucuuggaaggcagaggcaggucgaucucugaguucaagaccagccuggucuacauagcaagcuccaggccagucaaggauacacaucaagaccuugucucaaaagcuaaagcaaaagaugccaccagcuguggguggcuuagugauaacguguugucuucccuauguuaaggaccugggugcaaugaccagcacugcagacaaauaacccagacucugaacgguaagcaguguuugccaguuuggguugcucuucaagucaaggcuuagaaaugccacagguaaagguguguuguaaacuguucugcucuguaugaauagcccuguggcacagagacuugugucugaggcaccagagaaauggucuuccagggccuuaguuggaaguucuuccauuguuuugcaagugacucuacuuuguccucuuucuuuaggauuuggucaacacuggacucagcacuuucuuuuucuuuaucgccucaaucguguuggcugcucuaaaccauaaaaccggagcggaaauugcugccgugguaagcagacagacuugguuuaaaucaggcuguucucaccuucugagccuugcucuccucuguccccugacacaugucccauucccccuccuuuaguguuugcuguccuggccuugggggaccaagagaugaggggugguggucagauaauagagagagcucacucugcaugcuuuugagaagggcagggaaggauaagugguuuuaagaaccacugacauggguugagcagauaaaagguacuugcugccaagucuggugacuucaaucccaccucccaccugcacaugcauggcaucugcugcccccauagaaagggagagcgggagauuaaacaaacgagccagaccuagugguggcucacaccuuuaaucccagcacccagaaaggcagguuggucuuggaguuucagaccagccuggucuacagagugaguuccaaaacaguagggauacacagagaaacccuaucuugaaaaacagcagcagcaacaacaacaaaaggaaggaaggaaaggaggaaggaaagaagaaaagaaauagauauauaugauuucagaaaaacccucugcagugguuuucaugcuaggcuggaguuugugugggucagaaacuagacuagcucuugccagacaacagcugcacauugaucagggccggggaucugguauugcuggaaugggcugcacauaggcugggucccugcgacaacacucagcuucaggggggcuggagacaugauucagugguuaagagcacggucuguucuuccagagguccugaguucaguccccagcagccacguggugggucacaaccaucucuaauaugaucugaugcccucucuggcauagguguacaugcagguagaacacucauacauaaacaaguaaaucuuuguguguguggggggggggggcagucagcuucagggcacaugcacaaagguaaacuguggcuguauauuuuagauauuuggcuucuuggcaacagcagccuaugcagugagcacauuccuggccaugcagaaauggagagucagcguccgccagcagagcacuaaugacuacauccgagcucgcaccgagucgagagauguggacagccgcccugagauccagcgccuggacacaugagaacgucuggaguucucccgcugcccucgugcccguccuucuaaucaaguuuucuuucucuuagcacgucagauuuuugugugaaccagcugaauuuuguccuguuugguaaaaauucacuuugggaaagguugccuagaguggcccagugacugacagaucugugauggucacagauccaaagaggcccagguccucugaccuugggugcccgugggagcagccgacuuuaaugacugcucuaggucuuaacuguccgucucagaacucacggugucaccugacucugagccacccugucauguguauuugugaugagucaaaaccuuaauaaauggcauugagaagggaaguauaugucacaagacaggagcaccgggaugggacagccagugagguacguggacagccuucuagcgagcuggggugugugcugaguccguuagacccacccuccuugugcucuauucagagcaucgaggcaggcggcaugcucugagugggccucuaagggcugacgaaagggugugucccuguaacuuccuugccaggcuuguaugguacagggauaggaaaagcuaguguccuauggggacagcucugugagacugacucccagaacagugaucauuugucuccugcccugcugagaaaucacuugauucuuucucacgugaaucaccuuccugugguccauacucaacuuccgggaugggggagugucacguguguggggcccugcccaccuaacaugcacacccugaggcugaguugcaauuccagcacuuuuaccuucucaggugaaagcggcagaggaagcagcccucccuccccuuagccugggcacuuuguccucuugcuggccucaugguacagaguggcacgcucaaacccacacuucgauuguauggacacgucucauuuucugaacauccgagacaagcucuaaagugauucugagucaguuuaucuaggauuugagaauacuugaaucugcaccaggacacguccucccacggauguuccacggggcacugcugccauucugggcacccgagugucuucucuaugaucaaaaguccuggaacgcguuaugaauccuaguuacguauggcuuuuggauugguucuugguaaacugaagauuauuuuuguggugaaugaauuaaacaggccccuaugaugcuguaauuuuguuguuagagacuaauuauauuuuuguuuuuggaaaguuguuuuaacaugucagguucucccucugaacuguugauguuuacagaucuuguagcucuaagauuuugugggucgccucaccaaggagaagauguggcuggcaggaggauaguguggugguacagugcccccacuauguccuaaggaccguucacaaccugagcaguguccuuuguaguucauaacccagaaguggguggcagggcugccgaggagagc

SEQ ID NO: 4695 - RNA, 26000 nt, Mus musculus
cggucugguggcguccgcggcuccaccucccgcguaaggcuguccggcuggcugccugacccagcaacgucccuagcugcggcgaucccacgucccgcagacgcacgaggacaccgcgggcccgucgggacgcgcuggauaacggagcuucugcggcguugcgggcgggcagcgcggcccggccgggguccuugcggguccucggcgggcccgggggagggcccucuuuguggcugcaguuggcaagauggcgccgguggggguggagaagaagcugcugcugggucccaacgggcccgcaguggcggccgccggcgaccugacaagugaagaggaggaaggccagagucuauggugaggagcguauagagccgcagauggcgcggccggaccgggagcgggccggagcgggcaggaccgugggcagacauugaugggcagucgugggccgagcgguccuaggcggucccgcgcugaccacucuugucauugucgccgcaggucuucgaucuugagcgaaguguccacccgugccagguccaagcugccguccggcaaaaacauucugguguucggugagcagcgggguacugcccuggggcgcaggggugggucaggcggcgccccucccacugguucccaggcuucuccacccuuagcgccugcuugucgcuugccugccugggagggcacccuggacucuggcaggguagcugcugagucuccaagcccacaccucuacugacccccuagaaugcagcuccguuuggaguccagugaugugaugugggcuuggggcauuggggcacauuccuucagucuuuuggcugagccuucuucagccuugacucgguucaucgguuagccuugugcucaccaaguugaggauguggaggaaggaaaaagaggaugugcaggcuggauggagaagaugagggaaguaggugaccuggacugggaaacugaggagauggacgaagucuuuucuucagucuucaugggcaggcagcagagcuugggagucagccccaggaacuuucuugcauaaauccugcccucacugcuggguugcccagucagucauuuaaccucucuggcuucaguuaucuccuucaaaugaaagggauuauaugcguucaccugcaaugcuguuuguagaguaggaaaugagggcugagcagugggacaguacagacagucuuagacacccugaaagaaucccaguggagccgaggcagaugugugcgugguugcaucgcaucucucaugucaagagcagacugcugugggcgcaucacacugcuugauguguugagagagcgcuuguggaaucagguaucuugaaggguaauugccuaggugcaagcacaucaagauaguagggugaaucguuugggcacugucaaaagccuuuuuuuuuuuuuuuuuuuuuuuuuuugcaauagaggauaaagaugaggucagaucaugaaagucuggaggacuaaucggcuuuccuggagacuccugauuuucagauuuuuaucuucuuccacccuuccccaagccuuauggaaaugacugcauggugauguccguguguuucucucauccaauggccagggugguagguuauagccaggucugugcuuuagggagauaacucaggcuuccuggggccagcuaggucagaaugaacaggagcugaggucaugcugacaggcgcucuuccaggccccggguggauuguggcccucgugaaaagggugagcauuguggaggaaggaagauccucguggacugccuuuccuuucuuauguucucagauuccauaguguugaauccaaggaugcccagagauguuugguaaugguucucguucagguuuagagugcaucuagaugaggggguggcuauagcuaauccuagggagaugagaaagcacuugcuacugagacuguacuuaggagcuucaccuaggucgguaacccucccccucccccguuuccaagccuuuagggugcuugugaaguuguucuacaaaucaaauguguguaaauuacauaagcgucaugccuugaggcagagccagguuuuuauuuuaguguuccuagacuuuugggguuaguuguguuuugaagaguucuuguggcgaagauuuauuuuugugggaaacuagccucaucucucugacuuucacuucucugggauguagguagagcuggugaguuugcccuguuccuucccuugugaaaugaagagaauugcagcagaaggucauuugccaucuuggguuggcugucucugccagucacucuuaaaagcaggucuccuuuguugaugagagcgagugagagagaccuuaacaggcauguuugagauuucugguuguuccuuauuguguugguguuaugacuggcugucuuugcgcagagcgauacaugguauacuuuugucuucuugcaaaugucauuuguaggugaagaugguucugguaagacaacucucaugaccaaacuccaaggagcagaacacggcaaaaaaggaagaggcuuagaguaucuuuaccucagcguucaugaugaggaccgggacggugagugaccauuacuccaucggaagguaacauguagggcucugacuccuacguguccaggcacacucagcuuucugguacacccaaagacagugggugaaauguaugucauuugcaagacuuuagucacuuuuauuuguuuuuuguuuugguuuuuuugagacagguucucuaguggcccugacuggccuggaacucacuaccuagaccaggcuggccuugaccgcucaagagauauuacucuguaaugcuccuuuauaauuuuucagguucagcuguagaauaguuauuggugccugagucuuagaugaaguguauuggcucauuuucauuuuuuccuguuugcuuuuguccauuuaaauacuagugaucgugauguuagggcguuuuuauaacacguucuccuacuuccuuauuguuaaauugaagaagauaaacuaaaagccgcucuaacaccugaacucugcuaucucugagagcugugugguagaggacauggaggcucuugcucaagcuugggcaccucaugugcuaauugagaucuccagggaucuuaucccugcucccuugacuucaucuuguucaacauuccuuaguggaccugaaaagaaggcggaauguuggccuagugucgagcccugugucagaagaguaagcaucgacugagugucuugucuagacccacuggugucugcucguguaacugagacccauuggcgucugcuuguauaacugaggccucuaaaucaagccuagaggaccucauguguguuugcaucguuggcuuccugccuugcaggccaccuugccuuuccugggaagaccuugggcuugagagccagaccaaacugguucauagggccacgccuauguucugcaguaauggggcuucugacuacuaacuuaaccacacuuccauuuccuccugugaggaagaggaugcugguacauuuugcagguggacagagugugugggugugagaagcgugcuggagacuuggugaaagccuuccugccuuugugaaagggcagacugugguaaaugcucugagacccuuaauccucugguguuuccaagacugaggcacauuucaggacugagcgucccagugaccgcauuuacaugucuuugaguugaaguuuauacuagcgucaaguucagauucccccgaaagcuuuuccuuucuguauuuauaggacuuucucuaucggcugcuuacuuauaagaauccuuguuugauggaagaguugcccuuaccugagguuaauuauacaucuugcagccguagucuuuuuaauugugggguuugacuggguuguaaguacacauuucacaggcagucaccugcuaaagaaacuacucccugguuguagcuggguugugguaggauauuagaugucaaaggaccacugccucucaguuagauacucuugucuacugcugcaugggaugugugauccucacacauggggggagucauguauaguugacauuggccagaaaagcucaagaaacugugcuugcugguggguaaggcaucuaaaccucagaucuugaguacaaaguauguuuggaguccauucacagacccagacuggaaaacacuaaaauauaacuaguuugggaccagugagguagcucagcagguaaagucacuugcugccgagagagccugccugaguuugaucccugagacccacgugauggaaggaaaaaauugacuccacagguugucagccaacuucacuguggaaccuccaccuguacgcuaaggaacacacacggacagcucuagauaaauggcauaaaaaacuugaaguaggagcuagagagaugggucacuugcugcucuucagaggacucaucccagcaccauguaugguggcucacaguaguucacaacucuagcuuuagggaagccaaggccuguggucccugagagcacuuguacuccugugcacauagccacaugugggcaggcacacacauaauucaaaauaauaaaaauaaauuaaaaaaaauaauguagagauuggaaguacagcuagauguagauaccuuuaugcucaaacucaucaaaaugcauuuaauagauauuaauaacugguuauacaucaaggcagcuaaagaaagguagauuuuaaaaguauauguuggaaaaggaaguuaauggaaugauguuuugauguuaggaauucccucuaucaaggaacuuuuauagaaaaaauaauuaaggaauauguuugaaauguuucaaaaauauccuauuaacuuagagaauuaucuuccguaguugcauuguuacaguucccaguucuuuguuucagcuguaucuuaagaucucccuuuaguccacuuggauuauucucaagccagugucagacauuaguaccauuuuauucguaagugcuucuguaaguaucucuaaaaggugaagaugcuuggaaugucuaacugauuaucuugacagaacggcuuuagucgcuuagugugacgcacacacaagggguuuguuccucagcgcgcucaccagcucacagauaacugguaucuuaggacaguggguccuuuagaccgaggggacagcucaucaauaaacguuuguguccuuugguuguuaucagcagcuaauuauucucacccugcuccuuagagucuguugaagccuuaguuagagucguccuguaugugguuaucuaaacuuuuaaaagccuaggcaguuccuucuguacuagacuggauuugacgcccacuggguguuuggcccugcugggcugcgcuuucugugugaauuuauucccuuccugaugcugcaguucucaucacugugcagauagucacuguugggugauaauguggcuuuguuccucucuccccagaucacacacgcugcaauguguggauuuuagauggagaccucuaccauaaaggccugcugaaauuugcaguuucagcugagucucugcgggagacccuggucauuuuuguugccgacaugucucgaccuuggacgauaauggagucucugcagaagugggcuaguguuuuacgggagcacauugacaagaugaagauuccaccggaggagaugcgggaucuggaacggaaaugugaguaaaacucacuaguccucuuggauuauuggggccaccuucuuccuuuucaggcaaggggguuuacuugggauaguauuugcuuauguuuugaaaaauuguuucaguuauugaaauucaguuaucaagaauagcuugaaggaauuaggaaugcuugcugcucucguagagaacccagguucaguucccaguacucuuaccagucagcugccuauggcucccauuuccagggaaucuagucacuagcaugcauacaaugcacauacagucagacacucaaguacacacacacacacacacacaaauaaguaaguaaguaaauaaauaaauaaaaaagaacacuuuggccugauguacuggugugugccuuuaaucccaguacacuggaggcagaggcagguggaguuugaguaucaguaggaagguuugcuuuguuuuggcuuacgguuucagaggucucaguccauggucacuuggcaauuucuagaccugugauaaggccauccgucauuguaggagggaggcaaagaggaguagagagaaggggaaaggauggccuucaacggccuuccuguagucuucuugcccuugggugaguccaccuucuaauaaccacugagccgggagcacaugaguagcaauuuacugagagcuuaguggauuucccuucaguaaugccaucagcuagggacaggaucuuugaggacauuuuuccucaaaccccaagcccauguuucuggaaucccauggagaucccaugucuccucuuguugauggguuuaauaaaaaaaaaaaauaauaauaaagccccaaggaagagaaucuugcauuucugacugguuucuuuuggaaucuagcaaauaugauugcauucaggaauagcaagauuguuuucggugagaggggcuguugaaagacauuuuaaaauaaaaguuauuuuagguuuaaaacccuucugagaacaaagaaggcacaaaguaaaggaagugugcugcauuuucaagugcgguucagaggcuuguuuuuccuuccuuggcuucugugcaguuacaucagcuucugucccugugccagggagaugggaggggcacagggagcggaaccggcagccgcagcgccuuggccagugugagcuuggcugcccuggcucggugccacgggaugacaucacccccuuuggugaauugaugagggcucuggagcauggcacacaguaucugcacacucacugucagggaaguuugauggcgcuucucaaacuggcuuuccuacugcgugucuccugucgcacacuucaucuugcccccugcccgucaucagcgcagccggagccucacaccuuccuccuccccuggcugcgugugugccucccgccucaucugcccuuggggaucaugauugccaggccauucaucucgccucucuuuagccacugacuuuucuagaugaugccucuuuuucuugcaaaacagcgaugcuaaagacagcucagcaaaauaguugugaggcugaggcgcuauucucgagcacugcacacagcgucuuacccagacuggugagcugauguaccgcagacuucaguuuggguuugacaaccuuacaaagguugauuaaaauagaaaaagccacaucagccgagggcaccacucuuucucaaauaaggcaaguguuaggugcuggguguuuguucugggugcucuggggaggcagcaggcaggaaggacaccuauucuuggggagcuuguggaggagacacugaauuaauuuaauggucuuagucauuggcgucuaugucacugaggauuagguuuagcgacguaagacagaaaaauggaggggaaaauggcuuaaaaaguucugggggguuuauuugucaaggagaggaaaccuagaggcgggcaguuugcaaguggggcgcaagccugggaagacagcucgggagcccugccuccucuggacucacggcuucugucacuuugagggugugguucucuucccuuugacaauuaaacuuuaaacaauaugucgguguuccaagcagcaacauggagaccgggaggcagugcugaggugcgccugccugccugccugcucucuuuuuaaagagguugagaguggaaucuuuuuggcuuuucguagcaugugugcgcuugcacauaccugugcagcaugacuuugaaaagguucucuccucccacugcagguaccacgggucaaacucgggguuucacgugaccacuuugacucgcugaccaacccaccuuucccccuugcuagucuagaaagcgucuucaugccguguuggguuagcggggagaggagagagaacacuagagggcagggcaucuagcaacugcugagccaugucugugacugagcaucucggcguucacagucccuggucugugauauuuggaaugguagccgugccuuugugcuuggugaaggcgugcuuguauucacgcugguuuuagcuuacuuuagagaaguaguucuucauguucuugcucacaggacggcugccuuucagauuaauuagacucucugguguuuucuuauuaagauuuauuuuaguuucgauuauggggggcacagugugugugcaugugaauggagcugacagagugcuggggccuccuggagcuggaggcggguguugggcagugcuggaagcgaacucgguuccuugcaggagcagggcaugcucuuagcuccugagcaccucuccagcugccuuuaguaucauucucgacaagugagccccucuuuacaggcggguuccucucaagcugccugcuguggggcagcuuugugaccagccacugugacccagagcuggcagagggacagcaaccuugagcugccagaagguggugcuugaugcugcaaaaacuggaugaagacaguauaaggaagggcugggcuggguuggguuggguuugguuagguuggguuggguuggguggggcugggcuggguuggguuggguuggguggggcuggguuggguuugggcuguuuuguuugaggaauacagcccguccuagcguggaaagcacaguggcaggagccucaggcaguugcuggucacaguacaucuggagucaguaagcagaagugaauuccagugcuaagcuagucuucuccuuuuuaaaaauuuagucuagaugcagagacucugggaugguguaaguaaaucauaaaccauucuggaaacaccuuuacaggcacaccuagaggcgcgucuccuaagcgguuuauuugcuuauuuuuaaugucuguguggcucugguucaccugggauucacuagagugggcuggccuuagagagaucaaccuguggcccuugaccccuuuagggguugaaccucccuuucacgggguugcauaucaaauauuuacauugagauucauaacagcaaaauuacaauuaugaaguagcaaagaaaauaauuguauaguugggugucaccacaaugugaagaacuguuuuuuuuuuuuuuuuuuuuuuuuuugaaguguuguagcauuaggaagguugagaagcacugauuuagaguaacuaguuuccuucaggacuuguaggcuacucucaccaugugaccuauacagaagacugaacuggcgggcuccuggaauaggugauccggcugcucuacccccucccuucccacuguagcuuagcucaccucuaucuugacccuggcucugcccugcucccuguuggggaagcccuugacaaaugccuucucugcucuugggcaaucagaugucaccccgacaguuaaccacugcauuuuuuuauugacuugacuguuaaaagagaaauuccuuuaagcuccuacaacaacaucacauuuucuggcuauguucaacauaguauggagaugaccuugguugauuucuuuuuguugacaaugaaguuugacccauuagucucugccuuugugagaaacaaaggaaacaaaggaagggauguugagauggcucagucuguggcucagucuauaaacuauugccuguggagcaugaggaccagaguuuaguccucacccguguaacagcuaggugugggagcagcaacaauccuagcacuggggaggagaugggaagguucccgaagccagucaugcuaaauuggugaauuccagguucagcaagagacccugugucaaaaaagaaggugaagagcaauuaaguaagaugucacacucaagaacuuauguacauguguacuugauggcgcgcacgcgcgcccccccccccacacacacacagacugagcuuugucuagcuaugauuucagaguuugcaugcacugguggcuugcucucuuacuuuggugggaaaaaaaguugcucaccuguuaguagaaggggaacagaaagagaagagggccugaggguguagcucaguuaauagagggcaugcaugaagcccuggguucaguacuacauaaaccaggcacagcagcucugcuuguaaucccaguacuagggagguagaggcaggaagaccagaaguucaaggucaucuuccuuauauaaugaguuugagaucagcauaagaauaugcgugcacgcaugcacacacauaccuacgugggucaagagggaagaagggagcuaggcagugguggcacacgccuucaaucccagcacuugggaggcagaagcaggcggauuucugaguucgaggccagccugguuuacagagggaguuccaggacagccagggcuacacagagaaacccugucucagaaaaaaaacaaaaaacaaaaacaaaaaaagagggaggaagggggagaggaaaaugagagcaagccauaguagagccuuuacaggcacagccuuaauuaauaaccugcuucuuucauauaagguuccacaccaccaccaccccaguagcucauucagcuggaaauucaugucugaauuaauccagcgauagaauuaaugccuucuuaauucagucaccucucaaaaguaccaccagccgggaaccuucaacacaugaaucuuuuggggacucuucauguccaaaccacaacacuuguuacuuuuuaguuugccugguguuacucgaaagcccaugagcuucucggccauuucagaagcacagacaaugaugagcuaaaaaucucucagguuuuaaaaaacuguuugaaaccccuucuguggguguagaggagaguguacaucuuuuucuuggcuuuccauagugaucugucugucugugucugucugucuaucuaccuguuugugaggagaggggagcggggguuguggggcuguccugcuugcguguaugcaccauauguguguagugcccauggauaccagaagagggcauuagauccuuuggcacugggguuauucauugugugggugcugggacucaaacuggguccucuggaaacgcagucagugcucuuaaccacuaacucauguuuccagcccucccaguacuuuuacuuauguuuguguggcaugguuuuagugaaagcauaauaaaaggccuuagaccuuuuuucaguccuauuagguucauuagaaaaauagagccuguuggcuccuaagccuggaggggcuuuuccugucauaugaagaucuggguauggcaggcacagcugucauccuaacacuugggaggcagagggaggggagggggaagguaacugcugcaaguuguaggccagucuacacggugaguucccgguaucuaguaaggcccuuuauaauacaaaugacaaaacccaucauuaacccugaaguccucacauacagguucuggucugcaggccuuguuuucaccuggcuuaacuacagccaguggcuacucuaccuaaaagccccuucucuguauguaaagauuuguuuuaugaguguuguacuugcucauauaaacguguacugcauccagaccuagugcucauggaggccagaagagcauauuggaaucccugagacugggguuccagaugguugugaguuuccacaugggugcuaggaacugaagcugaguccucuggcaagucucuggcccucugagccauugcuccagcccccuaagauaacaggugugcauacgaaggagcaggugcgucaguccugcuguguuaggcacagauaggacaugcacacuggauguguaagugaagugcccugaagacaaagucccuaggaauagagaacugacugguaccuggcagucauguggucuuugccugcuucuccuguauggaaguggcaugcuccuggaauucagaguguaggcguuuaguagcuuuucuaaugaagacccugacaaggaguguguguuacugugauuuccauuggucaccuaggagggaaugcuauggcugucuggcacugugaccaaugugggaugcauaagaaaagugugugugcgggggaguuaucaguggcaguguuguuuguuuuguuucuuuuuggugguuuuauaauggaaacuaauaugagcuuaagaacguuaaagagcacaugaaaaaugucagguuugagccacagcacuauucuuaaaaccagaacacugaaagccuguuuagguuggaugaagcugaaggugucaugugcccaugcagcucacagcucaguagacagaagagcugguguuugcaucauagucccuaaacccuaaagcugcaaccucugccaugcauagaugcuuuuguuuauauuuauuauuaccuuuuuauccccuuaauuugcuaagccuaagauguguuucuauuugcgucuguauaauuuuuuucuuuucccucuguaguuaugaaagaguuucaagauuauaucgagccugaagaagguugucaggguuccccacagagaagagggccucugaccucaggcucagacgaagacaguguugcccucccucugggugacaacgugcugacucauaaccuggggaucccaguguugguggugugcacaaagguacguccagggaauugugagcuuggcuggguuugcccagugaacaagaaagaguuuuagaagcuucgauggaguuucuucucaagggaaaauugggcuuauucaggauucaucaagguauagugaaugugucaggguaggacauucugucauuucaugccgcugcugaauugacaguaccuaguucagaaagcccuguugacuucaugggcaaacucaagugagagcaguuugcuuaaggcucuaguuuaucugguccagacugguggugacauagaauaaugaaguagaaauagaaauuaagcuucauuuuagagaaaguaugucucuuauaagagggggaagguagcuuuaaaaacauccuggauuucaaaguggcguuauuccuagucuuuaacuaggcagccuuguugcccagcugcgggauauccccgcuuccugcuguuccugagauagaugagguacggugcccagcacugugaccucauuugauauugggaacauuuaugggcucaucaggccugucauaucuguacuuuguguauaaacugaggcccggaugaaagagaacucucucguuguuuuacucuucucgaacgccuggcccccugucuugagugaggcguuucuuuaguuuuguuuuuuuguuuuuuucaagacaggguuucucuguguagcccuggcuguccuggaacucacucuguagaccaggcuggccucgaacucagaaauccaccugccucugccucccaagugcugggauuaaaggcgugcgccaccacugcccggcuagaaauauuuuuguuucuaaagaaguuccucguucugcuccucagcgagcagagcagagcagcagagagcucacaucccucuugguuugucucucccacagugugaugccaugagcgucuuggagaaggagcacgauuacagggacgagcaccuggacuucauccaggcgcaccugcggagauucugccuccaguguauccuugggaugcugugggcccggagcacaggcucuccucccgagggggcgacugcacagccccuccugagcagaguagucuuugcucuuucuuugcuuugcuuugcuuuuuuuuuuuuuuuuucaugucacuuaauuauuuggggguggaacacaugaguguggagguuagaggaaaacuggggagucaguuuucuuccaccauguggguuccgagucaaaucuagguggucaagcuuggcagccagugccuuuaauucaagcacuagcccaucuugccugccuggggcagggguggguggagggggaauuguaaucuuucuauuaguuuuauaauuuugcaguguuggaauuucugaauuuuguacauaacaacuuaggcaugucuuugcucacuguggaaguauuauuauggguuuguuuuuucuuguuucguuuuguuuagggcagagucucgcugugccauccaggccggccuggagcgugugguucucggcccccacuuuuugagugcucguauaacaagcaugugcugcgcacccagcuuagucauuuuauuuuuaaggcuguauuuccgauaggcuuucgaauuaagaaacugauacgugaccauuuuauuacccaauuacauuguuuguacuuaaaaaucucauugaacuuugcucuuauucagagagguagaauuggcgauaugguuacugguuuagauguugcgagugugugagaaugagaauguguugugcugcccacgaaaaagaugccaugccagcagcuuuuugagucuucuuuauaaauccaacaguaguugguuccuuaguuccacacuagugacaggcaggcgcuuccucucagcccuugguuggcaccuaucucugaaggugucccugaugauauucucauucccuugugagcgccugccugggaaguaaccuauguaccucuguccgccaagcauagcguuccacugaguuugcgucuuugaaaguagccucaggagugggcagcacucugaguauuagaaaagaagaguggcugcauccuacuacagccucagcuggagaauuuauuuacugugcuucccugcugccucucuguagcugugaaaguuugcacgcuuuguuuacucgccuacagauaaaaccacagaucaccucgugcuuuagagauugugcuuaugugcgaucggguuuugucucacaaugaauugguuuuccuuaagcaaauugauuagauggagcagccuugauuuacaccucagugaaggaagagaaaaaccuugacuugcuguauaaguacauuguucauaaaaccuauggcuuccacuuuaccauacccgccuuaguuguggaaaaggacgcgguuuuuaugugaguucuuugaaggugguggcauuucguucuucucuuuauaguccauuugcugcucgugcgccuuuucagugcagggcuucugucugaaagagcgcuugggcuggcccucgggugcuagacaggugcagcuuccccucucugcuccuucugcauugacucguuccacuuaagggaaguggguggcguggucagaagugccacguuccuucauugaaagagaguugccugacuguaagcaaaccauuuugugcgcuuacugccagcucuagggaagcacuggcuguggggagaaucgaaguuagagauuucaguguggugacccacaguggcuuaugugggagcaucuggugacugcccuuggcaggggugacugcgagcaucuucucuguucccgucagugugggccucagcucugcuugcuacuugcuggcgucugcauuuuacagccucugggguugguccuccugucagacccugguuuccugagccacugucauuucucucaggagagaaucgcauugcucugucugccuaugacggugcuguggucuuacaguagcagacugauguuaagaucugagaggcucugggcuuaacaguuacaguuguucauucagcaagcuuuucacagcacccucuaggugcccagguucucugccgaggacgcaaaaaugagugggcuacaccucuguuacagcacagaaacaggcguguuccuuccgaggaggcuggggcaggguagcagggggucaguggaacagggcggggccagaggacgugcuccuggaagaugcaugcucugucucgggcaaaucugcaggaaggggccaagggcaucuaugaaaggcugagagccagaagccucaggaaaacuaaacagguuaccuucugcauauuugaagagagucucacucagacugcucauacccuuccucucaagagucacccagaacagcagacaggcacuaaagcaggaacucagugaaugcucugcuucuaugcucaacucaggucuuaauuacgagcucccgaagcaggagcucugguuggauuuagggcuaguguggaauggaggcgcaucuugugccuucuugaggcuuauagcaucguaggucaugauagauagauagauggauagauagauagaaagaacgaaccaaccucagcuguguccagucccguuuuuacucuugugucucuugcuaacuaccuguguaggacuuuguaaggucagcaagggcguuugggagaagcauccuggauggcacccucuuaguaauguaacugugacuaggaguugagggaauggagaguugugagaacagucaguuguuuuugguuuuguuuuuaacuagagcuucuugagcugagaaguguggacagagugugguugcugucccucagaguaggaagugggaagucugauccaccucauuuuuuucuugccuugugauguugagcugcgugacacucacauaggaaccuacggcuuccuugugucucuugucaaggaccuaggauagauauaggccauagcgucccccuuggcuucaaggcacuacuucaaugccaacaaaauuaaugaacuguucauaagauaauugguauaaagcaguguccucgagagggucaggaugcaaggggagagccaaagcccagggguaccgguccucucgggucucccuccuuugugcauugcucucugagcgagguccuacucggcccuugcucuuccacugguuccuuaggccuagccucccugagucucugaagcagggugugucacguugaccugaugggaugggugugcuguggcuuucggcuuauguacccagagcuaugagacaccggugggcagcaccuccagacuuaaaaccgugggaaaggaccucacaaucuaaaauguguuugagaugugcgugggaagacggucucgggcaaagcgugcuaaucugugucuccucgccuuuagaccugcaggcugggacaaugaaaagaaaauagcuauuuuacaugaaaauuuuacaaccgugaagccagaagacgcguaugaagauuuuauuguaaagccgccugugagaaagguaccucauucagucccuugcaggccuuaugugggugaagucaugaaaaugagaccagcuguuccaggaguggcccaggaggggcucacugugugaagugugggagacgggagggccacgucaugucaguuguaggcgacuuuccuguuaggucccaacagcgcuccuaccauuugggacuuacuuuggccggauccccucuggggucuccugcuugaagacugugaucugagaggugccuacuguuugggacuugccacacuuaacaacaugaacggguuccauaccguggcugguucugggagagcaucuguaccuaguuagaacaguguaccugcagucucaagaagagucccccaaacccguguggaggcccacaccaagguucuuguagcacgcacucugacagaccuuugagaauuuucacugccugugaucacaaacgugucucauuucacagcugguccaugacaaagaguuggcagcggaggaugagcagguguuccuaaugaagcaacagguaagaggccuccuccugcgaggaaugccacuucuggagcggguuuggggacucuguguuugagagcaugcagaggcauggagguuaagaugagguuuccucuuucccuacuuucucaacagguagggguuggagcacguguuucacgaugccugccugcauugcacauuacccuacggggauggacuuaguauguuuccaugcgcccuggaaaggugggcugcauacuuguugaauugaucauuuaccaaguggccugguucacuugcauuuuuccccccaguguauaaaagcaauggugccgucaucccuaaucucagcgcucgggaggcagaggcagguggauuucugugagugaggccagccuggucuacagagggagcuccaggacagccagggcuacacagagaaacccugugucggaaaagauauaugcacagucacacacauacauacauacauacauacauacauacauacauacauacacacacacagagagagagagagugaguuccagaacagccagggcuuuuacacagaaaccccuucucagaaaacauacaugcauaauacauacaugcaugcaugcauucaaguaaugcacauuuuguaccugaggagaguaauguagccaaaaacgacguuaauggggcuguagagauggcucagugguuaagagcacugacugcucuuccagagguccugaguucaauuuccagcacccacaugguggcucacaaccaucugaugaccucuucuggugugucugaaggcagcuacaguguacucauauaaauaaauaaaucuuuaaaaaaaaaaaaaaaagacguuaauuuuuuuuuaauccuccugccucugacucgcaggugcuaggauugucggcgggggucaccugccugugcuggcuuaugcaguacugggaaucuagcucagcguuacgcacgcuaagcaaguauuucaccagcugaguuacaugcucagcccagacugacugcucuacuacaauaguuuauuguucauuuuuuuaaagagcaucauguauauauacaguguggggguuuugguuguuuuuuuuagguuuuuuucaagacaggguuucucuguguaguccuggcuguccuaaaacucacucuguagaccaggcuggccuugaacucagagaucuccugucuccgacuccuaagugcugggauuaaaggugugcgccaccacugccuggcuauacaguguguguugaugacauucacucucaacuucuuccagauccacccugauucccucuaugauaacaauuuugaacacaaaccccuucuuuuuuuuuuuuuuuuuuuucgguuuuucaagacuggguuucucuguauagcccuggcuguccuggaacucacucuguagaccaggcuggccuggaacucagaaauccgccugccucugccucccgagugcugggauuaaaggcguaugccaccacacccggcucacaaacccauucuuaacacuucuuuuugacccaaauuguuagauaugugaccaucucuuaagggcagggccaaguccuaucaguuuuuagcaauuuuuucccaacucuuuucccuuuucuauggccugcuuauuuucuuagcuucaaaacugguuuugggggugucuuccuauaccaaauaccgaauuuugguucuuuuugcauuuguaguguuaaacaugaguguguauuggcgcccuguacuagucauaggagugaagcccuuaaagcuccagcccucaguucaugcugcaggccuugguuaauggccaguuugucccucucuuugcagucacuccuugccaagcagccugccacgcccacaagaaccuccgugaguaccuuucaccagacagagggucauggcccggugucaugggugccgucuaacuuuacaccgggauugcaacaguuuauauguaugugggcuuuuauuauaguuuuaaacugaguugcucuccccgaaggcccacagccagaaauacaguagcaccucagaaguguuugacgaaagacaacaacugauacuccguaagcuuucguuccuuucucaggagccugagcugggggcaacccuccacugugccgcagacacuggacuucagaugggaaaauguguugacuuugauuuuuuuguauuuuuuguuauuuuuauaucuauguaugacgugggcugguuuuggacuuaggaauccccugccagaggacccucuggcucuccaaggacgcagggucgggguggaccagcuaguguaccaagugccucccccggaacuucaguaaagaagccagauccaaacaucaaaaguauguaugccaucacuggggaaagguuuuaguccuaggcucacgggcgcguuauaacaguggcugugaucucuggugggaauccaggaaagcuagacugauggcuuuccaggaaaaguuauauuccagcaaguaaccguaugcaccuggcauuguguaagaccuuaaaccccgcaggugcccuuaggaaagaguacaguuugggaagucacuguacaguguguauccugaaccugucauuucuuuucuuagcuuuguaauaauacuguuugugaguuggcuaguuuuuuuauuuuuguucuuaccaagccacugcugauucauacacaaagauacugguugcaguaaacccaucagaacaaaagucuguaaauucuugcauguucaccuagcaucuuccacuuuggacaugagcuuuucauaauaggcugugagccuugcaggcuuagaaaccugaaaugcacugcacuaaggaugcagaaaugacaaaaacaaagacuuuucugugacccucaaaggugggaagugcaaacuuguuuccacugguaaucuuaucaccacccgguuagccucgucuaacagagaccacacugaguguggucagugcacuaggaagccgacagccacagaugcucaauuucaagcuugagaaccacuuuucugucucaauuugagugacgcuuccuuguuuuucuuuguguuuccuuagauaaugcggcaagugaagggguauuggccagcuucuucaauagucuguugaguaaaaaaacaggcucucccggaaguccuagugcugguggagugcagagcacagccaagaagucagguacagaagggccucagagcuucagauccuuaacagggcagugcugucaaaugggguugcacacggcagcggucgcuuucgccaucugcacaccuccaguguuccagcuagcugugaacagaagcaagccuuguccuggcaguuaagaucucgagcuguucuuguggaaggcccaggguuucagcaccugaaauaguaguuccauaacacccuuaacuccaguucuaggggauccgacacccucuucucacccccuugggcaccaggcaugcccaaggcacauagacauacaagcaggcagacauaauguucguguacauaaaauuaaauaaauaaaaucugggggcggggggaagaguuuuauuugcuucacagccccguuuuauuugcuggagccugugaaccugcauagucuaccgcaggaucccucuguuguauuccuucuauucaggcugguaggacaagcuagucuugaagguuccuaaaauaaagugguuaaguucuuaggaaucacauccuuucauuauuguggggccagagauuaaccuaggaguugauggaugcuaggcaaacaguagagugugccucuggcucaccuuugugguuuagaggcaaaccucuguuggccucauccgcugucuggccuuaacucuugauccucuugcuaggauuguaaguaugcgccacaacaccccacauauaaagggcauauuaggcauaugcuguugcguguuuucuccaauugauuuuccaaaguagaugaggauguuagaagaucaugguguccuuagggcagucugagccuccagcaacuuuggaguucuuagagacccaagaaucugaucugggccucagcuuugaccuuguguuugucccuuaccagauaagggucauuguccaggcucugguaguguuugacaacaggaaauaggagcaccaacauugugcaggauggacugcuuggccuggccucacuuucaacauaagacauaguaucuccaugugagucaguuuaaacuaagugacuuuauggguaggguguuuuuguuuucugggaaucgaacccuacacauuaauggaaauacuuugccaggacuacaucaucaacccauuaaucagucugacguguuguaguuagaaaugaagcaugagugccugucugggaaacaauguaguuuacuacaugccugaaauucagauggggaccuccagggagaccguggaaaaggugcacagggcucagggaugggggaugaggguuuucagaaagaccccuugaguuugauacagaggcauccccaggcccugccgaggaggcggcugccuaguugcagaagcacagaccuguggcacuggcaguaacaagauuagggucugguuuuuuuguuauccuuguugaaaagacuuuucucauuuugaggaugcugucacuaggaaagauggguuuugaggccagccugaucuacagaguaaguuccuggacagccagggcuauacagagaaacccugcauagaaaacaaaauuauuuccucacacugcuauuuuguguuuguuuuuuuuucucucucucucucucuuucuuguuccauuucuuuucuuuaaggacaaaagacuguguugucaaauguucaggaagaacuggauagaaugacucgaaagccagacuccaugguaacaaacucuucaacagaaaaugaagccugacccuccuuugaaagugcaucugucaaaugaccaaauaacuauguauauucaucugauaagaccaggauuuuucugauucggcacaugcugucaguuuuuggggguaggggagaugaacuuuaaaacaauacauauacuucuuuggcuuguccgagugugagaugcacauuuaggaggcuccaugucaggccccuucuuagggaugucccuuggacucuugggcugcgauucucuugugggaagcaagugcagcuggccuuguagaguggagaaaggaggcccacuuucuaucaggguggagcaaaggagacuaggaaggcauuguucagauggaugguuaguuugaccaguugcguguuagcaaauucacuuguucuugggaagcagguuaaguagcugacaguccaggaaagagaaagguuccggagggacgagagaagugcugguggggaagccgaagguugagggagguggaggaaggaagcgagugagcgggcaggcaguguuaguaaguacaagcucgguagaaaccagauagcaacaguuaagaccuaacaauuagaaacauuuccaaacuaagcacuaaacagaaugggagcugggcuuguucuaaaugaucuuuaaguuaugggaaauguguuuuauguagggugcugaguaaggugggcugacucagggcuggugaagaccacagcugcccccgggacccacaugcuugacccaggccaugucccuuguccuuggagagaugucgggcucuaugcagauguaaccuggggcaggcagucgcugugcguuauguucaaagucagcagauacaaaacuagauauuuuaaauaguuccuguuuuguguuguuuaauuauuuuuuuaacuaccacaggcuggccaacuaauagaaaaagggugauugauuucucauuuuguaccauguuggcaauguucuagggaaagugugggggaaguauuuaaugucguuacacucugguuauuuggcuugugccagguccugccuuagagccugugguaacccucccugauacagaaagguucuuucuguagcucccuggucggaucauugcugucagaccgacaggugggugcuuuccauggagaguggaagugguaggcuugugcuuuccaugaaacguagcacuucuucucuuaaggaggugcaagucuucugugucuuccaucaggggcauguucaugaacacugucaugucacaccaccaugcugaagauaacuucuguggauuugaaauggcacuuugaguuucugugugacacagcacauguaaaugcaagcacuaccaugacuuuaauguauaaaaucuuuguuauccaaaccaaggggaaaaccacaguucacuuccguggaguuuacucuuuuuuuauaugaauguuuguuacugugucucggcauaguguuccuaauguuguuacauacaugccagauuugacuaaccacuaauguaguugcguaaguuaacaucuaguuacaugacaaggcugcucaacugucgaguggcuuuguaaaggucugaacacuguuaaggggaaagcugagugcuugcuugccucucuaacaacaaaaagaugugucuugugccgguuguacuauugaaauauauuuuuuccuuuuuuaauucaguuuuuuuuguuguuguuauuuugguuuuguuuuguuuuguuuuuuaaacaugcauuguggcuucaaaugaccagguuguccaggcgaugacagcaaacuggcuggaguggaaaccaugauggagggucaacugaucuccguagcagccagggcaaagugaaugaccucagaaacuaggaauucuugcaaagacacugccuaauagugugauuuugaaaccuugauacaaaaguuaaaguguaucacuggaacggguaggcacuuuuuguguugaugucaagugugcucuaaccaacugaggaaaugcugaggucggagugggagggaggcuuggagaccauuguguuauuccuuugauacuuggaugcgccuaguuucagaagaaacugaugcguguugucaugugcucaguaguugccaaaguccaccagcuuugcggagcuucaggguuuuuuggggguuugaggagaugagguaauuuuuauuauuuuaggaguuucaagcauuggaaccaaaggccaaauaauaaacagccuuuacuuuuuagaguaaaauuaauucuauuugcaagaauacacuugcaugguagacuauaaaagacaauuuuaugacuauuuauacacauuauaaugauuaccucuguuugucuuuaaauggauaauuuuaaguaagcccagccuaaaaauuauagcccacaugagggcugugaauuggucuuuccuaaaaauccaacauauaugcugcuagauuauuuuauuuuauuugcauuuuuuuuaauaacagggaggguuucuuuguauugcccuggcuguccuggaacucacucuguagaacaggcuggccuccagagaucugccugccucugccucccaagugcuaggauuggugugugcuacagugcccgauugcaccuuuuuuuucauuuuuacuuuuuuuguuguuguuggcauuuuaaaaccaguguuuaaacugaagagacuguugucuugaugagggugagagcgacugcucuguacaucacgaccuuaacaauguugaugcuguaaguggaaguucacuguugucucucugcugaguucauugguguuuuuaacuucgaauuaggacugcggacgaucucccgucagccucaguccaggguguggcucugucugggugcaguaugcagucauguggaaccuugcuuucuagugcugggggaagagaugucuaauuacuggcuucaauaaacaagaauccagacugcuaagagguuuuggugacuuuguuuuggauaaagcaucccacuagauagucacuaccugcugaucauauguggguguguggcgguguagcuaagaauguguauaccuugagcuggugaguuggcuccgugucaccaagcugccaugaagcuucacaaccugaguucaguccucaggaccugcuugguaggaggauccgcuccuugaacuuguccucugaccaucacaagaacacacacaggaagguagaccaaacgaauaaucagaagaaauggcucagugguuaggacucacagcuccucuagccuccaggugaucugaguuuggguccauuuuagaauuuacuucagaccucucauaacugcguguaacuccagcuccaggagucuugacagguaccucacacacauacacauguaaaaagacuuuuuaaaaaauacaauuggggcuggcgagaugucucggggguaagagaacugacugcuuuuccgaaggaccggaguucaaaucccagcaaccacaugguggcucacaaccacccauaaugagaucugacacccucuucugacuugucugaagucagcuacaguguacuuauguauaauaauaaauaaaucuuuaaaaauaaaauaaaua

SEQ ID NO: 4696 - RNA, 1205 nt, Mus musculus
uccugccuuugugaaagggcagacugugguaaaugcucugagacccuuaauccucugguguuuccaagacugaggcacauuucaggacugagcgucccagugaccgcauuuacaugucuuugaguugaaguuuauacuagcgucaaguucagauucccccgaaagcuuuuccuuucuguauuuauaggacuuucucuaucggcugcuuacuuauaagaauccuuguuugauggaagaguugcccuuaccugagguuaauuauacaucuugcagccguagucuuuuuaauugugggguuugacuggguuguaaguacacauuucacaggcagucaccugcuaaagaaacuacucccugguuguagcuggguugugguaggauauuagaugucaaaggaccacugccucucaguuagauacucuugucuacugcugcaugggaugugugauccucacacauggggggagucauguauaguugacauuggccagaaaagcucaagaaacugugcuugcugguggguaaggcaucuaaaccucagaucuugaguacaaaguauguuuggaguccauucacagacccagacuggaaaacacuaaaauauaacuaguuugggaccagugagguagcucagcagguaaagucacuugcugccgagagagccugccugaguuugaucccugagacccacgugauggaaggaaaaaauugacuccacagguugucagccaacuucacuguggaaccuccaccuguacgcuaaggaacacacacggacagcucuagauaaauggcauaaaaaacuugaaguaggagcuagagagaugggucacuugcugcucuucagaggacucaucccagcaccauguaugguggcucacaguaguucacaacucuagcuuuagggaagccaaggccuguggucccugagagcacuuguacuccugugcacauagccacaugugggcaggcacacacauaauucaaaauaauaaaaauaaauuaaaaaaaauaauguagagauuggaaguacagcuagauguagauaccuuuaugcucaaacucaucaaaaugcauuuaauagauauuaauaacugguuauacaucaaggcagcuaaagaaagguagauuuuaaaaguauauguuggaaaaggaaguuaauggaaugauguuuugauguuaggaauucccucuaucaaggaacu

SEQ ID NO: 4697 - RNA, 1518 nt, Mus musculus
ugggaaggaaagaguuuauuucaucuuacccuuccagaucauaauccaucauuggaggaagucaggacagggucucaagcagggcuaaaaccugggggcaggaaccgaugcagaggccauggaggggugcugcuuacuggcuugcucagccagcccaggcauggcaccacccacaauggcauuucuucaauugagcuuccuucuucccugaugacucuaauugacacacaaaacuagccggcacacagggucucacuauguagcccuggcuacccucgaacuugcuauguagaccaggauggcuucaaauguauagaguuccucccgccucugccuccugaaugcugggauuaaaggcgugugacaccaugugcaaccauuuuaaaauuaauuuuuuugaaguaggcucucacauagcucaugcucaacuuaaacuuaccaaguagucuaagacuucugaucccucccccucccccccuccccgcccccaccagcugcccauugcugguaugacaggacaugcaaauaucuauguccagucauuuuuuuguggaucuucguucauguuuggcccauuuucuuuuaaacuucugagcuguaguuuccucaccucacuuauuaagaauuaaacaagauucaaugagaucgcuuuauaaauaugguugucuagcuugaguucauuccaaagcuuggacuugccgcaucagaggcugcccugcaggggucgccagcgcgcucucggucugguggcguccgcggcuccaccucccgcguaaggcuguccggcuggcugccugacccagcaacgucccuagcugcggcgaucccacgucccgcagacgcacgaggacaccgcgggcccgucgggacgcgcuggauaacggagcuucugcggcguugcgggcgggcagcgcggcccggccgggguccuugcggguccucggcgggcccgggggagggcccucuuuguggcugcaguuggcaagauggcgccgguggggguggagaagaagcugcugcugggucccaacgggcccgcaguggcggccgccggcgaccugacaagugaagaggaggaaggccagagucuauggugaggagcguauagagccgcagauggcgcggccggaccgggagcgggccggagcgggcaggaccgugggcagacauugaugggcagucgugggccgagcgguccuaggcggucccgcgcugaccacucuugucauugucgccgcaggucuucgaucuugagcgaaguguccacccgugccagguccaagcugccguccggcaaaaacauucugguguucggugagcagcgggguacugcccuggggcgcaggggugggucaggcggcgccccucccacugguucccaggcuucuccacccuuagcgccugcuugucgcuugccugccugggagggcacccuggacucuggcaggguagcugcugagucuccaagcccacaccucuacugacccccuagaaugcagcuccguuuggaguccagug

SEQ ID NO: 4698 - RNA, 23615 nt, Mus musculus
uauauuacaaaugagaaaaacuuuuauuaaggaaacaauuuaacuuccguccuuuaacagauuuuuacaaaccaaagcacaauaugaagacaauuacaguuccaaccauuaacauauuacacauggugcuuauucuacaacuggaaaguugcagaaguuugugacauaccacuauaaauauaaguauuauuaaaaauuacgaauuguuuggugauuauuuugauaacuucuugagcagcagcuccuguuggaaaaaggagagaaguaaauguuugaaaagaauaaauuuuaagaguuaaguaauauauaccagacugggccugacggugcaugcuuuuaaucccaguacuaaggagacaaagacugguggaucucugugaguucaaagccagccugcucaacauaguguguucuaggcuggccaaggauauacagugaagacacuugucucaaaaaaaaaaaaaaaaagaguuggguguggugguaacggaugacucuauucaucagacuggggauguagaggcaagaugauuaugagcucauggccagucugaguuacaaauggaauuggaggucagccugguguauaugagaucuaugcuauauagaauacaccacagauacagaugaguacaaaagacaaaacaaacaaaaaacauaaagccaagcuguuuaaaaucccaaacaaacauauuuugagucauaacaaaauaaaagauaauaauuauuauuauucagggucaaacccacacugaauacuacagagcuccuguaagguacuugaaacacaaagagacagugaaauuccaccaagaaaaaaagaaucuuuucuaaacugaggcagcuucuuucuacauacugaggcuguggacuuaaaccuguacuaucaccaaaucucucaggcaccauagauguagcagaggugcaagaaacaaaaagaucugcugcuugcuaccuugggucuuucuguuuaacagcaagagaaaggauagcuuacaaauaaauacagcauauaguauguagaagacuuugugcuaugauaaagaagaaaagaaggacuaguacagaggaauggcucauguuuauauaggggaagccucagagaauuacguucauaaucauaacaaaacacauaaaacuaaagaccuaccuacacucguuaggccucucugauugugucucuuagaaucuggccuauguaaauaaguaauaauuugcccuuuccuaugaauuuacuauuuagacaugaaagaaugauuuuauuuacauaaauuauccagaaucaggcuuuaauuuguguuugcuuaaaguacaguuuucuuaggacuccaucacuagcagcauucugaacagacuacuccucaaacuggaucugccuucaacgucuagaaaggaaucgaucauaagcacacagcucaggcuaugggaggcaauaggcaggagagucauuuuuaaaaagguauuauuugcuucauguuuguacuccuucucccugucauuaacauguggacacuccgugcaaugguauuagguggggcuucugggaagugauuagaaccugcacaaauagauucaugcccuuauaaaggagauccugcagguuucuuuuuauaugugagagcaaagugagaaaaccaccaugaaugagacaggcagugagaucucuacagccucucacuaugcuggcaucugaaucuuugaaacccguaagaaauacauuucugauguuuauaagguccaaucuaugguacaguuacagugucuaacuaaacuagagcaaagugauaaagggaguuuuaugaaagaaauggcagguuuucacugggcccugaggugcaaagaccuagggcaugucucaggaaaagaagggacguagggccuuuuagucaaguuagccuuuguuuccuagaacugauggggcaggaggauucgagggggaggaggaaggggaggaagaggaggaaggccuauguguccuuguacccagagagcuaagugaggcucaugaucggaagaaggucuucagaaggacuaaagacuccagagucgcucgcucugauggcacgggagcuggcgggcaaggagagcaguguggagggcaaagcacuaauuacacuaauuacaacaaauaguaacuguaugauaacaaauaagucauuucaucuacaaaacucaccucccaggaacgcagcaaugguguguggcucagcagcuccguaccggcaacuacagaaaggauggggguuuacaguuuuauuagucucaucacagucucucccagugaguauuaucuuuauaugcucuaaagaauacucacaauucauggacauaaucgucuuucaccauuacagacagcccauauuccugaaggaagccaguaagacaggacuucaacuucccuauaucuucuucaacuugauaguuagauacuccuaaaaaaaaguguguguguguguauauauauauauauauauauauauaauauauacauuuccauuaaaauaaauaugugggcugggcacaauagugcacaccuuuaacucaggaggcaaaggcaggcagaucucuguguuugugaaugcucuguauuacguagugagugcuaagacugccagggcugcauaggcgccaggucucaggggaaaaaguaauucaaacugaucguuaucucuuacuuaauccaguuuaaaacaguaagguauaaaacuacagaacaaacauaaaccaacauuugaaaauaucagaaucugcuaaacuaaaaucuaucacaaauugaaguucaguaagucuuacucaggucuagggauuuuaacuuagugacagcauauuaucccaacauucugguggguuucuggucuuuuaagucuuagcuaauuauguuguagaagauuaacacaaaaaauacucaauaauuauuugaucaaaaaauuaaagagaaaauaccuuacuuauauccuuuaaguuaaauuucuauuuuuuuggaaacaaagucuuauuauuaaucccugcuagucucaaacuuguauguagucaggggugacccugaacuucuaauucuccugacucuaccuccugggugagauaacaggcguaugcuuuuuucagugcugaagaucucuaaaccuagggcuuuguucacucaacaacaaacuaagcuacuuauuuccauuuccagcccuuuauuuccauuuugagugauuaaauggcacugaggacauaaagcaaucguaauauacaacauuuacuaaacauuaauagaugcuggauacuauuuuauguacuuugugccuuugcacugauuuaauucucaaaagaacuuuaugaaggagccacaacuauacagauagaaaagcugggacacagacaaauuacuuaguucaugaacagcaaaacuagaauacaagacaagcauuuuguuguuguuuucucaugcaggaaaucuaauccagggccuuaggagugcuagggccacuaagccaguccuacgucauuucuuucucucuucuuuguuguuugggacaaagucucauucugcagcccagcugaccucagauucacagcaaucuuucuaccucagccuccugaauguccguccgccccauagcugugagccaccauacccaggugucaagcaucucaguaaggagagugaagaugucucuucgauauuuaacucagucaaaccuucagaaucucaagccuaggcaccauacgacuaagaaccucccucuuaaaaaaggaacugcuucagcuccaacaagaaaccagcagagaggauuaaaggccaacagaugggucaguggguaaacugugcuguacaagccugaggagcccacuucaauccccgagaacccgcauucaaaccugagcauaaugguauacaucuaucuuaucaggggaaacccaaagacaggaggacccugcuuggccagccaggcuagccaaaucugugagcccucaguucauugaaaaaccuuuccucaaaagauaaugugaacagcaacugaagaagacauuuaauauuaaccucugguccccacacauacaugcacacauguauacacucaugcacacacacuuuaaccuguuuuaaaccacuaaguuuuugagaccuacacacacacacacacacacacaaugaauuuuaaaaagacaaauauaaaaauaagacacaagagauaggacuggagagucaguucagcaauuaagagcacugacugcucuuccaaagguccugaguucaauucccagcaaccacgugguggcucacaaccaucuguaaugggaucugauguccucuucuggugugucugaagacagcuacaguguacucacauacauaaaauaaauaaaucuucaaaauugaaaaaagaaaaaacauacaaggacauguuagugauacacauucaaccaacauucuucucuaacaguuuagaaucaaaugguuuaaaaguagugagccuuaaaaaacaauagagcacugggcuggagagauggcucagagguuaagagcacuggcuacucuuccagagguccugaguuuaauuccuagcaaccacaugguggcucacgaccauguaauaggaucagagucccuccucuggcauguguguguguguguguguguguguauguauguauguauguauguauguauguauguauguauauaaaaauauguauauaaaauacacaaacaaucuuuuuuaaaaaaaaaucaaauaauaguuccucuaauauccacagaauacuaaaauucaggucaaguggguuuuccugugugguugguuggucuuuuuugagacauauucucucuacauagcccuggcuguccuggaacucacucuguagacuuggcccagcucugccucuagugcugggauuaaaagcaagugccacuacaccuggcaucaagucaagcauuuauuuaagacuuuaaugagugaaucugauggcucaugccuguaaauucaauacuuuggagacugauugaggaagaucacaaauucaaggccagcccaagcuaauaaguaagauccugucuuaaaacaacaaaaaagccaaaagaucuucuuuguaucugguaaaucaacugcuguucuuaccuggguaucugccaugcuguuuaugaaaucgaucaacagcccgcaacaucagguacaggacuaucucauuauccggauuguccaugcuagaaacugaaaggaaaaaaaaaaaaucaguaaaacuagauaacauacacaagcaacaaaaggcugaauucauacucaaguuucaggauacaaaauaauauuagcaaaaaauauuaaauauuuuauuaaaauaaaguauaaaauuauaaauaagaaauaaauacauuaagguguaacacaaggggucuuauagacuccuagcuggagucucuaccaagguagaaacaugauaauguuaguucuauauagcacacaaugcagucaguaaucuaaacacauuuuuauguauuuauuucugaauaauauauguaaauuaaaaucauucagguaaucuaugaaauauucacauuauuuuuauagcaccauuuauucagcacuauuauacacauuuuauuaguaucuuuuaacuuagcaucugguuguuauacuuacuaauuucaucuuuguugacuguauccaagccauacucuucagcuaaagaucgacaucuuaccacucgaagaaaugcagaauugcugccuggaaacaguaaagacuucaggaagguugugacaacugaauacaccaaauuaugggucacuuuaugaacaagaaauuagggcuacaagauggaucagcagcuaggagagcuugcuguuaauggagaggaacugaguucaguucccaguacccaccugcccacagcaggccucaugacuacuuauaacucuagcuccaaggggaucugacaucuuugaccucugcaggugcacauauccacacacagauaggcacauacacauagcugggugugguggcgcacgccuuuaaucccagcacuugggaggcagaggcaggcagauuucugaguucgaggccagccuggucuacagagugaguuccaggacagucagggcuauacagagaaacccugucuugaaaaacccaaaacaaacaaacaauuuaaaaacaauaaacauuuugaagcauuuauucauuaaaaauuuuauugagugaccacaguacuguggggguuuuguuagacaccgaauauuaaugguaugaagaaauugcugccuugguuauagucucaguuuggugugugaggaaggcuuaaaacaaauguguguguccauguaccuguucuuugggguuccuccgauuaacugauaggccaucuuucuaacccggcaacuaacuuuaugaaacuuuuacuucugugugugauauaugcauggauaugcuuagccacccgugaauauguggugaauauguggugaccagagauugauucugagugucuucuaugaaucgccacuguauucuuuuucuuuuuguuuuuauuuguuuuccaccuaucuuuuugagacaggaucuguuugcauggcaagcacuuaacccgcugagcuaucuucaaccugcaacugacuccaagaacacgcuuuuaccgccucagaaauuagggagaaaaccccagaagcccagccaugaacuaucaugacaaauucuuaauuccauuagucacuuaacacagaucaaaugaguaccaauggcccagucuuaaaauguccuuuagaguacaaaaaaacaaaauaaaauuuaccuaaggauacacacacccuacuucaagaauuucaaccauuuaaaacucccaagaacacccucuguagcauacuuuuauuaagcaaaauaagaaaauuaaaaggacuuacaaagcaauuuuaauucuuucucugaaauggacucuggugccuauaaagaaauaaaugcagguuuuucucuagcacgcacacacacagagacagcaauggcacagcacaaagccaagagcugggaaaacacuccaaacacaacuguucuccuguaacaggggugcucauuagagacaaguaggcacuucugccaaagaagcaagccagggccccgccuucccucucuaaccccucccuggcugagcuccuugcugcggggagaaguacuguucaccacuuaccuggccaacagacugaagcaauuuggcaacgugauugccuacagcagcagcaucuuucuuugcuuucucucgguaacuggaaaagauugacaacaacaaaacccuacaauuaaugacuccuaaaauuagcaaagcuaaagucaucuuuaagugaacaaaaguuuauuuuuaauuuaaaaauguuuggaaacauaugaaaugugaaaaugguagagaauuaucaccaguagcaccucucaccaguuaggugucauggaagagcuggcaguagaguccucuucuggaguccucuaaagccaaagcucccauuauccaucccuacagcauccaacuucaauguacccaggugacaccugucaucccuacagcauccaacuucaauguacccaggugacaccugucaucccuacagcauccaacuucaauguacccaggugacaccugccaucccuacagcauccaacuucaauguacccaggugacaccugucaucccuacagcauccaacuucaauguacccaggugacacucgugggagucuuucuuuugagucauuuucuuuuggucauuaaucucucguaacuuaaggaaucaaugacuguagauaaacaccuguuauccaguauaccuccucugacacacauggacccguaaggucaggucucccuggauguuaccuucuuuguaacuaauguacagagcugaugaaugcaaggaaccugaccugguuuccuccagggccaaagguugccauacagagaagaucuuggucaguguuuaacaaaucuugguuuguuguccuaaucuaugaguuauaauacugaaaauuuggcaaaggacaacugaagacagaaacuaauggugacuuuagggacauugcucagagguagaacucuugcuucacauauauaugaggacccagguucaaucccaauaguacaaccuucacccuaaaaggugugcccuuaccugggagagacucagcauuaauacuagucauuuuuacagucaaauauaacuagauauuaaacaaaguuuuucaugacuuauacuauuggguagguuugaagugugugguuuuccuuggacuuaacuucaagaaggugaguuguucauguaacauuuuuuuuagguccucugucagaaaccagggucugagucccuuuaggagggcagauuuaaguagccuguuacacauaguuuaaaaacagugauaaggcaugguggcacauuccuuuaaccccacugaauucaaggcuagccuugucuacaaagcuaauuuuaggacagccaaggcuacacacaaaaacccuguuuugaaaaacaaacaaaauaaccacaacuaaaagacacuuacacauucugcaguuuuauguauuuguuugaaucugcaaucauaucaggaauugugccucggacagguaaauuuccuugacccuccuuggccacaaauuccuuuaaggcacgagcuagaauccaaaaaguuggugucuaaaaaaauaagaaaaaacuacuauaaagguguguauucugagcuggaguugaagacagcuuuauuuucccuucuuguuguuaccuguuuggugauauuuaugcaucgaucaucauuaaauauaucuucaauacugcuugggaucuaacaaaggaacacaagacauuacuuacauuaagaaugcuguccaccuuuauuuucaaugcuauuucuucaaauaaguccuuuauauuuucaaagugcaguaaaauaucaacuucugauguauuuaguuuuauuuacaaucagauucugauggagaucugaugggaaagagaauggaagaaaauccucuccuggccuguuagcauuucagacaagucucccauauccacauggaguaaaggaaaagccaaacaugucauucuauauacuuuguaucugaagacaacaaugacuacugacauugcuacaaagccagauuuaaagcuguucaugguuucccagcuuaugaaaguccugaaauucauucacccuaauuccagggcuguucagagaugaccacucuaacaaaaaauaaguaauuaugcaauuugaaacucacaaggucaccacacuaauaacuuuacaaacuauaggcuuugauucuaugcagacaaaauagaguucucagugacaaccucgugacuggugucuuggcuuccaaccccacaccucuacuguauucauaagagucaacagucuuuugaauggcccacuguaguggcacacaucuuuaaucucagcacuagaaggcagaggcaggugaaucugugugagcuccaggccaccuggucuacuaaugaguuccaggccagcuagcacuauauacagugagauccugucucaacaucaaacagaccuuccuacuucccugcucaaaacccuucuaggucugcgagauucugcuaugguauggcccuuucuagcucuccaaacucaaaucuugccuaucacuuucuuuccccuucaaucguacugacuuuccuacugauccuuuaacucugugcccugcgcccgugcccucugcuugagcagcucaugcaacagaccucuggguggcacuucacucaggccuuuuccuccuucccagcucccucucuaacacugcccccuagguacacccuauccaauacccagaccccuucuugccuccucacauucuaacuuuguucauacauuaauauccaauuguucaauuuacugcccccaacuccuagaaccauuuuucuguuuuauuuuucuugugcccagacuggacuagaacucacuaugcagccaauguggucucaagccucuuccuccaucuccuugguucuggcauuacaaguacaugccgccaugccuggcuuuauaaucauccuuuaguuuuaaaaacugaucauuacauuuuauuuucaguaaaaaugcagaucuaacauguaucauuugauagcuauacauauacauuuucaacauucuuuccaauuaagauaaaagauguuccuuagcuagaaugauuuacaaggcauacacucaggaaccauuucagggucuucaaaaugucuacagugacuugagugcuuuccuaaugugaaaggcaguacucaagcuauaaauuguaaaaaaaagaaaaaaaaaaacuauaaaaaaucuuccaggugucuuauuccacaguuccucaaaaaugaacgaacaaacuuagaagaagaagaagaagaagaagaagaagaagaggaggaggaggaggaggaggaggaggaggaggaggagcaggaggagcaggaggagaaggaggaggaggaggagcaggaggaggaggagcaggaggagcaggaggagcaggaggaggaggaggaggaggaggagcaggaggaggagcaggaggaggaggaggaagagaaggaggaggaggaggaagaaaaagaagcagcagcagcagcaacagcagcaacaguaguaguaguagucugacuuauuuuccgauacuuuuuauguauucuaaguugggcuuaaccucacucuguagcccaggcuggcuucaggccucagauucagaauccaccugccucagccuccaaagugccaggauuacagguguaaguuaccauaucagcuuauaauuuuugcaauguacaagucauugagaacaucuccaauuaugucuaaauaacugcugcaaaaaaaugcaagauaacaaaauuuaacuuuugaguuuaguacuucuuuugacuagcaaacuaucauuuguaagucuuaccuccaaauucucaacuauucauaaaucauauuucucuaagugaaagaaauuacuuuauuuuauugcuauuauaugcugaagcacagacauaauuuuaaugaggauaauauagauuuuuuuuuuguuuugagccccagcuguuucugcacuugcuauguggccaaggauggcuacucaucaccuugcuccccucccccagggguggagguacaggcauucaccaccaugcagggcacaaaacuuuauuaaagccgggcgugguggcgcacgccuuuaaucccagcacucgggaggcagaggcaggaggauuucugaguucaaggccauccuggucuacaaagugaguuccaggacagccagagcuagacagagaaacccugucucgaaaaaccaaaaacaaaaaaaaacaaaaaaaaacaaaacuuuauuaaaacuaaacugcuguuuuccgcugggcauggcacauacuuguaacacuugagagguggaggcaggaaaagugucacaaguucaaaaccagccuggucuauacagcaaauuugaaaguagccugggcuacauaaaaagaccuugucuuaauaaaaaacaaaacaaaagaacccaaacauucuuuguuuaggcauuuaggcaauauuagguuaaauuguuauaucaacuuucacauaugaaaacaucagaaaacacagugguuucagcaguuucuuugauaccugaguuguauuuagugcuguguucacauuuuugauggcuucuucaaaauucucuucgucuucuggagcuccauuuucauucuuuaaaaucccuauuaaaacaagaaauagcuaacaaugucuccuuucacuuuggcuuccaacauuauagaaaaaucuuaucaggagcugaacagaggaccacagugcuaacccuuacaggaaacacagccauuuguucuuccuaaacucuuuuuuuuuuuaauuuuuuuuauuuuugagacaggguuucucuguguaacccuggcuguccuagaacucacucugcagaccaggcuggccucgaacucaccuggguaugccucucaagugcuucuuaaacucuuuaagaaaugauaccuuuacccccagggaaaguaaaauaggaacucaugacagcaucaucugacaauaaauauugguuucaagcaauucuuuuucaauauuuaauaccuuauaugcuuuauauaauacuuaauuacaaugcagaaaauuaccuugucuuaucaaaucucugaaguccucuuuuucuuuauaacuuuuaggaauccguccauuugucuaaauugauuaaaauauuuaaagaucuaguuaucaaaacucaaaauauggaaauugggugucccaugguuuccccauuauaaaaucacugaaacagaggcuugcuuaauuuggaaaguguaauuguagaccauuucuuuacauucauucugggugaaauuuacuaaaauuccuauuuguuaauuaaaauaucaguacugaaagagugauagcuagacuucaacugaaaagcucccacuugcauuacauccucacaagggaaaacauuaaccucccauaacccucuaaagaaaucccuuaucacaucuuggaaauaauaguaauuuaauuaaaaaacaaaaaguacauacuucauuauaccacugugcuaaauauuuagcuaugaucacaauccauggaguauggcuaugguccuaaaauagaaacacaaauugaagaaaauagcaguauuaguuaauauuaacucuucacauaccaucuuauuuucaauauuuauaauuaucuucuaauccacaugaaguaauaaacaggcaaaugaacugguuuaauaaaacugguuuuagaaaugguuucugaguggcuguggaguagcucugugaguaaaaugugugccagacauggcuauaagcuggaaccucagugcauaaggucaaggcaggcagauccuggaucucauuggccaaucauagaugaauggcuagcucuagacugaugagacacugucucaaaauacaaaguagaaagcaacuaagagaaccugagguugaccucuggccuccacaggugcaugcauagguuucuguaaaaauacacacacacacacacacacacacacacacacacacacagacauagacauacacacacagacauagacauacacacacacacacacagacacacagacauagacauacacacacauacacacacacacacacacacagagagacauagacauacacacacacacauagacacacacacacacacacacacagacacacacacacagacacacacacacacacacacacauagacacacacacacacacacacacacacacacacacacacacacacacacacacacacacacacacuaaccuuuuuuuccauaugguccaagucauaagacugaagauguucucucaguucaggaaauggcuuaucuagucguagauccuccaaugcauuaucuggaugagauucuauuacugucaagcaaucccaaaagauaauucuuuacuucauuauaggaacguaagacacacacacacacacacacaauuuuguguaauuggaugguuggaaauggagucuuacucuauagcccaggcuagccuugaacucauggcaauccuucugucucaucauccugguuguugucguuacaggcaugacccaacgcaccaggcuggaaaccuauacuuuuuuuucuugagacagggucucacucuagccucgacugcuucuuuuacucaaugucaguuacucccacuuccugaucugacuuuggacacugcuuuccacaugagggauacaaaacaaugcacaacuucaauuaguauuuguaaugagguuauaagucugccacuugcuaugucacuuuagacaaguaacaauuauauuucugugcagagauaauaguaucugcuuaauaagguucuguaaagaguaaauaagucauuuacaucagagcagacacacagcuaacagugcugaccuucaucaucacccacuccugagcaucuccccuaaguuggaggcucucacccucucccuccucccuucuuuaccucacucccaucgcaccccugcaaacuuggcuccuuuaaguccacucauucucuacucauacucuaacauuagagcgaucaacuuaaaacacaaauguuaucccauugcuucccacuuuuaacucuuaaauggccugacgucaucuaccaaaaguguauccuaacugcccacaugacacuaagccuugugaggcuucaguguuaauagccacuguuacaccaacagagugccugguucauauaauagcuggcuuagaaugaaaacacuuuauuuaguagaagcauuuuuacugaauacuaaaggaaaauuuuauaaaauucuaagauuaagauucuauaguacaagcugauaucagcucugggcugcuguaggccugccuaugaaucacugguuuccuuuaacacuguuuccuuaggaauaguagcucggaaaaaggcuuaucauauguaacuggacguggaauggagaaaucuaaggccaauauaagacugaaaauaaagacaggugggaaauggugguguaauggagaggcaaaauuauuacuuuuauucuguauguuacuauguaugcugugcuauaauuacagcuaugcaacuaugaaguagcaacaaaauaauuuuauggcuaggggucaucacaacaugaggaauuguauuaaagggaaggcugagaaccacugauguaguguuugugucaaaguggcccacacacuccuguggcaaccauagauguccuauuuuggguuggggagcaaaagaaaccagguauuuacauagcuccugggucucuuagcaagacaaacaagguguauguuaugucucuggccugcauccauuuauaaagcuauguaaggaaauagucaaaacccuuugaaucaggcuagagauggcuuaaugguuaagagcagugguuacucuuccagagaauccagguucaagucccagcacugacauggugguucacaaccaucuguaagcccaguucugggugauaagagguccucuuuuggacucuguaggcacucauauacacuugguacacagucauacaugcaggcaaaacaucaauacacauauaaauaaguaagcacauaaaaaaacuauugaaucuuauugccuuuuugaaccuguacugcuagaaauuuauuucauaauucaaaacaauuuaaaaauugugacuuccuaaauuagcaaguuucuaaaauuacugcucaaguaaccauuagcaagucccauaugcuuaacaauuuuaccuggguguucuuuuauaauaauccucauauaaccaacuaguccauauguccuacagaucaaaagagggaucugggaauuccagagaacaucugcuaaacgcagcaauguacugaaaaagaaggcaaaguaagaacauaagccagcaaguauaugccagacacgggaacugucuaacauaaacaggcaagaacacaguggaaagcaagugauuucauggggcaacaaccucacaagugcugcacucgagggaugagaaaccccagucuguaguacuaggaagaaugcugaugaacacacuaucuaaacauuuucaucauaguggaacauuuccaaaacccauagacaccuacaaauccuccuguaaccacggaacugcuuuauuuuacuuuucuugguuuugguguuucagaaacacuggagcucacuacgcagcucaagcuguccugaaacucauuguguaggccaggcuagccucgauauccugaaacuuauuguguaggccaggcuagccuccaacuccugauccucucucucuggcuccugggugauggauuagacugcagugaauacuaccauaccuggcuucuaauuaaucuuucaucacuuagcaauagcuaauguucacuuaaguuacucuaaacauauccaaauaucuaacuuuuuauuccccauacaagaguuucaaaugaaaagcuucuuuaagaauuuuagaaacaagacaaaauauguauacagaaagauguacauagaaaacuauguaaaccaagcaagaccaugaaaaauauuaacaucgaaaauuuaccuuucaagaagcugaguugcaaccacaauaguaaaccuacagaaaaaugaaggaucauugucuagaagguuuucuggacucuaaauaagacaaggggaggaaaaaauucaacaguuucacauauuaaacauggcagaaacacauaagcuauuuuaauauaaauuaguugacaaauuaaauuccaacuaaauauaaaugacacaaaaauucagaauucuaaguuuuaggguuuugaauaauuuuuuaaaacacacuguagcaaaaaaauaauaauguauauauauauguauuauaccucuuccacaaaacuuccagagacaucgcuauuuaguucuuguaagaauuccauggcagcuugagcucgguucuuuucaaagacaaagcauuugauuugauuuagaaagugcuuggcuacaaugugauccccacacuuacagauuaagaaaaacucaaugugaaacuuuccaaauuccaugcauggaugugacaauucuccuucucaugauuuaacugagguccaaguagaacguuacucagguugaacuaagcuaucacuuauagaguuguuaaaugaccacguuauuugcccuugacuuuucugaucagacgaaagagaaaaccaggcagcaagcagggcugugcugaaucccguucagacccugucuaccuacacaagaguggccaaucacuaaagcaagcucaacuccauucagaauguaacacagcuuucauuugaaauacaaaagugucugugugugugugcgugugcgugugugcaugugcguguguaguuuaaaaacuaagguuuucauuugauguauuaaaaaaaaaaaaacuuucugguuaacuccacuuacuaauuucuaccacaguacucuauccacugaacaucaaugucacucgagucucuaauaaaggacaguguaaagucgcaguacucuaaguucuuaaacuaccaagagaguuaccagauuagaaagugagcuaaacccacuuuucccucagagaauaagaucuuugaaagucaaaacuuuuuuagcggccaagguauaguggcacuauuagaugcucacacaccaccauacucagucacggacugcuuaccuugccaauacugcuuuuuugaaggaaaaagcugaaggggauagaaaaaagccaagauuuauauggcuauaaagcaaaaguuguuuaacauuuauaauagugugcaccuugcauucaaaagggaaaacaaauguguguuuuacugcacucuaccacugagcuauccccacaaacacuauguccacagcugauguuaagucuccuugaaggaagggguggguaaaucagcguccucuauggcaccacuucacagcaugcgcugagagaaaagagucccaagaacgagaaaacaccacauggccuaucuccucccuggaaaguccuaauguaccucaaaagaacgcuuuauaguaaagagguuuacagaaaccucuuugacccauuccccaaacucguuugaccaugaaauccacuguuccauuuaauggcuauuaacauuuccuauaaccaauguucugcagacaccugggaaaugcuguagugaacgauuugcuuuugcaagaaauuauaaaagauucauucagacuuccucccacacauacucuggucacgucccaaaggcccauacuguggcugcugaugagagccagggcacaauuuuguggcaaaagcacaugguuccguaagaaaaaaaaacuccuuaguguuaguacaaaguaaugauuguauuauucuuaaaccauccugcagagucagcaagguaagcaacaauaauagaacuuuuauuauuuuauagauaccaauaaaagaguuaugcuguagauagcauaaauauacuaugcuccaaagaaaacauaucaaaggaaauaugaacuaaauccugauuuuccuugaauuaauauuuacuucuuguuuauggacaaauguaaugagagauuccuagacucuaaccacuuuaaaacaguaaguacgaaaucaaauuuggaaauguucugaaaaaucaaaguaugacuauauguaaaaaacaaaacauaggucauauggggcauuuuuauuuagcauuauagcacaauaagaaauauaucagacuaagaagauauaaaugaaagauauuguucuuauuccuuuuuuaaaauuucuuuaaaagauauauuuauuuauuuuauguauaugaguacacuguagcuguauagaugaugguuugagacaucuugugguugcuaggaauugaacucaggaccucugcucacuccggcccaaagcuuuauuauuauguaaguacacuguagcugucuucagacacaccagaagagggcaucagaucucauuacgggugguugugagcagcuaugugguugcugggauuugaacucaguaccuucagaagagcagucagugcucuuaaccccugagacaucucuccagcccuuauuccuuuuuuuaaagacaaggucucauuuuuuuagcucuagcugacggcuggucuugaauuuaaugagauccaccggccucugccuuccaagcggccucugccuuccaagcguuggaacugaauucauuuucuuauuccuauaaucccccaauccaaucauacucuucacuaacacuaaggaauuaacgccaggacuuagaaagcacucagaacucacagguaagagaaaaaugacuauuguuuugucugacagcaguaaagacagugacagacccugggugacagugagccccaucugcuaucggccggcuugccagacccugaguaacaugagcccaucugcuaucggccggcuugccagacccugucuuagcacuucgacuuuagucacuucuucaccauuaucuaacacccagucacaagguuaaaacugcucaggccucauccugagugcucugccuucucuaccaggcuuauauuuucaaagacagacauacuuguuuccagcaucuucuccgcugaccagauuuccaucaauaauuguaaaugauccaauaccuagggagacaaaguauagucacagacauguuuuagguuuuuuuuuuucuuuguuugcuugcucuuauauuuacuguuugaaugugagcgcacaugugccaugcacacaugaggaggucagagaccaaccaauacaggcugcacagaccaaauucaacuugucaggccuaacagcaaguaaccagccacuaagccacccugucagccuaagaagaucuaccucuguaucagagacuaaagaagucaccgagaaugcaaucacaggugucaccuuaccuggcagcaccaaguuuuuaagaauuucaguuccuguagccguugcauuuauuaagcaaacaugagcagauuccaaagcuucuuguccaugaucaccccacagccuauaaaacaaaacaaagauugaacauuaaaaaguucacaaaguaugacuuucuuauuugaauggugauauuuacaauauucuuucauaaaauaacauauaccaaccacagcaaacacgugggaaaggagcugauaauguguggguuacaugacaacauaacugaaaacuuugauaaaccauacuuugcaugauauaaucaauauuauuacuaaguuuugccuuucugaucuuuucuguuacuucuuucaaaccagguaauuuauaaaacagaaagucuagguagagucgucaacauucaagaaauguguuagccaagaaagcacuuaucgucucagcuauucaggaggccgacgcagaagagucuuuagaagcacguucagggucaaccugagcaacaaagagaggcccuaucucuuuaaaauacauacauacauaaauaaauaaauacauaaacagauacgugaauaaaggaagcuucuugcacuuaaaacauagucuguucucaaucucauuucuucaagugaugcagauccuauacauuuaaggucuugacauaagauauuuauuucccuguaacaucacaaaaauaagcaaaaauuuuaucaaggaaacuugcuuauuaucaucugaaaaagcucacauugaaguacuuuaaaauauaauaacagguauuacuauugcccuugguugccuucaagacacuaaagguuaagucccuauugcugaagacaccaugcacuucagacacaagaucuagaggaccucagcuggguuugacccggaagccuucugcaggaagaccagcuuuugcuguauacaaacuuucaagggagagaaaccguggguaguucuuccagcuguaauggcuaugaaacacaaaggcuaugaaaccagcauggagugacaacgugaggggcaauaguggcacucuuauauuggugguaaccaacagcuagcucuccaguugcacuuaaggcuugcucagcaggagagaaaucauaccuguuacuggaaaccuagccaacgacccaaggcuagaggugucauggaugucagagaagaaccuguugccaccacuuuacuaaaucagcuaauuccuaacugcauucuaaaaauuuauucuuuuuuuuuuuuuuuuuuuuuuuuuuuugagacaggguuucucuguguagcucuggcaguucuggaacucacucuguagaccaggcuggccuccaacucagaaauccgccugccucugccucucucucucucucucugccucucugccucugccucccaagugccgggauuaaaggcaugugccaccacugcccacguguguguguguguguguguguguguguguguuuaacagcaacagagaaaaagaggccgagauuucaaaaaggaacaaggggguccaugggagggacuggaaagggaaaaaugauauaauguuuaacugaauaaauacauacauacauacauauacauauauauauauauacacauacauacauauauacauacauauauauaauagccagugaacauucuaauuucuaauaggaugacuaagagaugcacacaucaauaacacagggguguaauaagaauuagaaacacauauuauaaccugauugagacuggcauaucacuaacaagacaaaguucaugaccacacauguaucauguuuuuugggccagguuugccaucuuuauucccccauuccuugacacacauauguuaucuccccaaaucccaaccaaccaacaaucuacuauuuucuuuucagaaugggaaauaauggggaagcccaaauuauuugaaaaugccauugccauacggguacuaucagaugcccggggacuuaaaaaaaaaagacuuugacacuccuuccaugucaccaauauaaacaaagcuuaucacaacaaacugcaccacuugauuuuccauuuacugagcauccagucuucacuuuaaagggucccagaccacacugcuggcacagggcuuugccuagaggaacugaucacucaagggcuggcaaauggagaaacaagcuugggaaaaaaaucagagagaccagaaagacuuuuucucuucccaggaaaugggacacagucuuaucugaguacuaagugguuggacaguugaagaauaagccuaagaguacaucuucaagauucagcaagaaaauguucuugcuggccugagaggcgggccuuggucccuggcuauuaccugccgacccaacuuuguuucugcuuccuucugaccugccuacagcaaaaagcaguucuuguuuugacagauaaaaugcagcccuuuaaggaauaacucaguaagaauccucuuccagucccuaggaacauuaaguaucuucucagcuuuguugccuucccuucuaccuccacccaaacacagaacuacgaguccacaagaacucagaguaguuacaagggcucugcuaccuuguuucucucucuagaagcuugggacaaaggaugagucugaaaaagccagguggccccaagcuggaaacaugucuaacucugggcaaauuaaccuaacuuuuacaagacuuaguuucccuauccaguaucaaagaccgucugccuucaaggauucucagaacuaaguaccuacgucucugggagaguaagagcuagguagucaauacaaagagaaaccuccauccuuagggacacaggguaaguucucuugagauuaagagaggcgaggggauggcaacacuuugauacacuuagcugacacagaguauacucaauaagaaaggaagaaggugggaagagacaaggaaggagaaauagcuaaagaauccaccggaugguuuagaugugcccuguccaaaugguuucugaguacuagaaaugcagcuggcaugaauuaagacauuuuuaaaauguguaugauaccugauuuauaagacucugugaacaacaacaacaaaaauagcuugguaauuuuaacaauaauuacguugaaauuguaauguuuuggaauacuagguuagauaaacacugucaaauuugauucugggauuggggaauguagcucaauuuggcaagcaggcaugauguccagaguuccagccucaauacuucauaaaccggguguaauaguccacacuuauaaucucagcuguuggggaaaaagaggcagaaggauugcaucaagucugagcgcagucugcucuacauugcaaguccaggcggccacucaaagguaaaagacaaaaaaaaaaaaaaaaagggguggggugggggagcaaaaacuuauuuuugagucuggcugggcagugagcaucuucaaucucagcacuugagaccugggacguaggcgcuugaguucaagacuggccuacuuaagaccaugucucuauauaaacgagagggguggggagaacuaguagcaaaacuuauuuuccugucucuuuauucucccgguucccaaggucuuccaauggaggccaggcuggcuuucaguuuccgauccaccugccucugcuucucaaguccuugggauuaccaugucuagcuucuuuuaacuuuauuugaaaggugccuacuggaaaauguguaauuacgaacacgguuugcuccgauaaagcuagcaugacgcauuucuauuggccagcgcgggcguagaccaauaccugccggggcgcagcgcucggcggucgggcaggauggggugcucccaccccccucguuuagcgaacgaguagggagggccugccgagacugugcagcccaguggguuggcggagacaccgcgcaccgcaaaccgcggacagccagccgugcgggaaggggcgagccggccuucgccgaacacucgggccaguggccggaucccagagcgccggcuccccacgcccugcacggccggccgcagccgcaggcccgugggaggccggccuacccggccuaggcacuuaggccccgcgggugucaggagagcccgccagccuggccggcuugcucacucguaaaccccggcucaccucagcugccggucguacuuuugcuccuugaguaucuucccuggcugcgccauggccgcgccuggcccgcgaacagcaaagccgccuaaggaggccgccacccacucggccucacgcaggcgcacua

SEQ ID NO: 4699 - RNA, 23615 nt, Mus musculus
uagugcgccugcgugaggccgaguggguggcggccuccuuaggcggcuuugcuguucgcgggccaggcgcggccauggcgcagccagggaagauacucaaggagcaaaaguacgaccggcagcugaggugagccgggguuuacgagugagcaagccggccaggcuggcgggcucuccugacacccgcggggccuaagugccuaggccggguaggccggccucccacgggccugcggcugcggccggccgugcagggcguggggagccggcgcucugggauccggccacuggcccgaguguucggcgaaggccggcucgccccuucccgcacggcuggcuguccgcgguuugcggugcgcggugucuccgccaacccacugggcugcacagucucggcaggcccucccuacucguucgcuaaacgaggggggugggagcaccccauccugcccgaccgccgagcgcugcgccccggcagguauuggucuacgcccgcgcuggccaauagaaaugcgucaugcuagcuuuaucggagcaaaccguguucguaauuacacauuuuccaguaggcaccuuucaaauaaaguuaaaagaagcuagacaugguaaucccaaggacuugagaagcagaggcagguggaucggaaacugaaagccagccuggccuccauuggaagaccuugggaaccgggagaauaaagagacaggaaaauaaguuuugcuacuaguucuccccaccccucucguuuauauagagacauggucuuaaguaggccagucuugaacucaagcgccuacgucccaggucucaagugcugagauugaagaugcucacugcccagccagacucaaaaauaaguuuuugcucccccaccccaccccuuuuuuuuuuuuuuuuugucuuuuaccuuugaguggccgccuggacuugcaauguagagcagacugcgcucagacuugaugcaauccuucugccucuuuuuccccaacagcugagauuauaaguguggacuauuacacccgguuuaugaaguauugaggcuggaacucuggacaucaugccugcuugccaaauugagcuacauuccccaaucccagaaucaaauuugacaguguuuaucuaaccuaguauuccaaaacauuacaauuucaacguaauuauuguuaaaauuaccaagcuauuuuuguuguuguuguucacagagucuuauaaaucagguaucauacacauuuuaaaaaugucuuaauucaugccagcugcauuucuaguacucagaaaccauuuggacagggcacaucuaaaccauccgguggauucuuuagcuauuucuccuuccuugucucuucccaccuucuuccuuucuuauugaguauacucugugucagcuaaguguaucaaaguguugccauccccucgccucucuuaaucucaagagaacuuacccugugucccuaaggauggagguuucucuuuguauugacuaccuagcucuuacucucccagagacguagguacuuaguucugagaauccuugaaggcagacggucuuugauacuggauagggaaacuaagucuuguaaaaguuagguuaauuugcccagaguuagacauguuuccagcuuggggccaccuggcuuuuucagacucauccuuugucccaagcuucuagagagagaaacaagguagcagagcccuuguaacuacucugaguucuuguggacucguaguucuguguuuggguggagguagaagggaaggcaacaaagcugagaagauacuuaauguuccuagggacuggaagaggauucuuacugaguuauuccuuaaagggcugcauuuuaucugucaaaacaagaacugcuuuuugcuguaggcaggucagaaggaagcagaaacaaaguugggucggcagguaauagccagggaccaaggcccgccucucaggccagcaagaacauuuucuugcugaaucuugaagauguacucuuaggcuuauucuucaacuguccaaccacuuaguacucagauaagacugugucccauuuccugggaagagaaaaagucuuucuggucucucugauuuuuuucccaagcuuguuucuccauuugccagcccuugagugaucaguuccucuaggcaaagcccugugccagcaguguggucugggacccuuuaaagugaagacuggaugcucaguaaauggaaaaucaaguggugcaguuuguugugauaagcuuuguuuauauuggugacauggaaggagugucaaagucuuuuuuuuuuaaguccccgggcaucugauaguacccguauggcaauggcauuuucaaauaauuugggcuuccccauuauuucccauucugaaaagaaaauaguagauuguugguugguugggauuuggggagauaacauaugugugucaaggaaugggggaauaaagauggcaaaccuggcccaaaaaacaugauacauguguggucaugaacuuugucuuguuagugauaugccagucucaaucagguuauaauauguguuucuaauucuuauuacaccccuguguuauugaugugugcaucucuuagucauccuauuagaaauuagaauguucacuggcuauuauauauauguauguauauauguauguauguguauauauauauauauguauauguauguauguauguauuuauucaguuaaacauuauaucauuuuucccuuuccagucccucccauggacccccuuguuccuuuuugaaaucucggccucuuuuucucuguugcuguuaaacacacacacacacacacacacacacacacacgugggcagugguggcacaugccuuuaaucccggcacuugggaggcagaggcagagaggcagagagagagagagagaggcagaggcaggcggauuucugaguuggaggccagccuggucuacagagugaguuccagaacugccagagcuacacagagaaacccugucucaaaaaaaaaaaaaaaaaaaaaaaaaaaagaauaaauuuuuagaaugcaguuaggaauuagcugauuuaguaaagugguggcaacagguucuucucugacauccaugacaccucuagccuugggucguuggcuagguuuccaguaacagguaugauuucucuccugcugagcaagccuuaagugcaacuggagagcuagcuguugguuaccaccaauauaagagugccacuauugccccucacguugucacuccaugcugguuucauagccuuuguguuucauagccauuacagcuggaagaacuacccacgguuucucucccuugaaaguuuguauacagcaaaagcuggucuuccugcagaaggcuuccgggucaaacccagcugagguccucuagaucuugugucugaagugcauggugucuucagcaauagggacuuaaccuuuagugucuugaaggcaaccaagggcaauaguaauaccuguuauuauauuuuaaaguacuucaaugugagcuuuuucagaugauaauaagcaaguuuccuugauaaaauuuuugcuuauuuuugugauguuacagggaaauaaauaucuuaugucaagaccuuaaauguauaggaucugcaucacuugaagaaaugagauugagaacagacuauguuuuaagugcaagaagcuuccuuuauucacguaucuguuuauguauuuauuuauuuauguauguauguauuuuaaagagauagggccucucuuuguugcucagguugacccugaacgugcuucuaaagacucuucugcgucggccuccugaauagcugagacgauaagugcuuucuuggcuaacacauuucuugaauguugacgacucuaccuagacuuucuguuuuauaaauuaccugguuugaaagaaguaacagaaaagaucagaaaggcaaaacuuaguaauaauauugauuauaucaugcaaaguaugguuuaucaaaguuuucaguuauguugucauguaacccacacauuaucagcuccuuucccacguguuugcugugguugguauauguuauuuuaugaaagaauauuguaaauaucaccauucaaauaagaaagucauacuuugugaacuuuuuaauguucaaucuuuguuuuguuuuauaggcuguggggugaucauggacaagaagcuuuggaaucugcucauguuugcuuaauaaaugcaacggcuacaggaacugaaauucuuaaaaacuuggugcugccagguaaggugacaccugugauugcauucucggugacuucuuuagucucugauacagagguagaucuucuuaggcugacaggguggcuuaguggcugguuacuugcuguuaggccugacaaguugaauuuggucugugcagccuguauugguuggucucugaccuccucaugugugcauggcacaugugcgcucacauucaaacaguaaauauaagagcaagcaaacaaagaaaaaaaaaaaccuaaaacaugucugugacuauacuuugucucccuagguauuggaucauuuacaauuauugauggaaaucuggucagcggagaagaugcuggaaacaaguaugucugucuuugaaaauauaagccugguagagaaggcagagcacucaggaugaggccugagcaguuuuaaccuugugacuggguguuagauaauggugaagaagugacuaaagucgaagugcuaagacagggucuggcaagccggccgauagcagaugggcucauguuacucagggucuggcaagccggccgauagcagauggggcucacugucacccagggucugucacugucuuuacugcugucagacaaaacaauagucauuuuucucuuaccugugaguucugagugcuuucuaaguccuggcguuaauuccuuaguguuagugaagaguaugauuggauugggggauuauaggaauaagaaaaugaauucaguuccaacgcuuggaaggcagaggccgcuuggaaggcagaggccgguggaucucauuaaauucaagaccagccgucagcuagagcuaaaaaaaugagaccuugucuuuaaaaaaaggaauaagggcuggagagaugucucagggguuaagagcacugacugcucuucugaagguacugaguucaaaucccagcaaccacauagcugcucacaaccacccguaaugagaucugaugcccucuucuggugugucugaagacagcuacaguguacuuacauaauaauaaagcuuugggccggagugagcagagguccugaguucaauuccuagcaaccacaagaugucucaaaccaucaucuauacagcuacaguguacucauauacauaaaauaaauaaauauaucuuuuaaagaaauuuuaaaaaaggaauaagaacaauaucuuucauuuauaucuucuuagucugauauauuucuuauugugcuauaaugcuaaauaaaaaugccccauaugaccuauguuuuguuuuuuacauauagucauacuuugauuuuucagaacauuuccaaauuugauuucguacuuacuguuuuaaagugguuagagucuaggaaucucucauuacauuuguccauaaacaagaaguaaauauuaauucaaggaaaaucaggauuuaguucauauuuccuuugauauguuuucuuuggagcauaguauauuuaugcuaucuacagcauaacucuuuuauugguaucuauaaaauaauaaaaguucuauuauuguugcuuaccuugcugacucugcaggaugguuuaagaauaauacaaucauuacuuuguacuaacacuaaggaguuuuuuuuucuuacggaaccaugugcuuuugccacaaaauugugcccuggcucucaucagcagccacaguaugggccuuugggacgugaccagaguaugugugggaggaagucugaaugaaucuuuuauaauuucuugcaaaagcaaaucguucacuacagcauuucccaggugucugcagaacauugguuauaggaaauguuaauagccauuaaauggaacaguggauuucauggucaaacgaguuuggggaaugggucaaagagguuucuguaaaccucuuuacuauaaagcguucuuuugagguacauuaggacuuuccagggaggagauaggccaugugguguuuucucguucuugggacucuuuucucucagcgcaugcugugaaguggugccauagaggacgcugauuuacccaccccuuccuucaaggagacuuaacaucagcuguggacauaguguuuguggggauagcucagugguagagugcaguaaaacacacauuuguuuucccuuuugaaugcaaggugcacacuauuauaaauguuaaacaacuuuugcuuuauagccauauaaaucuuggcuuuuuucuauccccuucagcuuuuuccuucaaaaaagcaguauuggcaagguaagcaguccgugacugaguaugguggugugugagcaucuaauagugccacuauaccuuggccgcuaaaaaaguuuugacuuucaaagaucuuauucucugagggaaaaguggguuuagcucacuuucuaaucugguaacucucuugguaguuuaagaacuuagaguacugcgacuuuacacuguccuuuauuagagacucgagugacauugauguucaguggauagaguacugugguagaaauuaguaaguggaguuaaccagaaaguuuuuuuuuuuuuaauacaucaaaugaaaaccuuaguuuuuaaacuacacacgcacaugcacacacgcacacgcacacacacacagacacuuuuguauuucaaaugaaagcuguguuacauucugaauggaguugagcuugcuuuagugauuggccacucuuguguagguagacagggucugaacgggauucagcacagcccugcuugcugccugguuuucucuuucgucugaucagaaaagucaagggcaaauaacguggucauuuaacaacucuauaagugauagcuuaguucaaccugaguaacguucuacuuggaccucaguuaaaucaugagaaggagaauugucacauccaugcauggaauuuggaaaguuucacauugaguuuuucuuaaucuguaaguguggggaucacauuguagccaagcacuuucuaaaucaaaucaaaugcuuugucuuugaaaagaaccgagcucaagcugccauggaauucuuacaagaacuaaauagcgaugucucuggaaguuuuguggaagagguauaauacauauauauauacauuauuauuuuuuugcuacaguguguuuuaaaaaauuauucaaaacccuaaaacuuagaauucugaauuuuugugucauuuauauuuaguuggaauuuaauuugucaacuaauuuauauuaaaauagcuuauguguuucugccauguuuaauaugugaaacuguugaauuuuuuccuccccuugucuuauuuagaguccagaaaaccuucuagacaaugauccuucauuuuucuguagguuuacuauugugguugcaacucagcuucuugaaagguaaauuuucgauguuaauauuuuucauggucuugcuugguuuacauaguuuucuauguacaucuuucuguauacauauuuugucuuguuucuaaaauucuuaaagaagcuuuucauuugaaacucuuguauggggaauaaaaaguuagauauuuggauauguuuagaguaacuuaagugaacauuagcuauugcuaagugaugaaagauuaauuagaagccagguaugguaguauucacugcagucuaauccaucacccaggagccagagagagaggaucaggaguuggaggcuagccuggccuacacaauaaguuucaggauaucgaggcuagccuggccuacacaaugaguuucaggacagcuugagcugcguagugagcuccaguguuucugaaacaccaaaaccaagaaaaguaaaauaaagcaguuccgugguuacaggaggauuuguaggugucuauggguuuuggaaauguuccacuaugaugaaaauguuuagauaguguguucaucagcauucuuccuaguacuacagacugggguuucucaucccucgagugcagcacuugugagguuguugccccaugaaaucacuugcuuuccacuguguucuugccuguuuauguuagacaguucccgugucuggcauauacuugcuggcuuauguucuuacuuugccuucuuuuucaguacauugcugcguuuagcagauguucucuggaauucccagaucccucuuuugaucuguaggacauauggacuaguugguuauaugaggauuauuauaaaagaacacccagguaaaauuguuaagcauaugggacuugcuaaugguuacuugagcaguaauuuuagaaacuugcuaauuuaggaagucacaauuuuuaaauuguuuugaauuaugaaauaaauuucuagcaguacagguucaaaaaggcaauaagauucaauaguuuuuuuaugugcuuacuuauuuauauguguauugauguuuugccugcauguaugacuguguaccaaguguauaugagugccuacagaguccaaaagaggaccucuuaucacccagaacugggcuuacagaugguugugaaccaccaugucagugcugggacuugaaccuggauucucuggaagaguaaccacugcucuuaaccauuaagccaucucuagccugauucaaaggguuuugacuauuuccuuacauagcuuuauaaauggaugcaggccagagacauaacauacaccuuguuugucuugcuaagagacccaggagcuauguaaauaccugguuucuuuugcuccccaacccaaaauaggacaucuaugguugccacaggagugugugggccacuuugacacaaacacuacaucagugguucucagccuucccuuuaauacaauuccucauguugugaugaccccuagccauaaaauuauuuuguugcuacuucauaguugcauagcuguaauuauagcacagcauacauaguaacauacagaauaaaaguaauaauuuugccucuccauuacaccaccauuucccaccugucuuuauuuucagucuuauauuggccuuagauuucuccauuccacguccaguuacauaugauaagccuuuuuccgagcuacuauuccuaaggaaacaguguuaaaggaaaccagugauucauaggcaggccuacagcagcccagagcugauaucagcuuguacuauagaaucuuaaucuuagaauuuuauaaaauuuuccuuuaguauucaguaaaaaugcuucuacuaaauaaaguguuuucauucuaagccagcuauuauaugaaccaggcacucuguugguguaacaguggcuauuaacacugaagccucacaaggcuuagugucaugugggcaguuaggauacacuuuugguagaugacgucaggccauuuaagaguuaaaagugggaagcaaugggauaacauuuguguuuuaaguugaucgcucuaauguuagaguaugaguagagaaugaguggacuuaaaggagccaaguuugcaggggugcgaugggagugagguaaagaagggaggagggagagggugagagccuccaacuuaggggagaugcucaggagugggugaugaugaaggucagcacuguuagcugugugucugcucugauguaaaugacuuauuuacucuuuacagaaccuuauuaagcagauacuauuaucucugcacagaaauauaauuguuacuugucuaaagugacauagcaaguggcagacuuauaaccucauuacaaauacuaauugaaguugugcauuguuuuguaucccucauguggaaagcaguguccaaagucagaucaggaagugggaguaacugacauugaguaaaagaagcagucgaggcuagagugagacccugucucaagaaaaaaaaguauagguuuccagccuggugcguugggucaugccuguaacgacaacaaccaggaugaugagacagaaggauugccaugaguucaaggcuagccugggcuauagaguaagacuccauuuccaaccauccaauuacacaaaauugugugugugugugugugugucuuacguuccuauaaugaaguaaagaauuaucuuuugggauugcuugacaguaauagaaucucauccagauaaugcauuggaggaucuacgacuagauaagccauuuccugaacugagagaacaucuucagucuuaugacuuggaccauauggaaaaaaagguuagugugugugugugugugugugugugugugugugugugugugugugugugugugugugugugugucuaugugugugugugugugugugugucugugugugugugucugugugugugugugugugugugucuauguguguguguguaugucuaugucucucuguguguguguguguguguguauguguguguaugucuaugucugugugucuguguguguguguguguaugucuaugucuguguguguaugucuaugucuguguguguguguguguguguguguguguguguguguguauuuuuacagaaaccuaugcaugcaccuguggaggccagaggucaaccucagguucucuuaguugcuuucuacuuuguauuuugagacagugucucaucagucuagagcuagccauucaucuaugauuggccaaugagauccaggaucugccugccuugaccuuaugcacugagguuccagcuuauagccaugucuggcacacauuuuacucacagagcuacuccacagccacucagaaaccauuucuaaaaccaguuuuauuaaaccaguucauuugccuguuuauuacuucauguggauuagaagauaauuauaaauauugaaaauaagaugguaugugaagaguuaauauuaacuaauacugcuauuuucuucaauuuguguuucuauuuuaggaccauagccauacuccauggauugugaucauagcuaaauauuuagcacagugguauaaugaaguauguacuuuuuguuuuuuaauuaaauuacuauuauuuccaagaugugauaagggauuucuuuagaggguuaugggagguuaauguuuucccuugugaggauguaaugcaagugggagcuuuucaguugaagucuagcuaucacucuuucaguacugauauuuuaauuaacaaauaggaauuuuaguaaauuucacccagaaugaauguaaagaaauggucuacaauuacacuuuccaaauuaagcaagccucuguuucagugauuuuauaauggggaaaccaugggacacccaauuuccauauuuugaguuuugauaacuagaucuuuaaauauuuuaaucaauuuagacaaauggacggauuccuaaaaguuauaaagaaaaagaggacuucagagauuugauaagacaagguaauuuucugcauuguaauuaaguauuauauaaagcauauaagguauuaaauauugaaaaagaauugcuugaaaccaauauuuauugucagaugaugcugucaugaguuccuauuuuacuuucccuggggguaaagguaucauuucuuaaagaguuuaagaagcacuugagaggcauacccaggugaguucgaggccagccuggucugcagagugaguucuaggacagccaggguuacacagagaaacccugucucaaaaauaaaaaaaauuaaaaaaaaaaagaguuuaggaagaacaaauggcuguguuuccuguaaggguuagcacugugguccucuguucagcuccugauaagauuuuucuauaauguuggaagccaaagugaaaggagacauuguuagcuauuucuuguuuuaauagggauuuuaaagaaugaaaauggagcuccagaagacgaagagaauuuugaagaagccaucaaaaaugugaacacagcacuaaauacaacucagguaucaaagaaacugcugaaaccacuguguuuucugauguuuucauaugugaaaguugauauaacaauuuaaccuaauauugccuaaaugccuaaacaaagaauguuuggguucuuuuguuuuguuuuuuauuaagacaaggucuuuuuauguagcccaggcuacuuucaaauuugcuguauagaccaggcugguuuugaacuugugacacuuuuccugccuccaccucucaaguguuacaaguaugugccaugcccagcggaaaacagcaguuuaguuuuaauaaaguuuuguuuuuuuuuguuuuuuuuuguuuuugguuuuucgagacaggguuucucugucuagcucuggcuguccuggaacucacuuuguagaccaggauggccuugaacucagaaauccuccugccucugccucccgagugcugggauuaaaggcgugcgccaccacgcccggcuuuaauaaaguuuugugcccugcaugguggugaaugccuguaccuccaccccugggggaggggagcaaggugaugaguagccauccuuggccacauagcaagugcagaaacagcuggggcucaaaacaaaaaaaaaaucuauauuauccucauuaaaauuaugucugugcuucagcauauaauagcaauaaaauaaaguaauuucuuucacuuagagaaauaugauuuaugaauaguugagaauuuggagguaagacuuacaaaugauaguuugcuagucaaaagaaguacuaaacucaaaaguuaaauuuuguuaucuugcauuuuuuugcagcaguuauuuagacauaauuggagauguucucaaugacuuguacauugcaaaaauuauaagcugauaugguaacuuacaccuguaauccuggcacuuuggaggcugaggcagguggauucugaaucugaggccugaagccagccugggcuacagagugagguuaagcccaacuuagaauacauaaaaaguaucggaaaauaagucagacuacuacuacuacuguugcugcuguugcugcugcugcugcuucuuuuucuuccuccuccuccuccuucucuuccuccuccuccuccugcuccuccuccugcuccuccuccuccuccuccuccuccugcuccuccugcuccuccugcuccuccuccuccugcuccuccuccuccuccuucuccuccugcuccuccugcuccuccuccuccuccuccuccuccuccuccuccuccucuucuucuucuucuucuucuucuucuucuucuaaguuuguucguucauuuuugaggaacuguggaauaagacaccuggaagauuuuuuauaguuuuuuuuuuucuuuuuuuuacaauuuauagcuugaguacugccuuucacauuaggaaagcacucaagucacuguagacauuuugaagacccugaaaugguuccugaguguaugccuuguaaaucauucuagcuaaggaacaucuuuuaucuuaauuggaaagaauguugaaaauguauauguauagcuaucaaaugauacauguuagaucugcauuuuuacugaaaauaaaauguaaugaucaguuuuuaaaacuaaaggaugauuauaaagccaggcauggcggcauguacuuguaaugccagaaccaaggagauggaggaagaggcuugagaccacauuggcugcauagugaguucuaguccagucugggcacaagaaaaauaaaacagaaaaaugguucuaggaguugggggcaguaaauugaacaauuggauauuaauguaugaacaaaguuagaaugugaggaggcaagaaggggucuggguauuggauaggguguaccuagggggcaguguuagagagggagcugggaaggaggaaaaggccugagugaagugccacccagaggucuguugcaugagcugcucaagcagagggcacgggcgcagggcacagaguuaaaggaucaguaggaaagucaguacgauugaaggggaaagaaagugauaggcaagauuugaguuuggagagcuagaaagggccauaccauagcagaaucucgcagaccuagaaggguuuugagcagggaaguaggaaggucuguuugauguugagacaggaucucacuguauauagugcuagcuggccuggaacucauuaguagaccagguggccuggagcucacacagauucaccugccucugccuucuagugcugagauuaaagaugugugccacuacagugggccauucaaaagacuguugacucuuaugaauacaguagaggugugggguuggaagccaagacaccagucacgagguugucacugagaacucuauuuugucugcauagaaucaaagccuauaguuuguaaaguuauuaguguggugaccuugugaguuucaaauugcauaauuacuuauuuuuuguuagaguggucaucucugaacagcccuggaauuagggugaaugaauuucaggacuuucauaagcugggaaaccaugaacagcuuuaaaucuggcuuuguagcaaugucaguagucauuguugucuucagauacaaaguauauagaaugacauguuuggcuuuuccuuuacuccauguggauaugggagacuugucugaaaugcuaacaggccaggagaggauuuucuuccauucucuuucccaucagaucuccaucagaaucugauuguaaauaaaacuaaauacaucagaaguugauauuuuacugcacuuugaaaauauaaaggacuuauuugaagaaauagcauugaaaauaaagguggacagcauucuuaauguaaguaaugucuuguguuccuuuguuagaucccaagcaguauugaagauauauuuaaugaugaucgaugcauaaauaucaccaaacagguaacaacaagaagggaaaauaaagcugucuucaacuccagcucagaauacacaccuuuauaguaguuuuuucuuauuuuuuuagacaccaacuuuuuggauucuagcucgugccuuaaaggaauuuguggccaaggagggucaaggaaauuuaccuguccgaggcacaauuccugauaugauugcagauucaaacaaauacauaaaacugcagaauguguaagugucuuuuaguugugguuauuuuguuuguuuuucaaaacaggguuuuuguguguagccuuggcuguccuaaaauuagcuuuguagacaaggcuagccuugaauucagugggguuaaaggaaugugccaccaugccuuaucacuguuuuuaaacuauguguaacaggcuacuuaaaucugcccuccuaaagggacucagacccugguuucugacagaggaccuaaaaaaaauguuacaugaacaacucaccuucuugaaguuaaguccaaggaaaaccacacacuucaaaccuacccaauaguauaagucaugaaaaacuuuguuuaauaucuaguuauauuugacuguaaaaaugacuaguauuaaugcugagucucucccagguaagggcacaccuuuuagggugaagguuguacuauugggauugaaccuggguccucauauauaugugaagcaagaguucuaccucugagcaaugucccuaaagucaccauuaguuucugucuucaguuguccuuugccaaauuuucaguauuauaacucauagauuaggacaacaaaccaagauuuguuaaacacugaccaagaucuucucuguauggcaaccuuuggcccuggaggaaaccaggucagguuccuugcauucaucagcucuguacauuaguuacaaagaagguaacauccagggagaccugaccuuacggguccaugugugucagaggagguauacuggauaacagguguuuaucuacagucauugauuccuuaaguuacgagagauuaaugaccaaaagaaaaugacucaaaagaaagacucccacgagugucaccuggguacauugaaguuggaugcuguagggaugacaggugucaccuggguacauugaaguuggaugcuguagggauggcaggugucaccuggguacauugaaguuggaugcuguagggaugacaggugucaccuggguacauugaaguuggaugcuguagggaugacaggugucaccuggguacauugaaguuggaugcuguagggauggauaaugggagcuuuggcuuuagaggacuccagaagaggacucuacugccagcucuuccaugacaccuaacuggugagaggugcuacuggugauaauucucuaccauuuucacauuucauauguuuccaaacauuuuuaaauuaaaaauaaacuuuuguucacuuaaagaugacuuuagcuuugcuaauuuuaggagucauuaauuguaggguuuuguuguugucaaucuuuuccaguuaccgagagaaagcaaagaaagaugcugcugcuguaggcaaucacguugccaaauugcuucagucuguuggccagguaaguggugaacaguacuucuccccgcagcaaggagcucagccagggagggguuagagagggaaggcggggcccuggcuugcuucuuuggcagaagugccuacuugucucuaaugagcaccccuguuacaggagaacaguuguguuuggaguguuuucccagcucuuggcuuugugcugugccauugcugucucugugugugugcgugcuagagaaaaaccugcauuuauuucuuuauaggcaccagaguccauuucagagaaagaauuaaaauugcuuuguaaguccuuuuaauuuucuuauuuugcuuaauaaaaguaugcuacagaggguguucuugggaguuuuaaaugguugaaauucuugaaguaggguguguguauccuuagguaaauuuuauuuuguuuuuuuguacucuaaaggacauuuuaagacugggccauugguacucauuugaucuguguuaagugacuaauggaauuaagaauuugucaugauaguucauggcugggcuucugggguuuucucccuaauuucugaggcgguaaaagcguguucuuggagucaguugcagguugaagauagcucagcggguuaagugcuugccaugcaaacagauccugucucaaaaagauagguggaaaacaaauaaaaacaaaaagaaaaagaauacaguggcgauucauagaagacacucagaaucaaucucuggucaccacauauucaccacauauucacggguggcuaagcauauccaugcauauaucacacacagaaguaaaaguuucauaaaguuaguugccggguuagaaagauggccuaucaguuaaucggaggaaccccaaagaacagguacauggacacacacauuuguuuuaagccuuccucacacaccaaacugagacuauaaccaaggcagcaauuucuucauaccauuaauauucggugucuaacaaaacccccacaguacuguggucacucaauaaaauuuuuaaugaauaaaugcuucaaaauguuuauuguuuuuaaauuguuuguuuguuuuggguuuuucaagacaggguuucucuguauagcccugacuguccuggaacucacucuguagaccaggcuggccucgaacucagaaaucugccugccucugccucccaagugcugggauuaaaggcgugcgccaccacacccagcuauguguaugugccuaucuguguguggauaugugcaccugcagaggucaaagaugucagauccccuuggagcuagaguuauaaguagucaugaggccugcugugggcagguggguacugggaacugaacucaguuccucuccauuaacagcaagcucuccuagcugcugauccaucuuguagcccuaauuucuuguucauaaagugacccauaauuugguguauucaguugucacaaccuuccugaagucuuuacuguuuccaggcagcaauucugcauuucuucgagugguaagaugucgaucuuuagcugaagaguauggcuuggauacagucaacaaagaugaaauuaguaaguauaacaaccagaugcuaaguuaaaagauacuaauaaaauguguauaauagugcugaauaaauggugcuauaaaaauaaugugaauauuucauagauuaccugaaugauuuuaauuuacauauauuauucagaaauaaauacauaaaaauguguuuagauuacugacugcauugugugcuauauagaacuaacauuaucauguuucuaccuugguagagacuccagcuaggagucuauaagaccccuuguguuacaccuuaauguauuuauuucuuauuuauaauuuuauacuuuauuuuaauaaaauauuuaauauuuuuugcuaauauuauuuuguauccugaaacuugaguaugaauucagccuuuuguugcuuguguauguuaucuaguuuuacugauuuuuuuuuuuuccuuucaguuucuagcauggacaauccggauaaugagauaguccuguaccugauguugcgggcuguugaucgauuucauaaacagcauggcagauacccagguaagaacagcaguugauuuaccagauacaaagaagaucuuuuggcuuuuuuguuguuuuaagacaggaucuuacuuauuagcuugggcuggccuugaauuugugaucuuccucaaucagucuccaaaguauugaauuuacaggcaugagccaucagauucacucauuaaagucuuaaauaaaugcuugacuugaugccagguguaguggcacuugcuuuuaaucccagcacuagaggcagagcugggccaagucuacagagugaguuccaggacagccagggcuauguagagagaauaugucucaaaaaagaccaaccaaccacacaggaaaacccacuugaccugaauuuuaguauucuguggauauuagaggaacuauuauuugauuuuuuuuuaaaaaagauuguuuguguauuuuauauacauauuuuuauauacauacauacauacauacauacauacauacauacauacacacacacacacacacacacacaugccagaggagggacucugauccuauuacauggucgugagccaccaugugguugcuaggaauuaaacucaggaccucuggaagaguagccagugcucuuaaccucugagccaucucuccagcccagugcucuauuguuuuuuaaggcucacuacuuuuaaaccauuugauucuaaacuguuagagaagaauguugguugaauguguaucacuaacauguccuuguauguuuuuucuuuuuucaauuuugaagauuuauuuauuuuauguaugugaguacacuguagcugucuucagacacaccagaagaggacaucagaucccauuacagaugguugugagccaccacgugguugcugggaauugaacucaggaccuuuggaagagcagucagugcucuuaauugcugaacugacucuccaguccuaucucuugugucuuauuuuuauauuugucuuuuuaaaauucauuguguguguguguguguguguguaggucucaaaaacuuagugguuuaaaacagguuaaagugugugugcaugaguguauacaugugugcauguauguguggggaccagagguuaauauuaaaugucuucuucaguugcuguucacauuaucuuuugaggaaagguuuuucaaugaacugagggcucacagauuuggcuagccuggcuggccaagcaggguccuccugucuuuggguuuccccugauaagauagauguauaccauuaugcucagguuugaaugcggguucucggggauugaagugggcuccucaggcuuguacagcacaguuuacccacugacccaucuguuggccuuuaauccucucugcugguuucuuguuggagcugaagcaguuccuuuuuuaagagggagguucuuagucguauggugccuaggcuugagauucugaagguuugacugaguuaaauaucgaagagacaucuucacucuccuuacugagaugcuugacaccuggguaugguggcucacagcuauggggcggacggacauucaggaggcugagguagaaagauugcugugaaucugaggucagcugggcugcagaaugagacuuugucccaaacaacaaagaagagagaaagaaaugacguaggacuggcuuaguggcccuagcacuccuaaggcccuggauuagauuuccugcaugagaaaacaacaacaaaaugcuugucuuguauucuaguuuugcuguucaugaacuaaguaauuugucugugucccagcuuuucuaucuguauaguuguggcuccuucauaaaguucuuuugagaauuaaaucagugcaaaggcacaaaguacauaaaauaguauccagcaucuauuaauguuuaguaaauguuguauauuacgauugcuuuauguccucagugccauuuaaucacucaaaauggaaauaaagggcuggaaauggaaauaaguagcuuaguuuguuguugagugaacaaagcccuagguuuagagaucuucagcacugaaaaaagcauacgccuguuaucucacccaggagguagagucaggagaauuagaaguucagggucaccccugacuacauacaaguuugagacuagcagggauuaauaauaagacuuuguuuccaaaaaaauagaaauuuaacuuaaaggauauaaguaagguauuuucucuuuaauuuuuugaucaaauaauuauugaguauuuuuuguguuaaucuucuacaacauaauuagcuaagacuuaaaagaccagaaacccaccagaauguugggauaauaugcugucacuaaguuaaaaucccuagaccugaguaagacuuacugaacuucaauuugugauagauuuuaguuuagcagauucugauauuuucaaauguugguuuauguuuguucuguaguuuuauaccuuacuguuuuaaacuggauuaaguaagagauaacgaucaguuugaauuacuuuuuccccugagaccuggcgccuaugcagcccuggcagucuuagcacucacuacguaauacagagcauucacaaacacagagaucugccugccuuugccuccugaguuaaaggugugcacuauugugcccagcccacauauuuauuuuaauggaaauguauauauuauauauauauauauauauauauauacacacacacacacuuuuuuuuaggaguaucuaacuaucaaguugaagaagauauagggaaguugaaguccugucuuacuggcuuccuucaggaauaugggcugucuguaauggugaaagacgauuauguccaugaauugugaguauucuuuagagcauauaaagauaauacucacugggagagacugugaugagacuaauaaaacuguaaacccccauccuuucuguaguugccgguacggagcugcugagccacacaccauugcugcguuccugggaggugaguuuuguagaugaaaugacuuauuuguuaucauacaguuacuauuuguuguaauuaguguaauuagugcuuugcccuccacacugcucuccuugcccgccagcucccgugccaucagagcgagcgacucuggagucuuuaguccuucugaagaccuucuuccgaucaugagccucacuuagcucucuggguacaaggacacauaggccuuccuccucuuccuccccuuccuccucccccucgaauccuccugccccaucaguucuaggaaacaaaggcuaacuugacuaaaaggcccuacgucccuucuuuuccugagacaugcccuaggucuuugcaccucagggcccagugaaaaccugccauuucuuucauaaaacucccuuuaucacuuugcucuaguuuaguuagacacuguaacuguaccauagauuggaccuuauaaacaucagaaauguauuucuuacggguuucaaagauucagaugccagcauagugagaggcuguagagaucucacugccugucucauucauggugguuuucucacuuugcucucacauauaaaaagaaaccugcaggaucuccuuuauaagggcaugaaucuauuugugcagguucuaaucacuucccagaagccccaccuaauaccauugcacggaguguccacauguuaaugacagggagaaggaguacaaacaugaagcaaauaauaccuuuuuaaaaaugacucuccugccuauugccucccauagccugagcugugugcuuaugaucgauuccuuucuagacguugaaggcagauccaguuugaggaguagucuguucagaaugcugcuagugauggaguccuaagaaaacuguacuuuaagcaaacacaaauuaaagccugauucuggauaauuuauguaaauaaaaucauucuuucaugucuaaauaguaaauucauaggaaagggcaaauuauuacuuauuuacauaggccagauucuaagagacacaaucagagaggccuaacgaguguagguaggucuuuaguuuuauguguuuuguuaugauuaugaacguaauucucugaggcuuccccuauauaaacaugagccauuccucuguacuaguccuucuuuucuucuuuaucauagcacaaagucuucuacauacuauaugcuguauuuauuuguaagcuauccuuucucuugcuguuaaacagaaagacccaagguagcaagcagcagaucuuuuuguuucuugcaccucugcuacaucuauggugccugagagauuuggugauaguacagguuuaaguccacagccucaguauguagaaagaagcugccucaguuuagaaaagauucuuuuuuucuugguggaauuucacugucucuuuguguuucaaguaccuuacaggagcucuguaguauucaguguggguuugacccugaauaauaauaauuauuaucuuuuauuuuguuaugacucaaaauauguuuguuugggauuuuaaacagcuuggcuuuauguuuuuuguuuguuuugucuuuuguacucaucuguaucugugguguauucuauauagcauagaucucauauacaccaggcugaccuccaauuccauuuguaacucagacuggccaugagcucauaaucaucuugccucuacauccccagucugaugaauagagucauccguuaccaccacacccaacucuuuuuuuuuuuuuuuuugagacaagugucuucacuguauauccuuggccagccuagaacacacuauguugagcaggcuggcuuugaacucacagagauccaccagucuuugucuccuuaguacugggauuaaaagcaugcaccgucaggcccagucugguauauauuacuuaacucuuaaaauuuauucuuuucaaacauuuacuucucuccuuuuuccaacaggagcugcugcucaagaaguuaucaaaauaaucaccaaacaauucguaauuuuuaauaauacuuauauuuauagugguaugucacaaacuucugcaacuuuccaguuguagaauaagcaccauguguaauauguuaaugguuggaacuguaauugucuucauauugugcuuugguuuguaaaaaucuguuaaaggacggaaguuaaauuguuuccuuaauaaaaguuuuucucauuuguaauaua

SEQ ID NO: 4700 - RNA, 7578 nt, Mus musculus
ggugcugguuccucgacugggggccucuccagggaaguaaaacccagucgcagcaaccgcggaacugugcucaggaccagagugagccgagaggauccgccgagugccagcggcgccagcuggggaggagaggacgaggauacgagguaaggaaggggacgauucggggugcggacgccuucccuagccuaguuuacggguaccucaggugauggggcggagagggggaugaggugagagggcgggacgagcuggccccuggucauggucaccccacucgcgcgcacgcgccacgugggcccgcgcacugguggaggagacgacugcuuagccgguucucugcaccagcuuccuuaguacuggagcaccggugagcuggacgucgcaacuggauucuuacaccuuggaaagccaaggcucagccacuaaacgggggcugggauuucuuagagccuugcgguccagccaagaaaucaagagacuugguuucuuuaggggugcuaaauucuuucugucccauuggaggcgaaugguuuucauugcgcacagcugccuguccuuucugcagggucaaggggcgucugaggccaucugccccuguccgaccucaucugucccaaguucagcgggauggguauuggcuuugggaaaucgguuugacagugcguuuauacccuuugaccuacugguuuuggaaauaaguaagggaaaggugacugcaaaugccauguaauuugguaccagguuaguggaaacaagcuccaagucaccaguaguugugaauguuuaugccaaaaaccauaaauaguacuaucacugaaaacauugccuuuaauaggaaaucauguucacaguaguuggcccaaugauauaaaaaucuguacagaauguaucccaaggacaaaaauaguggcucccuccuuuuguugauuuuugagacaguuucucuguguaccuggucucaaauucugccugccuuuuccuucuaagugcugggauuaaaggcgugcacccacacucccaguuucaaccccccccccccauucccaugggcuuacuuugucaagcaaaguaacagucugcaauguagaucaggcuggcuuugaacucacagaucagcuugccucuucaccuuugcuuccggaauucuggaauuaaaggcgugauagcacugugacggcucagaagugucguauuuuauuaagucuuuacagaacguugugaaaucuugacauggugcacacacuuuuaaucucaugagguauugagaacgucagagcaggcagaucucugauuuugaggacagcuugaccuacacagugaauuucaugcuggccagggugacaaaguaagaccuugucucaaaacaaaacaacaaugaccaauacaaauuacacaggaauucugugagaccagcaacugauggcuaauucuagcuacccuggaaucugaggcaggaggaucuaaaguucaaggcuaagugugaaagagggcuggggauguagcucagugguagaucaaauagaagagaccuuguguucaguccccagugaugaauaaaacaacaauaauaaaacaaaaccuaaccacguauugccggugagacacaguaugcuaaguagcuagagucaguggggcuucaaaaacaccauaucgagauaauauugaugauauuuauauauaauauauuaauguaauauauauaauguauaccagguacaggccuggacucaggacagccgcuagucagcagcuacaugacuggaauucaugggguagguagauuccuugggggaacagauacaaaagggaaaacuuaaauacugcaagggagacugaacaaaggacguagauaguaggcucuggccugaggaacgguuuagaaaggaaaaggaggcacaaguuggcuggcaggaaggccggaagcucucuauaaaaucagagagcgcauuagcaaaagugauguucuagcaguuuaguauuuuuaauaacuugaacuuugaagcuuuuauaaacucuugaaauuucaggcugaaaaaacacuccaccuccaccugccacuuguuucagaaugucaaguacuguguccuacuggaucuucaauucugcaaggaaucguauugcucuuuuacgaggugggagacgccuauacucaagggcugccacgaguaggaaccugcugaaguggaggcccuuuucuccggcauuggcaucaucagcccucaagugugguucuccaccugguggcuuugcccugcggaaagccuacagacacacaucaaccgaggaagaggauuuccaccuacagcucagccccgaacaggucagugaccugcuccgagcuggcgagucaucccacaagguccuugauuucaacaacggaguaccaaauucaguguuaagguucgagagcaaccagcuggcugccaauuccccuguggaggaccggcaagguguggcuaccugcguccaaacgaaugggaugauguucgguauuuuugauggacacgggggccacgcgugugcgcaagcggugagugagaggcuuuucuacuacauggcggugucccugaugucccaucagaccuuggagcagauggaggaagcaacggaaaacaugaagccuuugcugcccauccugcguuggcucaagcaccccggagauaguauuuauaaggacgucacguccgugcaucuggaccaccuccgugucuauuggcaggagcuccuugaccugcauauggaaauggggcugagcauugaagaagcauugauguacuccuuccagagacuggauucugacaucucgcuagaaauccaggcuccucuggaagaugagguaacgagaaacuuaucccuccagguugcuuucucuggggcaacagccugcauggcccacgucaauggaguucaccugcauguagcaaaugcuggugacugccgggcuauccucgguguccaggaagaaaacggugccuggucauguuuaccucuuaccugugaccacaacgccuggaaugaggcugagcugucccggcuuaagagggaacaccccgaguccgaggacaggacacucaucauagacgacaggcuucuggguguccucaugcccugcagggccuucggggauguccagcuaaaguggagcaaagagcugcagcggaauguccucgcaaggggcuuugauacggaggcccucaacaucuaccaguuuaccccgccccacuacuacacuccacccuaccugacugccaaaccugagguuaccuaccacaggcuaaggcgccaggauaaguuccuggugcuggccucagauggccugugggacaugcuggggaaugaggacguggugaggcuggugguggggcaccuguccaaggugggucgccauaagccggaccuggaccaaagaccagccaaccuaggccucaugcagagccugcugcugcagaggaaagccaguggacuccaugcggcugaccagaacacagccacgcaucugaucagacacgccaucgggagcaacgaguacggggagauggagccggagcggcuggcugccaugcugacacugccagaggauguggccaggauguaccgggaugauaucacugucauggugguguuuuuuaacucugauucaauugauaccuacuguaaagaggguuaagagucucccucuggugccaaggcuaacaggaaugcccuuuagacacuucacuccuuagugagcaauccaaaccuuaguaaagaauaggcagacauagguugcugaguaauuaacaaaggaagagagggaaaaccagccuuagugguggugauggugggggagacgacuacgaagacaacgaugaugacaggacaaagacauuaggagugauuuuuuuuuuuuuuuuuuuuuuuuuuuuguccugugugugcuggucagcucuucuguguagcaggcagaauaaagacuaaaauuggcuuaggcucacguagcccauguccuuuauaagacuguuaaauugugucaucccgugcuuuuaaaggauaaauuuaaucaugagucuaagaauaaagaacuucaggaucuccugagacccaguugcagauuuuacagaugcgauuauucagaacucuguuaugcccaaagucuaggcgcuagugucuuguuuuuuguuguuguuguuguuguuuuuuaguuagggaagccuagguuuacaaagcaaucuucagaaucuucagggcacuuuucuauaugugugugugugugugugugugugugugugugugugugugugugugucggaaaugaccuugacaacauuuuguacuguuugcguuuuuuaacgcugguuaaguuuauuuuaaaacugaacccuccagcucucaaggaggacugccagaagcacguuugggaccugggugaggaagagaggagcuaggcccugggccagcugaauuuaauugugcagcuauuguucgccuccguugagccucaccucugaaccuucgaggcauccguccugggaggugauuucugucuaaucccuaacuccugacacuuuugcugaguaagccguuccccccucccccaccucccccaggcuuagccacaggcuacucauaauuuuagguuccuuuugauuauagccccaacucuuguuuccccgugacacaacccuaccucugcuauucugucugccuagccucaucccgacguuacuggaaaaucuuccccguucuaucauccagagguuggaagaaagaaggugauaugguuggguggcaguugacgacauguaggcaggacuucuucagugguuuguggaguucagccuagaucuagagaagugaaaguaaggcuuucucucugcaucuuggaagggaggagggaggcuuaucagaugggccacgcgccccugccuguugaauugccgucacuccgccucggggaccauauuuagugugagagguaaaagcuaaaaaucaucuggccauagucuucaugggucacugguguuugaaaacgaauccgcacgaauccgguuuagaggauaaguuuucuccucugucagguggcuguggcauugaacuucaggaaaugugucccuaaacacaugugguucuuuuugggcaguuuuaauuuccugcccuugucagcacuucagccaucgucggcaaggcucuuguuuccacuguaucauccacacacuagguuuggcccccuuggcuuugcagguagacauuuuguugaguuuagauggggcuagcaaaaugacucaguggguaaaggcugccagucucaaaacccugaguuccauccaggggacccccgugaugaaaggcuugaguugaaaguugaccuccgaccuucaugugugcaccguggcaugugaacucacacaaaauaaauaagaaaaaaaaaaaaaaaaucagagccgggcaguguuggugcuugccuuuagugccagcauucgggaagcugaggcagguagaucucugaguucgagaccagccuggucuagagaguuccaggacagcugggacuacacagagaaacccugucuugacccccacccccaccaaaaacaaaaucaggauugcuuuuguauauuuccuaguguaucuguuuagugauuuuuuuuuuuaaacaaaaagacaagaaacagaacucuuggguccuuuuguucugaaccugaucucuuagauuuuuacucaaaaguaaaauguaggcagucccccugaggagcagccccucugcccccacacuuggguggguuuacucucuguggcuccuuucugagaggaccacgcuuaugcucucagguguggccuaccuucugagugccucuuuuucuuaaccuucaucuuuacgccuauccuacauaauaacccccaacucugccgccucaaaauaaaguagaaaaugaaaauuuugggugugguggcgcaggcuuuaauuguagcacuugcgugaccgagggaagaacaccagaaguucaaagagauacgugagacccuuguacaaaaaaauaguguguccccagcuaggcacuaaggcuacacagagagaccuugccucaggaaacaaaacaaaacaaaaaaacccauaaccccuaaacaugagucauuauuagucuagauuuauggcuuguuauuugaauggaagacacuauugaacauuuuuuuuucuuugcucuuugcuuucgguacuagcuaaagccaggaguauccuuggagccuuaacugguguucggugucugagcucuguuuuggaggcuggcacgggucauaaaagguucugaauccaguaacuaauccuggaguugauaggacacagaccucccuucugugucuccucacugucuaauagaugucccugcucuccagcugaaauauugagagagcagaaagggcaauuuauagucucucuuucucucucccucugaacucagccccucugugccugcuccagugcguguugucuucuggucccuugccagugucuugcuggcuacgggucuuggcagcggcucccuugaagcaagugagccuaagcuuugggccacugaaauuaggaaggagauccauggucccugucacuucuuccaaagcgcuucuccucccucucauaucgagauuccaguuauuagacuuuuacauuuuaaauaaugagacugaccguuuaguauugcagauguaauuuuugaaagaaguaugucuuggugcuuaaagugacgcuuaugauuugggguaagagacagauggcaaugauaucauuuagaucuuuguuuuauguguaaacagugccgugcuguugauuuccaaaguuaauaaagcuguaggaaagacuaguuuugaauguauauuagaucauguuaauaagauucagucuucugagauguuauuuguaacauuaaagcuaaguuauuguaauguuaacugagaugcuguaauauauggacguuuuccccagaaguacauuuggcuuaauaaaagcuaaaaagcuuuuuaggcacaaaacuugauugggacacaaucaaguugacaacuuuuaaacacagauggcuugaccuucagauaaagaaggguauaauuaugucgaacagcaacauucaaagggaggcugguucuguccuuuugaccgucaguuucuguucuuccuuggacagugguaaccucccagguuaaaccagaauauucuggaauggagccauugcagugccgagucuuugaagugcugcagcugcuguggaagcacccuguuaacugaggaucaaagcuaguggugcaguucaugcugcaaauggucauguguguagccuggugggggaggcacguuuaggcugcuguguaacuguuuccugagccgcugagguccccugcuuucuuccuuugguucccggugucuaacuugccuccuggaaaauauuucuuacuaagcauuuucuuggaacaaucauuaaccaugaucuuuaauaauuacuggcauuuguauuucaaacuguguaccggugucccuaucugacacugauuuucuaaacuuugaagauauuuaaguagaacuuuuaaauaaaagaugcaaaaugaaau

SEQ ID NO: 4701 - RNA, 3259 nt, Mus musculus
gagguuuaaauaggaggcccuagaacagcgacccagcgccagcugaggggcugagaaagcagcagaggagaaaaagacugcagucgugacagcgacaagggucugagucugaacaggggucuacgaguggguucuaucagaucccccaguggucugugucgcagcgcugaucaaguccugauaacaucugugugagaguuggugaguguccugacuaagcgggguggacaacaccaucuggggcugaauguggaugcagguccagcuggguuacugguuaagacguagagaccuccugguuggcaguagguuccuucauccugagcaucuuucuugacuccagaguccuaccugcucccgcgauagagcugccaucccaauucuucguuccccagacggcguccaacacgaugacccugaaugguggcagcggagcaagcgggagccguggugcgggccgggagcgcgaccgccgucgaggcagcaccccauggggcccggcacccccacugcaccgcaggagcaugccgguggacgagcgagaccuucaggcggcgcuagccccgggcucccuggcaacgacugccgcuggaacucggacacagggccagaggcuggacuggcccgaaggcuccuccgacucgcucaguucuggaggcagugggucagaggagggcguuuacaaggugcugcugcucggggcgccuggugugggcaaaagcgcucuggcgcgcaucuuuggugguauagaagacggaccugaagcagaagcagcaggugagagagcugagcuguuuagauaaagacaguuggggggcgguggagcuggacuaaaaguggcaaauacuaugaaauuucaaggcguuuucgaaauuauguuauuuccgcguccaagauggagaaacugaaggagacuuacucccuacucacuccacccccuccaccucucuccuacccacguaccagucguugauaggaaaaaaguguccagaauagaagaguagagugcuagauaugauuuuuuuccuguggcucguagcagcacuuuccugccuaccggggcuggcaggaacaaauucugaggacauuucugggagaggaaaguuagguggccaaagucuccaggguuugugacagccacuauacuaacuucacccaauaugaccacacccacccuugacccaggcagcaggaucccuagacacccaguacuucucuaguuuggggacaaagagauggaggucguguccuccagucccugacucccgggcuugucauauuguuugggcauagcaaccaucugcuaacagaggagaauuaucagaggacugggagaagcagcaggaggcguggucaggagaagaaggcagacacugggaacguugacagccgacugauaacuggcuucuuggcuuccuuucuagggcacacauaugaccguucuaucacuguggauggagaagaagcgucacuauuggucuaugacauuugggaacagguaggacgcaggccgggucacaggacacaagaggaagcaaagcuggagaagggucuugcugguaauuacaggguuguguguguguuuguguccccuccaggaugggggcugcuggcugccuggccacugcauggccaugggggaugcauacgucaucguguacuccaucacggacaagggcagcuuugagaaagccucagaacuccggguccagcugcggcgggcccggcagacagacgacgugcccaucauucucgugggcaacaagagugaccuggugcgcucucgugaggucucuguggaugguaagcaggcaucgggucaggaaagggagggagauccuggcugggcugugggccaguuggucuuggcucagcuugagucccuggggaucaucaguggcuaaaaauguucaggaagaaaacuugguguuggagggugggggagguguugcugguccaucaggcccccaaaggccuaccuaaaacaaaggagaagaaugaaccagaucugcuaggggaaaugagacacacaagcaccuccucagcugcucgcuggguccaugccugccugacaggagauaugagugaggcuuaagagauggaggaacauggagagaaucaggaagucagaauccgaucccaggcccuaccagucucagaguaaaccugcuccuuccucaucgggcuuugguuuagcaucaacuucuguggcaugcaguacuucaaacucagugaucuugccagacccccaguccacugggcuguuuguuauaguagcaagucauaaacuaccuaguugucaaacaguuuucauuugccuugguccacuauuacaggcuacauuuuaaaugcugggcuuuaaauacaugaauaccuuuuugugggccaccauaaacuuuggggucauauucugccuaucaagugaccccagcaauguuuaggguucucaguacaggaacuaggaucuccaugucucuaggaaggaccuaggguuccuucuucuguuauccuugaguuguagcugcuggauauggccaggguuugaguuugcauucucccauccuugacugacacaugucuguccccaccacauagagggccgggccugcgcaguggucuucgacugcaaguucaucgagacaucagcagcacugcaucacaauguccaggcacuauucgaggggguugugcgccagauacgccugcgcagggacagcaaagaagauaacgcccggcggcaagcuggcacucggcgacgggagagccuuggcaagaaggccaaacgcuuucugggccgcaucguggcucgcaacagccgcaagauggccuuccgcgccaaguccaaguccugccaugaccucucuguucucuaaggcccaauggcccccuugcuuaaugggccaguaaauggcuggagggacuggcccaggcaacuguucuagaugucucagaguugguucauccucuguguuucucagaacugucaacuaugcagcacacacccuugucucauggucauggacagaaagauagugcugaccagggaggcaacuccaaauggccagagaggccuaggcccauggagaugcauugugcaggcccacaugcauaccaagcagccugaacccagcuuguggacaggacucugccuuucucuaugcgggugucugugcccuggagggaggcuguucaauaugguugcuguuuguuuacaugcagauuuuuuuuuuguaauaaagacuauuuccugacaagccag

SEQ ID NO: 4702 - RNA, 4300 nt, Mus musculus
uuggucuaucucaaaugaucuuccaaccaccugguccuccauguucacaagugaaagagcugaaagauccuucccaaacuguaggccuccccauaugugaaccucagcuuggcaagccccaucugucugaggugaccaugguaucuguguucaggcauguucaagauaggcaggugcuuuugagucauucuucugguuuuccugguagcugggccagcgggaugagaaacaccaagcugcuggcaugaugucccuuugacauucuugacuccuugguggcuggccacuggcugucugcagcauaccaucugugaauacuggaccagcacccaaagaacuuucuggaaccacagcugugcuggaaaggcauaguagaguggggaaggaugaaguuucagaucccugagacaguccaccucauauauccagcucuauuucuggacugugaucccucaagccucgguugcuauaucuacacaaugggaauaacaagucccagcuagaugagauggccuuggggauuggaugacacauaugcacacacucggcugcauuuaucuucccccauuccugcccuugacuaaagggucugcuggcacauggguacucaggauagcucagugaaauaaauggauugagucacaacacagcagaggcccugaaggaagagggcugcagugugaggaggguuggggaugcugaaacccaacuguauucauuacuuuucucacugcuguuacaaaaugcaugagaagaagcaacuggagaagaaggguuugauuuggcuuacaguuugaggaauacaucaugguaaagaaggcauggcuucaggcacgugaggcagcaaagcaaaauggaugcugguucucagcuaacucuuuccuuguuaucuuagaccccaguccaugagugauucuacccgaauucaaaaugagucuucucuucaguuaaaccuuucgaccuacagacacggccggaagucucuaugacacgucuaaauacagucaaauuggcaauggagauuaacccucagacaugccagguucucuuuucaacauuuagucaccugagggaguggggacggucccacagagaggaggugggauuagguaauagaguuaucugcauuguaccuggguucucugaccuuccucaggacagaacaucauccugaagauacugaagcagaagcaagagagaguccacagauucacucagccugccccauccaaccaaggaugaugacaauuuacacgugccugcuaagagagcaacacauaccacucuuaggccaauggccuaaacaaauaacguuucauguuauuugugucucaggacuaaggaaacagggaaggauugagagaccccccccccccaagggcauagagacuucacaagaaaacuaacagagacaauuaaccuagaccuuugguagcucccagagacugagccaccaaccaaagagcauauaugggcuggaccuagcccccaguacauaugcaacagauaugcaacuuggucuucauguggguuccccaacaacuggaaugggagcuauccucaacucuguugccugacuguagauccuauuccccuaacugggcugccuugucuggccucaguggaagaugucccuaguccugcagugacuugaugugccagggugguuugguacccagggcguacucagaggagaaagcgaggagguggagaaagaggcugugggaggggagagugcaagggggcugugaucgggauguaaagugaagaaaaagaaagaggggagagggagagagagagagagaguaaagugaagaaaaagaaagaggggagagggagagagagagagagagagagagagagagagagaggaagaggaaagaaagaaagaaagaaagaaagaaaagaaagaaagaaagaaagaaagaaagaaagaaagaaagaaagaaagaaagaaagaaagaaagaaagaaagaaagaaagaaagaaagaaaaagcgagcaacaaggguagaacuaacaagguacagagccugcuccaaccuguuuguuccuucugggcagcugagagagcugagaggaccagaaguguagcaggaaaugauccuaaggucguguccugauauugggucgugaggcuccuggcaacaccuaggcuccugaugaucaucgcagggccuguuggcguagccaaggaaugcuuggggucugaguggcucuguguggauggcguugccucggcaaagaagauacacuguugcagucaaaagcucaaauuaccagaggggaaagucagcccaguuucccuguguggccccuucugggaaggucuacagcuauccucuagcuguauucugccaggcacucuccuggacaccucaagguucuuuccagccacacuguauguguggccuugggguguuugugucaugaacggccaacuuggguuccugcugggaagcagagggcugacucuagaagcuucugaccggucaggagaagcagaagccccugacucccucuucccacugagucuuaucuaagaaacaaaagccagcagggacuuccuaggccuccaugaucccuccuucauggaacggacacauaagcaggugccuuggaucagcuuuugcuuauuugagggccuuaagaacaagagaaccgccagacuugguggcgcaagccuuuaaucccagcacuccggaggcagaggcagauagauuucugaguucgaggccagccuggucuacaaagugaguuccaggacagccagggcuauacagagaaacccugucucaaaaaaccagagagagagagagagagagagagagagagagagagagagagagagagagagagagagaacaagagaacccugcaucauaaaccuccuaaccuuaucccuuagcugguuuccucaauucaaggccuuuuuagguguugccaaggagacuaaugcaguaccagaaagucuggcucaagucuccauggcaaccugcuacagcccacuaagguccaucuauguaugaugucaccugagccccaaaugggugcccuuccacccccgccacagucauugcaaacgucuaagagcaagucccugucccgaaauacgucacagccaguacacaggcauagacacacacacacacacacacacacacacacacacacacagucgucacccuagagacuagcaaggaaggaacaguucacgauauccaauucaggacuggguaccugaaugcugggagagaggcagacaggggacuagacacccaguccacccaaucaccucuccuucccucagauacuaucccuguuuucaaaccagugucugagaaaggggagcucugaagcaguggugguacuggguauauuuuugccauuuauaaaagagucuggcacacggggauggaucaaaagugagucuuaaacagagcagaggcccugcgaccaguuccugaaagcuaccccucccccauacccuacauuuaugccccuccucggugagauguuuacaagcaaaaggcccaguguggggcucaggagcaggaagaacuugaagacuauaaagggguuggcucuuucuggagucccccacuguuaggccggaucuccccaacucugggcaaccucaugcccaaaaacaaaguggcuagggccaggguuagauauuuuuagcaguuacuggcagcuguuccgcaugcuuagaguuagaguugggauuugaguuuguguguuccuuuuucuggcccuguaguuucucuccagcagacaagcacccagcaggcucuaucacccccugaaccuccuaagggaccccaagaauucauggaugacaccaaccuucaaccugaagggcagucccguugggagacucuuuaggucccaggacaaagacaggaauagaaaggacuuaguguugaagcuagaaauaccaguuuaggacccucuaaauucugguuagguccauaccuggaggaacgggcuucauagguucugagcguguccauaauacgucuacugacuuggguaauaggccaggagugagcagaagggaaaauucaucuuuaaagauggagugguaguucacuccacuuuacccacuacuggcagccucuguaucaaugcacacacacacacacacacacacacacacacacacacacacuggugcacccuccucaacgcacacuccccaucccuccccuccaacaccccucuaaacuaccccccaucccgcgcgagccuccuuccagcuaccugccccgccccuggcggguuugcgguccuagaag

SEQ ID NO: 4703 - RNA, 2223 nt, Mus musculus
uuggcuuccugcgauccagcucccaacaggaucccacggcuaagaaccgaagggacgccccggcgagagcuaccaacauuuuucccgcuuucggaguagcccgcacgacaaauacaccgcuucuagcaaacuacucgccgaaucccuggaguguggcgugucccuugcacgaccccguagccacaccacgcccucuccucguucccaggaagugcgcggaaggagcggaaguacacaccaccgggggauugugggaaccgcgguuccgggauggugggcggcggcgguagcggcggcgggcucuuagagaacgcuaacccccucaucuaugagcguuccggggagcggccagugacggcgggcgaggaagaugaggaagugccggacagcaucgacgcccgggagaucuucgauauccgucgcugcagggcgcuggcgggacggugggggcuuggggugucggcaagaagugaugcgcagcccgcugguggaggggugucccgguuaggcguugccugcggagauuuugagugggccaaaacuuagagucccuuuuccuucacuuggcacaucuuauccgcuccauuaaugacccggagcauccacugacacuggaggaauugaacguaguagagcaaguucggauucaggugaguaguuuacucgaguaaucaaaaagguaccguuguaccucagaggcugguguucuccguucacaagcccccaagaggaucugugggagguguguuaauguuuauggagccgauaaaaaguugggugacuugcccaaaucgauaaacuaaagagugucuuugggcuaggggccgccgugcgaucacugcgaucugaucucccuugucaucgcagguuagcgacccagagagcacaguagcaguggccuucacacccaccaucccacacugcagcauggccacgcuuauuggccucuccaucaaagucaagcugcugcgaucccuuccccagcgguucaaggucaguuggagucaagcccccgagggugaaacaaacuacuggggcgggcgaggggacaucgggcggagaucggaaggauccgaacucgcagaguugaacccccaaguugaugugacaagaauauuggggggaaaaaacuccagaaaauaggagugugguggaaagggcagcugggagcugugaaugggcgugaucgaucgaggcacuggaaggcuuuuaaagucaauagucgcugacuagguccuaggguaaaaguggauugacugacugcagguggguuugggguggcuuggaagagccagaaucaagaggggugacugggaguucagaugguugggagguaguguccaaaagaaaaggacaggcggguaaaugcucgggcccacauugucuuuccugcagauggauguacacauuacacccgggacccacgccuccgagcaugcagguuaguguggacugcugggccccaaacuaggugaggcuuccccuuugccacagucaucugugggggcaagauuaggaccaggggacuaagugaauaaaauggccauacuacagcuuagaccaaagcuggccugacugaaaucuccugcuucccaugacccacccuccugugguccucaaguacacagggacauugggucgggcuucaggaaacacuggagggaggcagacauaagcagucccugguggugacgggcauuccaaaugaugaagcuaguuauggguacaggugaugcauauagccugauccaggcuuggaguccugagacuaucagaaaagaacuuuauugguagaaauauaauguauacugaggcuagcaaccuggcccaaguuugcuuuaauccuguuuuuccacccuucuuuuccuacccagugaacaaacaacuugcagauaaggagcgaguggcagcugcccuggagaauacacaccugcuugagguuguuaaucaguguuuauccgcccgcucgugagccuggcuuuggacccccagccugcacucagguuguccuggccucagcuccaccaagggcucauggcuuuguuuucuugaaucacugacaaggagaaacuuaacacuuuuuauuuuguaauaaacccuuaauuuauauucauuucccaguaugccuuagcgucucucauaguggacucauuuucgguuguaguagagugggguggggaccuaugaaggguggguccaugaggugcccucauugcuucugau

SEQ ID NO: 4704 - RNA, 2516 nt, Mus musculus
auaauuuuaucccauuuuuaauauuuuggucuagcaacuugugauacauagaugacaauuuugugaguuuuucaaauguguguacagauuuuuguaaauaaugacuuuuguaauuaacucauguacagccucaucuuguauaguucaugaugaaugugcaggggaccugccccagcugucuguaugguuccugggccuacagccaggccuguguggcacucccaugacugauuugacaggugucuucccauuuggaccuucgucuggccagagacccugcacaucccacugucaggguagccaggacucuucccauccucgugaucagaggagacuuccucgucccccuuccaauaaagcaccuaugcccacagugacagcgugccaugugcugccacugggcuguuuguacuaaaaugugagcuguugauuuccuugaagcuggaguugaagaauaugagcaaucuuauaguggaggaaucuuaggacuccuuccgggagggggaugggucacccuucagaaguacacuggcaugguuuuguguguguguguauagugggcaagacggugacacaugauggccccgccccacaugcuacaggcaaaccucgaccugaagggcuuaguuagcucuaacaccagaccucaaagggaacagauaagauauggccacugggaauccaaugagagaaggaaggaagcuaguaacuauacgaaaaugccugccagguccacgagggcugaggccuggcuauggguauauccacuuguguuuguuucaucccagcccuagcucucucagugagugaucuggagaaaagucauguacaccauaaacccacauggaaaaccccuuuggguucuuucauguucuguccugcagcugaguaagagaaguuugauaccgugagagauaacuaagaauuccauuggaagggaccuguugccacaggcugcggaugugcacagacugggcccugaggcccaugcaacaagcgccacauaagccagaugucagcugcagacagcccauguacuaccaccaguucucgguagaaacaggggucaaagguucgaagaugaggugcagcugaaggcugggagaugccaaaggugcgaaacgcuggaugaggcucuggugugagccgcaagcgcugcaaacacaugccuagaaagacaucgucuaugggaaagagcucaacuugugagcaagcaucagcuaggcggcggagcguggcucccgaaagaacaaagccgccgccaccugcguaggcaggguaaacgggcaguccauacacagcccggggaaugaaguacuugcuggcucuagcucggauuggccuugccugcacaaucacaucacccgcaagaagguccugugcgggaucccggagcuccagaaacugcagcagguuccucacgugcacgaacacaucugcaucgcccuuaaaaacaaaguguacaucuggacagaaugcugaggcccaagauagaaagugaaucuccuucagcguuagauugaaaaaggugucuucgaaagcccagagcagaaugucugcauaagcucggcucuccgccuccagcagggugcgccagugcgaacgggugccugccccgccagagcccgcccccuugggcacgcccaacaagaacacucggcgcacgagugcccccugcacgcgacccucggcuccccaagucuggcgaacggcuucccgccgcucaaaguccgcagccacagacuugacagcgaugagcagguccggcgaaccgccggaugcgccgucgcugcggcauuugcgacgcugguuaaugagcagcgggaagcgccguugguccuuggcgcgcagauacccgccgaagucaaagggguccguaggugugggcggcaccggagugucccccucguaggccagcggggccgcgcgggcgguguuagggagcucgcgugcucggaggcuaggagugggccgcgggagcugggguccucgcgcugguggucuggucgugggggaugccacgucgcgcugcgcguagagcaggaguccgagggcggcgcugagcagcagcguaagccacgcgucugggcaaaggcgcggccuccuccuccuccucauguccagccccgcccuucacagggcccucuauccuuccuucauccacucugucgaccuccgucccugccccugcccccaccgcagcagccuaagggacaaaaaguucagcuucuaaccucagcuccagcccagaaaggaugccaaagucuggacagggugacgcaggccucuccccuaccgcccccuuacccacccauccagugcaucaaagcugggucccuucuaccuuucccccuccccgccucugaccuugguccuuaggaccccagcacucacgcuugaccgcgggggaggggugacaaccccugaaacugucaguucagggucccaagggcagccaugaccccggcuugagccaaaugcagcguuggcaggaagggggcugaggccgugccacg

SEQ ID NO: 4705 - RNA, 4680 nt, Mus musculus
acgcaggaauauuaaaggauuuauuuacuuuacacucacccuugacucuuggcuccuacuugugccugcccuccccccagcucuggaccugagcuagagcuagugcgaguguacagaggggacggagggcccagaauagacagagacacagagguugagagggcucgcugaauuuauggugccugagauuggucuggaugcuuucauagacccccaguuccccaaaagcgccuuagucaacggagccccuaaagagacuagcaacuggggcgugccugcgcaacuugcuuaggccuucccgaggcuugggguucgcgcggcccugggggggcuagauugcccaaucaccgcaccagugugggccgccagggaugcggcucacgcuuuagcuugagcguauagcugcgcaggcgcggacagugcgcucggaaggcguccaguaccgagggucucaccacgcagaagcaguguauuucucucaagcccgcgcagcgcgccgccagcuccuccagcgcggugugcaacuccggggaugcggacgcgcgcaccucgagggcgcgcaaaguuucagcguaguggcgcguugcgaagcgcacggguccuacagugucaccggagagguugagacgcagcacagccacugguacugcugguugcaggaugcgcgucacggccucaucuggaagcacaggcuccagcuccagcuccaccuccagcccaggauggcggcaacucagcgucgcccaggcuucaucaggcagaggggaagcacgagcaucuucggggcacgcgcaccucagugccagaagugcaaaaggggagcgaugcggagcggcuagcaauuccagcgcggcgcgcgacauacuagcaaggugcaguccaagggcgcgcaagugaggacaggccuccaguaguuugagcacagaagugggcugcacgcuguucaccagugcaugguuguccaggaaaagacugcggagcucgggacagccagcagcagccuuaagcaccagagugucguccagcguguagggcaaguggcgcaggucgagguggcgaaguuggugagcagcuccgcagacugcgugcacagcucccaggauguccuggcccgcaucaaaaagcgguuucucuccgcggcacuccaagcgcaggccucggagccuuggggcucggcuggccagagcggucagcagcucgguggccguuccgcggcugggcuucuuugauggcucauauuccagccuuagguugugaaugugguccaggcaggaggacagauaugguggcaacaagucuuccagcucacagucacaacuuauguuagagcgacauagaaagaaauuagcggugucaccaugaacuaggaaagaaacuuuuuuuuuaaauuaauguuuugauuuguguguguguguguguguguguguguguguguguguguguguguauucuugcuuuaccugcauguauguccgugcaccacaggcgugccuggugucugaggaggccagaaggggguguuggaaucccuagagcugaaauuacagccauagcuucgagcugcugugugcgaggcaggaaucgaacucaggucuucuagaagagccgcuagugcucuuaacugaagagucauuucuaugugccuuucacuuugccucuugccuaugacaggaauuuccauccuauuucuuuagaagacuucagagguuucugccugagguugaacccucucccagcagcccccccacccccaccccgccacuccaggaguguguguguguguguguguggggggguauuuaaggaacuuggcaugcucaguagucgguggagauggagcagggccuccagacccaagugauuaagucuauaagccuccauuuccugucugugcaaaggaggcacuacuccagacccacuaccccucaucuuccugugagcauuaaaugaguuaacuuauguaaggcacuuaggauacuaguuggggacuugggacagagugagugguagacuccuugccuagcaaaugucagacacuggguucaauccucuguuucggaaaaaaaaaauaauaaaaagacaaugccaauugguauauaacaggcagccaaugagccugucuucacagaugaagaugagugggccacaggaagcaacucaccugaugcuuuuaucagaccacacggugcuguuggcggcagccgccgcccaggcccugcagacucugguggcuacagcaaggucccugagaggcaggucacggaagaugagcgccaacacuuccucuggcagauugucgaccagcucccccauggugcggcuggaggggaggggccugcugcucccagcugcugugacuaaagugaaagagggaguccccugggucagaggggcggauggaugcuugugcacaguaauacugggagcccaggaagcgcuaugugguuuguagagaaggcagagaucccaggcugugagauggcuuagcagauaaaggcauuugccccaaacacggacgaccugaguucugucccggggucagaacucuuucagaagaacugacuucugaaaguuguccucugaucuccaagaaugcauguguacccugauuggagcacuuccacacacauaccugaauaaacaaacaaacaaacaaaaaguuuagaaaacauacaacaaaagaaugggacuggagggauggcucagcagcuacaaacaaacaaucaaacaacaaaaccuuggcuguacuugcagaggacccagguuugguucccagcaccccacauguggcucacaacugcccuuaauuucagguucaggagacuugaugcccucuucuagccucugugggcaccagagacacacauaguguacaguguacgcaaacacucauacacauaaaaaaaaguguaaaucuaaaaauuguuuuuaagacaaggcacuggagagagagcucagcuguuaagagcgcuuguugcccucaaagaagguaggacuuugguucccagcaccuccauagccaguaaaaacugucuauagcuauaggucuaggagaucuaaaaacuuuguagccucuguggcacugcacgcucauguuacacagacgcauguguaaaaccauacacauuaaauaaauuaagcuaauuuaaaaaagaaaaugcagggcuggagagauggcucagcgguuaagagcacugacugcucuuucagagguccugaguucaauucccagcaaccacaugguggcucacaaccaucuguaaugggaucugaugcccucuucuggugugucugaagacagcuacaguauauucacauacauuaaauacauaaauuuuuuuuuaaacagaagucucugcucagaauaguaaaucucccuaaaggcuuaaagguauaguuccagugguugugccuacacacacacacauacauacacacacgcacacacacacacacacacacuuuccuaucuacccucucuuuuuuuucucuuuucucaucucugcuguguggcccuggcugguauugaacuugagaauacuccugccucagugguuugguuuuucuuucuuuuuuaaaaaauagggucucacugucuagccuuggcuggccuggaacucccuauguagaccaggcuggccuugaacucacagagauccuccugccucugccugggaaagcuaugacuaaaggugugugucaccaagccuggcccucacuggcucuucaaacuacuuucucguguguugaacaaaugagaaauagguuucaaguugaggaauccuguccacuagaaacugacuguuggggcuaaucaggcaccagucuuagagaauauuuuuuguuuguuucuuuuugucugaaaucacaggccaaucaggaagugaugggcgucccagaaggggagucaccuuuacacugccuccacccccuaguaacggacugacuuccugcaugcuuucugugacagaccugugguaaaaagcuuguggcucugucuggggccggaccgcucuggcacccuugaggagcuguuguucaaguuaggacccugacccucgcggagccuugguuccugcuagcuaauaaagacucggguggaacccugcagacacaccccagagcuuggcuuuuacgagaggggugggaucggaaucugcguuuucucugaagcugccaguuuugcuucaaagugcuguaagguuuuuguaaagguucacacuugccguuucauuuccccaugucuuccagguguauggucucucguggaauuuaccucaaguauacacuagaguucccggauacuccaagcuaggcuuguccuggaaccacagcaccccauuuucuguguuaaagacuagcagagauuagaucaucaaaccagauuuccuagggggcgccagaaaaaauucucaucuccaggagaugcccucugauugaaccccaggaacuaacuuaaauuuggcggcucucacucugaagcccuuucggcuucaaaacccccaaacugcuauguccagugggcaguucguccugccaucuaaacuuggguguccguuaucuuaccugcucagcggacuaggugggcuuuacccggagacaggggacuggccacggaggacagcuagggcaggaaggagaggcccugggcggagaaggcgggacgcgcgggcggacccg

SEQ ID NO: 4706 - RNA, 6163 nt, Mus musculus
agaagauccagggcagagccugaagguaucuauuguaggagucgaugaagaauauacacaaucaucucaggagcaaauggcccugagccauggguagauccuggacuugaaagccaggcacuuugauuagcucugaggcucaguuugcuuccuauaggucuccuaugaagacguggaacaacugcggcccuacggggugcuagacaauaccagagugccccacuucaugaaggacuuggaacguuaccggcagcagcuggaacacaucaugaccaccaaccggcuggaugaagcggagcugggccgccugcugccugacugauguugacuaaggguuauagacagacgcucuugacagaggucacagaucggaauaugaaguucuuuaugguuccauagccuagguguuucuugggggcauuugggaggccaggagcaucgugggcagaugagaagcaacguuagaagguuuuuguccuugcuacccuuccuggggccugugaacugcagcagcaugucacauaaacuccugagcaggggagaugggagggcgaugagaugggagcugagugugaauagaaauguggguugguuugggaauagaaacuuguuccugcaugagauggcuuugggugucugguaccacuccuucccuucccccuaccuggccgauuggugcuccuucuacacucauaccucuaccucucacuggggccagcaggaguugggaaccccucugaggugauuugccugagcaugggguuccggcugucacucaggcucagagacccagcugggcugggcuuugccuuucagcauucugucugucucacuggucaugcauuguuccauagucgcccucauggggucauuucaugccuccaggcggggcccggaaguaguaguaguaguaguaguaguaguaguaguaguaguaguaguaguuccauguaggggcaggauccuuuggaaaaguaccguauguuccuagaccccuuccuuccuuccuuccuuccuuccuucuuuccuuccuuccuuccuuccuuccuuccuuccuuccuuccuucccucucccucucucccucuuccuuccuuccuuccucccucucucccucuuccuuccuuccuuccuuccuuccuuccuuccuuccuuccucccucccucccucucccucucucucucucucuuccuuccuuccuuccuuccuuccuuccuuccuuccuucuuuucuuucaaagacuuauuuauuuuauguauacgaguacacuguagcugucuucagacacacuagaagagggcaucagauuccauuacagaugguugugagccgccaugugguugcugggaguagaacucaggaccucugggaaagcagucagugcucuuaaccacugagccaucucuccagcccccuagacccccuuucuuaucacucacacagacacacugugucuugugucuugugaguccagcaccuggucccacccucaguccccauguuagucuugguugugccugucuuuaaccacagccucacagcuggucucuggcagugguuaggacaggcgggagcaaccacaaucaaaccuacagggcaggcccuaggguuuguuaucccacguucaggccaggauuaguacagagcugguuaaggcuuucauuucacuucagauucagcggugggagagugagcuaguacuguccuaacccuggcuuuucaguuaauguuuccaucugugaagcuuggaaacacagcugggaaguuuguauucauuuacuuaguagauaugugcagagcuccuuguguaugucugugacugguuagaccccacgccccucacugagcucccaguucagaggaaagccagacaauuaaacagcaguuacaaugauguguguggcuucugucuacucaaguuuccucucagguccucccugcaagacugugagcgccaagacuucucuccauguguggauggacaucccccuucacuugcuugguacaccaagccgagugauuuccauggauuagaaguguugcccacucggccucccaaauggccccugaggggaauaaagugggugagggagggucagauuugggggccugcaucugagaucuccagaauuacagcuugggcucuuugggaaguggaauguuuuugaggggauggggguauuuucacacaagccugcucaggucagugggauucagacccacgcucacccucaguucuugagcaaagagccagacuuguggagagucaggaacagacugacccuccugaguuuauucauuuggcaguaggugucucggugcaucgauggggucaagcucuggcagguuuccaggucuuauccagcacaaauaggauuggacagcuaaggauucuggccuucaggaaucuggagaugaaaaugaugguuaguggaauagggaucaaccccccccccccacacacacacacuuugcaguccacaacccguaacaagccugcaagcaaggguuuaggcgcucucacaaccuucagauucauccucuucuuggaagucgggcucggguucggguuccggcucgggcucggguucuggcucgggcucggguuccggcucgggcucggguucggguucuggcucgggcuccggcuccggcucuuguucuggauucauuucuuguuccaggucuggcucauccccuucaguagcuucagcuucuaguucuggcuccucuggaguucgaggcugcagugccucagagcccucaggaccuccgaccuccucuugcucugacgcucuuggcagcucaggacauguggucccugaacugggugcuucuggcguccaguggccugggcaugaagggucauagcugcgguuccgguagccugggaaggaagagggaguacuugagguucaguucaccccucugugguuaccuccaaauucucugcccuccauuuacccuuugcuucgcccugccccuaauccacgcccuucgauucaucaaggcuccacccucuuggugcucaccgggccccacgugcugccaaucccaggccgggucuggcaugcgcacuguuugcugggcacagcgcaguagcuccuggcaggcugccucgcccuugcucugcaccaacagcaguaggcggcgcacccugcgcucugcaucgggcagcgcauccaaggcuucguacucgggcccagugaggacgccccgggccaccagcgcauccagcagcagcccagagucagccugcaaugucucuaccagccguuuccguucccggucaauggucucugaugggcgcuccugcacguugcccauuucugcugugucaagaaggagagaagggggcggggcguaauuugcguuacucuacgcugaccaggaguuaucuaaguucaccucaacaucagagucuggaugguugcucagcgcaagaccuagaggccaggggcccagaacgcacccuccagcuucuuggcugcuucuguccugauuccucagguuucuuuugcagacuccaccugucaguggagugcucuucccagcuaggaccucccucccuccuaagccccagacaccugcacaguuggcuaccaguugagacccaguuuauccaacugaauuauuuugucugaacccaauuccuuaccuaaauaggcagaaaacccuaggcuugauucauaccuucuuccucgccccugcagcaaaccuuggaucaagggcagccugccugaucgcucauacaaucgggucugcacccgaagggccaaggcacccguguuccauucaccuaacacggagguccaggcaucccagaaccuugccccuucauucaccaccguccgcagccucaacauagucuugggacucuuccagguuaucguagcacaacugaacuuuaauuuugagagaucuccugguaucagggacccacuuguuucccuaauggcccggcagucacuuacagccauuucuuauuugaccuugaaaugcccagcucuuaaaagccacuaggagugcuuaccagacuuuuagcuuccccuccauggauuacccauuuugagaggcugccuguaccaaaccguaggaaccaaguaugaauuaaucuccucugcucauuuuuuaucagcuccugccuaucaugacuaccucccaacgaguuggguguccuaacccagccaauaagggcccugacuuuaaggaaaaaagaaaccuggccauucccucugccuucucuuuauucauacagcauccuucuaagucuccccugccuuuuuguuuguuuauuuguuugcuuuuuguuuucgagacaggauuucucuguguagcccuggcuguccuggaacucacucuguagaccaggcuggucucgaacucagaaauccgccugccucugccucccaagcccuggucuccucugccuuaaauguuccuguuucuaccuucuuccuggcccauugagucauaucccccaaccccugccccacacauaucaaaagucccaugccucaguacucacacuguccugucccugggcacuucacaccuugggucuccaucccucauaucuguugguccuucucccccaaggccacuaagcgcagacaggguacuccuccaacccacaucucccuucaugccccaucccugucagaugucuuuuaaucagucuccauuagcuucuucuccuuaaacccagcagcagccgauugccucccgggacaauaaauaucucugcgcacuucucucacaccccacgccucccuucacuccaacauugugacuuuugacaacucugggguagaauuuaucuuuccgguuuuauggaugaagaggcagguucggaggaacccaguacaacuggaaucugacuugcccuagccuaaacuauaauguuccuugucuagcugaauggcaggcguagacacccacccuuugucuccaguacucaccaaagaaucuaagcuacuagucuggcuauuuuaacccccucccaccacucuggacagcuagguuuccauccaaccauucaguccugugagaacuaugguccuagcacuuuagccuuugccaacgcuggucccugggccugggauacuugucucuccccucuacucuguggacccagcccuuaacacucaaaugcucccaugucuaccccaauuccugagaguucaaagguucggagcuccuucugugugccuugguccucacuacuguguuuacugggauccacacuacacuguauucaggaccucugcuguccucaaugaggcuuccaaagacugucucccaccacugguuacagagaagggggugaugucagcuccuguucuggcccgacuucgaggcaggauuggccuccucuuuccccccucuguacccugaguuuauguuagcuguguuucucugagguuaucacagcucuaaggugaaugcuggcuaugcccuguucagugcaucaaagaacaagucuaaauaguacccugagccccagguggagaaguaagaccugguaauuuuuugggaucccuagcuugcuggcugaaugagauuuguuauugugggugggaaaccaggagcgggagcuggucacgcaugcgcgacugcaaggguacccucaccagcccuccacucaguccuagagcuucagucccgcggaaggguggggcccacagaccuucgaacuccgcugcugguggugaggccugggauucugcccaaucugucuccuuucccucccugcuggguggagucgggcuugugguccggagcguuucggauagucccacuccggaguugagccucaccggggcagaugacagugcagaaagggccaagcgagcgagcgagcgggguggguacgcgaacagcagcugcaacaggggcggggcggccagggcugcugggaauggcgugggggaagggcaugcuucacuggcucugcgaacucugguggcgacgcugguggaggcgugcuggcagggguggucacauaguccgcuacccuucccugucccaaagcacccggauuugagucaggggguggguacagcucacagucucacuuguccagcccucucuggaccuucuaauugcuaggugcuuuuaauuuuccuuuccacgacuccuccaucugccugucacagguaagu

SEQ ID NO: 4707 - RNA, 16115 nt, Mus musculus
gccuugggggagaaguagggguuucugggccgugaagugggagagaggcuuccuuggggagaggaauuuggcugcuggugccaaaggagcuggagucccuccggucccgugagcagugagggugugcccagcucugcaggagcgagaaggcuacucucaaggccaaggccacuugcagaggagggagaacuggacaccggucagaucugguaaguucuguaccaaacuauccugggcguuacagagcaggaaaggggacuuacaguuuugccuauuugcauaguccaagccagaggacugaggccucccagguauccccuucuuacuuccugaaggggguaggcaaggacccugcuccucuuucucagcggagcccaaggaacauccgcucugccugaucuccuccaggcacucgcucccacuccuaccacaucggcagcagcucuaggcaaacuauggacagcaagauacagcccacacuucguccugguaugagccucguuggcugggcuuggggaaggaugaugucaagacaaaugggaauuagugggguuggguuuucccgucaggucuagcuagagcucuauaggauugccaagaguggggcugucccgaggaaacagaagagcagcaggugcguuagccacaggcccucccugacugacacaaccaaccccaggaucuuccugcccaaggccugaguggccagagcaggagagggccgaacagcuggcucggggugcagcacucaagugggcuucaggcaucuucuaccggccagagcagcugaccaggcugggccaguaccgaagccgugaaauacagcguaacuauucccuggaagcaagaauuaaggugggugaggagcaggaguguuagacugggcuggagggcuggccaggccuuaggagcggcuaccucucuccacagucaguggugcaguccuaccuggaaggugugcagacugguguguggcagcugacccgagcccucgaggcugugcagggaacucgugaagcuuugagccaggcccaucacuuacuaaaggguuugucucggaccucacaaacccuggaaccccugagggaauguguuguccagcacaaacaacuucagauccugacucgguuguugccaaggcuacaagcaggugagugggggcggggaaagcggagguggagagcccuggacuuuagcuucuaagaauccacaaaucccauucugaucagcagcuggggcacuaggaaagggauuacauggagagagacaccagggacaucccagagaauaaucccagcuucaaagagugugagaaauaggcgcagucgccucauccugggcuucucaggcuugggauguuaaagucagcacgggaauuccaugaaguggcuauagccacaguaguuuacuuacugaaagaacguuggcuguagcucugguagagcauguguuuaguaugugcaaggcccuaaauucaaucucaggcaucaccccaaauaacacauauauacaaaguacaauacauaccugcauccauacauauauacaucaauguacacacacauacauaacaauacauauguaguuauguuuguaaguauuucauaacaagauuggcaaauagcaaccagcauggccuuccauuuauuuugucugccuguaacauuuuuuuaagauuuauuuauuuuuuauuuauacgagcacacugcagcugucuucagauacacuagaaaagugcaucggaucccauuacagauggcugugagccaucaugugguugcuagggauugaacucaggaccucuggcagaacagucagugcucuuaacgacggggccaucucuccagcccuguaacauuguuuuuaaagauuacuguaagugaguguuugagugccugguacaugcaggggucagaagaggacuaugauggccuggaacuagaguuacaauugugagcugccacauggguguugggaaucauagccagugcucauaaccacugagccauccaucucuccagucggccacccaccuccccggcaugcuugauuucauggucuguugguucagggguuaacauauggcccaacucuauaggccuuagccuggauguucagaugacccgacgcaguaccaugcuuauuauuaaauaguuaauacaucacaccagucuccagaccucagugucccuugcuguacccauagcccagaugggaaggcugagaccucaagccgucuccuuucuuccuuagugccggcuacaguggcccacacgcagacccugauagacucugagcgacucuuggaggcauaugugagccugcgggaacuagagcagcugaaagaggagacacuggcaccccuaggaggucuggaguugccaaucuuccaggggcuaggccuucuggcugaggcccuaggccaagcuguggaggcggcugcaggagcugcggggcggcuggcacgagaggacccagcccugcugguagcugcuauucguguggcagagguggagacugagcgcacaauccuggggcaggcaccccgagacuggcggcagcgaugucuucgggcgcuacaggagggccuggagcggguccacuuugcaucgccugugcuuccggagccaggggcucuggcgggguggcuugaggcucugcagguagccuugcccgccgaguuggcaacagcggaggcauugguggcacccugcugcccaccaagcuaccgugugguugagcuaugggcccacacccugcacaguggccugcgccguagcgugcagcaacuccucgcggggcccgagcuaggagcugcugacacguuugccuugcugcacugggcacugcauguguacacggggugaguguccuuggagaagcgggaagugggacgauuagaggcucagugugacauccugcuauccaucucuaggaaggaaaugauggggaacuuggaacuggggccugaggcugaugugucccagcuagagccccucuugaccucagagaacauugagcagcuggaggcagccuuuguggcucagguucaggugacuagugacuguccgguugucuaguugaacgucaugucaauacccugauauagcucgcugcuccuuacucuuucuugccagguaaguguggcucaguggcugaagaaggcacuggauggagagguagcagaguggagcggggaacaggagccccccacagauccauccgguuucuaccacuccccaaugccagccauuguccugcagguaggugggaagaacccaaggaaguaggcagcucgcauauggaaaggggagaagggcagcgggucuaggaaaugucugaaggccgcuccucccugcuuguagauccuggcugaaaacauucaagugaccaaccugauuagugacucauugcaucggcgggcgcauaacauggcagugucagagcugggcgcauucuugagaagguuugccaagcaggggggcccauccacaaucuccagcccugcucccagacagcccaagggcucugaguaaacuggacaggacacacuaguguguguguguuacccuuaaacaaauacuugaaagugggacaagaguucugggggugcagcugugggggugccacauuagcagcaaacccaagaggcuccucugccuacugcagcuucagcgacgcucugauccgauucucucgagaccaucucaggggagacgccguggccccucacuaugugcccuaccuacugucugccuucaaccaccaaucagcacugagguaccacacuuuuccuaacacacuucugaguuccuuuaaagucuggaugccacccacaccagaaccacuuugggcucacaaagaugggguucuaauccucgcucugcuaauuaucaguuguauuacaagguaccugucacuuuucuuacuaguauuauuuggauaauaauaaaaucgucagagaaucauauuagauaaagauguuaaaucuacuacauucaggaaauaaauuuuuuaaaagauuuauuuauaugaauacacuguaccugucuucaacccaccagaagagggcaucagaucccauuacagauggcugugagccaccauguggaccucuggaagggcagucagugcucuuaaccacugagccaucucuccagcccccccuuuuuuuuuucgagacaaggcuucucuguguagcccuggcuguccuggaacucaaucuguagaccaggcuggccucaaagcccggcugcaaauauauuuuuuuaaagauuuauguauaugguacacuguagcugaaccagauggucgugagccuucaugugguuguugggaauugaauuuuuaggaccucugcuuccuggucagcacccccucacuccagucaacuccgcuuguucaggcccaaagauuuuuuuuuuuucuuuuuuccagacaggguuucucuggguagccuuggcuguccuggaacucacucuguagaccaggcuggccucgaacucagaaauccgccugccucugccuuccuccaagcugggauuaaagacgugcaccaccacgccuggcucaggcccaaagauuuaugauuauacauaaguacacuguagcugccuucagacaagccagaagaaggcaucagaucucauuacugguaguugugagccaccaugugguugcugagauuugaacucaggaccuucggaagagcagucguucuuucgucagccuccaccaggccuggcuuaucuugaguguuaugcucuugguggugugcagagaggacagacauacaugcggggaauuuuuacucuuuuaagagcuccccucuaaaacaaaauaaaaggaagaauaacuuaacuugagguuacauuagaggcaaguccgcugggcauacucuuccuagccuuacagaauaccugagcccuucauaaauucagagccgcccuuuccgccccagcucccaccagacacuguaccacaagguggcgccagaguggaugaauccuagagggccaugcgagccuuggccuugguccugaagucacacuuuuugguccagaucuucggucucgguccugcugccggacggggaagcuuccggggucuuagcuccaguggaagcugcgcuggacgacguacaaaggaggaucugccgccugguuuuggaaguacugcagguugagcuccaggugaggucgccaucccagucuagauugguagugugagggagaaacacggucuauuuaugguggccucuacgggauccggaucauuucccuagcccugucugugcuaugcuuucccuagccccuguucuccgcucugcccucgcgccgguggcuauugaguucugaguugcuagauggugugugugagcagacgucgcacuucugccaggacuucuggcgcguacggaagccugguguucagguagggcgaggagaggaaagcuggggaagggguugugcuggugggacccuauauucaaacugauuacuguccugcagcugcugcuggcagaggcggaacgaaccgugguguuacaauaccuaagggcucugaugcagggccgccuagugugccgcgguacggacgagcggagccaggcggcugagcgacuucggcaggaugcugcccagcucaaagagcuuuuccuugguuuggugagagcucauugggagggcagacagucgaggaucucuguaguugggugggagccgagggcccgcuggaaacccuguucccauguguucagggccuggaagagagcgcucacugcgcgcccguccugcucgcgcugagggaacugcucaaccuccacgaccccacacugcuuggccucgagguggcaggcuugaggcagcaauuucccgacgugaggugcgaggaaggggacaggggaggaacggcccaggaggacgagggagggcugggcugacgcacguggugguauuccugcagcgaggaucacgucucugcccucuuggaccugcgcggagacgugucccgagagcaucgucaggcagcacucaguucgcugcaggcggguccaccgcccucaccguccacuggccgccgggcgcucuucagccugguaccgacgccuacgcccucccuguccuccugccucccuucaggucccugcuccugacacccaucuguuugcguaauaaagccacgucuacgacacgucugaaucuauguguugggggcgcgccggugaaagcaacagugcaauuagggguccgugcacagugguacaucuauaauccuggcugaauccuaguauucuggcagcaucucaccuaugcagacaucugcucucuuuguggacugcgugccccgaacccugggcucccguggaguacucacuuccuauguaucuacuaccggcaagcaguaaaugguuucaucgcccucgccagucgcuuuagaagcgcggaaguuugaagagggggaagucuaggaccagacgcgguccaggggcgcaggguggcagcgaaucccgccccucuucgcacguuuggcuccgcccacagcgagcuuaagcacgcccccuacggcggagacggacguggcccuugcgucuucgugugagcgugcgcgcgcccgagugcgcgugucuuuggcgcgggcuuccauggucucggcggccagcgaucggcuuugaggagcaggaacugcgggcagcaaaagaggcgugaucaggugggggcgcggcacgcggaccgaaccccuaccccacuccaaaaaccgagacuaaauaugacuaagacuucacccuucuugauuuaccagggaauucccccaaguccauugucuccuagcuccgcccuccauugggcacgcccuucacccugucucacgcccuuuauuugucuucagggcacgcccucccagagcucuugguuccuauugguuguuuucccacguuaucucuuuccagggguucuuauuggugugggccacacccucucauuugucaccagaccccgccuucagcagucagggacuccagccucacccugaauucauucauucugcaacuagugagugcgugggacgagagggugaaucagacccuuccugaccucggggaguucagggcacgguggggaaauauggaucuagccuccagccaugacagccuagggcugucaagaagccaucaagacccugggacccuuuacacaucgggaaggcuucccagagaaagugaggccuaaaccgggcccugaaaaaaaugguuaagagguugcuccagggacacauuggcaaaagaauucuuggcagaagaaccugagacgugaaagaaacaggugaauucugguaauuacguggagguagguggaaugaacgaagggaaaauggaagaacuggcccauauaguggucaguagacauccagaaaaguauacaguuugagggugaaugagaucugagacuagaagucauuuuuuaagcagccgaucacuagguaagguggaggaagacuccgagaaggaggaggaugccgggguggggguggggggagucuaaacaggguaucuaaguuugcgaaaggaaugauuauaguauuuuugcuuuagaggucuauuuuuauuauuucuggguauggguauaugcaugugcccguggaggccagaagagggccuugggucuccugcagcuggaguuagccugcguggacacuaggaacuggauuuggguucucagggagagcagcaagucucuccagcuccaugauuuaguucuuacaaggacucagguucauccauggaucacaguggauuacagugcuggaucagggacuguucuggguucuggaagcacaguugcacauuauagaaaggaaaacccagauaaagccuucagaucugccaugcagacagugagcuagcugcaguagacuucagagacagcaacaacuacagaaaaagcuuaguuccaggagagagaggagguuugcucuuuuguagagauuugcuagugcugacuuucuuuuauucuucuuucccuuuuuuuuuuccucucuguuuaaagcuuuuaaagacagguauugcugcauagcccagguuggccuggaauucacaauucucuuguuucagccucaagugcugggauuacagacaugugccacuacaucugacaagcuuuucuucuguuuuuaauuuuuuuuuuauuaaaacacuuccauguaguuugaucauguuuuuauccacacacccaaacuccucccagaccaacuuucucucucucucucucucucucucucucucucguguguguguguguguguguguguguguguguguguguguguguguguaugucuagggcaucucuucuaauaugauauuuaugaagauuuuuaagaaagugacaagugacccaugcuauucuggggugugugugugcgcacauuuuuauacaauggguauguuccguuuaaaguaccuguuaaauaguaaagauaccuugaagauuggguauguuggcuuaauccugacccaagacuagagagguugaaguaggaagauggugaguugaaggccacaugggcuacauagggaugcucugucuaaagcaaaguuagauaggugugaagaguguugauccuggucuuaagggaggaguccaaacugauuuauuuaaaaccaugauagugaaguuggguauggaggucagugguugaggguuugcuuaauguguacaaggcccuggguaaaacaaaacaagaaggacuggagagauggcucagugguuaagagcacugacugcucuuccagaggucccgaguucaauucccagcaaccacaugguggcucacaacggucugugaugggcuccaaugcucucuucuggugugucugaagauagcuacaauguacuuauauacauaaaauaaauaguuguuuuaaaaaacaacagcggcaacaacaacagaacagaacagaacaagaaaccacaaaauuagauggaauccaggggccgcuagggggugugaguguaaauggaauagagaaguugccauauacaagccuuggguuauuacaguguuaagagguugauauuacaaggaagaccaagaagaaacagccagugaugugggcagacaagcaugcccuaauguguucagaaaggaagaugggaguaauguccccgggcuagaaggaucagcugcaccaggugcuacagacccacaccauacagauccauuggugaccuugagcagcucaguuugauggacagcaggacgucugcauguccaauggcaguuugggaaacagaacucaggagcgcacgggaaagaagaaaagggagaugguguguaagugacucaggguaucgugccgcaacaggagagcagcugcggggaguuaggcgcggacucucagaaagguuuuguuuuguuuuuuaagauguuuuuuaacaacagcauguauuucuucaguugccagaaagacuggugauguaggaucaaggagaaaggcuacaguugaguuucugagcaggcaaggggaguucagaggcugacgccuucagugugucucuggggagagaguggauugcacugagcccugacacgcagucaggggugaguucucugacaguggccuuggaugcccacugggaaagauaucucagcuaggugacaggccaggggcugguuugaaugcgcuggguuuccucugcuucccaaaagcagauucuaauuccauccugaucaaugggaaagagaagaguauuucauguggggacuggccugagcaagugcauucauucaaacugauuaccaaagggcgggaggcuguaaugagcuaggugaagcggggaggugggacugggaagaugccaucgguacaaagcagauugugggcuucucucaccugugguccaucuagggaucugaggcggucuguauucugccaacuuccagauuggguaagugcuaaacacugaaauuagaaccauguuuaagaccuuaguuuuagcucuagaucugaccgucagagagaauucuaauaaauaggaaaaugucuacaauucguugccuugcuuugcuccaccucagacuauuggauaagccugguagaaggaaugcauacuucuggaggguggagaguuucuugaguuccuggcagcagacucuggacucaacacggauaacaugggacagggggcuuccuccucugaccacauccccucaugcugguuucugcaugccguucugugucccuagaggucaacagucugggaaguuggcacgacagagcuggaugugacccucaggagagaauggugcuggacucggggacacagguguaugagcaggcaccccccaggcccccugccgguuccccaucucagcaccauaagcugaagcccucaaacggaaaugggccaccccuguaccccuggccugagucccuggggaugcccuuggcucuggcagucccuucagcacugcagcagcagacuauguggcagaccuucucaaagcugcacuuggagcagaguagccacaugcgucgcagcgagagcaccuacaguguaaauaguacuggccggcgggggcgugguaaagccccgauuggacggggaugcgauccaggagggacccuacggccugcagccuccuuaccucacauugcuaagauucgaaaggauguaggcaguaguagcagcaagagccccuguauguugguggcccugcggccaacuaacauggaccaggaacgggaaaaguucuuccagucucauuauaccuacaauccacaguucgaguaucaggaaccgaugccaaugagugugcuggagaaguaccaggaggccucugcgcaauucaugaaucaggucagcucccccugcccauuucacccuggcccugacuacccaagggaccuagccugacuagugacuguggcccuguguacaggcaguuggcaucauugaggcuguccuggagaaguuuggcacuuaugaaaacuuugaggcugccacagggggccagcugcugaccaagugccaaauuugguccaccgugcgcaaauacaugcagaaggaaggcuguguuggggagguaaguuugcccuaucuacaagacccauccucugugugccccaaaucaggucaccuagcucauagaccccuacacgucuggccagcucuaauuccccagacaugucccugccccagucccagagaaguaaaagccagcuuugaaggguggguacccuagccagcgcccggccuguagcacugggugucagggcuuggaaaccgugacucagggaucccugucacccuguagauugugguacagcugagugaagaucuacugucccaggcugugaugaugguggagaacagccgacccacacuggccaucaacuugacuggagcccgccaguacugguuggagggcaugcugcggcacgagauaggucaggcuguggguggccuuuggguggguggguaggauugaaagguauggagagauggggguaggguaguggggggucucaguaguccccuucuuucucccccuuccuucccucuggaagaagacaggcuuauucaucccuaagcagacaccucuuccuuugcauuagcaaacaugccugcccacucuguaggcugaccuucaucuucuuuuuuugagacuaucuccaauucuucuucuucuucuucuucuucuucuucuucuucuucuucuucuucuucuucuucuucuucuucuucuucuuccucuuccucuuccucuuccucuucuucuucuucuuccucccccucccccuccucccccucccccuccucccccuccucccccuccucucccuccccucuccccccuccccccucccccucucccucuccuuuuucuuaagauuuacuuauuuuauauaugugaguacacuguagcugucuucagacacacuagacaagugcaucggaucccauuacagaugauugugagccaccaugugcuugcugggaauuggacucaggaccucuggaagagcagucagugcucuaaaccgcugagccaucucuccagccccuaucucccaauucuuuucugauuuuccuuugacagugaaggaguucuaaggggccaaaaaaagaauccugugggcuuccacuagaccagcccaccaguuccaccuggguggguggcagacuagagccuagaaaugguauugcuugcagaugcauagauaaaagaagacagaccaggcuaggaaggcaagcacaagacacuaguuacucuguccuccccagacaggaaucuuguugcucugggcaaaaagugguuuuugauuggagcauuugaaugacugucaagaugauuggcucgggcauuaggauguugggaagcgggcaggugcuuaguaucugugagggcuggggcacacagaaugaacugggacgaaggagaugagaacguaaguagagaagagcuugcccugaaccaagaaguugucuggaguaggcugcgaauggauuuagguagggcuugggaugacuuguagggugugaauuuuggggcggggcacgaggaucuaagagucucuacuagagguccuuggagugaguucuccgcccccuccuccuccuccucccugcaggcacccacuaccugcguggugugaauaauucgcggcaaccguggcacagcacugaaggcagauugcaguacggccuucagccagccaacccuacugaggagggccuggcuagccugcauagugugcuguuucgaaagcaaccauuccuguggcgcgccgcccugcucuacuacaccauccaccaggcggcgcacauguccuuccgccagcucuuccaggaucuggcgcaguacgugcaggacgaggguguacgcugggaguacugcguccgugccaagcgaggacagacggauaccucccagccaggugggaacuguggagucgcaagaaugcucaagcuggcgcaaggugaaggguggcuuuuggguaaggcucgauugguuauccuucucacaggcugcuucagcaaggaccagguguaccuggauggcauuuugcgcauccuacggcaccggcacaccauugauuuccagcugcugaccucgcugggcaagguaaagggccgaaaggcccagccagcucuuucuucuuuagaguuauguuuggugaaggccucgacacuugggaaggcagacaaaaugagacaaaguuuugguagcacagaucaggugugugaccuagccugcagauguguacauagguguuaagggaggugagcacuccaaggcagggagaggucaagaaguucuggggaagaaggugggagaaauggccagggaccaaagcccaggucuuguaccagguugaggcaaaccucgauagaagcaaagggggggggggaguaucguaaaugugugggcauggauuuucuuuaaaaggcuccaacugaauguucugugggaagugcaggaaauggaagaccuagauaggcaagagaaggaggucuuccaucacucuuacagaauugauaauggcaaagcuauaaacuacagauaaaagaacuguuggacucccugaauggggaaaugagaaccuagucggccuuucuuggaccugauuguggugacuaugcagaggggaggacagacagcugacauucaacagucuccuguuggaugugggagauaacccgagagagagacccagguaucaguuggauaccauuuagaggugaggagauaaggugggcuggagaggaauggguuguacaacguagauaaaagauagagagagaaagauagaagauccagggcagagccugaagguaucuauuguaggagucgaugaagaauauacacaaucaucucaggagcaaauggcccugagccauggguagauccuggacuugaaagccaggcacuuugauuagcucugaggcucaguuugcuuccuauaggucuccuaugaagacguggaacaacugcggcccuacggggugcuagacaauaccagagugccccacuucaugaaggacuuggaacguuaccggcagcagcuggaacacaucaugaccaccaaccggcuggaugaagcggagcugggccgccugcugccugacugauguugacuaaggguuauagacagacgcucuugacagaggucacagaucggaauaugaaguucuuuaugguuccauagccuagguguuucuugggggcauuugggaggccaggagcaucgugggcagaugagaagcaacguuagaagguuuuuguccuugcuacccuuccuggggccugugaacugcagcagcaugucacauaaacuccugagcaggggagaugggagggcgaugagaugggagcugagugugaauagaaauguggguugguuugggaauagaaacuuguuccugcaugagauggcuuugggugucugguaccacuccuucccuucccccuaccuggccgauuggugcuccuucuacacucauaccucuaccucucacuggggccagcaggaguugggaaccccucugaggugauuugccugagcaugggguuccggcugucacucaggcucagagacccagcugggcugggcuuugccuuucagcauucugucugucucacuggucaugcauuguuccauagucgcccucauggggucauuucaugccuccaggcggggcccggaaguaguaguaguaguaguaguaguaguaguaguaguaguaguaguaguuccauguaggggcaggauccuuuggaaaaguaccguauguuccuagaccccuuccuuccuuccuuccuuccuuccuucuuuccuuccuuccuuccuuccuuccuuccuuccuuccuuccuucccucucccucucucccucuuccuuccuuccuuccucccucucucccucuuccuuccuuccuuccuuccuuccuuccuuccuuccuuccucccucccucccucucccucucucucucucucuuccuuccuuccuuccuuccuuccuuccuuccuuccuucuuuucuuucaaagacuuauuuauuuuauguauacgaguacacuguagcugucuucagacacacuagaagagggcaucagauuccauuacagaugguugugagccgccaugugguugcugggaguagaacucaggaccucugggaaagcagucagugcucuuaaccacugagccaucucuccagcccccuagacccccuuucuuaucacucacacagacacacugugucuugugucuugugaguccagcaccuggucccacccucaguccccauguuagucuugguugugccugucuuuaaccacagccucacagcuggucucuggcagugguuaggacaggcgggagcaaccacaaucaaaccuacagggcaggcccuaggguuuguuaucccacguucaggccaggauuaguacagagcugguuaaggcuuucauuucacuucagauucagcggugggagagugagcuaguacuguccuaacccuggcuuuucaguuaauguuuccaucugugaagcuuggaaacacagcugggaaguuuguauucauuuacuuaguagauaugugcagagcuccuuguguaugucugugacugguuagaccccacgccccucacugagcucccaguucagaggaaagccagacaauuaaacagcaguuacaaugauguguguggcuucugucuacucaaguuuccucucagguccucccugcaagacugugagcgccaagacuucucuccauguguggauggacaucccccuucacuugcuugguacaccaagccgagugauuuccauggauuagaaguguugcccacucggccucccaaauggccccugaggggaauaaagugggugagggagggucagauuugggggccugcaucugagaucuccagaauuacagcuugggcucuuugggaaguggaauguuuuugaggggauggggguauuuucacacaagccugcucaggucagugggauucagacccacgcucacccucaguucuugagcaaagagccagacuuguggagagucaggaacagacugacccuccugaguuuauucauuug

SEQ ID NO: 4708 - RNA, 1859 nt, Mus musculus
ccuggaccgcgucugguccuagacuucccccucuucaaacuuccgcgcuucuaaagcgacuggcgagggcgaugaaaccauuuacugcuugccgguaguagauacauaggaagugaguacuccacgggagcccaggguucggggcacgcaguccacaaagagagcagaugucugcauaggugagaugcugccagaauacuaggauucagccaggauuauagauguaccacugugcacggaccccuaauugcacuguugcuuucaccggcgcgcccccaacacauagauucagacgugucguagacguggcuuuauuacgcaaacagaugggugucaggagcagggaccugaagggaggcaggaggacagggagggcguaggcgucgguaccaggcugaagagcgcccggcggccaguggacggugagggcgguggacccgccugcagcgaacugagugcugccugacgaugcucucgggacacgucuccgcgcagguccaagagggcagagacgugauccucgcugcaggaauaccaccacgugcgucagcccagcccucccucguccuccugggccguuccuccccuguccccuuccucgcaccucacgucgggaaauugcugccucaagccugccaccucgaggccaagcaguguggggucguggagguugagcaguucccucagcgcgagcaggacgggcgcgcagugagcgcucucuuccaggcccugaacacaugggaacaggguuuccagcgggcccucggcucccacccaacuacagagauccucgacugucugcccucccaaugagcucucaccaaaccaaggaaaagcucuuugagcugggcagcauccugccgaagucgcucagccgccuggcuccgcucguccguaccgcggcacacuaggcggcccugcaucagagcccuuagguauuguaacaccacgguucguuccgccucugccagcagcagcugcaggacaguaaucaguuugaauauagggucccaccagcacaaccccuuccccagcuuuccucuccucgcccuaccugaacaccaggcuuccguacgcgccagaaguccuggcagaagugcgacgucugcucacacacaccaucuagcaacucagaacucaauagccaccggcgcgagggcagagcggagaacaggggcuagggaaagcauagcacagacagggcuagggaaaugauccggaucccguagaggccaccauaaauagaccguguuucucccucacacuaccaaucuagacugggauggcgaccucaccuggagcucaaccugcaguacuuccaaaaccaggcggcagauccuccuuuguacgucguccagcgcagcuuccacuggagcuaagaccccggaagcuuccccguccggcagcaggaccgagaccgaagaucuggaccaaaaagugugacuucaggaccaaggccaaggcucgcauggcccucuaggauucauccacucuggcgccaccuugugguacagugucuggugggagcuggggcggaaagggcggcucugaauuuaugaagggcucagguauucuguaaggcuaggaagaguaugcccagcggacuugccucuaauguaaccucaaguuaaguuauucuuccuuuuauuuuguuuuagaggggagcucuuaaaagaguaaaaauuccccgcauguaugucuguccucucugcacaccaccaagagcauaacacucaagauaagccaggccugguggaggcugacgaaagaacgacugcucuuccgaagguccugaguucaaaucucagcaaccacaugguggcucacaacuaccaguaaugagaucugaugccuucuuc

SEQ ID NO: 4709 - RNA, 1859 nt, Mus musculus
gaagaaggcaucagaucucauuacugguaguugugagccaccaugugguugcugagauuugaacucaggaccuucggaagagcagucguucuuucgucagccuccaccaggccuggcuuaucuugaguguuaugcucuugguggugugcagagaggacagacauacaugcggggaauuuuuacucuuuuaagagcuccccucuaaaacaaaauaaaaggaagaauaacuuaacuugagguuacauuagaggcaaguccgcugggcauacucuuccuagccuuacagaauaccugagcccuucauaaauucagagccgcccuuuccgccccagcucccaccagacacuguaccacaagguggcgccagaguggaugaauccuagagggccaugcgagccuuggccuugguccugaagucacacuuuuugguccagaucuucggucucgguccugcugccggacggggaagcuuccggggucuuagcuccaguggaagcugcgcuggacgacguacaaaggaggaucugccgccugguuuuggaaguacugcagguugagcuccaggugaggucgccaucccagucuagauugguagugugagggagaaacacggucuauuuaugguggccucuacgggauccggaucauuucccuagcccugucugugcuaugcuuucccuagccccuguucuccgcucugcccucgcgccgguggcuauugaguucugaguugcuagauggugugugugagcagacgucgcacuucugccaggacuucuggcgcguacggaagccugguguucagguagggcgaggagaggaaagcuggggaagggguugugcuggugggacccuauauucaaacugauuacuguccugcagcugcugcuggcagaggcggaacgaaccgugguguuacaauaccuaagggcucugaugcagggccgccuagugugccgcgguacggacgagcggagccaggcggcugagcgacuucggcaggaugcugcccagcucaaagagcuuuuccuugguuuggugagagcucauugggagggcagacagucgaggaucucuguaguugggugggagccgagggcccgcuggaaacccuguucccauguguucagggccuggaagagagcgcucacugcgcgcccguccugcucgcgcugagggaacugcucaaccuccacgaccccacacugcuuggccucgagguggcaggcuugaggcagcaauuucccgacgugaggugcgaggaaggggacaggggaggaacggcccaggaggacgagggagggcugggcugacgcacguggugguauuccugcagcgaggaucacgucucugcccucuuggaccugcgcggagacgugucccgagagcaucgucaggcagcacucaguucgcugcaggcggguccaccgcccucaccguccacuggccgccgggcgcucuucagccugguaccgacgccuacgcccucccuguccuccugccucccuucaggucccugcuccugacacccaucuguuugcguaauaaagccacgucuacgacacgucugaaucuauguguugggggcgcgccggugaaagcaacagugcaauuagggguccgugcacagugguacaucuauaauccuggcugaauccuaguauucuggcagcaucucaccuaugcagacaucugcucucuuuguggacugcgugccccgaacccugggcucccguggaguacucacuuccuauguaucuacuaccggcaagcaguaaaugguuucaucgcccucgccagucgcuuuagaagcgcggaaguuugaagagggggaagucuaggaccagacgcgguccagg

SEQ ID NO: 4710 - RNA, 8859 nt, Mus musculus
cgauugcgcucuuuaccggaagugcaugugcugccgauguggugucuacugacugcaguuccaguuacucgcccuuguuucaguggcugggugucugcugcgcaccauggcgguaagggacaaggcguggucugcaccggcaaagcuuucccgauguugggaaaguaaaaacagaagggcucgaaggcauaaggcacugggccagagaggggcgccacccaauggacugugcuagaccgaacgggaugcggggagaguggccgugcaggacuacaccaggacuaguguuggaggcuagggcgggcgcgggcgaggguaguugccaguuccagaucuaaaccacuaccccagagggacgccauuaaguuccgcuggaguuuucccggagaggaucucaacccaaagcugaaccuuacgaggaaagccaaagaagauacuaacguaauuugaauuguuuuggggugagcauuaggcgaucauaacuggggguacaguaaagucgguguccuaacuauauuaggaagauggacuagaggaguggucgguaucucagggauugcuaggguugacaaagcacgcuaaggacuuggcugcgggguagauaaagcugcagguaaccaggcugguacagggagugaggaggacugaggcaaaacagcucugacagcaucucaccaacccuccgcagcccaaaggaaaaguggguaccagagggaagaaacagauauuugaagagaacaaagaaacucucaaguuuuaccuucggaucauacugggagccaacguaaguugcuugccuugugcuuucucugcccucucauuccuaucugauuaggagcgcuggcaaaugacagccaaggcuccaaaagagaacguuguaaagaaaugaagccaggcagacaccagccuguaaucccugcaccagggaggcucaggcagaaagaugggcgguuugaaguuagcuuugaguaacaaagaaauccuaucucaaaaaaaaaaauuaaaaauaaaaauaaaaaggggugaugggguuaauaagugaagcuggccauaguggcauauaacuguauuucuagcuauuuggaagacugaggucagaguguugagugguaaccagagccccacagaaagacugaagucucauucgagagagugagagcagguguagcgccgugguggagcccuuggcuaggcucugccagcaucgccagcaaacacugcccuccuccccccaaaguauccagggacugaguggucagagcacuugucgcucuuacagaggaccucgguuccacuccaggggcaccacaugguagcucgaaaccuucucauugaguggauccaaugcccucuugugaccucuaugguaccaggcacagcgucaggcacauggugcacauagauacauugcaggcaaaaacacucauacauguaaaauguauuuuaauuuuaaaccauuuaaaaaaaaaaaguagccaggcacagaagaaauaugaacuagacauagaagcaaaacaugaagaaaugaaggggaaacaaagcaaaacaacaauaaauaaauaaaaagucccagcugagauuuguuauacugaggccauaccaagcuuauacauguuauacuaaggcuacucuuccuggacagauaugagucuaagcgcuaucugacucagaaagcagaggucuuccaccaccagguuucuuccuccuagucuggcccaguucucggucagaguugaggaaagcccauaauuugcgggguggggggcuggccuucagcccuaaccugaucguguuugugugcuugcaggccaucuacugccuuguaaccuuggucuucuucuauuccucugccucauucugggccuggguaaguauccugggaaaggagugugcacgcgcgcgcccgugcaugaauggucaguggugccagccugugacauucucacucuuguccuacagauggcccugggcuuuagcuuggccguguacggggccagcuaccacucuaugagcucgauggcucgggcauccuucucugaggauggguccuugauggaugguggcauggaccucaacauggagcagggcauggcagagugagugucccccaucgccagcucaggugagcggccccagggcuggggcgcuggggcccacacagcccaagacucacaacuaaacaguguggaaggggcaggccuuagggccaacauaccauccuuggcagccucccuuuaucccgcaggcaccuuaaggaugugauccuacugacagccauuguucaggugcucagcuguuucucccucuacaucugguccuucuggcuucugguacgugggcuggagugcugggccuccccacugcucaccagucuuugcgaguggccucacguggucuuuucucuccuaggcuccaggccgggcccuuuaccuuuuguggguaaacgugcugggccccugguucacagcagacaguggagccccugcaccagagcucaaugagaaacgacaacgccgacaggagcggcggcagaugaaaagguuauagcauccuuaacugaggcuguaggcugcugggcacugguuggcucuguuaugcugcguggccccaugccuggagcagugagggccuaguuuaagggccaaagcagccuggauuauaggaucacuaaauaaauaguuucgaauguggcuaacggccgugugggugaugaugcacgaagcagaaagaauuuuagucucgggaugcuccugucuuggcucagcaaggcagagaucuuuaaagaagagaaaggcucuuauagauuagcuagguaaacuuuauuuuguuccaaauaaggaacucacacaugcaaaauacauguacguguauacacacacacacacacacacacacacacacacacacacacaccuaauacuguucacaauacugguuucuggguauaagcuucugaaaccagguuucuguuccaggcccuuuccgcacuccaucucuugugcaugucgcugucauguccaggcgugguagcaccucacaccucuagaccaggagcuuugcuuagucccagugccugcaccaggucaucuccaaguccacucuucaguguccgucucacugcagggacagagcaggguuacaggggcgggagagggggcaaggggagguauggggaacaucuugcagcuuaguaaggggaugcucacaggacuuucgguugccacgagagcgcuuccucucccgagcagcuaaggcucuaggaccgcucuugguaacugacugcaccagcagguccauuaucucaucugacgugucgguggguaagccggaggcugcagucuccucaggggaugcagcggagggccccacugcugugugugagacgggggaacugcucuggaccauaccuaagggagagagcagagggaaaucagacaaagguggcuuuagaacacauuccccuagcagcagcugugagcccuaccucugcugcgucggcuguguguggcaucuuccggccugcugguaagcaggcucuucaugcuggcaugauugucaguaucacccugaccuggcccgcugcccacagccacugggacagacagguuauugggggccuccccagccacaccugagaacuucucugucuagacagggaaagaagggugguuaagagcaaggggaaggaaccaugagguggcaggcaagcccugcaagggggugggcacucaccucgguaaucaugcgaccacgggucuuguugcgcucacgguauguagcccgcuucugcugcugcugcaguacccguucccgacaaguccgauacucaagggcaaacucucucaguguguggcagaacugcaugaugcguacaucccuugcugccugugggguguagcccagguagagcaggaaggcauggaaccuaggcagguuggaaggagugggagacuggaucaugagucuuccugguguuuaagggauggugguggcaguccuaccucccucuggcuccuggccccaccuauugcagacucggcgaugcacuacucuuaacauggcuacccggcggguacacugggccaagaagugggugaggcgagcacgcagagcuggggagagcucgugcuuagccaagcuccggaggcuguccucggcagccuggcuccggcacuccagcugcccuagguucucagucagcuguucaaaguccaccugaaaagcaagaggguacaugucacugcuugaggccugaaugccucauguuagcacugccaugccuggccugugacaauaaaaggccaugucgcagcugugcccggguccaggcuggauaguuugguugacaguguuuguucauuguaugccugggcaacuuagauccugucucagaaagcaaaaaugugggcagugguauagcucagugauguagaacguuugcauuuauuguauaagacucuggauugaggccccugcaucaccaaacaaaccaaaaccguagaguucaguacaaugacauagcaguccauugcuucaagcaaaaccagaacagguuacucagaagaaguggcaaguaaauaggcccagagaacugaauggcuguguuaagcuauuaaagcccaccggcagaggauacagcgcauacccacauccugaggaaacuggggcagcagcccagugagguaggaggagaaggggucacccccaagaagcaaugcccuguuguauaucagccagucuuaguggaaucacugccugguacuaaccuuggcacagcgggugagggcaggaauuucugaguagaggucagaggaaucaggucgggucuggagcaccagggagcagagaugauagagcaaugacugccgucgcacuguguccuucacuucugacaccuucuccagguagcucagcucaaagccacugcucugaaaggacccugucucagucugguccuagcuggauccagagccuggaccuccaguccccaagugcucucucacuuaccugggaaccauugaggaaguugcccacagccaaaaggguagccagaauacagcggaagguggcauuguguaccagcuguuccaugcccacuuucagaucaaacaguggcucugcaauuuccuggugugagggacgaggagccaucaggccacauggucaucacucaccuguucuuaccaccccaucccgcuccaugacccgcguacccgcuccaugacccgcguacccgcuccaugcuuucccgcguacccaacuccaugacccccgcguacccgcuccaugcuuucauaguccagcuugaaagcccagagcuguaggcgcgcagccaggccuccaauggaagcaagcgucaucaggaaauucucagcggggccgagggguacaucgggguuagccagcugggcuuccucaaucuucugccgcucuuccuccgugggcaucauugucagcaguuucugaaggugcagccaccgccccagaggcucaggacugaccugaggccugaccucgucuucuuaccccgcccuaggccuuccaggggagcccugaguuugggagaaugcuuuacagaaauggcaggccugugcccaccgcuggaaggacuggaagcucuacugaccaaagggaagagccagcauuucccuccuuauccuuaggguagccccaccucaaugccaucuuugcugacagcaaacucaucgaaguugagcagggcagccuugaugacgugcacggguggcagagugguuaggccaauguugauggcauugcugcgcuugggguccagcacuacggucauuguccggcggcccucaccagcuuucugcaagguugggagaauggcauuuuaagaaggggaagagggagcugggcaugguggugcaggccuuuaaucccagcacuugggaggcagaggcaguuggauuucugauuucgaggccaaccagggcuauacagagaaauccugucuugaaaaaccaaaagaaggggaagaggggcuggagagauggcucagagguuaagagcacugacugcucuuccgaagguccugaguucauuucccagcaaccacaugguagauacaaucaucuggaaugggauccaaugcccucuucugguaugucugauacauaaaauuaauaacuaaaucuuuacaaaaggggggggggacuagcugggguagcaccuuaagcuagcaugguggcauacaccuuuaacuccagcacucaggaggguaucugugaggcuaaggccagccuggucuaaagagcaaauuccagacaaacaaggccacacaaagaagccuugucugggggggauaaaaagagggcacuuaaguucucugaauggccuaaugaacccaugacuggagauaagagauacacagccugggaauggacuaauaauucucaugaggguucugcuuacucagagagaaugaguuuccuuuccuugccgguuccccauguagggaaggaagcauuagcucuaauaacucggcccccucaacucccaguucaugcccaucaagcccauuuaccuugguugguagcacauccuuggcucuggacucaaauagguguuccaggcgggcuguguccaccgagacggguuccagcgaggcccacaggguaggacaaggcccaaagcggcuucuagagcacccagggcccccagucagcuuuaguucccgccagaaaaguuuuacugucuuccuuuugguggggugccuugggccgucaagugcugaguggguaaaaggagcagccagggguggaggcggugggcaggagccuaugaugggugggggaggugggggcggagguggagggcaggagccuguggcggguggggggagaggugggggcggagguggggggcaggagccugugauggguggaggaggugggggcggaggagggggacccccagagagugagggcgauagagaugacaggaagggagaugcuuuuccagccuccacagauuccacauucaguguguccuggucuucauccuccccuaggucugagaaguccaaguccccaaugcagagcuuggggacacaggugggaggcuccuggauaggcucagccuuagggcuugguggugacacuggcuucuugggcucuggcucaagacuccgcugggugcgcagcaggauucgggaaacagggcucugggguguccugggugcagaggcuggcucuggggagucccacaguucccuugugccuaggaaaaaauaaagugacugucagccgcaggcccucuguggggcacuaaagcaacaugacagugagagacaagagggaugguucagcuguuaagacccugaguucagcucccagcacuacuccugggugguuauaaccaagcacccagaacuccagucucagagcgcuaaggccccuuccccauggauacacaaaugaaaggagguuuggugguuuguuuuuaguaucucuuaaaaaacauuuaaugugccggcuggugguggcacacaccuuuagucugcaggcaggcagaucucuaugaguucgagaccagccuuguuuacagagcaaguuccaggacagcaaaagcuacacagugaaaucuuuuuucuuuuuuuucgagacagaguuucucuguguagcccuggcugucuuggaccucacuuuguagaccaggcuggccucgaacucggaaauccgccugccucugccucccgagugcugggauuaaaggcgugcgccaccaagcccggccuuacacagugaaaucuuaucucaaaaaacaaacuaauuuuauguauaugaauguuuugccuuuauguaugucugugaacuggugcaugcccaguacccauagagguaauaagcuauaaaauuuuacaaaggggggggagggcuaugaguuugaaaaagccagaugagggauacaugggagaggggugaaaggagaaaagagaaggagaaaaugauauaauuauauuuuaauaaaaauguaucaauugguggugguuauaaagaccuuuaaucucugcaauugggaagcagaggcaggcaggucucugaguuugaggucagccuggucuacagagugaagaccaggacagccagggcuacacagagaaacccacucuugaaaaacagaaacaauuauuaagaaggcagcaugggauuuccccaaacuagaguuauuaggcccuugugaacuuccaugugaguguugggaacccaaugcaggaccucucucggcugccaacugagcccucucuccgguccccaggguugguuucuuuagcggcuggauucugccugagcaucacccaccugaugauccaucagugucaucuaccguggcuccagccagcgucuccgcucggccuugggccagagcagccugcuucuccgucucugcugccgccacauucuccaggaaccgggcucugaagagagaggcaugucaacgguggugucugacccaaguccagcccaggguggcacacaugccuugcugagccacugggcacugcccucaguugcaagcacacacaggcacgugggacaguccaugcacuagguauaccucugccaacccgccaacccauaucccaggaguuacaaccaacucgcuguucuuggucaaaguacagaaguucuacugacaucuaacuugaaaccuuguuaaggaaucuauguucauugucccgauucuaaauaagauccuuagaguuagggaaggagauaguugucccaacaggcacaacagacuucuuacaggccugucugcuuuugggaguuacaguggagaaaaggcucuguuaacagugugcacucaauuuguguugaaauauaaaugcuaccu

SEQ ID NO: 4711 - RNA, 21626 nt, Mus musculus
ucggauaaucuggguagcugggccacucucaagggacgagaugggacuaauugcuagcuugaaagacaaaugaaagcauuucucucauuuggggaaagcaguaagaagaaucucuuucaauguggaauaagaaguggaaauagauuuuauauuugaaagaagagguggauucaguccccuuuagcugugggggcaaaaaaaaagaggacgggugcucuuucucgaaaaagaaugggaugagucacugugaggaggcagguagcacauguuuuuucggcuugggugaugaaugaaaaguggagacauucuucgguuuggggcgagaugagucaaaugccccaaguuguuccuaauuuaaagggaauuccauaagguccucucagauccauggaauaggcaaacaguucccuguaguuugaaggaaagggaaggcggcgccucugggcucuggagagaugaggaauagccagcuuuucagccuggaaagagccggguccgucccggccuugagguuucuggguacguugagagcaccguuguccauuaggcuuucugggugugcccagugcgcgugcgcagcugugguccgguaggggggucccagguuuuggagaucgugcuggaaggcggcagcgcaccgcccccugcgguuuucucagcuuagcacugggacccgcagccugagcaccugggacggguggcccgcugcugggcgguguucugcaguagcugcgcuugucucugcuucccgagacccccguccuucuuggugcuccgggacgcgguggcuggucaccuuucugaauccggaggagaggcgguuuaggagagcacacucgaaagaguggguuucaggacucgagggguuaggaggguuaugcuggggaauuuccggagaugagauuaaccuagaagagauggaggaggggauccuaacugcuaggauccugggcagggucucgggguccggaccuggccuggggguaucggagcucggauuggggggagugagccccacgugccugugacgcgggggcgccggguaggcggcggcagcggcggcggcggcggcggcagcgacgcggggccggcggccgugcagugcccggaggacagcaagaugcugagcgccgcacugcuucuucugcccggguugccccuggcgggggcgggggccacagaagaacccacccaggaguccgggccguugggugagccuccuccaggcuuggcgcucuuccgcuggcaguggcacgagguggaggcgcccuaccugguggcccuguggauccugguggccagcuuagccaaaaucggugaguguguguguguguguguguguguguguguguguguguguguguguguguguguucgcgcgcccgcacgccaggcuagcggcccgcagaggacccgcccccaagccccuaggucuccagauuugcgucuugcauugugcggggacuuaggcuccaauuccacaaaucuggguucucucccauuuccugcucucuugugggucucccuucuugguugguaguucaggggauuugccuuccuaagagcugccugucgccgcucuccucucaccguuccauccuuagacucuuucccccaguuuccccuuccccuugcaguuagcucuccucaauaaacgucaguaaggccucuccuccagacguccagcuucucagaaaccugucagcaaugaggacgcaaggggacacugaagggaugauauucuccuggaaacccuaggcauucugguucugagaaauuuuccugcccuggagagacggccaagagucugagauuuuaauaucuccugagauagcuaaaaggccacuuuuccuauagcauaucucucuacuccacuuaaagcuguugccaccuucuauagcccauuugcaaccucacccuccaauucacauuccucuuuucgauguuuaaaaaacuugcguuuauuggaucuugacugugugcuggcuacccugggugcuuucauauguucucccucuuuccgcccucacauugaaggcugugcuucagguucacacauuuuucccccaucagagaugcuuuuccuugccucuccccgcuuucuggcagccaguggucccuccuccucgauggagacccuccuccuuucucacuguuguucaagcucugcugugggggugacuaauuauagcugagcgcugcuacucacucuccaucuaugcuggcacagcuuguacuccagucuccccagugaaaccuucauguaggaaucccacagccuaguguuugccuccuucuccugggauauugcuggggguauagaacgggaaauggagaugugauagaacucuccacuccaccuuggcagcccucaauuaauaauggagcucuaaguaucuucaggggaccugauucugccagagaacugauuuuuucguaggucguggguuugcagggauggggaugggacaugcucagggaagaaggaaaccagagauggggcuggagagaggaggaccugugucugagcucaccuuagaggcccagcagcaagguguagaaagcagcuucaacuuggaguaaggacugcguuuguggacaagcccauggguuguagaacagccuucucuuacuuaaaguuuauagcuuuaaacauccuaaauaaacagugccuuuucuaguuuggauaauaccuccuacagaggaagacaaugaguccucuccagcgaaaaaggaugggggggggcgggguggcauucacaguauucuggaacaccuuccaguuucaaaacuagaaugcccuuucauuccauacauuuccuuucauucaguacauauagaugcagaguccccuauguucuagauaagauguagggccuuugggugcaguuuccaaagggccuugcuuuggcauaagcuuaagguuaauaaggaucuuuccccuaucugcccgagggacugggccauaugggcuguguccaacaugcaagaacccaagggagaaccauauuagggacaaagguaggagaagcaauaaugucagaaauccuuuucuuagacccucuuccccuagagacagauauguuucuuuucuccagagucaaauguaauuaauauuuguugagagccuacugugugucugacaccaagcuaggcacacuugcccaucuuguauacucugucccugcccuuugcgauggauguuuuucuuacgccaaaggagagaaacugaaguuuagguagaucaaagaacucgccugaugguuuggagacuugggucaguggcuaagagcaccuccgguugaggacccagguucaguucccaggacccacauggcagcuaacgucagaccauggcucaauuuccagaggaucugugggcuccugcacucaugugguacacaaauacacguuauaaauaaauaaauaaauaaauaaauaaauaaauaaauaaauuuauuuccuaggaucacaucauuagacccugauaaggucaaggggcuuugagaucugacugcucucugcaaagcuugcucggucucucucucucucucucucucucucucucucuuccucccuuccuuuccuucuuucuuuauugagacugagaguacuauacagcccuggcuagucuggaacucacacgcacaggggucugccugccucuacuugcuuccugagugcuggccuuaaagcaugugccacgguacccagcuacagaaagccuuuuaaacugagcuauugaaugaaauauguacauuagguugagaggcccaaggugcaucuaaaaggagcuauguguacauauguuagcauagauuggguuauauuaauagcaaagguuuauugaguauuuacuauaaaucaaugugcuaagugcuuucuuuuggggugggggggaggguagggggagcagaugagaaaaagucuugcuacauagcccagguuagcccugaacucucuauauaaaccaaguuggcucagugcuuaaaaaaagaaaaaagcauuggccguuccuguagaggacuccaguuuaauucccagugcacacgcagcaacugacacauacaguagccuguggcgccugcucuaggggaucugacacccucucccggccuaagacaccaggcguauacaugacacccuuacauacaugcaagcaaauacucauacacauaaaauauaaauaaaugaaucuuuuuuaaaaaaaaaaacccuacacaauguuuaccuugaacuuacggccguccucuuaccucagccuuguaagucucaggaugaccaaugugugccgcuguacuugauuuuucugcccccaucccguugcugaagauugagucuagaaccucgugagugguaggauaugcccugccguugaaugucuuacagcucagcugcauccugaccuuauuuugagagaggguugcuacauugaucauaggucuguccuacuaggcccugcucuaaaugcugaaaaacaggguguuuuauuuaaucuucccaaccauccgauuugaucguuauccuuuucuuccuuucuuucuuucuugguuuuuguuguuguuguuguuugguuuuuugaggcaugguuucuuuguguagcccuggcuguccuggaacucacuuuguagaccaggcuuggccucgaacuugggaauccuccugccucugccuccugaguccuaggauuaaaggcgugcgccaccacgcccagcuaguuauccuuuucauucccauuuugcagaugggaacauucgagagucaaaggaugagucuucaaacccaguccgcuugauuuuagaggcccugauuucuucuucccuagcaauccuauacaugauaugauauagagagccuguuuagcauuugcuaaacgucagaccacuuguauggguaaaggaagucagggaaagauaaggucagucccugggaauggcaaugcagaggagggggcauuuucaggaaggagggguaggggaggcaagaacagccuugcggccauggaggacuuguggccuuggagucggagauucuguaguucuucccuugguccuagggccagggagucuaacuuuggguaaacugcuuaagacaaaguauuccaagccaggcugugggaggccaccccacggcuucuuucuuaccuguugccuccuugcauuccaguguuccaccugucccggaagguaacaucucuggucccugagagcugccugcugauuuugcugggccuggugcuagggggcauugucuuagccguggccaagaaggcugaguaccagcuggagccggggaccuucuuccuuuuccugcucccucccaucgugcuagacucaggcuauuucaugcccagccggcuguuuuuugacaacuugggugccauccucaccuacgccguggugggcacacucuggaaugccuucacaacagguguugcccuuuggggccugcagcaggcuggacuugugggugaguaacccuagggccuaggcuguuuaaaaaaaaaauuagaagucuugcuagcuccauccccuaagucccuucuccagccugaaggucagacgcacaaguccuguucccugggagcucaguugcagguccgacucaccuggagugaauggcgguccuccagauaggcuuuggccuuaauuuuggucucugccaguuggcucugugccucugcagcgugacggcugaucaggggccaggcucccagcugugugugggcugcuagagcucaggaggcugcaguagcacucugugcucuccugcccucugucacaacacugccauuugccagcccugcaaggguuuauaguucuaggucugcuacccaagcuaugccaggugguuuccaguuuuuauuucuaauaagugcauauuuuacauccacaaaaugcuaacugguauaaccgggcauucuuuuguauugugucuucuuacuaccucuggcaagguagaauguaccucauuuaauggaagagaaaguagagcccucuggguucguuggaaaucagggccugugcuuagccuccguuuuauugagacucugcauuuaggcccucucccaaccucuucuuuauuuccugucauaagaaauccauucaguccugauauuaaaucagacuucauuuaagguaaaaaaggagaagcuugcaauucccagcuggaacuccagucucguguucuuaauaaaaagugagcuauuuggggcaggaaaugaagggaggaccucagauucuaagcauaguaguaauucuaaauaauaacgguacuggugucuuaccguguguuaggcgcuaacuaaauaaagaacauuuugagauugauaucauccccauuuugcauauggggaaacugaggcucacgggguuaugggacauacucaagucccaccuaugguacuuuucuuacugcaauccggccuucugauccagccuuccuuucccucugagaacuguguacacagcacauccaucuguuggcugagaacuacaggugugggacaacccauguccuguuauccuggguaauaaagccagccaauucuaccugcugucaacuacuuuuccuuuuacgauugcugcaguuuuauuacuagcaccugcugaaugguuuugcagccaucuugugaguuaggcaaagaaagaguccuguuacaacaacaagagcccaugucacagcaacuggugaugggcaaagccaggucuuaggcacacggcagcucaagcccguaggacacaggcccguucccccaccuuuccaaacucccuuuggguuuauuucuucccaguaggaaagcuuguggucuugucaccggaaguccugucagagacagagucaucuucaucaaccagcccuauuaucuucuugucucucgcuggcagcuccuaggguacaggcuggccugcuggauuucuugcuguuugggagucucaucucagcaguggacccuguggccguguuggccgucuuugaggaggugcaugucaaucagacccucuuuaucaucaucuucggcgagucucugcucaaugaugcaguaacugugguaagaacaucugguggcuugcugaccccugaccuuaggcgugaccgggcuuagaccuuuccuccuaguccccuggggaggaaaugucugagcuuucuucuguucccgcccacuucccccguauggcccccuccuacuuccugucuccccucuugucacucaggugcuguacaaggucugcaacuccuuuguggagaugggcucugccaacgugcaggccacugacuaccuaaagggcgucggucaguauuucccccaacuuggccugcauucaaugucugccuucucuggauuguugcgacucacccagccagcguuugggacagaggaggcuauuccgaugucucauuccuuccucuccucuauggagaaauggggucugggaggagcuugccuuggaauucuagucugggauccugagccccagggaguguggugggugccuuccucucuauuucuuacugggcaacagacuuugucagcccagcuuggggagggucugggccaggggucgugcugacaacccacuccucccccagccucccuguuuguggucagucugggcggggcagcggugggcuuagucuuugccuuccuccuggcccugaccacacgcuucaccaagcggguccgcaucaucgagccguugcuggucuuccuccucgccuacgcagccuaccucacugcugagauggccucguuguccgccauucuugcgugaguccuggggggcuaucacaggcaggcaaaccgggaaagggagagucaauacuuuacgugaccaaacgcaaggucuuugggaaccuguaggccucauggagcccuugugguagcggacaccucauacucucuccucagaggacgcaagccucagguugugcucuagcacccagaauugucugagcaccugaaggcucacacuuccucuaccugaagugcagguuaaguugccagcauacuucaaggcccaaaaccacugggugguauggguauagcacuccccagaggguuuguuagucagagcaagaggcacuaaugggaaacccggagaucuguauuuauuccaggacuaccacuaacuaguaaucuucaugcaucccugaacuuggacaugggacaccugauacccugugaugggcagcacccccuccagcugcagguucaagccgagagggacugagccuucgggacccucccucaucugcacuuugucccucucccagggugaccauguguggccugggauguaagaaauacguggaagccaacaucucccauaagucccgcacggcugucaaguacacgaugaaaacacucgccagcugugccgaaacggucaucuucauguuacuuggcaucucggccguggacucuuccaaaugggccugggacucugggcuggugcugggcacccucuucuucauccuguucuuccgagcccucgguauugcuggcgcccucugcuccccuguccccuuccuuuccccucucgccgccccucauccccucaguccaaguucacauccacaucaauucccaugccuccccgcagcgcucaccuguccugaccccugccagaccuuagcccagaugcuuggugccgggcucccaguguccuccacucccaacuccuugcucccgcuggcccucccuccugcuguaggcguggucuugcagacgugggcgcugaaucaguuccggcuggucccucuggacaagauugaccagguggugauguccuaugggggccuucggggggcuguggccuuugcucucgucauccuccuggacaggaccaaagucccugccaaggacuacuuuguggccaccacuauugugguggucuucuucaccgucaucgugcaggugggagcgcccaggaggcuaggcggggagagguucagcaggcccugggagagucuuggaacacuuugggacagggccuuucguuuccaccgggggaggcagggaccugacuucccaggcuuugaaugugauauaacugaggcccaauuuuuuugggggggggugggggaaggcagcagggaaccgaacaggacagggcucaccucuugccuguccguaggguuugaccaucaagccacuggucaaguggcugagggugaagaggagugauuaccacaaacccaccuugaaccaggagcugcaugagcacguggguaccagagccccauuccccuccccugccccucucucccuccuccuacguuggcagaguccugaugcagucccccuacccacccccauucuagacuuuugaccacauucuggccgcaguggaggacguuguggggcaccauggcuaccacuacuggagggacaggugagggagcugccccaaggcuccuucagcaacaguggccccuaucagccagggcagcaugggagauaugccacccuucugagaaggggacgcagccagguucaggcugcgugaccucugccugaagcccuucaguggcaccccaguguccucaggauaagauagagccccccaccaggguggccugcuagacgcugcauggucuggcacuugccagacucccgcccuguucuguucuguucuguucugcguuugguggucugucugauaauuacacagacccuauuuagaacucagagcccaccaugcaguccaagccuggccacuaagaccacuggauguguugucuaccagaacccugccucaccucccucuuagcuuagcuuugaaucauccuucagaccuaaccacgggcguugauuccuuggagaccucuggccucucugacaaggacaaauccccguuauaauuauccuugguaguuuuuuugucaugguuauaauuuuuuacaguuauuuuaaauaacuuuaacuaaugacagacucucuccugaaacuguaaaggcuguaagaacagggacuagccuugagauucuccuuagcugagacucauaccaagaaagccaggccagugcuggcacugucccugcccugucuaggggaaggggcagccagcuacaccgugaggguaauacucaggacugggccuggcauccucuauaggugggaacaguuugacaagaaguaccugagucagcucuugaugcggcggucagccuaucguauccgcgaccagaucugggauguguacuacagacucaacauccgagaugccaucagcuuuguggaccaggugggccaagcaguuaccagguaggccaguggcggcuagacagauggucagcagaguagggcuguaaggaacgacaggcaggcaggcuuguuagcaaggaauuagccggaauuuccagcuggccccacggugucgugaagucacagcugcaggggcaagccugguagugacagagucuggcaggcuuguacaagaaggugggaaacagcugggugcugaagucagcagacacaguucagccauuaucacgggugggcugauauuuggauaaguuacuuacauugccugggcuucaguuuucucagugaggggaaaguaaccauaaggauggaacugcccaggcccgacucugagaauucagugugaaguguuucagugucugcuguaacaaauaacaaaauaaugcccguggguauagcucaacgguuuaccacuuguguagcauucaagaaccugggugauccccagcccuggcucaaaacaaaaguguucaaaauaauuguuaacgcuuguaauucuuuuuauuacucucugucugggcccccuccucaucugacccuugucugaccucugucuugacuccuacagggaggccaugucuuguccuccacaggacucacucugcccucuaugccuagcagaaauucuguggcagagaccucugucaccaaccuguugugaguccacgagccgcucccucuucccuucccccaagcucuucuccccagaucccucuggggagggacgugucaacaccuugccugugcccuuccccucaccuguccugcccaguccucagcacacuuaucccugccucccacaggagggagagcggcaguggagcgugucuggaucugcaggugauugacacggugcgcagcggccgagaccgggaggaugccgugaugcaucaucugcucuguggaggccucuacaagccacggcgcagggugagggcuugcaggaugugggaggaguucccagggugguggggaguggaugguagagcccaugaucggagacucuucgggcauucgguuguaaugaauugaauugaaagcugaacagguugggacucuagaagggaacacuuuggacucgaaacugggcuuuaggaaggagaggagcacccauggcuaaugucccugaggggagaggaagagacagaggacagggagcuuugaggaugcaggucaaagggaagcagggaccugagaaggccuucggaaucaguuuaaggagagagaggcggguuaguccugugcaaaaucaggcagcuuuggagcuuugaggguggaaagguccauccuauccaggagaggaucuucuauaaucccacaagggggcagcaggucacuauccuggaccuuuugaaguaggaaucuugacuguuacucauggcugcacuacagagaacacugagacagaauuggcuggauuugggagcaccucccguuaguuuccaguucugcagaauaagaugugcagguggcuuuacucagaccccacccccccucaccccaccccccaccccaccucgcagccccuucugccucugguguguguuugcccaugagaagccccucccccaccccauggaagagcugcuaggugauugucuagggcaagugacaggggcucccucauuuuucuauucuggacuugcuguuucggcugcccaggaccccugauuugguucaccauauuguccucacauucugccagaccuucauauaguggcuggcaaacccaccucaucccaaguuuucuuuuccuuuuaauguuuuucaugugcaaaauuuuaguagcgagaacgaaauaagucacuuauccauuacccaacucuaauaauuaucugugcgugauuaaauuuuuucacuccauaacccaccacacccugcccacacuuugucuuacagcagacuccagacaucaucugauauuaucuauaaauaucucaguauacggcaagaacucuuuguuucuuuuauuuuuugguuucuuuaagacagucuugcuagccgcccuaggacuggcuucaaauugggggguccucuugccucagccucccaaaugcugggguuccaagugugaagccaccacugagcuggcaagaucuuuaaaacguuaggucaggcugaggauauuggacaguaguagaacguuugcuuagcaucuaugaggcccugaguuugacuucccccacugcaaaaaaaucaaguuaaaucaaaucauaguauuacuauuauaacauaauaauuccuuauagcaaaugcucagucacuguucaauaaauaucuguuuuuuccuagcugguuugcauagcucaggauccaaaugaagcucacaauuuaugucugggaaauaugucuuccaauaagacaaaccuauaacaguuuuucuuuuccuccuugcuauuuauugaagaaacuaaauucuuuauauuggaggauuuaccauuuuuucuagauuuugcugaccagccaaguguuauuuagcauauuacuccauuucuuauauuuucugauuauuaaaucugaagccuggcagcuggagagauggcucaguaguuaagagcacuaacugcucuuccagagguacugaguucaauucccagcaacuacaugguggcucacaaccaucuguaaugggaucugaugcccucuucuggugugucugaagacagcuacaguguacucauauacauaaaauaaauaaaucauuaaaaaaaucuggagccugaucagguccagggccuuucagguaugcuguauccuucuuacuauguuacaucagagagaguacauagaggugugcaugugugugugugugugugugugugugugugugugugugugucuggcugaugaguuggcuucgguuuuuuugcauaguuuaaagauauugucaaaugucaucuuauuuaauuucgccaucauuccaucauuuggaucccaugucuaccaccaaaugucucuuucucagauccauaucaucugaacauuugcuaagccuguuaacuuuacauccaucuaaaccaucauaaacauugaacaggauagagcugaggacagaacccuguggcaagcuccuuaagacuuucuuccaggcugacauggauggagcguuuuugggguacgguuacuugacuagcucugaaugcauuuagucgcaccaugacacagucccuaacuccuuauguucuuuccagaaacagcguuagagaucguauauagucaacuaagauauagcuuaagagagaggaggggcuggagagaaagcucuggaagaggucuccucauagagaagcuugauggaaugcuuuuggcuucgccuccuagagauuuagaugcuguaauauggagugggaugaagaggcuguguguuuaauaagcccccagauagcuccagugcagcggcucugaugccugguguuuugaaaccucacaucgugucgccugguuagcugaaguggagagagcgcauaggaucucuggggagaggguuuagagaaacagggccaagagcaauacagaaaaauauacauggaagaaagggccaggaagccagccaaggcgagaagggaccccuuagagaaggaaaagccuuggguggaagaagggcuggcugccauccagaggccucaggacuggugaccaggcaggaaguuuggauguagcguuuuugguauuuaaggaaguacuagacaggaaaauguccaaaucgauuuauaagauccuggccucaaaaaaaaaaaaaaaaaaaaagugggggggggggagaugguagugucaaugaaaggacuuuaaaaacaagggcaggagcuuuucuaaaagcagaugggaaguggacacugggauuccuuaguaaggaaagcaaaggugcagggguuggggggcguagcugagggauccaggaagcagcugagcacagcugacacagcacugccaccuugccccagagguaggguggcauuuccagcuccauagggaaaggagaaaggcagaugggagaccggaaggagcucucagaagagggucagagaaacaggaaguacaaggaauaggaaaagaaccaaagagaaugugaggcaaaauggagugaccaggaaugguccagguaguacuuggccgauuuccucccacuggagaggaagagauggcuaagcugccaacggcagaaauagguaggcugggggacuguauggaugucuuggucuuccugagaaagaguuaaacgaagcagauaaaggguugccucuguauuaaauaaaccguugcugggaccaagaggaucuaggguucagggcagauacuuaggaaaguccagagcauuggccuggugcugagguagcuguagaaaagguuagaaggaaauuagcuggcaggaggauccucuguugcuaucuggggaucgggacacagccauaaacucagaggauguggcucugugguuuuauaguagccccaggaacaaaguacaggacucccugccucucaucacuucaaauuagagagaacugagggaaaggcagccagggacuugucaaaaaaagggcaauuuuuccuuagugaacugaauacagggucucuggcuauauuccauuuguauauuuuaaauuuuauuuguuacuccauggugaacucuggaaacgccaggcuggcaggaccugugauggacaugcuggggggugcggccugagauuccuguggaggcucaggcccccagccucauggcaaggucggguugucauugccaguacaaagcuagcugcggccgccacuucaucucagaggaugcccaggagcgacaggacaaggagaucuuccagcagaacaugaagcgacggcuugaguccuuuaaguccaccaaacauaacaucuguuucaccaagagcaaaccucggccccgaaagaccagccauaagaaggugggugugacuuuucucugggauaccuccuuuacggcuauaggcugguaacaaauaauucugaguuuucucacauccucaacucagcucgaggagaugcuuuguuuaaucaccuucaggguuuggugacucuagaguuuggguuuccuuucagcccagucugggcuucagagggagggguagccucuuggcugugggggccauuugcuacccggggugaaacggacaggaaaagggcagaguucuuggcaaaggaguccuucggccaauucaggcccauguauucagagccucugauaggaaguaggucacucuaggcuccacaguuacugccaggcugaccaagaaauaguggaguggaagaccauugugauaaacgacccuucccugccacuucuagguuaggaaagcuuguucuguugacuuuugccauuucacaggguuugggaaauggggugguaaagacgguggucacacucuuagguuugcuuucugguccucagaaggaugguguggcuaaucccgaagcuaccaaugggaagccuccucgagaccugggcuuucaggacacaggcaagcagggaacugcagggagccgcagggcuggaagggagguggggaagggagagagcaggccugucauuccaauccuggaggcucuccucugggaacacuuagcgccaggagcuggggguaccccccccccccccccagggacuagaugggcacacuugaguguuggaauaguucacaucuguauagaaugcauggcagaauugaugauucagacuaucgacuauuaaggacuugggaaaggucacagagagacagacagguagaguggccugggccuccaaggauaggcggaaccaaaggcauaagguccucaaaccuaguuccuugcgagccgcauuugcuagcggaccuuccagccuugcggguguggggaucaucaguuggucugggcugacaacagaaagagccaagagguguggcccucauggcuuccucugaggacuuagcaccuuuggauugccuccuugggcaauggaaucccccaccccccaccccccaucacguccaacacucuaggccacugcccaaaacggcugaagggagaugcaggugcuucugcuuacauggcuuuuagagggggagcggggagggcaggagcugacgugagguugucugauaucaagaagcagccacuggguugguuggccugaaucgguuuucacccuuguccagcugcagugauacuaaccguggagucugaggaggaggaagaaagcgacaguucagagacagagaaagaggacgaugaagggaucaucuuuguggcucgugccaccagugagguucuccaggaaggcaaggucucagguaaugcucucccugugggcucgcuccccugugcagaugaggccgguucugguuaccguauccaaggacucacaaccaaacucagagccuuagaaccugguucagaaucacgugauacaaacgggcuuugaacuugaccuauguugucaugugguucgguucugguuaccguauccaaggacucacaaccaaacucagagccuuagaaccugguucagaaucacgugauacaaacgggcuuugaacuugaccuauguugucaugugguucaaagagcacagcccaaggaacacaaagugauaagcagaccuagaagcgagugacccaggucucuugugacccaggcuuagcacaccuucccgcacguagagcucugggugaggagguugggaggagccugagucuaucgaaacggaauccuuaugcauaaaaagcaguauucacguuucugcaccuggagaucucucuccuaauguuagguuucaaggguaguccgcacaaacgcucaggggacauuagagaaguuuagugcagaaaauuucaaaauaugaaaugacacaguagugaaacgaccucccaucugcccauguccagcuucagccgugaccugcucauagcuugucuuccuucacggauacugugaccuaugacaccggcucccaggguucguaggaagaaaaucucaaauaccucauuuuaucaaccaauaaacauacaacguacaagacaaguguucuuccgaaagacacaaccacaguaucauaaccauauauauaaaaucuuucucauaagauaccuagcuggagccaggcggugguggugcacgccuuuaauuccagcacuugggagacagaggcaggcggauuucugaguucgaggccagccuggucuacaaagugaguuccagggcuacacagagaaacccugucucauaaaaccaaaaccaaaaaaaaaaaaaaaaaaaaaaaaaaaauccuagcugggaggauucccuugauuuuuauuuguauuuguuuauuuugagacaaggucucauuauguaacccaggcuugcccagcuggccucaaacccacaauccuccugacccugccuccaaguccuggaaguaaggugugugcuaccucauccagccccuuugcagcaguuuugugcaaguaaagaugcagcauagaccacacuuuacauucaguuaauaagucccuucuaaaguacuucaggcuacacuguccaaacaucaagccauccagcucccuagagagggacaggaagaccaaggucugaccaagaacuucagcaauaguccccugcauugcuuuaaaaagcccggauaaaagaauuuccaaaauaucuucucugcaucagccacacggugucuuuccaacauugcuccuucuguuacaaugcaugaucagaagaaccuguucccagaggcuggacguucagugaaggcuuuaaguucuuucagagagaccuuaagauggcucucauuccguugggaucuauggaagaagcaauccaggcccuuauugaacuucacaaucauggucuuggagaaaauggccaccucagaguuuccuucucaaaaauccaccaucugaucuuucugugaauuuuucuccucauacuggaccaucauuucuguaaaaucuucaggcacagccugaagcaguacaagaccaauucuaucucuuucacaaaguaacucuuugggaguuugauauucaaguacauucaaaacaaaagauauuccuuuuuuucccucucauuuuccccaacaguguaugaucaaaaguuugcugugccuuuguauugugguuucuaugaaaauaacuuuuagggaaaaaaaucaggaaaauauuucuuaaauaauuuaauucccugaaucagauuucaaaaggacagauuucuuucugucuggguccagaucagcuuuacaugacuucuaaacuccucuguacuuugagaaauuuaaauauacauacuuacaauuucuugauguaauuuaaaucaccuacaaaucaaggguuuuuucuuaacuuuaugauucagaaguuucccuguagaaaaugacauucauucacuuauaaaaauuauaccagguuuauaaggugguggugccagguggugguaguggcacacaccuuuaauuucagugcucaggaggcagagacaggugagucucuaaguucaaggucaacccggucuacagagcgaguuccaggacagccagcccuacacagagaaacccuaucugaaaaaaacaaaacaaaauaaaacaaaagaauguggugggauaguaaguuugcuccauggcugaagagauggcucagcaguuaaaggcuaggcucacaaccaaaacauaaaaaauuugcuccaaaggggacuucagugaaguccagaaucuucucuuuuuuaauuaauguauuuauuauguauacagcauucuaccuguacauaugccugcggccagaagagggcacuagaucuccuuauagaugguugugagccaccaugugcuugucgggggaauugaacucaggaacucugggugagcagccagugcucuucaccacugagccaucucuccaguccccaucuggagacauuuuaaagauuuauuuuaacaaguguagugagugugucugucuauuccauguauuuguggaugcugucaggggcuagaagagggcagggaaugcccucgagcuagaguugcaggcgguuguaagcugccugaccugguccuggaaacggaacugagucuucugcaagaacagcaagugcucuugaccucugagccaccucuccagucccaaguggaguugucacaguuguugucacagcucaguagggugucucacugcuuggucagaaugagccuuagcaagauccggucucugagcugcugcugcuaacugagggugaucagagacaaggcauccuucuuguuugguuuuccugagcuguaguuaauuaccauuuguucaguauguaccuguggacagcgguucugugugcaacucucugcuagugcuaggacacaagacaaccaaagcaguccgaugcuuccucccagggagacauuuauugaguacagcacagaugagugcaauauggugaccucggguacauuugaggauuccccugcauugacaauaaacucauguguacucucucugcguucccaggaagccuugagguguguccaagcccacgcaucauucccccauccccaaccugugcagagaaggaguuacccuggaagagugggcagggagaccuggcuguguaugugucuucagaaacaaccaagaucgugccuguggacaugcagacaggcuggaaccagagcaucucgucccuggagagccuggcauccccucccugcacccagcccccgacuuuaacccgcuuacccccccacccucuggucacugaagagccccagguuccuauugaccugucuucugacccucgcucuagcuuugccuuccccccaagccuggccaaagcuggucguucucgaagugagagcagcgcugacaucccccagcaggaguugcagccccucaugggccacaaggaccacacucaccuuaguccgggcacugccaacucccacuggugcauccaguucaaccgaggaggcaggcuguagcccaggccucaggggggagcaggaguggagccccuguggggagugcucuucagccugggcagaggagccuacccagccuggacugaagugguaacggccuccuugggacuggucagaaggguuuccugggcugguccucacagggacccuucuccccucucucccugcccucaacccuucccacuuuucauuucgaaaaauggcucaggauccaguccagaguucuaagggauaggcccccaagcugcugucccuucccuagggcgucuuucuggacuuaguguuggcagcuguuccuccccacaaaccaucauucuucaguggacacugguccccccugaccuccacccucuccccugcaccaggucaggaucauugcccuggcagcgaggcugucggaggggcugguccucagagcagcugggcuaggagagagcucagucaggucagcuaacuuguggggucagccacacgaguaccacaucuugcuuuaacccuuucccucugcuuucaguuauugaggucauggugagucuuuuucuaggaccuaggcgcugggccaggcuuuccuucagagcugcuuuauagccagucuacugcauuaggucuaaaucugaacuuucugaggcuuggaucugagauuuuuuuagaguaggagacaggucucugggcccgucaccaccucagaauuuucccaaagggagaagggaccaagucucccagggccagugcaccguuccugguggagcugggaugccuggcugcaauguuugggggcagcuagcugacuaacaggugacuuucccgggguuagccccugccguguguuuuguaccuuaaacccgagauacauuaaacaucucucagaugaaugagcguccucuguccauuugucucaagcuuuuagggguaaggacaagaaggggucugccuauuucaagauuuuucaggaguagagaauaguaggggauagcuuaggcagagccauuagucccccuggucccugggcuuugccaguauuaucccacuagcaggaggcauggauugucagucuaggggaucaauguauggguuggagaagagggcgucucagaacugggaauccacaaaugggaaaggccagcagggagcugagagucuacgcuauccacggacgaagccucuaugugcaguaccacggagacauuucuaggaaaguguaagaacagcugcgagccagaugaacaagugucacucugcacaugacagguaggaauucaagcuccggagagcuggguccccugagcauuuacuagacaaaggaaugugggccuugaaauccuuagauaacagcuuuccccaaguccaguuccuaaugucugaagaauuuuuaaacacaucuuugagaauaaaauggcauaaaauuca

SEQ ID NO: 4712 - RNA, 3942 nt, Mus musculus
auccugguacaaaagguaucuuuauugaggucuggguaagaauuaggcacuuggccagagcagcagcuuaaauaugaggcaaaagcaggcaagagucagccaugccugggaccaggcuggggcggugaggauauaggcacugacucccagacagaugacagggagacaggaagaagggacacagcagucugggucagaggccugaugggauggcccugggacugggcaggaagcucuugguggcagauccagcagggagggagccaggcuuucuugcuccaugugacccuggaccccaggccugggccuccagugggacagccucccugggggcuuuggcaggugucacuucuucaccuuggcgucauaggugccugcguuuuuguaggcacucacguagccacugucguccaggauguccugccguccagcgaugcccuuucccuugccgcucucaucaaagcguucuuugugggagcccguauacuuacugguguccgucagccgguccacagcaccacccguuuuagcuuucuguuuggauagaguucccacagaguccugugagagggaaccuggcccaucccacccacccccauuucugcugagauccaccccucccccacccccacccaucuccguggcagggcuggcagggcacuuacggugacgccaauguuggccgguuccuugcccgcuaucagcuggcagauggcaucaaaggccuccuccuuggacuuccccuugaaccgcuuaguugccagcucuuccagggccuucuugaacuccucauaguugauuacucuagcagauuucgcccugccagacaccgugugcaccguaaggauccccccuuuuugacauccucccugauuccagcccccuaacgaccacccccacaccccccacuuucugaaagcaugagaaacagggguugccuggugcucacuugacuuuggagaagacgaugucgacgucggugcccguuacggccuuuccgucggccaccuuacaguccuugcacagcuuggcccaguucuugccauucaucucuugcccgcuggccuuggggucgccauggauggcaaacuuccggaagcucuccuccagcccagcuauguccgugcucgcugccaugccacccugcgaggauccgccacagucaccucccggccaaguuauucccaccuccucuagacccagaaugccccuacugccuucucaauaccugugaggugcugggcagugguggcgcacgccuuuaaucccagcacuggggaggcagaggcaggcaacuuucugaguucgaggccagccuggucuacaaaguaaguuccgggacagccagggcuauacagagaaacccugucucgaaaaacaaaacaaaacaaacaaaaaaaaaaaaccugugagguaugaguuggcagcacaucagucccucagucaggacugggaugccuaaggguuagcaccuugugucugucuaugcccagagcugaggaagagcuaugggcagaaaggugcugucgcucggugccagcccuggaugucaagagggcucagaagaugaagucaugaugcccacacggcccugggaacagaagggcacuguccugaaagacugugaugauagcagcuagggccauggcuuugucugucccuggcacaaagccugguuggguggaagugggggugguggcagaaaagccucccugaaaacuccugucaaucugggucaacgccagacaagggugguguaugggcagguauguagugagggcagugucucuguaaaggucauggagaccuagggaggcccagccucggccugacaauggagcaagagcaagggcagcagugccugcccuaggcaggggcgcagcuggcccagcccuggccuuguuacuauuugcuguuaaacaaaaacaggaggggagcaggaacuugggucuggccuggccacaguuuguggagccuggagacaguugcuaagggaggguggugcugcuuggagacaguugcuaaggguaggauggugucagggcggcuugagggagaagcucccagugcugcugggcugggcugggcugggcuggggaucaggggcccaaggguggggcauaccagcacucccuaagccuagggcacaaccguggcuuccuggccccuugccacugauugaagcuguagcuuccagucuguggagcuuaagagugggaaacgaagaaaccuggguagagacuuggacaguagccccuaaauucuuccauggggccaugaucuuggugccucaauccuucacugaggcacaaucccguugucuacacuucagcccuccacuaaggucuucuuuucacugagcgugaccacgccuguccacguucccauagcucagaugcacugagcccuggcccuccacacccucugccucguacccacuaaccauacccacagccuugcaccgaggcuuccuccacccacacccaaagccuugaauuugacccuuuuuccuuuuccauccccacacagacauuaagaccccugcaaugaaacuccuccccagcaugcccacagcccugcagucaagugcauguccuacuacagaccccugaccacacccuccucagagcuccauugcagaucucugaccacacccucagccccacccugaaagucccucuccaaaucaaacccuguguacacugcauccauuuugcauccuuuuaacucacauccugaagaccccaaccacagucacuagcuggacucugcacccuuacaaaggcccccuggccauacccuuggagcauucccguucauccauauagcuacagcuucugacacagcccugccuugaaaucucccagucuaugcaguaacacuuccauacuuccaugcaaagcauugaacacccaccaccacacacgcgcagaguucccugaccacacccucagcacucucucuuuacucauaugcuaaagcuauugacacagaccugaccuaaagccccucagagucuaaccagcacuggcaucgccaggcaucauguuaagacauaccaccaucaccacacccacugcagccuccuguucucagccaccaucuuuaccuugccucuuaggggaaaaaaaaaaaaguguccaaugaccacaaccuggcccccgaacaacuuccucuucuuccauuacuaguugguccacacugaaaggccuuuucuggugaccacaccuacucauccauaaguugcaauuuuuaagacucagaaacccagagauugcacucugcagggaccucugugggucuguaaaugggguccgccacacccuuugccucucccaaagaugucaacccgcccggggacccaaagcccuguacuugaacaccacagguaaauguguccaggggaguuuggggugcuacaugaugcucuucucaaggaaaugggaggauccugaggcuacugcucacuccugucuaugggaagaugaauuugggggcuguugauguggaacagaaucacagcagcugcucugggguccucagacccugggcacaguguucaugccucugaacugaauccgcucgucagcuccugcugggacagcugcagucaucaaucagccuggcaagaaggugggggcaggaguguguguggaacccuuggggccagggccgggguguucagcugauaggcucagcucaguaccaucugagguugguucaggcugcucccacccaccccuccuuuugggggauacgaauuaggguggucgauguucagucuccuaccggcuucuaccgcuuggcugcuccugagcgugccuucggacaggacccaggaacugaugcuggagaccaggaggcuccacagcuccgcucccugccggcucccgggcgggacugcagcccgggcggcuccguaguauuauccccuguuucucg

SEQ ID NO: 4713 - RNA, 3942 nt, Mus musculus
cgagaaacaggggauaauacuacggagccgcccgggcugcagucccgcccgggagccggcagggagcggagcuguggagccuccuggucuccagcaucaguuccuggguccuguccgaaggcacgcucaggagcagccaagcgguagaagccgguaggagacugaacaucgaccacccuaauucguaucccccaaaaggaggggugggugggagcagccugaaccaaccucagaugguacugagcugagccuaucagcugaacaccccggcccuggccccaaggguuccacacacacuccugcccccaccuucuugccaggcugauugaugacugcagcugucccagcaggagcugacgagcggauucaguucagaggcaugaacacugugcccagggucugaggaccccagagcagcugcugugauucuguuccacaucaacagcccccaaauucaucuucccauagacaggagugagcaguagccucaggauccucccauuuccuugagaagagcaucauguagcaccccaaacuccccuggacacauuuaccugugguguucaaguacagggcuuuggguccccgggcggguugacaucuuugggagaggcaaaggguguggcggaccccauuuacagacccacagaggucccugcagagugcaaucucuggguuucugagucuuaaaaauugcaacuuauggaugaguagguguggucaccagaaaaggccuuucaguguggaccaacuaguaauggaagaagaggaaguuguucgggggccagguuguggucauuggacacuuuuuuuuuuuuccccuaagaggcaagguaaagaugguggcugagaacaggaggcugcaguggguguggugauggugguaugucuuaacaugaugccuggcgaugccagugcugguuagacucugaggggcuuuaggucaggucugugucaauagcuuuagcauaugaguaaagagagagugcugaggguguggucagggaacucugcgcguguguggugguggguguucaaugcuuugcauggaaguauggaaguguuacugcauagacugggagauuucaaggcagggcugugucagaagcuguagcuauauggaugaacgggaaugcuccaaggguauggccagggggccuuuguaagggugcagaguccagcuagugacugugguuggggucuucaggaugugaguuaaaaggaugcaaaauggaugcaguguacacaggguuugauuuggagagggacuuucaggguggggcugaggguguggucagagaucugcaauggagcucugaggaggguguggucaggggucuguaguaggacaugcacuugacugcagggcugugggcaugcuggggaggaguuucauugcaggggucuuaaugucuguguggggauggaaaaggaaaaagggucaaauucaaggcuuuggguguggguggaggaagccucggugcaaggcuguggguaugguuaguggguacgaggcagaggguguggagggccagggcucagugcaucugagcuaugggaacguggacaggcguggucacgcucagugaaaagaagaccuuaguggagggcugaaguguagacaacgggauugugccucagugaaggauugaggcaccaagaucauggccccauggaagaauuuaggggcuacuguccaagucucuacccagguuucuucguuucccacucuuaagcuccacagacuggaagcuacagcuucaaucaguggcaaggggccaggaagccacgguugugcccuaggcuuagggagugcugguaugccccacccuugggccccugauccccagcccagcccagcccagcccagcagcacugggagcuucucccucaagccgcccugacaccauccuacccuuagcaacugucuccaagcagcaccacccucccuuagcaacugucuccaggcuccacaaacuguggccaggccagacccaaguuccugcuccccuccuguuuuuguuuaacagcaaauaguaacaaggccagggcugggccagcugcgccccugccuagggcaggcacugcugcccuugcucuugcuccauugucaggccgaggcugggccucccuaggucuccaugaccuuuacagagacacugcccucacuacauaccugcccauacaccacccuugucuggcguugacccagauugacaggaguuuucagggaggcuuuucugccaccacccccacuuccacccaaccaggcuuugugccagggacagacaaagccauggcccuagcugcuaucaucacagucuuucaggacagugcccuucuguucccagggccgugugggcaucaugacuucaucuucugagcccucuugacauccagggcuggcaccgagcgacagcaccuuucugcccauagcucuuccucagcucugggcauagacagacacaaggugcuaacccuuaggcaucccaguccugacugagggacugaugugcugccaacucauaccucacagguuuuuuuuuuuuguuuguuuuguuuuguuuuucgagacaggguuucucuguauagcccuggcugucccggaacuuacuuuguagaccaggcuggccucgaacucagaaaguugccugccucugccuccccagugcugggauuaaaggcgugcgccaccacugcccagcaccucacagguauugagaaggcaguaggggcauucugggucuagaggaggugggaauaacuuggccgggaggugacuguggcggauccucgcaggguggcauggcagcgagcacggacauagcugggcuggaggagagcuuccggaaguuugccauccauggcgaccccaaggccagcgggcaagagaugaauggcaagaacugggccaagcugugcaaggacuguaagguggccgacggaaaggccguaacgggcaccgacgucgacaucgucuucuccaaagucaagugagcaccaggcaaccccuguuucucaugcuuucagaaagugggggguguggggguggucguuagggggcuggaaucagggaggaugucaaaaaggggggauccuuacggugcacacggugucuggcagggcgaaaucugcuagaguaaucaacuaugaggaguucaagaaggcccuggaagagcuggcaacuaagcgguucaaggggaaguccaaggaggaggccuuugaugccaucugccagcugauagcgggcaaggaaccggccaacauuggcgucaccguaagugcccugccagcccugccacggagaugggugggggugggggagggguggaucucagcagaaaugggggugggugggaugggccagguucccucucacaggacucugugggaacucuauccaaacagaaagcuaaaacggguggugcuguggaccggcugacggacaccaguaaguauacgggcucccacaaagaacgcuuugaugagagcggcaagggaaagggcaucgcuggacggcaggacauccuggacgacaguggcuacgugagugccuacaaaaacgcaggcaccuaugacgccaaggugaagaagugacaccugccaaagcccccagggaggcugucccacuggaggcccaggccugggguccagggucacauggagcaagaaagccuggcucccucccugcuggaucugccaccaagagcuuccugcccagucccagggccaucccaucaggccucugacccagacugcugugucccuucuuccugucucccugucaucugucugggagucagugccuauauccucaccgccccagccuggucccaggcauggcugacucuugccugcuuuugccucauauuuaagcugcugcucuggccaagugccuaauucuuacccagaccucaauaaagauaccuuuuguaccaggau

SEQ ID NO: 4714 - RNA, 5255 nt, Mus musculus
caaagaaagcgaguaucccucccaccccaggccgguguuccucugcauuccguguccuagccucgagucccucucggcgcuccccaaccaggcccccgccccgccccagcccggccccgaagucauggagcgcuggccuuggccgucgggcggcgccuggcugcugguggcugcccgcgcgcugcugcagcugcugcgcucagaccugcgucugggccgcccguuguuggcggcacuggcccugcuggcugcucucgacuggcugugccagcgccugcugcccccgccggcggcacucguggugcuggcuggugcuggcuggaucgcguugucccgccuagcgcgcccuccucgccugccgguggccacucgcgcggugcucaucaccggugagugugcagagcgcagggacuccaggcuggagggcgggaccgcacaccuagaggguuucccuugggcgccaucaaggggaacuccgcagcucagacguaagaguccuucucuaaacgcaagaaagugagccaaguaggaagcuccgggcaccucaccaagucuggguuaacuaccugcgaccgcgaggauuauuggugagaaaguagagagugggcaggugcucaaaggaaacuagugacugaaagaggagaaacuuaguuuaugcugagcuccuuaagagaucagguguggagcagaagacaguacuuuaggggacuucagaagacccgagacggggauaaugccaucucuugaacucugccugacaucccccacaucacuagaacacaguaucugcuauucucugggggcagagugcuuagauggugaguucugcuccccgaccuccucuggcuggaauccuuggaguucagaaccgccugaguucacagcagcuggagaguagcugcuucuuagauccagcuacccacugccaaaacugcagccgccugcagucuacaccuaacaccucauccugcccagcccugggugcccaggaaaggguccucagagagcuggacucaggugucucuagugccugccugugcuuucuuugucuggagcagggaauaaaucugucaucaggagggaaggggaggggaggggggcugcagacccagcaggaaauggggagggggaggaaggccagggggcauugguccauugcauggggggaggggcagcuguuucucccccaaccaccauggcuucuuggaggucuugguccuuuauggguggucugcaugauaggauagggccgggagacuuuaggaggaaauccuugaacuggaccuuggagggaguuggguagugacagguggaaucugaaaggugucuuggauccuagaaagggcgugagacaaagguuuaagacagaaagaaauaagcacgguuugggaaggggacagucaauaaccagucuggcuggggggggggggggaugugaaguuuccuugggaggagacccgaaugucaggugagaaaccagauugcacuaaggugauauggcuucggaagagaggguggagguugaguaggacucaggugauauggaagagacuuccagagugagugugaagccacggcaagcccccccccccccccccuuucaggagccugaggaaggaaagcuacugaauucccuugaaaugaagcagggacucguuauaggcucugccuucaaacauggaacagaucucuuccuguccugugugagcggcuuucaccagauccuaugccacuucagguucuacugauacagcuggggcauccugagaucucaccucaggucuuugcuacuggucuagucuugagccugagcaagaggugagaagagggaugcuuucugugccccaggcuccuuccaucucugcaaaccucaguguuugggagaagagaauuuggccccagccuacucccguguaagcacuggaaguuggcuucuagcuuccugaugccugaaaacucugggguuuuccgagucaccaccaagcagcaagagcacuuaagugaccgguucuugacccaccugccaagaacacugcgcuuucugccuacacucaucccuccccaagaaugcccaagaauuguuugucaaaccuaggccacaagcucagccaugcugucaugucugggcugugugacuugguaccuugugugcaugcauuauguaugugucuucgugcugaagggagacaggggucaagcucgugugugaacaugcaggcagguuuacaggugagcaagaggguaaggaccccggagcugaguuucugggaggcuuuuaguaaaguucugucuccuccaaaaggaagcagaagcaagagugcaugugugugcacacacacucccuucccccagucagauuugcuugggaaggaccccucaacacagacuagcaggccccagcuacacaaagcccgguuugcagcccccaaccagcuuuguucucuucucagcucaggggggaggggcugagacgaggaggggugcuguuuguccaggaguggggaagcugggcugcaaagcagcuuuucugcacagcaggaccucggggcuggcagcuccacagacuccccucccccacuggcccuccucauccucucacuggccacccacagagccaggaucagcauggaaaccaucaaggaagcaagggcuuaucaguaccagggacccccacacuggggccuugccuggugguucuuaucucugcauaccaagggcaagaaaaugaagacuccauggguagucaccgaccuugggucacacuuaguggugugggaagggauuccaaugcaggucuguuuucuucacuuaccaugcaugguuccuagccugagaggaaaagugaucuggggcucagcaaauguauacauacguccgaagucaaugauuggaauuccaagggcagagaucaagggggaguugggaacgggcuccaaguugagucuggaacaauaguaggagcaacugaggcugcagaaguacucagguugaguacggccaggaugauggcaucugggcuuuauucuaaggcccauagaauccuggggaagcaaaaagccuuuaggacuugucagcagcagggugauacugucauuuuaaaaaauaucccucugacuuaggcugaugauagauucacgagacaaguugggaccagagugggucuguuucuucuagaaaguaagguuuaucaaucacauuugaugggauagcuauagggaaccagauagaugacaacugucacagaacugaugcucaggguucagucaggagggccaacguauaacacacauuuguaaggaagaagggagggcugagugucccggaggcuagauuccucccagaccuuaguggucuucggcuugucuugggcuggaaauccauugguucuccuacccuggcuagguugugacacugguuuuggcaaggagacagcuaagaaacuggaugccaugggcuucacggugcuggccacaguguuggauuugaauagcccuggugcccuagaacugcgugaccucuguucuccucgccugaagcugcugcagauggaucugaccaaggcagaggacaucagccguguucuggaaaucaccaaggcccacacggccagcacuggucagcagaugugucuccauuaggggugggcagggcuggguggguacgagggaggaagggacugcauguuugcugucaggaucaccugaaccuucccuccugcuuuuaugccuccaggccuguggggucugguuaacaacgcuggccucaauaucguaguggcugacguggaacugucuccaguggcgacuuuccgcaagugcauggaggugaacuucuuuggugcacuugagcugaccaagggccuccugccacucuugcgucacucgaggggacguauugugaccguuggcagcccagcagguaagugcucuuccacucagagacaaagcgguaaaggagcugcuaucgggugaagaaugauuugaggaaucccaggcugaggcugagcaucccgugcaauccacaggagacaugccauaccccugcuuggcagccuacggcaccuccaaggcagcaauagcacugcuuauggacacauucggcugugagcugcuucccugggguaucaaggucagcauuaucaagccuggcugcuucaagacaggugaggguucagguuuggggugggacacccaugcagcagggacguguggucugaggauagaguguggcuugguuuacaggcgugguuuacauuaaauagauuaauggccuuugggcucuucuggcugcugcuuccugaccuugucaccccuuccucagaugcagugacuaaugugaaccucugggagaaacgcaagcaacugcugcuggccaacauuccuagagagcugcuccaggccuauggugaagacuacauugagcacgugcacgggcaguuccugaauucacucagaauggcauugccugaccuuagcccaguuguagaugccaucaucgaugcauugcuggcagcucagccacgaagccgcuacuacccaggccguggccuggggcucauguauuucauccaccacuaccugccagagggccugcgacgcugcuuccuacagaacuucuuuaucaaucaccuucugccccgagcacugaggcccggccaacauggcccugcuccugcuuaagacacacccuuccccaguggcagcucugugagccacaaaccuagguguuuuagcaggaugggcuucuucagcccuuggcccucuccccugcccauuauagacaccccccccccccagccuuacccuagagucuguguuaagcccagcccagccucuauugcugaugccucguccagcccaggacguggaagucugcuagugagccucuggaccucuccucugcuucuugagcccacacauacccuaccaggcacaaugcucuacacugcagcuuggaaaacccagguggauggagaguuuaguauaagauuuuggcuguagccuuugauaguacucuacagaccauuucugugcuaacuuuagaaugauuaggcagguggggaccuccucagaauucuuuugggacccacagucucagugcugcaaguccagaguaaaucccaacugccucuugacuggcucaagauuuagguccucaauuacuggcccccagccacauggaagcuguauguuguaccugccugguuguuggcauuuuaaaauaaagauacauuuuauuucuacuagaaugggaga

SEQ ID NO: 4715 - RNA, 41668 nt, Mus musculus
agcaggguuuuuaaagagggcaauuuuauugucucagaggggcagagcggagggagaaggcuacaaagcugcuuucccaauaccccaagaauacauauucucuacucuucccacagguucuggggaugaccuauggacacugucccagggguccuuaggcuaaggagggacaugaaagucauacaaguuucuuagacaugucaguggcuguaaacauagggcugggggccucucugcucuggagggaaucuugguccauucuugaucaggggagaggugccuaaccccuuuuuaggccuaagaguagucccagaaggggucauggaagcugggcaaacaaucccaggacaaugcuacaccucaccaggucagacaagugagcccugggcuucaccacagcacacagacacacacacagugcacuugggaaccuuaaguuagaaugcuaaaagauggggauguaguugucgaucuuggcgcgauggcgcugggcaaugcacucagcaauccauacgauguugcgacauuccuguuccuuaagcuucacaaaggcauaaaagacaccaaaauggaacugguucaggaaggccagcuuguuuagcuucaccuguggacagacacaggugugaugaacaggcgcuguggccuaagucacaaccuucccuauacggggucggcucuacaagacccuguucuuaccucauguucaaaaaaccgguccuccagggucuugucuccaggauugcuaccugcacccucaaaaagcaguuuguauuccuggccgggaagaggaagagcacagguaugagugcugggugcugggcugcccacauggccaccuaaucuugucagcuagggcacucaccggguaguaaucagcuacauucuugaccuguucauagucaucagcccgcgccagcugagccaagcccucaggguagagccggccacagugcgggaagagcuuggcacgguccuccuuggacagcucugugccgaaagaguugauggugaugaugaaagcgcggcggucugcuucaaacugcagggccagugcauaggugaggagagagggaagaugagggagaccacgcuagucaguuggcagaguucccccuaguaaggcucaaugggaacaaaaggcagagagguggggaggcacucaccucuaggauaggacacauggcaucagcuguggucccacccaacagaguacagaacuuguagaaggacuccaaguaggccuguagagaggacagugcuugcuuagagccaggauugcagugcugggagacugguuagaaacccagucagcugaucuccccucucaaaaccuuucaugguagggaugggccagcucauucuaugccaacuuccccucuaccgaacaucuacuaauuucaacaguuaaucauccaaggagcaguagcuuggugcauucuagcugcgugagaaaacccagcuaucugacccacucucugcuugagaacacauagucccaccccucucuguagccagguuuagggggcucugucuucuuucuagugcuuugccuuccuuuccuagucuucagagacuuccccuuccccagccucagaaaaccagguguccaagggcuaaugagggaaguuauccucagaguucacaaagguccagacucaacucaugcauccucccuugcaacacccuccuugcagaacacuacugagcacuccuccucccacccucagacagucccuaggcuucaacagcagaaaccaaauuaucaggucaauuccugcugaaggaugguuaucaccuaugcgaacagcagccucacagucacuaacuggggacaugggcugccagcggaaacaaguaauuuuguugaggcaaauuugaucugcugggcgugagaaaaggacaggucagcucacacacaaggucuucccuaacucucauuugcaaggucacacagagguuucuuuccaauaccuguccccccaucaaggucuugcagacuccauggggaacacuuuugcaugaaacuugccucagaccccaccuaaggucccacauguagcaugaccacagagacucagaucucuguguuggggacuauucugaguugggauugggaggcuguagaaagcuuuccacauccgagugagccauccaagcuggcugggacccauaggaugugcauucaaacucagauaagcugaugauucccagagcuccacaagccacagugacacuaaacaagaugggcucaggagagaaccugaaguugaucacugagcucacaggaaucaaaguuacuauuaaguaagcaauaagaaacagccaggaaagcaacaacagaguccagcacagaggaucaacagccauucuguaggcagaaauggcucccaucucccaccucggugguacuucacagccccuccaggagucaguccucuguggccuuguuugugguuagccaagcugguuaugcuaaaaaucuuaggaccuacccuaguggagucuguaguuccuaucugggggggaaacuacuagccaguuugagguuccauucccuguuccuaccugcuugcuuagccaagauguauugaucuccagagaagcugacccuaggauuaagguucacacuuuccucuagaggcuauagcagcaaagaaacuggcaagacucagguaccaaggucaccuccacaaccccacccuguccccuggagucugccagcccaugucuguugcaccagcugccuacaauucacuugccagauggaugaggguccaccuaaucucccaucuguggccacugggcugggacauugccugacaggcaggcagccuuggcaugaggcccacagcggugggucaguuuuuaugagcugguuucuggccaguccuugucagugacuccagcuaaaaccagucaggcccagagagggugugggcaaggcuagggguauagccacgccccucauccugucuggagcaaggaaucugucaauaggccaggugagugggugggagcacuauguguguguguguacacaugugcacacgugugcauauuaccuuaccccuuaccaauaaucugccuuccacccuaaagucauagagggccuucuaagauacgcucuauuagaagaccuuaugcucacagccuaaaguucauuuaauuuuuuucacauuuuacuuauuuugugugcauguaugugcaaagguaagaagacaauuaguggguagcaguucucuccuucuaccaugugggugggucccagauaucaaacucagcuuguccaaguuggcaguuaagcauuuucauuuccugagcaauguugucagcccaaaguuacgguuuucguuauuguuguuguuuguuuugugacagggucucacuauguaacccuggcugucccaaaacuuacuacauagacucaaauucacagagaucugcuugccucugccuuccaagcacuggacugaaagucacuaugccuggcuuaccuuuucuugagagacucuuacuauggagacauggcugaccugcaucucacuacauauacuaagcuaaucuugaacuuagcaaaaaucuucuugcucaaguuguccuagcauucugaaguauguaccaccacucccagcuaaaguucaaacucuugccgaugcauucaagguccugggugacuuggcucacucaguguauguaucuucccuuggaucuccuccccacuauccaugugaaaccuacacuuucacaguaaaccccuugccuuguggccuggcucaugcuccuugccuuccuucugccuaugcuaucauaguuucuaucaucuaccugcagauccuaucuguaugcugacacaggacccauagaaagacuaggucuguacucaggcugagccagauguccaccagccagcuacaaucagggcagaagacacacaccucaccccccccuccccaguggagacuggauagacagauguccuugggucccuuagccagugccauccccggcuucucuucaagguuugccuauugcugaucuauguuccugacuaaagucuuccaggagucuuggcaucacagcuuagaaucacaccacaaacuuaacccagccuuucccaaaugucccuaacugauagcuaccuuuuaaucuccauaaugacuguacaaacugaggaauuucaagcccauucucuuuccauagacgagccagucuaugcccauagucuaauaggaagcaaaaggugaauaaaggcugaagacagugagauacauggcauugguucaaggucugggaaccugaaagggucauaauaaacuggcugugccuggcuggaucuuuccccaccuaacuaagcacauaucacugccuuugccuaggugccugucuuggcugccaagaguucauguggcguagguuucagggcaaugaccuggguggugguccaugacacuccuggaugcuacaugaguggcuguccaggaggcagcucugacaggccaagugucagagcaccagcuacuccagccugcugcagacaccuuggaauggauaaccuguucuacaaaaccuugaaaccaccccaggaaccugagagugagaggcuaagcccccagaaaggagccugaugcaggugcaugcuggcccagcaucucacauaaauuaccuucugucacacacaacccccccacccccacugcuucucaaaaacacuaccuuguaaagcguauuucggauuaucucgauguucaucucaucaagguccugcucugagaugcaguccuggaaaaaagccgcugggaagggaagacaaggauguaaagagcaggacagcagccucagugagagggcgcacuaagcuaaguacuggauggagacccccaauccagucugagcuacugccuuggaaguaggagaagcaauucucugggcccugugugcugaccugagcuuuuccugcuucuuugcuccuaaaauugauuuauaaaggaggcggccagccauaacaugaucuaaucacugcuggggcagacccaaguuuagaccaugccaaagacaggcuugcauaagaggccaugagauuucccuucuccaggggcagcuaucaauuuggggacuggaaaccacugcuauguauacccuacgaaggccuagagccugcacaugggaaacuagccuccuccuccucuuuuacuuuugguuuuuugagacaggguuucucuguguagcccuggcugucuuagaacucacucuguagaccaggcuggccucgaacucagaaauccgccugccucugccuccugagugcugggauuaaagaugugugccaccagugcccggcuucuucuuuuuuuuuuuuuuuaagauuuauuuuaucucauguauuuggguauacuguagcuguuaucaaacacaccagaauaggacaucggaucccauuacagauggauguaagccaccaugugguugcugagaauugaacucaggaucucugaggaagagcagucagugcucuuaacugcugagccaucucuccagcccucuucuucuuuacauaagaaugaucuuauggagaagagcaagcuaagauuggaguaguuagaaauccacugcaggaggagaggcuagggcagaaucccagggagggccugaagauguauccgauguccuuccuuuaaagaugaaacugcagaagccacaaacagcccagaacuagcucagaguuacagggacaaucaaaggcaaacuaggugaguagauauggcuggcacuucucagcuuaggaccuucugauucaacucugguggcuuccuggaauaguuccccaggguuuagauuguggcuauaaggguacuagcuaguuaugauacucaugccuucucuccagcauucuaggcauccugcuggacaccaucugaccugaccccugggaccugcucaguggagucaaaugaagcuuuuugcuuuuguuuucugucucauaagaagccagccauuauuauagcccugguuagggcuacagucugccagaccccucaggacuccaagagacacaagcuccuugcucuucuccauaaguucauucagcccccuucugagucccaaaaaaccacauucuuuccaaaguuagauagucucagucugcccuuuggguugcccgucugccuaggaaaagcaaugggagaguaaagaaagagggaugggaaacaaugagaacaggaagcugagggagcaaggucagcugcagcacagucuccugcuuuagggcugccccaccuccuacaauccauaaaacccacacugaggcucugaugcuaagaccacugccuagcugcuguuucuaccacagaggcucacccagggguguguccaccagaauggcauuguagagcucugcaggugucugugcgauguucacagccuccaucugcucaaagcugccuagcggauggcacuugggcacaaguucagcuauugaacgcuggugcagugugccugugauuagcaggaucacguugucaaucauguagcuauaacugugagaagcagacaacaacagggcagacuguuagaguagaggaguggggaggacuggcccccaacuuugcucacauccuugcucacacaacuccuaagaguaagugcuggcuuguggaugcuguaaaugggcuccagagagacuacccuuccccacacagacuccugucaccacuaccaccaugaccccaacccccaauaacagaacaucggauaaauauagcuuuuccuuuaacaggaugguagagucaugccccauaaacgacuggaacacaaguaaauagccuauagugugaacagugcuccaacaguacacagaacgcaugggcacaugcaggugaggcacauaacccaucccagggacagaugcacucaggagcuugacagauaaaaggacugggagaugaaaguguguucuggauagagggaacaguaugcagaggccugggggcagacacugagugagacuggauugaucugaggaacugaguauugucaagacuggcagagggaaagggagggcacagcuguaggcaaggcagugcugucagcagaaggcugccugaagacugagcucaggucaggcagaggguuccaacuuuaccucaaauacuacggagccauagugggaugaaaauaagaaaccacaauauuaucagggccacucuggcuccaugggaguugggaguccagaguaggagaggagaaagacuaagaaacaggcuaggaaaaggcuucuccaagaagggccagagaagagucauaaaggccccuucuagaauaaaggacagagucaggcagacugcagagccccacugugaacacaaaaaaauacacuacucuuuagagccaguucaagcaauuacucaggaggaccugaaugagauacagaagcaggucugauucaagucaguucuaggcuuagucucauaggcuugcccugcaaucggauacucugugcaccauggacagcagagggggcuguggagcuggggaggguggggcugccuaguuaagacuuggcaaggaacaacuaagacaacuugucuccaacugaaaagcagagccaaagaggagcuaggacagaaaguuuuguguacucaccuauggggaugagguaguaggggaaaagggaagguauaaagaauaggaggagccggguagucccaacuauuauccauccuguuacaaguaguaaacuaugaguauagaggaaguggagaauguccuuaaaggcuaagcugggccuuggaaggguaaggacuaaaaauggaggcuacugucaaucuggcccuggacauaguucuuguucuguuucugggagguccagagcuaggcucuaucccuguaacaaauccuuguaccuaagucugagacuuuaccaaggaaaggccuugguaggagguggggcucaguaccaaaggaauaaaaggaaaaaggugguggcccaguguaucagucacugugguacuccuauaagccccucaaaauaccugaguuuugucucagccuaacccauacuccuugugcuugaugaacacagcucccacucaauucaaugccacuuuaaccucuagucuccugggccuggggcuaggcagcugaucucuuuccauacccaaucuagaugguucauuacagaauaugcacugagaagagucacaccucaccuuccaaaaacaagggucucaagcaagauccaucuguaauugcaagcuaaaaggaacauauggccagccucuuguccuugaccccacagaacuggcaguuaacuuccacccacuccagccauacuaaaacuaaugucuuccuaagacauccagagagaccucaccccagagauaagaaugccuuuuccccucauauccccuuuugauaugcugaagaacaacagcauaucucuggaacuuacauuauucaagugauucuaugugaccuuacugccacaacagauaaaacaccuauggcuaccuuuagccaaagcuuuuguuuguuuguuuguuuguuugcuuguuuugagaugugguuucuccguauggcucuggcugcccuggaacucacuuuguagaccaggcuggccucaaacucagaaauccgccugccucugccucccagugcugggauuaaaggcgugcgccaccacgcccggcuuagccaaagcuuuauguuuuagcucuaaacucccaccucugucucucagagagaccccacaaccccaguuuccuuagucuaaacuuuuccuucccccuugugcccacaagccagggucucuguuuaucuguuuaggcuagggacaagacuggaauaagacugucugaguacuucuaagagcccuggaccagccucagaagaaagcccuguagggaaaugcugccaccugacuucacugcuauaccucuagugaguagaagaaaccagcuguaguucaugguucagcucugacacuguaugcagaagucaguaguagcucuccccucccuucuagcuuccccaaaccucuccuugcuauaagccuuaguugaguacagagaaaaaugcugggccaaguuagggccacucacaaucacagcacucagccccuucuaacuccuccuucuacacaggccaggccagccuguauccugugccaggcugaguacuucccuccccggggccaacucuaagauugcuucaguggaggccccugcuuucccuuccuguacagcaaggcucaggaucgucuuuccugggagauggaaggcaggacaggccuggcagagauaagacccagccauaugccuuccuaccuucagcaaacaggaaaccucccuccucuuugccuggucuucagaaauugccucccugcccccagaaagcugcuuugccaugucuccccucauuuggccucaaaagagagaauaaaguuccagcuggucagcaucucccuccagaggaagacagcuggggaguggauggcccacugccugccaggccaaagaggcccuuuuggagugggggaugggggaaggggguagagcagucuauaauccucugcccuaaggcccucccuugcccugugccuccaaauagcuuggagugggagaaguuucaggcuacaguuuaggaagcuacuuccuucaagaaaccuuuagagucccuagccgacccugucucuccacugugcccuuuggugccaccugcuggagcaacauagcuuuucugcacuugggcuggcaggcuguguauaaccagguacuugugccaaauggccuaucugcagcccccaccaaggagccucauuuguugcuagugacauuaucuguacuaaacuacaucuaguuccaaggaaccccacccagggcugaaaaugaacagaagucucugcuaugaccuuuucuacuuagcacauuaccccuuaagccucaaguuccccuuugcaaccagaaugaaugagauguggacuacagaagaguuagugaggcucugaccaucuccucauuaaaauccugacccuccucaaaggcccaguugaguuauccuauuugaucugagccuuuggaauccugaagggucccucauagucaugcuuuuuccuaggucagaaagaacagggucagugcuggcuuccuuuccauccuaaagagcaauaagggaacaacccacagcagcccgagagccucauugggaacagucaggauaagaaggccugaggaaacccagugaccacucuaggacaaugaagggccaacgugaggcaacauggccucacuuaggagguaagagaugcuuuggggacccacuagacaugugagaccauguccugggacaaagguuccuuccagguguccacuuccacugauggucauucucccagauaguacagguuaaaccacacaauuucugccaguggacacguaggcuacaggcaauuguuauacaccagggauggcccuugcuugagaccugcuucauuuaaaaacaauggcacuuaggggccaccugaagaugucccagagaccaaguugacccucuacaaacaacuuucccaacuucucuuccaagguuaggggguucuccugugagaaaauaccaugaaaugggccaaguaaaaguauccuucauggcuaaagaacccugaaugcagguucuaucacaaguuacagggcaaguuaggccugguaacagcccucauuuuagcagcauauuaaauguguuaggauugugaauguugaguaggucaccuaaaacuacacgcugagagucuacuucacacagacugccugcucuguggcaggcacacaaccaccccuguugucacugucugccccucagcaccacucacucugcaucuguguagugcccuccuggccuggcucuggacucagccaaaguuuuuuucagucuagauucccauccuuauuaguucuucccucaaacacccaccuuccuuccuuccuuccuuccuuccuuccuuccuuccuuccuuucuuccuuucuuucuuccuuucuuucuuucuuccuuucuuuuuuuuuuuuucccgagacaggguuucucuguguagcccuggcuguccuggaacucacuuuguagaccaggcuggucuugaacucagaaauuugccugccucugccucccgagugcugggauuaaaggcgcgagccacuaugcccggcuuuaaacaccuuucuucucagccaguagucauuccuuaaggaaagcagucauguagaagggucaaccuggucucugggacaucuucagguggcaccuaagugccauuguuuuuaaaugaagcaggucucuaacaagggccauccuugguguauaacaauugccuguagccuacguguccacuggcagaaauugugugguuuaaccuguacuaucugggagaaugaccaucaguggaagugaacaccuggaaggaaacuuugucccaggacauggucaugaguccccaggcccaguauaggguucaaaugaaaacuucacucaauucuuucuaaaguucuauucacauuugaauagucugacagggcacugaaauagaaagcagcuaaaaaaauaggaguuaaauuuagucagauaucaugagagaagaaacugcugagggcuggauacaaccaauguccaauccuagagaccuuggccaaugaaggccaagagugaccauagccagggccuuguuauggagugacaaaacuucugggaaaugacugcaggcuugagugauagaggaggugagaaaaaagaugaggaaugagaaaaauaggccccauaaaaugaguuuuaaggguguuuaaugaucuuagagauguagguguggugcuagaagcacuuaaaagggaacaugacaacacagaaguaaagaggaguggccacucaggguccaggugaggugaagagauucagaauguugggcagaaggaucucagggaaggaagguggaguggacucggggcgagaugcagaugcagaauuggaagguguacuugcuucugaugacuccguggaggaguaggugggccgucugcacagggaugaagaggcuacaggaaggagaggacugauguuuaggauggggaggggucauccugcucaugaugggagcugcagggugcugaguagggacagcaagaaguugcugggcagaaacaagcugaggaugaguaggugagcauguacgucuauuaguaggaacgacauucccucccacacacccugccaauugcuggcuuccccagcucugcucccagaaguggagguggaggaaggacaacuccaggcuggaggcucugggauuccuccagggcuggggggcugccaguagggugggaccauaagcugggaagccaagagaguuacagaugcuggcagaagagaucucaaaugauagaccagaaaacaucagcuacagagguaaggaaaugaagacagaggaauagcaaagaaggaaacaaggcccgauacccugcugaaucuggaucccauguccuacaagggacucagagugggcuggagagccugaaggcuguggguggaggauggucaccugauugagcaaugucaggaguguaguaguucuacguggugacaaagcagucaucaguugggggcuugguggggggguguggagaguagagaaggaggcauugcagaugaaggggucaaggacaagcagccacaggcucagacuggucaacaugugacauccuggauggugguagagagaaaggcuauaagccacaaucacccaugauuggaagaggccaggaagugguagauucagaaaguuugccacaggauaacacuuggccgcacaucaucuuuaagcacacuuggugcuuggagccaaccuccagcagagagcuggcagcugcucuguuucagucacucucagagcccucuccaguuucacagccuggcaggcugacacugaaacaggccaggguagaugcacaggcaggugggcaaguuggcagcaagauagguaacaucuacucucugaccacuggcauggggucaagcuucauccagccagcuuggcuggcaagaccagaacauuaaccaggaagcuggagaagccuugugcaaacaagcugaaggugaaggcugagcgauggcaauaaauuuaguuuccugguauguccucggcucucgcugugggguagaggauacgcaggcccaggcuagggauuaggugacagaugguagaaugaugugugacacacacacaaagcaucaguauauaauacacucuaucuguccugucccacuagguucauguuggcauaccuugaugaagagaaagacaguuugaucaugaacccauaugggauucugcagcaaagagguaccugaagaaaaagaucuacagccagaagaaggcuugcuuuccaacuuauuggaguacucugugccuuucaagugucccagccuguuagaacugagguuggagcccucugccuaaauaccccauuugaacagaugaauuuuaugcaagugacuguucuuggcugaaaggaggagaugggcuagacagccacauacaacccugucucugaaaagacaagugaagugaugugucugguccuaaacaagaggcuagggaagggaaaaacaagacauucagaagaauguggggauacaucuaacaacacgcucagaggcuacccaaugaacauacuucuguucaccacuugcaugaggcagccaccugggcugaagccauuauuuguuugccaggcucugacucaggacuucuacgucauuccuucagagccaauuucuuuaccuuuuagggucccagacacacaggucuaguugaaauagccuguucuagcccucaacucuagggucuucucuguuuagcuucucuaagagcuugguguauagcuucucuaagaguuccaucaaaggguuacacaauggggaagccuggagcaacaaggguuauuaauaaacaaccuacuccccuuagcuccugggaagaacagcaaggcauucggccucccccaacucaaguccauccccuagcuuucugaccugucagagcacaugaagaacagcccucagcuguugggauaaucuuuuuguacacuguaugaaggugugucucuguccuuccucaacugccucuucugauugguuuaauaaagaacugaacagccuguagcaaggcaggagaggacaggugggacauccaggagagauagggacucugggaaagagucagaggcacagagguaaugggccacacagcagaaagcagacuagaauaaaugggcuauuaaguuauaugagguaguugagaacaagccuagauaucaggccuaaucauucauaaacaguaguaagucuccaugucauuaauugaguacuaguggguugagacaguccagugaugcucagccuagaaaggggcagaagaacuguauggcucaccccaggaucuccagagcccugucuacacccagaccuugacucuaccaagaggggaguaggggaaaccuaacaaguguuugauguaggugcuguagaauaaguaaauaggggagcuccaauucucgcagcuuuugcagcucuaacaccuccacaacaaugagagaaggaaaugaaacugguaacaccacuuuaaagguggugaccuagaguccagaguuguugaaugaccauucuaguuauaccacuugagaagacuuuaaagacauucuuuaacaacagcuggccugacagagcugccaucuggucaccugacagaagcacaauagcugcugaccaagaccauucuggugccaucgucugcaggcauagaacuaccuugcccagcacugugcgcucacucacguuaugaaguccaggaagcuggcgagcggcucauaagcaugguuucucauguggcggaacucuacuaccaucuucuccuugagcuugucaucgaugacugacaccgucagaggugacgcuucauuggccaggaaguugccauaaucuguacucuguaggugcagcuucaagucugaaacccaaggaaagaugguaagggcuaggcuuucugaaccuuaccgguugcccuaaguuuccaucccuaaucaauucuaagcccugcuccucccgcgaaggugcauccugcugccgccugacuucaucucccuaauagcucagugccaauuuacaaaguagccaggcuaaggcccagaugccccagacccuaggaacacaagucagcauuccaggccccagaguacaacacaaguagaauaacuguccaccaaagugaugagguugggaagccucaacauaaggugucauuuaucaucugugggcuuugagguccugacuuggaagaaaauauaacaugggcucuacuuuccagcacauuaaaauuggaagagcaaaauauucagacaugaggcacaauaaaaaaaaaauucugccaggcagugguggcacacacagguagaucugggaguucaaggccauccuagucuacaaaguggauucuaggacagccagagcuacacagagaagcccugucucaaaaaaaacaaacuaaaccaaaccaaauaaacaaaagaaaaagaaaaaaaaaggaagaaagaaagaaaagaaaagaaaagaaaagaaagauccaaagcugcuggagguagaugagagaaucagcacaaagauauagcugagcagaaaaggccaugcuggguuggacugcagcaaaggguggggcccaggaagcaugaaggaaaagugagaugggaccugaaggauuuauagcuaggaauggguuccccuuaacaguggcuggagguagacaaacuaauacuaagaauucucuucaauuuuuaggaacauaugaaaaaauaugacucaccccugccucuaguccauuccucacacaguagccagugauuauuuuauuuuuuuuuaaagauuuauuuauuuauuauauguaaauacacugucuucagacacaccagaagagggagucagaucucguuacggaugguugugagccaccaugugguugcuaggauuugaacucuggaccuucggaagagcagucgggugcucuuacccacugagccaucucaccagcccccgauuauuuuauuuuugcagugcugggaacugaacuuagcacuucauauaugcuaggcuauauuguaucacugagguauuauuuuauuauuuuuacuuuuuuauauguuugugugcacauguauguauaugcaugauuguaguucugaggaaaaucuuagguaucauuuuucagcuuuuccuuuuguuuagacaggguugcucacuggccuggaaccugaccaaguaggcuagacaagcuguccagcaacuuaauagggauccaacugucuugccucccaucucaucauuguuguuauaaaaauacaugccaccacacccagcuuuuuacagauucugggagucuaaacuacagagccaucaaccuaguucauucauuccuucauucuuucauucgagacaagaucucccuauggagccuggcuggccuugaacucacagagaugucccugacucugucucucaaguguaggauuaaaaguaugucccacuauacccagccucuuugaaacauaaucuugucauguagcacaaguuggccuggaacucacuauguagaccagguuggccucaaacuuuuucaauccucuugccucagccuuuccagugcugguauugagaucacaggcucuaacccccaucaucagcuuugacacuucuuaaaaaguuacaucuauauguguguggaggugggugugagcaugcaggugcccacacauguucccaacaugcagugucacugcgugccuauggagaucagaggacuccuacagaaauguguucccuccuuccaccacaugagcuucagguacugcacucaggcuugguagcaagugccuuugccuguugagaguggucuucuuaaaacacaagaagaagccaggcgugguggcgaaugccuuuaaucccggcacucgggaggcagaggcaggcagauuucugaguucgaggccagccuggucuacaaagugaguuccaggacagccagagcuauacagagaaacccugucuugaaaacacacacacacacacacacacacacacacacacacacacacacacacaccacacacacacacacacacacacacacacacacacaaagaauuauuugugcucuaaaaauuacuauagaauaaaaagaaaaaaaaacaggagaagauaagugaugauggcuggaaaauuacuccugcguuauuauaugagggccacuauggucucaaaggaaauacuaaagccagugacagguagguaggaaggagaugaaggaugccccagguguucuugaggcccagagggugacaccagcuggaucugcucagagagaaugaaagguacaacagauaacucguccauagacuucaggcaccucucugaugccccucauacucuaucacaugaagaaugccucagcaguguguggcauugaggcauacaacuucaaucccaguacucagaaggcagaagcaggaggaugucuguggguucaagccagccaguucuacauaggcaguuucaggccagccagagcaacauaacuagacccugucucaacccaaacaaaugaacaaccaccauaauaaagaaugcucaacuugcagucaaguauguaaaaggagauggauuagcacauguugcugaauguggggaacguguauaaacgugcuggaauagauacuuuccaccuauaugccuugggguuuccaccuauaugccuuggggggugggggcuggugauaaacagaauuuauaucaucuguggcuccuaggcacuaauagggugcaccuuagcuugaggaggauccaauguguucgugccaacuuggccacuuucaucuacuuuucucccauggccauccuaaagaugauaaaaaagagaaggcaaagcaaguuaaaagaagccaucuggcuuuuagugauaugugcacaucuuccaaugucucuaacccaggcaucugcaaugacucugauaagggguucuguucuuucuuauucucacaaucuggcuacuuugagaguaaggcauggguaacaggagguauucaacucagaaauacuuggauuauuguaguaauucagauggguuuuucaaggaaaaaaaaucuaauuauauugauggcuauugcuauaacagucuauaacagucuauugccugcauuucuaccuccacauuguaauaaccuugagacuagacaagugcacaaucuuuguaaaagaaacauggaagagagguuuuaggucagcuggcggaaagcuuaccuagcauauacgaaguccuggguucauuuccuaacacuguacaaacccaggugugaugacacauaccuauaauacuagcauuuggaggcagaaguaguucaguugcucaaggccaucuuaggcuauaagacccugucuugauaaagaaaagaaaaacagaacuagggggugggguacagacaggacaauacuuuaucuuagaacacuugucuaguaguuccuuacagccaugcugcuucauaagucugccagcuuuucugaauuacuuugagaagcauaacuuucuucuuuucuccucccuuauuuaagcauauuuuucuuaacauacugggcuucacuccucuaaugccccauuucccaccauggagcucuguaugcugccaaauggcugaccuccacaaugguuuaacucaaacugcauggcuguuuuuccuuuuccauucuccuccuccaggcagcuacugagauuuacaacuugcuugcccugggguuuuucuuugaaacucuuauaaaauuguccucuuaaauaaacuuuggcuucacuugacuuucaaaaagaaaaaaggaaaaagaaagauuauuaaugccucugaaaugguuuuuguggguaugaaacaaaugguuaaaaauaugagcuaucccaccuaauaaguacugaaaugaagcagacuucauuuaccaugucauagucguguccugauuuauauauuuguaucuaccagcaaacauguugcuaccggagccugagggaccaacaugaacaagggguuuugguccagggccaccaaguucucaaacguuuacuacaagaaguucuagagcugacagcagcuaggccaaacugucuguuuauccaugcagucauagcagucagccuaaaauucucuucaggucaaaagacuuccucuucagcucccuagagaucaagacaggcacaggaaggcuccagaguaaaacucaguccucugacuggagugccuccugucacuggccccaucaguucccaggguagcaagcccacuacccuacuggauccccugauccuucauuccuaaagcauugaggauccaggccccugcacacucuguccuucuaagcccuggcacaugcucugggaagauucccgaggcaagcuaucaacucccacuggggauccugaagauaagcucuccaacagcaugacacuuccucuaucccagacuuugccuuacaucacaaaacuucucucucagaagacuagcucagcaacuuccccaacugccaaauacuuucucuuuaacaaccagauagucuucaucaaauaccugguacuccagugagaguuuucaccucagaaggccuggacauacacaggcuaugcaauggucuccuucccaugccaggagcaaucuuugugcuggaccucucagacaugucaauuucaaaggcuuaucaauuaaaagccagaaccuuguccagagucucacagucaagaguauagagaggcuaggauaucaggcaggccuggugggacucugucaguccccaccucggcugucuuuuguucucugagccuccuugaacacauugguagagcagaccuuuuagguauagaaccagcuguccaaacagccuuuaaagccagaagaguugaccacuggcuugcagaccaccuggacacucacugcccacuugucaauaguaggcauaggcccacacucucaugacucagugacaaaucccacuagcaucacuuuugacaucaaccauuacuaaagaagguaggaaaauaugcuugggguugagcagaacaaagcuagaaugcuccuuuguacagccccaccccugggacuucacacaagcuucagagcagacaccccugugcuuccauugcugcauucugcugacacugcaucgggagaagccacggcucugagcacugcuggaaugcaggcggcugggugguuucugcuggaguuugucagaucagagcaaacccgggagacucuacugagaauccugcccaaggcuggaagagucugccuuaccaggaaacucauuuuuaaaagcccccagagacaaugucaaagggccaguuccagaccacuuucucuggcuaagacccacauuucccugugaccaagggaaaagggacagccugccagccaaggcaacuggagggagggagacaggcugauuccuuagcucgcccacgaggggaccacacagggcuucuaaaccaguucugacccuguuggagaaaccuggcgcccagaaacaguggcuggcaacccuaagcccuucagacaggccuggccagggcuaggacaagcuggguuagaauucucucuccucagcuuccugcuauuucugaagguuguggaggaggggaugugacugggaauagaauccaagcauuaggagaggccuggaacuuauagaugccuagugggagacuuagccacccggcccuagcccagccccucaagggcacccgaggacaacaggggcuagguuugcuaugggaccugggcucagcagccuaacagcaucagugacaguccuugagaggaccaggcaugacugguuugagguaugagcuguguucuaguuacaguagacucuggggacaacacuggucuacccacaagcccagcugucuaccccaaauucuaucaguggcccagugccaagugucuggacaguugggaugucugacaguaaaagacuuccucagaggcugauucucaaauugaagaagaugcugcugcgaucaggaaagucuugcuuuagugugagguuaaacccuagcucagaggagacagauuaauucagugucuacucugggcuugcuccuccccagcccaccuccagaaccacccuaaaccaccuaugcuuccuacguuccugucucagauguucugagacaugaccuccaacucccagugccggaaaggcauccuauucuacuccucaguuuccaagcucagagugaagucacccaacuccaauaugucacuaacaccuuucuuccaggcucuguggcccuggagcuacagcucuguuucucccaaaagcccauggucucggacucucagcccuuacacugcuuuagcccucgacucgacgacucucugacuuaacaguuaccuuccuaucaucccugaaaaugcuccagggaaguccauaggagaccuuacuaaaaagcccugaauuggaaguuuccucaggccaggcuaggaagacugaacaggaagagacacccccacccuagaaaccaagagccucuguccuccucuuccacaggguagccucugucauccuugaguugagugucaaaugccacugauccagguccagcagagagcucucugaagguaccugggaagaccacagccuaauacccaccuggcacagcuauucagcuuauaagcuugcaccagcuuuaggcuagccucauaguuuccaucuguccugaaaacccacuugguuaccccuaauccccaguugucucuuucaguaguaagggucuggucacugcugauacuauugaccauacugacugaccccagacuccucaacaguacaguaccaugucccaccaacaaccugaccaguguucucugcucuguaugauaaaauauugucuuggcagugacucagccaagcugugugagauggagcuaagcagcccugcccccacccucuuccugaaagcauucccuaagcuugccaaccugaaggggauccuucaggucacucaacuagcucccagggccagguagcacauggccucccucuccagcccucuggcccuuacaguaguucuccaaggacuuaggcaagcaggaaaagagggucauggccuaugucaagggguuggucccacaugcuuuacggaaccaacacacuaaacaggguggcccagaucuacagucacuauggccucaugguccauccacauagagcuccugcuggccaacuggccugagugaaguguaaagggacaguguguucccagacuucacuucugcuuuuccagagguuacucaaugacucucuccugggacgcucaggaguuuucaggaauuauaugaaaccagaugccagaauauguuccauagagccuaaugugccaagccugcaaggguggcuaggccauuggccuguuggguccaagugaggaaucugcuuugaaggaacaaggauccacuuccaauguuauuacuucuagagguucaaaaugagaaaacacgggauggccagucuggugauucaauaaagccugugccacccuaauacuucuggaugaauaugcugugccaaaaccuccucccuaggcucaggggaguuucucaggcucgugucagcucuaaaacagaugugugcacuggcuggcuggaucugcagggucagaguaccacaucuggaacacacgcgugggagccucugcaugagaacuauuaacucuggguuuaccuaaggcaccagcacacacugaauauccucucuagccuucaagccuccacuauggcagaaagugcuccgaaaacucccaggaaaugccaacuaaucaccucuguguuucaacucuuucuacgaaaugcuagcuuucucccuccccacaaacuuucuguuccuccuuaccaccccuagauugucaagagccacuuauccuggacagugaaggcauacccuuccuccaaaagcuaguuuaugguucuaguucccuucccucuacagcucacuuugacaaaccauuggucacuccugggacagagaaaaggaaauuguguguguguguguguguguguuuauuaaauacagggcuugcuguguaaccuagggugacccucaaacuuaaaacccuacugucugccgggugugguggcgaacgccuuuaaucccagcacucgggaggcagaggcaggcggauuucugaguucaaggccagccuggucuacaaagugagcuccaggacagccagggcuauacagagaaacacugucucgaaaaacaacaacucccauauauuuuacuuucugcuaucaugaacauagagacuugaugaucacauuuucaaaauguuuauuugaagacuauuaccuuucagcuauauuucauauucuccuagcaagauuacauuccugccauuucuaugacacuaggucaaucauguucucacaauaucucuauauaacagucucuaacacuaucauguugacuaguuuucauauugucuuccucuacugauccacucuguaugacacauuccacaggaacaugucacuggaucuuuagggccuaggacagugcuucccgaauggcaaauguccagccaacgauugacgaguggcucucuggcuuaaaaugaggucuuccaaaauuaaugacaauguccucuucauauuuuuaagaguucauguuccaaauuucuguauucucaccuuauagugugauggaaaaucgguuuuccuuuuccuccccuacccuuuuaaccuucauuuauaaauggcaaugcuagcucauauuauuuaauugauguuuucauuguuaauuuaaggaauaacuuguuaauucugcaaauaaaugcucugugacaauuuaaaaaaaaagaaaaacaacaacaacaacaacaacaaaaaaacaaaacccuauugucuauaagugcuaggauuacagguauguaccuacaaucuugccuggcucaaaaugagaaaaaucugagcuuuggagccauaaaaaugugaguuuaaaucuuguccugcaacuuggccuugaguauuuuauaguacaucuguauauccaggcucuuggcuccugaccagcauaugcauugugcgcccacucccacucucagggaacccacacaaacauuaaauugaaguaauaguauacagaaagauaucagcacaacguacuauacaccaucuuuuuucaucagaaagggugccauacaaagcuuccuaaugaacacucucagcccaauagucuccaccacuccagccauggaucgagcugcccuauuuagcucuccaaauaauucccugauccugcuuuucaugguccauagaaauccuuccuccaggcugauagcauguccuccauguuaccaccuguaggugagaaugcaaacacaccagcacaacucuacuauuuauuggaguuagaagaauagggcgggccaggugugguggcccacgccuuuaaucccagcacucaggagacagaggcaggcggauuuccgaguuugaggccagccuggucuacagagugaguuccaggacagccagggcuauacagagaaacacugucuugaaaaaccaaaaagaagaagaagaagaagaagaagaagaagaagaagaagaagaagaagaaggaagaaggaagaaggaagaaggaagaaggaagaaggaagaaggaagaaggaagaaggaagaaggaagaaggaagaaggaagaaggaagaaagaagaaggaagaaggaagaaggaagaaggaagaaagaagaaagaagaaagaagaaagaagaaagaagaaagaagaaaggagaaagaagaaagaagaaagagaagaaagagaagaaagaagaaagaaaaggaagaaggaagaagaaggaagaaggaagaaggaaaaaggaagaaggaagaaggaagaaagaagaaagaagaaauaaaaagaaagaagaagaaagaagaagaaagaaggaagaagaaagaagaauagggcuggcucaagaucuggaauacaugacccaaaguccauguguuacuucaucuaucaauaagcucugagcagcccagaaaucuggacaaagguuauagcccaacucccccacacccauccccccacuacacucugggcuucccucaggagcuucagcccuagagucuuggggguaaacuggagguagaguagccaaguguagcuucugcuccaugggaaguccuaggaccuggcaagccaucagaaccuggagucuacugcuggcauagccauacucaguuauugaguuucaguugguguaagacagagcuccugcacggcaaggacaggaguacucccuccuuggucucuagaccugaauuuuauuucaugcuggaggcuuauaaauuaaggugaggcacugacagcaggagauggagcuaaacccauagaggugguccagaugauacuggugacaccacccaccaacaucaaacauugaugggaagaucacuucccaugcccaagaaucaucaggaugucugccccauguuagccacccacucccagcuuugggacagguggcagguggcagcagaguuacauuuaauuacccacaugaucucaggaacaccccgucccuguagcuaggacaaugaaagcaucucucauaacccaugaggaagucaacucaucugacaaucaggagggugccagucaggcaauaauagcuucaugugccaaagggaggggcagaacugguuacugcugcacccagggcaaguuccaagaagcucuccucuaacugagugguaauccaacaggauggccuucaucaagcuauucccuccuugguccuucacagacuucacaggacugguaugacccaaaagacacaaggcuugcagaguaguuuccuuguguuuccaaccacagccucgccugacaaucaagggaacuuacccugggaguuggggaccacaccucuucugcugcuacugugcacuuuggccuuauguaagcuuucuucuuaagguuugcuacuacaguuauagaaucugcagaauggaauaaaucuggggcuauaaagaacacuguuugcacuucucaaagaugugaacuguuuuuguguaaaagagguaaaguggucugacucagcuaggugccaagcagccaaaugaagagucccaguagcagugagcguccuggguuugcuggaccacaguaccugggugaucuagucagcccuugaugcugggcuccuguucuacacacagaccucuggaagaagaacgggaaggaaagcuagggcuugcucagauaaagaaggccaguuuuagggcuaguaucucuguuccacuauaccaggauccuggcaggagcaucuugccaaauccauggugcucagagagagcccaagggagagacauaagaaagaaauacucagccagggaacaaugaugcacacuuuuaaucccaacacauaggaggaagaggcaggcagaucucugugaguuugaggccagccuggucuacagaguguguuaguuccaggacaccaggguuacacagagaaaccuugucucagaaaaaauuaauaauuaauaauuaaucauuauuaauuaaaauauuaauaauuaauaauuauaauuaauaaauaaaucaauauugcuuugaccucagcuuuaugaauaggcucaaaggaucaagcaucauucaagaauaugaagacauguuaccuucaguaagaaacuccacucccuauagcucauggaaccugcagagaauagcccaggccaggggcagaguugauucacaccauauauaugucuugcagagccaacagacuuagaccaggcaagaagacagcaacaugcagcaguaacuauccagacugguccuguucaguacccuucucucacccuagcucaagcuuacccccaguuacauagccacucaaggagagugagaccuuuguggggcagcagucagaugcuaggcuaaauguggucagcacugugguccuggcuggacucuggcagggcagugcuuucgugcuuagggaccuucauuuuuuuuguugguuuguuguuguuguuuuguuucgagacagggucucucuguauagccuuggcuguccuggaauucacuuuguagacuaggauggccucaaacucagaaauccuccugccucugccucccaagugcugggauuaaaggugugcaccaccacgcccagcuccuucauaauuuaaaagguagauucaauggcucgacaguuaaaaacauugcugaucuuacagaaaaguuagguuuccagcauccacaucauguggauguuacuauaacuccagcugcugggggaccugacuccucugcacuccaugaauaccucaacauacaugcauagacacuccuacacacacucacacagagagacacacacagagacacacauucucauuuucucucucuaacaaaaugaaacaaaaguuagauccacaugauggaagccacuauaaagacgugagaagcaaacugucuuggcaaugacgggaagaccuuccuacucucuguucccaccaggucuggccauguggaacauaguuugaaauuuaguggguggagaaaaugaaugagcugccacaugugaccuggaagccucaggguccuaugcagcagaucaugguuacaccucaccuaaauuccucaacucccaacucauuaacucuaaucuagauuucuucuggcaaggccugaggaauuggcaagagccccagagcagggauucuuuccacuaaccacccuuacugagucaggggcuaaauaaacacagguauagcccagggagccuugaauaaacaaauuaaauaguaaaugaagggaaaaagagagaaucuagaauaauuggaccugaagaacuaaaacaggugucaggagacuaugaguaaguccuuuggcuuuagcugggaccuaauuucucagauaaaauaagaagguuggaugaguuaccucaggaaccuaucugccauauccuagucuggucaggcccaggucauucugacacccuguaacacaaccuucaaaggccacucaaagguucagguuagauugguggccuaggcagcagugaagcagucuuggcagggcuaguagcagauacaggaaagacacuggggaagucuaaagccuucagaauacagcagcaacaagacaagcaagaaggaagggggccucaucuaccaaccaaauaugaagucuuagaugagaucaaguccugaauccauugccugaauguccaaagucaaguacccuuggcuagaccaggcagagcuggcuagguuaacaguguccagcaaccaguaagggcuuuuccuacgagaaccuuuccucugcugaaagucagccagucuguccucagaugguuaguccaguccaggccucugagcacacauucauaguccaucagggaaacuacaggaugcuggguaugaauaggcagaaaagccaucuagguugugaaauagcagucuagcuaaagugaucuuucauuuuccugucuucuuaaagggaacagggagacaaaggaagucaaucuugcaauacuggcuaagcagaagcaccaaccucacuggaaaggcauucaagugagagcagaggggaacaacaacaaaaauaaagaauugugaguuaccuauuaaugacuccauguugguauaaugauagagccaacauuucuuuuuuuuuuuuuaagcuggggcuaauguuuuuauucagaauaaaacacuaucagaauauaaaaauaaagggagcauaguaaagauuaaagagcacaggcauuguauuaaaucacuuagaggugucacuugaggguguuuguuguuucuguuuauucagacagcaguaauuaucaaauuaugaaucaaacuauucauugcaaauuuaacagugaccauugguggcuggguguuguggcgcacgccuuuagucccagcacucaggaggcagaggcaguuggauuucugaguucgaggccagccuggucuacaaagugaguuccaggacagccagggcuacacagagaaaccuucucggaaaaaaaaaaaaaagaguaaccagagccaacauuucuuacguggaguuuaguaccaugcuuaguucucucagagucacuuacacauauggauaugccacacacaugccuaaguguccuucuuagaguuccaaagggaacugaagagagucuauacuauggaugaguucuggguagauccagcaaggggagaaccaccaagggugaauugcucaugaaggguauauuucuaggagacugaaaagcaaggccucggccccuggggaaccuuaagguccuauuugaaacccccaagacaucuuaagagcucguaaacuaguacacugcaauggcugcugcuccaagucugacaccugccagaugaucuagaugcaaguaaaugcagacaguguauuagucacggucagagcauccuguaccaggcuucaggacagagaaugauaucagagaauguccuuggucuucuuccuaugcuuggaauaugggacacagagggaaaagaguagaaagaaacaaacaggaaacacuaaacccuauaccuaaucugggaggcuaacuguggacucagugacagaagagcccaggacagaacccuaaaggacaccagccauagacagguacagcagaaccaugcugcaccuccauccaggcucuuaguggcagagugguccuagugcacccucuuguggacaaaggaaugaugguuuauggacaaccaugaggggguuggcucuuggcaagaagaggguguuccaucuccaguucucacucaacacauucuuccaaugucaucaugccucagacucuaggucuccaucucccccaaccaucagacccugcaggugugaaacugcugacaccugcagagaggugcagacauguaucauaaacaauggaaauuuaggggggcuggagagcagcuuaaagcacuugaacuuguaaaggacccaaacucacacuugaacuuguaaaggacccaaacucaauuccuagcacauauaugauggguucuaaccauaccuaacuacaguucaaugaaauccaaugcucucuuuugaccauguauguacacgguacauauauguacauacauacauacaugcagguaaaacagucauacacauuuuuaagaaaaugaauaaaggccgggagugguggcacacaccuuuauuccuagcacuuggaaggcagaggcaggcaaauuucugaguuugaggcuagccuggucuacaaagugaauuccaggacagccaaggaaggcuacagagaaacccugggacuggaguuacaagacaauuuugaguugcuauguggguacugggaauugaaccugggucuucuaaaaaaguuaguguuuuuaaucacuuauccaucuuucuaucccuauuccauguuuuuuauucuuaaauucaaacagcagaagaaaacauaaauuagccauugaaaacuuuccucccuccuagccucucuagacagcguagggccuuugcuuccaaaugcuuguucacaugcaugccuucuaguguuugacuacaguaggauuacgcucaauggcuuacaacuuugccccuaacaauauauuucuaaaucagcacuuagaaaacuuccucuaguguucuaccguaagggcacuaaacacuacaacuguggggccgugaacugugcagaggcagccugguuccugauggagcacaggccuggaacccaggacacuugguggguggugacuuccgccuucaugggacaaugggaguucagccaugccuccugggccccaggcuccaguagcagcuacagcaucccacagcccccugcagagagguguguggccaucagucacuuaggcaaugccccaagcuccagguauugucuggacuccacccccaugguuacagggcaauagccagguaugcuccuccccacaguuaccuagcaacauccaggauggcacagcccacuauaaaaggagcuacuugccccuccucgaucuuuuaccucuuauucucuugcuuuuacucaugcucccuuugcuccccuccccucuccccccuucuucuccccccccuccacguggccauggccgcccucugccuuucuacaauaaaggccuuaaauaaauaaauuuaaauaaauaaaaaauaaauaaauaaauuuaaauaaauaaaaauuuaaauaaauaauaaauaaauaaauaaauaaauaaauaaauaaaggcugucucaucucaucgggacccucagugcuggagcaauggagcaggucuuccccuaaccuaaccucccacagggagaccucucugaguaagaucacugacugcucuuccgaagguccugaguucaaaucccagcaaccacaugauggcucacaaccaucuguacagcuacaguguacucauauauauuaaauaaauaaauaaauaaauaauuaagucuuaacucucaucccucuugagcaguagugcuucugaggucuccauggccuuccacacaccagcaggacaucuaucuacucagacacaauacuucaguaucuauucagacacaauauuaccccuacacacacuucauguuuucuacuccugguugcaagauugauacccuguaguuuuguucuaaugugucuaacaccacuaguucucuggaggcaggagcuaaggcagaagccaugaaggagugcuguuuacugguuugcucucccuggauugcucagccuccuuucuuaaagaaccuccagcccagagguagcuccauccacaauggacugggccuuccaacauuaaucaaagaaaacgcccuacaagcuuguugccugcagcuugaucuuauggaggcauuuucuuaauugaggcucccuccugucugaugacccuaguuuaugucaaguugacauaaaaacuauccagcacauguagcaagcacuuuuaucaaaaacaggcagaucuauacaaguucaaggucagccuagucuacacagcaaguuccaggccaaccauggcuacauaacaagacucugccuuauaagacaaacaaacaaacaaacacccacaaauuauacauacauacacacacacacacacacacauauaucaugcugaacauggugguggucuaucccuucaaucccagaauuuaugaggcuaagaaaagacaauugugaguuuagacguccaagaacagggcuggagagguggcucagcgguuaacagcacugacugcucuucugaaggucaugaguucauaucccagccaccacaugguggcucacaaccauccauaaugagaucugacucccucuucugguaugucugaagacaacuacaguguacuuacauauaauaaauaaaucuuaaaaaaaaguccaagaacaaccuuguucucuuuauauaguaagacuuugcuucaaaauaaacaaacaagaaacaauaaaacugaaggaaugcagccagaaucagaaccuaaucaaacaucuagaucuauugauuuacaggggcaaaaagagagagcaagagaaagccuaaagauaggacuuaaugguagaaugacaguuuugcaugcccaaugcucuagguucaaucccacuuucuccccauccccccaaccccaccccaccccacccccaaaaagaaaagaaagucaagggacaggggcuggagaauuguccaguuaggagcacuaguuguucuuccagaguaucuggguuugauucucagaauacacauaauggcuugaaaccaucuguaacuccaguuccagggaaucauacccaccucuucuggccuugguggggaugcucaugguacaaagacaugcaggcaaaauacccauacacacaaaauuuguguguguguguguguguguguguguguguguguguguguguguguagguuuaugcaugugaauucagucccugaaaagaccaaaagagggcauuggcucccuuggaaugagaguuaagaacacuggaaacugccugaugugggugcugggaauuaaauuccaguccugagaagagugaccugugcccuuagccauugaguaaucucucuugccuugaauauaauaauaauaauaauaauaauaauaauaauaauaauaauuuuuuucuuuuuuuuuuaacaaacucaagggacagguaaacacauauagcugagguacaaugaguaaauugagauggauggaaagucuauuaaucaaaugacucaaccucuucacuaaaccaaaaagaaaaauuagaaacagacaauauacuaaaauaauugaggggcuggagagauggcucagugguuaagagcacugacugcucuuccagagguccugaguucaauuuccagcaaccacaugguggcucacaaucauuugcaaugggaucaguuaaccuuuucugguaugccugaagagagcaacagaguacucacauacauuaaauaaauaaguaaaucuuaaaauauuugaaccagacaugguagcucacagcuuuaaucuuagcacauauuaaacugagaggagagagauuuacuguugaucugggcuacauugugaguuucaggacagccugggauuaccaugcaccaccuggaucaacaagacaaaucaccacuaggcaguggcagcgcauaccuuuaauccuagcacuugccagguaaaggcaggaggauuucucugaguucgaggccagucuggucuacauagugaguuccaggacagccagggcuacacagagaaacccugucuuggggggggaagggggaaggcaaaucaccacccuaaaaaacaauuugagaggguucagugaguaaaggcauuuguugagcaagcccagauuucaagguggaaagagaaaaucgacuccggaagguuucaccugacuuccauguaagcauauggcugggugcaacuauaccccacacgcaugcaucaaacagaugacaccccaaaaauucuugagaacaugaggacugaaaugugugucuguguucugauuaaacuuuaaaaacuuuuagcuuggcauggugacccacaacuucaaucccagcacucuggagggagaagcagaaggaccucugaguuugaggccagccuggucuacagagugagcuccaggacagccuggucuacaaagugagcuccaggacagccagggcuguuauacaagaaacccugucuugaaaaaaacauaaauaagaaaguaaauaaauaaauaacaacaacuugaagcaaucauaaaccuaacacuaaauaauuuuuuauuuuuuaaaaacucuuuauuagcugggcauggugguguacaccuuuaaucccagcacuugggaggcagaggcaggccgauuucugaguuugaggccagccuggucuacaaagugaguuccaggacagccagggcuacacagagaaacccugucucaaaaaaacaaaacaaaacaaaaacaaaaaaacccuuuuuauuacuuuaugugcacauauuuugccugcauauaugucugugaagcaugugcaugacuggugcccucagaggccagaagagggguucagauucccuggcacugaaauugcaaacgacugugagcuagcguguggaugcuggccacuaauacauauuugauuauauuaagcuacuaagaguguuuucuuuuguuuguuuguuuuuaugcaaugucucauguauuccuggcuggucuuaaacaaccuacauagcagaugaugaucuugaauuucugauucuccugucuucaccuccugagugcugcgauuauuggggugagccauuaagcccaguuuugcagagcuguggauugaccugagggcucugugcacacuaggcaaguacucuacuaacuaaguuuaccuucuuccucucucacuuuuguuuuuugagauaauaucucaguaugcagcccaggcuguccucaaacucauauuccuccaccagccucucaaacacugggauugcaggccuuuaucaauuacuggcuuuuuaauguauaugguacacaugcuaugugcaugcuaugugcauguauacaggugcauaagcgugcgagaguacaaauggagaucugaguuugaugucgggugucuuccucaaucacucuccaguuuauuucugagacagggucucucacugaucucaaagacuggagacuaguuuaguuugccuuaaaagccugucuuuacuuccugagccuugaaaugacaccuuuuaugugggugcagggaaucugaacuacagaccuugcauuugcaaaacaaacucuacauccacucaagucaucucuccagucuuuauuacuuuuuaaaauaauauuaauuugauucuauuuaaugucaugaccuuuuucagaauuauugaaauauuuacagaagaaagaauaugucuaaauuuuaccucaaaauguucuggagucggguaauacaugaaccuuuacuuuaggggaagguguaaugaagauccaacucagggccuaguacauguacuuuuccacuuagcgcgcgugcgcgcgcgcacacacacacacacacacacacuaaauaaaugaggggauggaaagauggcuuaguuguuuaaagcacuugcugcucuagcagagaaucuagguucaauuccuagcaccuacaaggcaacuuacaaccaucugucacucuacacaagccauuuucuggcuuguguggaaccaggcauguacauaguguguguguguguguguguauguguguguguguguguguaaaacauucauacacacaaauaaaauaaaaacuaagagguuacauaccuugcucguggccauaggucauaugacaguaaguccucaucugcaaccacuauacuauauuauacucuaccgaucucuuauaucuuuuccugccugcugauagccaucuccaggauaugacucaagaaaucaccauucaauaagggaucucaaucccuacagugucuggcaaaagaagaaugaaugaagcugagcauguuggagaauggaggcagggggaucagaaauucaaggccaaccucagcuacaugaaacacuacccaauacaaacaaaccaaaagcccaguagacuaauauauucaaaguaauucuguauaauuuucauguguacaucucuauuccacucccugcaccaucaaguuccuagcacaagauucaaccuaagaacaaauucaccaaucuccacacacaaaaagcucagaacuaugaagagcucuuacaaccaccaucucuguucccucggcuuaucaaaaggaauauuucauguaaaauauuguacaucuuuuuguuuguuuguuuuuaaauauauuuauuuuuuauuuauacaaguacacuguagcuaucuucagacacacaccagaagugcaucagaucccauuacagauaggugugagcuaccauauguuuguuagaaauugaacucaaaaccucuggaagagcagucauggcucugagccucugagccaucucuccggaccaguacaggacaucuuaaagagacaguucuaucagagagaggguguagugagguagauacccuauuugaguggacccaggaaagcuaaaaugcuauacuugcuauguauuucuguuuuguuuugauuuuuugaguuaggaucuuaagucugucuugaacucaugauucuccaaacuugagugcuggaauuacagaaccacaccauugaccugucuuuuacuuacccugucuugcaaagcaaacaaagauccuuagucaugcccucucucucucuuuuuuuaauauuuuauuuauuuauuuauuuauuuauuuauuuauuuauuuauuuauuauauguaaguacacugucuucagacacuccagaagagggcaucagauuuuguuacagaugguugugagccaccaugugguugcugggauuugaucucaggaccuucagaagagcagucaauacucuuaaccacugagccaucucuccagccccacccccucucuuccuucugccaacugcccaacaccugaaacauccucuuugaaaucuguaucaccccagagcauaccugaaaacuucaauggggagcuguaugugccagugcacgccuuuaaucccagcacuugggaggcagaggcaauaggaucucuaugaguucuaggcuauccuggcacauagcaaguuccaggacagucagagcuagauaagaccuuaucuugaaaacuucacacacacacacacacacacacacacacacacacacacacacaccuuacugggacccacaaguuucuucaguuuucuuacuucucuuacuucucaucucuuuccgucuuccccuuaaagaugggggaggcaaaaaaaaaaaaaaaaucuagcaauagcagccugaagcccaggcuuuuacuaucaccuucaaaagcauagaaagaaagccuuugugcaaaaggaaguuuggguaacuccuuucaauuuuuuuuauguuauuuuauguguauggguguuugcuugcauguauauauguguaccauguagauauaugccuauggaggccagaagagggugcuggauccaguggaaacuggaguuacaaacuccagugagccaugagggugcuacaaauugaacauggguccucuggaagaacagccaaugcucuuaacugcugagccaucucucugcuccuccugauuuuuaaaagcaccacucugagccuggcagugguggcuaggucuuuaaucccagcacuugagaggcagagauaggcagaucuugcaggucaaagccagccuggucuacagaggaguuccagaacaaccaggaauacacagagaaacccugccucaaaauaaaacaaacaaauaaaaaguaccacuuucuggaggucagaggacaaccugugggaguugaguuuucuccuucuauuacauaaguccuaaggacugaacucaggucaucggguuugacagcaagugccuuuaccuauugaacugucucgauggcccgccuuccuaauucugauuauguucuguccuuaaaaguccugaguagcuccaacauacaaaguccuugggaucccaaacaugugucaagaaauuucuagaaaaauaugacugacaaauaccacaggaguuaugauugaauggaggagacaacauucuagucaaccauggccauuuuuuuuucaaagaugagguuggcugccaggugugaaacucacaucauaccuguaacccagcauuuaggaggacuuugcuaacuccuaacaagccagggauauauaguaaacucuaagccaaccuagaugagagagagaaagagagaaagagagaauggaugaauauggaagaaagaaagagaaugaaagagaauggaugaaugggggcuggagagagaguguggcaguuaagagcacuggcugcucucccagaggaccuagguucauuucccagauccacaugguucacacggccaucuguaacaccagcuccagagggcacaacuccuucucuggccuccagggacacuccaacucauauguacauguccacacauacauacacacauucacauuaucuuuuaaaacaaauacaaaaguacaaaaacaauuucagcuauuuaggaggcuaaaaggaggaucacgauaucaaagccagccuaagcuacagcguauaggccagccaguguaacugaaaaagagccugucucaaaacaaaagggcuguggcuacaguucagcaaaguucacuugccaaguaucucuaaggcuuaaauuggugggaggaaaagggugguaguggggcagugcuuaaugggugaagaaggaagcagagaaaaaaguaaguuaaguaaaagacaacauaaacucaccuuuccuggaugcugauucugucuuuagugcuuacuggguucuucaugcugggcuaagcguuuuacaaaguagcacuguggccaucucacagucuuuaugagauagauagugcuuauauggcugaugaagaagucuauauccagagacauuaaacaauuugccuacaauaauccaguaacccauguuugcuugacucugaacuccuauuaccucugagcaccaagugcugggguauacuguguguaaaggagaugaguaugaauaaaagagcaaguagucccuaagugcuacuggaaagaucuggaugguguuccacaaggaggcccacugcuaaacaguucaucaggaagaauacccuagugugacuauugccaaugauggggugucugcugggaagacagaaacacaagcacccagaaauucaacaguggaacuggcagcagcuggaguaagaaaugccagaagccagaaaaggcaacaguguccaccccuagauuuauccaaguaaggagcuuccucaaagaacaaaacuaaacacuaaauuccuuguaacaggaaaaaaaaaaucucccaagucccaguugauccacagagcucacacugagugccaagcacaguguuaagccccgccccaggcagccaggcagccuacuucuccucuucccacagucacaucuaaaccuuuggggcuggcucccacagcccaacaucuugaaccucuccuuccuugcuuccacucauaugauaaaggugaacaauuuuuucuugcagguuaacauaaaaaucauaaaaucuacuacugcucuuuaacuuuaguaaguuuccuauuuuaacauuauuuuucacuugacgggacuaguuuucaagguaaacauuaacuguaugagcccaacuuaacaucagaaguauuugauaagaaguuucuacauugggugaaucacccagccucuuccagcuacaagccccuuucuucaaaggaauccuuuaggacucagagaugggaacucaugucucuguccuuuacuaccaugugcguggagggucuagaauuagggacaucucuagcuuaguacaucugcuacaguugagccaucuaacuuuagaucagugguucucaaccuuccuaaagcugcaacccuuuaaaacaccuuauguuguggugacccccaacuauaaaaauuauuuucauugcugcuucacaacuguaauuuugcuacuguuguuaaccauaaauauuugugguuuucaauggucuuaggugacccuuaugaccgucaaagggauggugacccacaaguuggaaacuguugcuuuagauuuauguguuaagaaagaggaacuugggggcuggcgagauggcucaacgguuaagagaaccgauugcucuucugaagguccugaguucaaaucccagcaacuacaugguggcucacaaccauccguaaagagaucugaugcccucuucugguguaucugaagacagguacaguguacuuacauauaacaauaaauaaaucuuaaaaaaaaaaaaaaggaaaagaaagaaagaggaacuuagcuuucugucacucuuguguaagaaacuggugcccugccgggcgugguggugugcgccuuuaaucccagcacuuggcaggugaauuucugaguuugaggccagcuuggucuacagagugaguuccaagacagccagggcuacacagagaaacccugucucgaaaaaccaagaaagaaagaaagaaacaaacaaacaaacuggugccccaacagugcugggguggggugugaaugcagguuggggccaaauacuuguacgugaauuucugauuuacagagccaccucuugcuuuuccaaacagucuugaagacucuacacagccagcgguucagagcugggaggaaccucucgcuaaacuggcuuagcaauuccccaggacgacccaacccucagaccaacaccaccaagacacaacgauucuaaagcccuugggggaggagagaagccuuuuccaucuaacuucccuaggcacugccacccaacaggccuaggguugggccagggggaagaagcuuggaggcgcacucgucgcgccggcuaaccaauccucggggacccguccuucuaaauuauaggacuagcucgacgagguuagaggcaacccgagcccagguaaaccacugcgguucuugaaggcuuguuuacgucugggcccccgcgcagagccgcagcuagaggcagacuccuuccugacaugcccaccaucaaucagcucgcggguucccagaggccucgcgugcccuucccggcucagggaggccccccucagacagcccggacccgcggcucacccucgagcgucucgcacugcaccagguugagguaguccgccuggcugagcaccccggccuucaggccgcgcacuaaucccuccaaguagccauuguccacguugaaauagagcuccgggaagaacgacauggcugcggcgggggugggaggcggcaggggaggcggggggcggcgggaccagagagccccgaucugcccgcacgcaacuagacuccccggaucagcugacgcggcggccgcagcgggcugucaagugcgucaggugacgcaccgcgucucacgugaccgcaguagggccuggcucuuaaauggcuccaguuuccgggcacccuggcacgcaug

SEQ ID NO: 4716 - RNA, 719 nt, Mus musculus
acaagaaaagaagucugagaauacaguucacugucaaagcaccugucuaaaaaggucccgcagagcucagcagccaagaugugacuucacugaggaccagacugcagaauucaaggaggcuuuccagcuguuugaccgaacaggcgauggcaagauccuguacagccagcguggggaugugaugcgggcccugggccagaacccuaccaacgccgaggugcucaagguccuggggaaccccaagagugaugagaugaaugugaaggugcuggacuuugagcacuuccugcccaugcuacagaccguggccaagaacaaggaccagggaaccuacgaggauuauguugaaggccuucguguguuugacaaggaaggaaauggcaccgucaugggugcugaaauccgucauguccuagucacacugggugagaagaugacagaggaagaaguagagaugcuaguggcggggcaugaggacagcaaugguugcaucaacuaugaagagcuugucuggacggugcugaacggcugaggacauucuguaucccgagccuguuccuugcccagugugauuucuguguggccccagaggcuccccugucacagcaccuugcccaucugguuucuuuuggaugauguuugccuucaccaaauaaaauuugcucucuuugcaaaaaaaaaaaaaaaaaaaaaaaaaaaccaaacaccugucuaguacu

SEQ ID NO: 4717 - RNA, 12468 nt, Mus musculus
ccaggagcucugcucugugugggugaggacuguaacuggaagggaaacugggcacaguguggacaggggcuaagaguagacuugggugguauuaguggucuuuacuggacucucugagauacuucaccccuuccaggaacccccagagaggcaucgugauacuucugcauuccaguauaaauacgagacacccucugccucccuccacacccagguccaaacugccaggugaguguuugggguggcuuugcccguguuggucaccagucuuggguaacccugaccucugggugugguuuccuuccaggcucucuccucagcuuguagcuugggccuugaauauagugauggagucagagucugaguuaacccagguaugaggagucacugggacauagcagaggacacaugggcugacggacagacaguauuccacgcuguuucauucaaguuuuuuaauaaaauaauuucaugcggcaggaggagagagauucagggguuggggccgccgccucuuuggucuguggcuggggagggagggcuccgcucagggcuggaggguucugugggguacggaggaagaggcuuggauccaaggccagagccugugaaggguuauggagagaaacaaugcuaggcuuguacugagcagucguaucagcaucccagcuggcccgugcccacucucaccuaagcuuggggaugggggugccucgagcuucggccuacgcuugaggacaggggagcgcugcagccggaggggccguucuaaaaaggauacagaaaaaacucacuggcuguccccaacccucugguccaccuugagugcacgcaaaaccaugcacaugcuacgcccauagauuguccagcaaguguccucccacccuagcugaggugggccuucaggagguggcgcuguccaaggaccaagaccgaucgagcccaccucccccuuucuccugcacucaagcacaggcagaggggucucccucacccgcgggggccuggagcugguccucaugcacagacacugcucgccggccugccgaaagaggccucggccucagcuggccaucuagaggaggccgagaugucagaggacguucccauacuccgcccacacccagccuucgccucccaccuuuggccuucccagaugagucggguuccuagccuaggaguggggugccuaccuaccuucauuccuagggcccaagcagggguccucugggagacucaggaugucuggggcggggcugguucuucggggacuugggcugggacauggggaggggggcccuggaccauccuguuggccccaaccacggccucugagcucugcauucagcugcugucccaaugucuuccagguggcagacucaggccccuggccuccuggcccaggucugcaugagggaucuggguagagaagacaaugucagcuaacacccaagccugucuguggaaugguucugagcaacaguccgauccccucccaacccuugcaccuccuuuaacauauccaguggcccucacucaccagcagacacagaguggguacgggacuugauugagaugggaggggucucuguggaacuguccauaaugucaccugcaaggaaggauuagaggcuuaggugucagaccuuagugguggagggagggagccuuagggguuaucugaggccaccuuguuccccaacauauaucuccuugucccgggugggguccuacucaccaucagagccugccuucuugaucucgccgucuuuacucuguaggaaacacaugagucaggcagcagcccugccgcccugacccuagccuugucucuguccauguuguuaaaacccagcuacagaaugcauagcauaggcuggccagagcaugguaaagccaguuuccacccucugaccuuacagucugggauagacagauagcuaacaugcaaaaauguucauguuggucaugacagguagacuuugcuuuugagauagucuugcuguagacaacucaggcuagucuuacuugcaauccuccugccccaguuuucugaaugcugagauuaccgccacauccagcagauaauuaguucuaugacuugccacacuuuaacaucacuacauucaggccaggucucacugcauguguucuuccuggaaagcuauuuaaauggauggcauacagagguguaguuccuaauaaagaccaugauuguaguaauguuauccgggugaccauggaagggugucagggaaggcuggaaaggagccuguauaauccaguacaugacccgacagucagagaauaaaaaucaauggccaagugaggcuucaaaggaaaacaggucuaagguggccaguaccaagguccugugagaucucacagcgggauuaggaaucuggauaaagggacuggagagacggcucagcagcuaagagcacugacuacucuuccagaggacccaaguucaacucccggcaacuaucuguaaugggauccaaugcuaguuucuggugugucugaagacagaaggcagggacaguguacucacauaaauauuaaaacaaaaaaaaaacauaaggcaucuggauaaggaaguuccuggagaacuuucagguaaaacaaggucaaauuucuguuaauuucuucuucagaaaaaggaguucccuauacccuagaagaucugaaccaggucagaagcaagaaggaagaaaguucuccuccuugccucuugagggaugagaacauguaacugauaauuagaucuauucccaccauguguuucucccuucuuggucacauaugucacccacagauuaccacaugccaccugcccccgcaguucacccccaacucacuugcuuccucuugcucucggcacccccacuggcccggcucacgccgauccucuguagcaucacuuguacccgcugcucaaaagauggagccaguucugugucuccccguuccagaggccgccucugaggacagagaugccuaaguggugagagaaccccacugcucucuguuccugaggagccucagccccggccccuggccuuaccuuaucaggucugguacccacggcugcuuccuccucagcagguagcaggaucauggaguaggccuugcuuucccgcguguaccgaggccgauuucugcgagcagggucagggcugcuggugccgccuuccgccccuccagguuccucaccacggccuggacgggccgguggucgcaggagauccccaaguguggauuuucuggcucgagcugcugcuccagggcuggucuccaggucaggucgcggaccccuuguugaacgagguuucuuaaaggcaaagagcguacccagcuucuuucgaagugugcgggggacaggaguggcaccacccucaguggcuggauccuccucuggggcccagcuguaggaauaaccaucagugagugaagaaacucggggauguuccacccuccuccgcccccagucaaccgacccucacucacaagugauccugcuggaucagccuuuuggagaagaacuccuccacacccucauccacgcgagcagugagcccauuuccuucuugaagcagggcugggggcaccugggagacauugggagguuaggagucaggacugggaacugugacucuuccuagacauccucuccuucccaguggccuggccugaguacaucccggagcuggagacugucuguaccacucuggcuuucauucuucauugcugucacagcgcacccacccaguccagaggcugcuauacccugaaccaccuggcugucacuaagcaaacaccuaugggucgcacauugcaaauaugccaucccuucuacucccaacaguucccugcaguacccuaaccuuccaccuccacaccacaccacccggccucucaucccggcucaguggcgccgcugcugcgucagacccucagggggccucaggccagcugcuccucuccuucugccagugcccacuacccuugccaguacccaacccacacauacauccacccgcugguacacagcagacgcaggagugucccgcgguccagcugcccaguguuuuucagcaaccuuaggagagggagggcaaggcggacauccgcucucgcauguucacccauagagcagaccacuacaaggaggggguccaccaucuaguagcuccucacaggaaagccacacaccauggcccguuauugccauggccugaguaugaggguggccagaaagaugauagagcgcgauccgguggccuugggccuccacaacccaucuuccagucuucuaucucaagugaagagugaaugguccacccaugacccucaagaggggcgagggggaagggaagcacuuaccugggggccccccggcggcgggcggugguggugcuggcgacguggucucggucgggcucggguuggguggcguagggguugcccggcggguggcagguccaugcgaggcagagggccggcggguggccccggggcggcggggcuuggagagccgcgugcagacggcccagccugcggcucugcaucuucccccggagcugccagcucggggucccguuccgcuuccucagcagcaccugaggcaaaagcaccagaagagcacagagcgucgaacccggggagguggcggaggagcuagggagggcggcggggacccgcccagggcgcggggaggggcccggcuacgccgcccgccccucccccagucgccgcuguccguggugcugagcgcggccccgagugcgcgcgacuuugugcagccgccaagcaugcgcguccugggguuagggaaaggggaggaggagguagggaaggaggugucuuaguguuauucuguucuggucccacaggguucugagaacagcugacucuggcuuucuuccuggcuuggcucggggaagggcuaggguacacccgggacagggcugaaagaguguccagauuuaacagagcuucaguccacuuggauuaaacucucuuacuccagggccugacuuaccaugaagggaggagaccaggugaaaacaguuacuaggcucaagccauuuccaugaagaacucucauccuggugggauggguacagccucagucuaggguuaggaugacccagaccugcuccucaccuucuacauuccagagcaagaaggagaaagccagccgggguccuaggcuugaaauucugaagacacucaccuuuucucucuccucuuccuucuccgugggaaagaaaagcucuuccaaucccccagucucaagggggcugagcucauuuccacccaguggugguacagcaggggccauggucacuggugccugcugaguuagccucuccaccuguaauaccaggccacccaaagauaggcagaacuaaguagcuagcuuaugaccccagaagucauuucaggguugcccgugaggguuaaacaaguuacucuaugaaauguguucaaagcuucccccucaccagucgaucucgggcugcaugaagaccugcaagagccugagccacaaugcucucugcuagggucccagugauugacaggcgcaugucccuaaaggcaggagacagugaggauuagugugcugucucuguccagcauugcccagcccaguugggcuugcucaccucagccuagagaaggcaucuugcagcagauguuccggaagcagcucugggaggcccccggagcccaccagaacucccucuagcugcuuccuccagccaggugucugcaacaucugugggcagaggcuccuugugguauccaggguggucugagugaaguccugggcaaagguuacaaaauguuagcaguaugccaaaacccagccccuuuggcuuugaaggugugaguucccauuaaaccacugcugacuaagggccuaucccagacaagcguguggaaugagggucaagccugcauggggaggugcggcuggggcaggacuaguaucuuaccuggauguccuggcggcagaucucgcccaccugacccaggaggcucucuagcuucugcugcagcugccagugguggcuuggggaucucccagccucauagagaauggggaggaucuggggaggccaaggaacaaaaggacuugcaaacuggcacaugauugggagcggaaagguccucagagcaggaaagagggugcuuacacugagagagaaguuggcauucuggauggcguccucagccuggugcacggcaaccucacccuggggcccagccccacagcccagcagcuccauaugcuccuguacugacuggcauagcucguucaccuccuggggggcaggcaggagggagucauggauuaguccucccuuuguuucucaucagucuccccgauucugccugucucccuuccaagguuuuccuacaggaagacaaacugugagggaaacccuaucugaucacuugauuauuuucuccaggccuaaaacaggaaggaaagaagcuuuggucacucugauuucaaagaugucaccuuaaccauccauacagagaacaguuguguguauguguguguguaugguggcgcacgccuuuaaucccagcacuugggaggcagaggcaggcggauuucugaguucgaggccagcuuggucuacagagugaauuccaagacggcaaggauuacacagagaaacccugucucaaaucaaucaaucaaucaaucaaucaaucaaucaaggcuugggcugggcaguguuggcacaugccuuuaauccuagcacuugggaggcagaagcaagcagaucucugggaguucaaggauaucccaggcuacacagagaaacccugucucaagaaaccaaaaccaaacaaaagaauugaggcuugggaaugcagagguaagaauaauacaaaaagauggguuaaugaaaggaaauuaaagccagagauaggacugcuggagcuagccacacagucaguaaagagagguuagcccuuaaauaggaagucgaauaaagaggcuacagcaaggacagccuauuuaaacccuuaaagcagccaaauguuacacgggaagcuguuucaagaacggugaccaagaaaaggaaauuguuugagacauagaacucagcacuguggcucagaaaagucagacucugacucaggugcucagguauucaagauuagggcaaggggcacuaaccugcucugaguggucugaaaucagaccuaagggcugaaggcagggcuugagguccgaaguagagucuacuugguuguuccuccagagacaggcuuggaucugcagucaaagagauagugagaaacgccaggggguggagucaccacacacaaaagggcagagagaagcgcggacccccaccugauggaccgcucgaguugugaguucuggccggcugcgaugagccuggguuacgucauucaguggcagcggcauggacuugaggcugugguucuguuccagggcuugcgccacauccagcaggcccagagcagauguguuguuccggucccagaucacagaccugggccccaccaggcuucagcaggggcagaaccccgcccaacccucuggccuuauccaaucaccugucucaucaccauguauaccuuaaacccauacacccgucuauuauauaacucuugcccucuccugcgggucccagcccuuaucaugaucauacccaccguagccugguguugacgcguagagccuuggcuagcaucuuggccccagcauccccuauggcauugccacugauauccagcgcugucaguuuaggauuggugcccaaagcccggaucaggaugcuggcacccugcuucaaccgcgacucagccacggauagugacugcaaaggcugggguuaaaaggaaggcacugauggauacaugggcucagguucagcaaagaagguuugaaggaauauacauaagaagcauuacaagacguuaauugcuugaggaccccccacagggcucugugaacucacacagucgucauccugcauuagcugggcuauccgaugcaggacaucguccagggucucccuguggaaaggggcugcuguuagggaacuaaaugggugaugcaguccuucuugagagguacagggggaagcuugggacucacuugcaccgaacguugaaguuccuuccaagggccacguguuucagagaccggcuccucccgauggcaagcaccagugucaccaugucggagccaaagccuagggguaaccagagugaugcacaaaucacuccuaccaggucagggugcccacccuggggaucugguacaaauaacaggagcauggauggauggguucccuggcggccucaccauuauccgacagauccaaggaacucaaggcacccgcaucacaaaccaagucuuguaucaccugggcacccacggagcggagcuggagguggagguagggugcacucaggauuaugccuggguagggaaggccucccagccucacucucaauaauguggacgugcucucagcucacaaccaggaccggguaccuaccucacacgcgcugaggucuaggugcagaucauggaucugaguguugagugcaagaccuucuagaagggcccugagagagggguaacacacaggugacaagaucugggaacacgggacucggugcgaacgaauaagcgccaggcagguugggguuacgaaagauuaugggugucauagaggggugaggcaguagaggucaagagacacugcucaagguugugacugcacgggaggacugaccugagcgcuucagguggcagcuugcagcccgccaggcccaggugccguagcauccugguaccgccaaggaagcguugcagcgcggcuggugccgcuugggacuuccugcggugagggguggagagcagaagugggauuuacgcucaggggagcugauacccucaagccucguccuuccgagccugccuggugccccuuacaugcgagagaagauauuccuugaagcuuccagaugggugaggcuggagcagcagccaccagcuaaggccgugaagagcugagaggaaggugguauuagcgauaaccuuccagaagcccuggcuuucucugccacgcuccgcucuccuuccuucccugcucaggcgcagccaagcccugccacgcaucccccaugaccacacucuuaccgugccuagcguggcgucagugccugcaagauucaaauacgccaggacguuaggacggcucaggaaaguauacaggcccuacggagggagagagggaggcagggguugccuaaggaucuggcaucccacugacucggccgucccaguuucugacuuuaaaaacugcuacucaccccacuauccugugagggucccagugccccaggguucccagaaagauccaggugggucaggguagagucaaagguggcauucguugccagugcccugccuagagcucucauuccugguggugggugggaggagcggcugaguaucaagacaugcucaccuuaccucgagcccucccaacccuccccagucccacccaccucgaggugucaagccugucugugcuaggcugagucuccucaaggcuccuggacaaugcucuaggugucugcugagugcagccauaccuguggacagagcagcucugugaaccucaccucuuccggcucggcugccuugggucucccagauucugccauaccucugucauccagcaaguucccagacaggcugagcucccgaaguccagaauuaaaauguccugccagggccugggcuagucgccuaacgaagucucugaggaccaagaccccaguuaagacugauucccagucucuccgcagaucacagguucccacgcccagcucaggccucucacccucgcagaccacaagccuccaacaccagcuccuccaaauaggaagauugacucgucaugugcagaaucuguucugagaccuccaggcucugagagcaagagggucgugacucaucagguugaacuuugacccuuacacccuuggcacucccuuuuguguguacucucucaccagcuucauguccucgcaggagaggcgccggaaccacagguuauaagauaaggcagcuacacucaaagccaggucucuaucgcggggaagagaaaaugcagugcucagggccuuccaaacacagggcucagucagcauccccccucuacagacagacuaggaauuugggugcuggaguucucgccucccaauccuggcuggccucauaccggcugccaaaguggcugaaaucuccaaggcagaaguggcggcagcccuggcgaugguagauaguguccacauccuagauguaaagaaaaaaagucacagcuagccuggggccacaaaggguagaggggcuuagcacacacaaggggcgucaaacauccccagaacucccccaaaagggcccuacccucacccacugaaucuccucucggaaugggaagccauuguaaucgcacagagcuucguauguuuccaagaagccaccuagagaggugucgggggagugauagggaaacagacaggcacuaagucagagacaggggaaggucagccccauaguagauggcggcagugauaaaaguggcccuguucacuuuggggagcccccccaauaccaagagacuaggauugcauggaggcaaacuggaagguuuaugcggcucugacuuggcccucaccgcacggacugcuggguaugguggacucuaagggauggcuucucuccagucgagccagcagagacgagggugugggcuuccggaauagcuuccuaggcaggggauaaggagaagaggcaaaagggacuucuagcuccuugaaggaugaaaagcuuucacugaggcccugccccaccccuuggauuuucuaagccucacccaaggguugagcgagggaagaccuuuuugauggcagcagcuacaugcugagccagcuguucgagggcagccacacagggaaacuccaggaccaguucaggcagggacuccagcucaaaggugaccuggggaaggaggagccuuuuggaucccugugugguggaagcgcuguccauucagagugauauguguaggaauaaaugaucaagcggaguguauguucaaguugggguccagcuuucuuacccgaggggguguuuccuguagugccauggccuggaccuccagguagcugaauguacaguccaccuggaaagcaucagagucauuccaacugacuguugcuacucucuugagccuaguucguucuuucuuucuuucuuucuuucuuucuuucuuucuuucuuucuuucuuucuuucucuuuccugagacaggguuucucuguguagaccuggcuguccuggagcucacucuguagaccaggccugccugccucugucucccuagugccaggacuaaaggcgugcaccaccaccuccuagcuuguucuuaaaauuuaaaaauuguacuauuggguguuugcuggcauguuugucucuguaccacucuugugugccugguucccaaagaugccagaagacgguggugggugccuucgaacuagaguuccaaccacuugugagcccaccugguggugggagaauugaacccagguccucucuccacagcccaugauuuuguggcauccugagcuagaccugcccagacuucccuccugucugcuguuggaaaguaaaagccagcaugggcaaagaagacagcugcgcaaggcagucccuugcugaaggggaagggguguuggcccggccugggacucacccucaggggaaggcaggugugcagcaaauaugcccuccaucgaagcagugccuggggggagacaaaagacuaauacucuagggaaaucaaguuucuuugugcagggucuggccacuguccugagcuucacuccuggcuaccauaccaggauauggcuuugcucggcacccuccuggggaagccagguuuucaacagcagcuccgccuccuugggccacaggaaccuggugaucucgccuguggaaagacagucuacugggugacuuuggcuccucuauuagggccacucugugcccaaggucugugcuagacugagugcccagguauucauguguggaucagcuaggaagaaaugaagcggacuuuuaggcacuggcccucccuccagaacaaaaaccccuggucaaguucccuaaggcgccgagaggagaggucugguuuggagucaggcucuucauggccaggugggcucccagggcuuaccucgcaguucacaggauaugucgucuggggucugugccauagggccgggacggcccaaugagcucuggcgggaaaaagcagccggcaggagcguacacaggaagccaggggcccaggcagcagugcagccaccugcuccuccugca

SEQ ID NO: 4718 - RNA, 5569 nt, Mus musculus
ugggaauagaucuaauuaucaguuacauguucucaucccucaagaggcaaggaggagaacuuucuuccuucuugcuucugaccugguucagaucuucuaggguauagggaacuccuuuuucugaagaagaaauuaacagaaauuugaccuuguuuuaccugaaaguucuccaggaacuuccuuauccagaugccuuauguuuuuuuuuuguuuuaauauuuaugugaguacacugucccugccuucugucuucagacacaccagaaacuagcauuggaucccauuacagauaguugccgggaguugaacuuggguccucuggaagaguagucagugcucuuagcugcugagccgucucuccagucccuuuauccagauuccuaaucccgcugugagaucucacaggaccuugguacuggccaccuuagaccuguuuuccuuugaagccucacuuggccauugauuuuuauucucugacugucgggucauguacuggauuauacaggcuccuuuccagccuucccugacacccuuccauggucacccggauaacauuacuacaaucauggucuuuauuaggaacuacaccucuguaugccauccauuuaaauagcuuuccaggaagaacacaugcagugagaccuggccugaauguagugauguuaaaguguggcaagucauagaacuaauuaucugcuggauguggcgguaaucucagcauucagaaaacuggggcaggaggauugcaaguaagacuagccugaguugucuacagcaagacuaucucaaaagcaaagucuaccugucaugaccaacaugaacauuuuugcauguuagcuaucugucuaucccagacuguaaggucagaggguggaaacuggcuuuaccaugcucuggccagccuaugcuaugcauucuguagcuggguuuuaacaacauggacagagacaaggcuagggucagggcggcagggcugcugccugacucauguguuuccuacagaguaaagacggcgagaucaagaaggcaggcucugauggugaguaggaccccacccgggacaaggagauauauguuggggaacaagguggccucagauaaccccuaaggcucccucccuccaccacuaaggucugacaccuaagccucuaauccuuccuugcaggugacauuauggacaguuccacagagaccccucccaucucaaucaagucccguacccacucugugucugcuggugagugagggccacuggauauguuaaaggaggugcaaggguugggaggggaucggacuguugcucagaaccauuccacagacaggcuuggguguuagcugacauugucuucucuacccagaucccucaugcagaccugggccaggaggccaggggccugagucugccaccuggaagacauugggacagcagcugaaugcagagcucagaggccgugguuggggccaacaggaugguccagggccccccuccccaugucccagcccaaguccccgaagaaccagccccgccccagacauccugagucucccagaggaccccugcuugggcccuaggaaugaagguagguaggcaccccacuccuaggcuaggaacccgacucaucugggaaggccaaaggugggaggcgaaggcugggugugggcggaguaugggaacguccucugacaucucggccuccucuagauggccagcugaggccgaggccucuuucggcaggccggcgagcagugucugugcaugaggaccagcuccaggcccccgcgggugagggagaccccucugccugugcuugagugcaggagaaagggggaggugggcucgaucggucuugguccuuggacagcgccaccuccugaaggcccaccucagcuagggugggaggacacuugcuggacaaucuaugggcguagcaugugcaugguuuugcgugcacucaagguggaccagaggguuggggacagccagugaguuuuuucuguauccuuuuuagaacggccccuccggcugcagcgcuccccuguccucaagcguaggccgaagcucgaggcacccccauccccaagcuuaggugagagugggcacgggccagcugggaugcugauacgacugcucaguacaagccuagcauuguuucucuccauaacccuucacaggcucuggccuuggauccaagccucuuccuccguaccccacagaacccuccagcccugagcggagcccucccuccccagccacagaccaaagaggcggcggccccaaccccugaaucucucuccuccugccgcaugaaauuauuuuauuaaaaaacuugaaugaaacagcguggaauacugucuguccgucagcccauguguccucugcuaugucccagugacuccucauaccuggguuaacucagacucugacuccaucacuauauucaaggcccaagcuacaagcugaggagagagccuggaaggaaaccacacccagaggucaggguuacccaagacuggugaccaacacgggcaaagccaccccaaacacucaccuggcaguuuggaccuggguguggagggaggcagagggugucucguauuuauacuggaaugcagaaguaucacgaugccucucuggggguuccuggaaggggugaaguaucucagagaguccaguaaagaccacuaauaccacccaagucuacucuuagccccuguccacacugugcccaguuucccuuccaguuacaguccucacccacacagagcagagcuccugggcgcugguucuugggagaagcugccguuucuugaaggagcacuggaacuccagcuuaggagccugagcucuggucucacaggacuggugugaucuaggggcagggugaaggggugaaagacuggggcugcaguucaagaguagggagcuggguguagaauugcaggguggagaagugggggccugagcucuuggggagguugagccaacagcugguggagacugggaacuguccaucugcccaggguccgauguagccaaggcugacagaaggcuaacgcuggcaccacuuuccuccaggggcauguggcugggugaagcggagguuccugggggaaaggaaacggggugugagcacagaccucucugcucaggacagcugagugccugcgaguguuauacagcauuucacagccucuccacagucaaguaaucugacccaggguacugagugcuuauagccugaaccaaaggaacugggugaaggacaaagaugagucccuggaugcugggcagugguggcacacaccuuuaaucccagcacuuggaaggcagaggcagguggauuucugaguuggaggccagccuggucuacagagugaguuccaagacagccagggcuacacagagaaacccugucucaaaaaaaaaaaaaaaacaccaaaaaaaaaaggugggucccuggcauucuggagagaaucaucaguacuguggugggcucugagccccccccaccccccuguccccauucaguucuuaccccgagccuucugacuggagccuguagaacucaaaaucugcuccucacccucagggaugugcagcaaugagccagacacagugaacacagcuuuucccugcgggacacgagagagggagagagcucagcauggcaguugccuaacccucccucugaaaccucccagaaaaagcccagcacugaccaaggccugggagccagaggugauccagucggugaggggggugguuguacaaggaccuuucagcaccaggcagcucuuagcuagacacacuagggcuccccgaugauccugguccucccucaccucauccagaagcugggacaggguuaggccuggggccagcauuuuagccgaaggauugaaguugcaacaagaaggaaggguaagugagagauuucagugacuuacugaggaaccacagagggaguuagguaggguuaccggggaaaccccuaccaguaccugcacuggaagaagcagacucugagagguggucccuagagaaacagugaagacuucucagggacagcucugaugccaaucuacccagcucugccacccgugaccauaccgcgcacagccucagggcccaaccccaaacuuacucaagacacucauugaguuuucucugcacaucugaauccugauugcugggagaaagaggagggugguaggugaucaggguuauugaugcccaucccucucaccugaagaucuaugccaagugcgcgugaagagacaaaagguggaagcuucauuuaacuguuuuguuuuggggagaggaauauggagagauuuagacugaagcccucaggacuucagccaugcgaagccuguagucugccacugagcuacauccccuucccuuaaagggaccacuuaccaaccagucaccuguauccggggcugcuccgugggcagcagguuaaagcgauccaccuggagguagaacuccgcaggcuggaggaguuggggaguggugucucaggaguggugacaaagagcuagguacaguaaccaacccgcccaagugagccuuaccacucaccgcaugguccugagccaccugaacgcggagcccgcaggccugcaguagcaggagccggcccucggucccgcggaauccgagcuccuucuccucccugcggcgagcacagcccucauuguccagagcacaggcacaaacccccauacgccuggggaaugagcuuuccccacuucuccaguacccgcccacuucagguucaaugccccacuagccagcuggccucccaccuuccgcugacaaguagcacuucucuuaccagucggaggugucgauggcguugcgcgucaccacgcaucggacacuguggguuccgucugacacaaguaacacggccccggugucaggugugucaggggcggaagaagggccgggagucuccgaguccuggaguaccuaacacaacaguaguggcuagugucaauucacucccgccuucucuacccgggucucugggaucugagcgaccugcuuaccuugagcagcugcccgguucguggacuugacaguguuucugaaccuaggaucagcucucgaauccagggcuguagggccagcaacccugaaucggacauuagcagggcggcacccugggcgacccccaggaaagggucuucccgcgagcaccgccgcuccgccucuagcgggagaggaagcacgugaccgccaggcggauccuaaguuugagacuccgccccccucgcgguucugcgccugcgcaagcucuucccggguccugcugacugaccuagcugcuggcugaugacaguuuauucuuaccggggcaucucucugagcccgugagcuguuccucaguacaacucuagagccggaaaggaaaaggcaaggacuagauuggaugagagcgauccagguuaggaggcugcagcagagaauggggccugaagccacuuuggcucuguguaagaccuccagaauuuuccuaaaauguugccguaguuuccuuuacaaaaugaaaaugac

SEQ ID NO: 4719 - RNA, 2590 nt, Mus musculus
agggccacgaggaggacuggaguccaggucccgaccugaagucagcagguccagcuucaacgcguuuccuuccaggcguccuugggcugaggagcaagacgcgguggaaagccgugcucagggguggggcgggguacucgccccgccgaggcaccccgcaacucacccgaggccggccgccgguaguaguccgggcagagaguggggucuggggggauggguccagagaugcgggacgggcccucgcacaugauccuaccgcagcccugcaacagugcaccagggccuguugcgcugcgcaacuuuccccucuaaucccugucgggugcuuccacccuccacccgagcccugcauccccgcgguagcccccaucaccgagccccaccccucgacgaccgcccgucucuaggcgcagacuguaccaccgccccgcgacuagcccacugcccagagggguucgccgccccucccccgccaagccccagcgagggcucucacuggagcaguuuuaccgccaacuguugcaagccgguaggaguugcuguugcuuggcaacaaauggcuuccugaggucaggggucaaaugacuaaggcgaacagccuucugggguuuguaguuccagaugaggagugauucuaagucucgggucucaacaggagccuuaccucucaaccugucuccccuaccagcacugaguaccaguccagccccgcucugggccugagguuuucucugaucaacugucgagggaugcacugauuccucauagccuauggccucagaaggggccaagaggcagccagaaacccagaauggggcagcaguaggguuagcccagguugcagagagccuugaggugacuugggcauuucaaagcucgggagauggagggguagggcaggagaggugggacucuagguaacccaacccucuaacugccaggccaagcccuacaaguagagaggccuaagcugguuaccuucauauuuuguggccaauauguaguuaggagacaccaccacccccccaaccaagggagauguacuccaauugcagcagcuuugggcuuugaauaacugauccccacaauacuuugccuggccaucggcucccaaugaccuauguguaucuucuaguguccaggaacagaagagugucuggugccggcacaugagaccugcaggagcccaggcgaagacaagugucccguggggcacagcuuagagccagagcuccaggaggaaggaauaaaggugggagaggaagggcucaaugcagggguggaagcaggagaggagagaggacccaagccuacgucauccaucgugagaccagcucaugggcccaagagaaagugagagggcuuucggagggaagggcugggaaggugggucuuaugcccggagauuccuaaauccccauuccuucaaggcagagauucuugucuuugaccaauaccccucacucccaacucuagaacuugggggcugggggguugguauggauuugggacuucuagaucuugcaaggagacugagcuaccauaaaugcugagccucuacugggcuuggagcuucacugucuaagaaauggacagcuaacuagcucuaguggacaggcagggguaagcccuaggcucaagauauaggaaccaaagacugaagccugccucuuucaggccucuugucccagguuuggguuccccagcccucccagggccaagcaccauguccauccuaggucagaaguugagcugccaccgggggugcugcagaagaaggaggagccagaaggcagccacagugaauccucacuguccucgaaacagcacaaaaaagccaagaaacgcaagaguggcggggcuccugugccgcccgcuguggccagcgcauccgcacccgccgccgagaccuugggguuggagcgugaguggcagucccugggcucuucucuuguuuucuuugucuucugaggcugacauggcacagccugguguucuagccuuugcucugccuuggguucuugcaggaaaagcccagcgccugcggccacuguaccaauacaucaacuacugcaacccagagcugaaucaggaggaggacggggacagggagcccgagguagagccugaggccgaguuagcacugguucccgaggagccgggcguggaacagcugcagcugcagaccuugcugcccguggcaggugagcugggcuuaggccuugcuuuacccugcccuaauccguuagugccacugacccauaaucuuccuccucugguagaggagguuggagaggagccugggggucugucuagucugagggugaguggcagccucaaggcugagguggauaagacgacgcaaguggauaucgacaagauguugagugucugugcugccccucuugugcccccucuauccccucaguacaagugaccaucuagccacugagaauaccccuggucuaggccuaaaccauggcucuaaguccaucggccuaagccaucagguggaggaaggaauuuuagucuuugucuacacuugagaauuugcgcucacugaaaauaaacauuuccccccuuuuag

SEQ ID NO: 4720 - RNA, 65908 nt, Mus musculus
ugcugauacacacagcugcugauacacacagcugcugauacacacagcugcugauacacacagcugcugauacacacagcugcugauacacacagcugcugcugaugaaauggaaguccauucccgaaaggugaguuacaaagugaagggugcggagggaaggggcugagucuuuucugccuagaacagcuugggcccacuuucagaucagugggaaggaugagccugccucaccuucucuuccagagcauggggaaccuggcuucugggagggagucacauuucucugauugggaagaagcuagucugcuagguuaugcuuuuggguuguauguggaacagacagguuguagagggugacgugugggguuccaaaagaagagcaucacuaaccaguguccuucguuucugagaaagcuugcguuucucaaugcccuuggcuuccggagucccuccugaagcuuguauacuuauucugcauagaaaagaagcuguggugggugacagagcccauaaagaggagauccuuccguccucugacccuucccgaauccauagggcaugacucucucuuccuuuuaaaucucucucugucucugugugugucugcuugugagucugugcacuuugcuuauguggacagguacuggcacaguccaaaagagggcauuguuuaauggcuugaaagagucugggggccugguaccugggguuucaaaaggaucagguuugagcaaaucauuuaaccuucuuuagcaauuuucucuuaaagaaacagacaauucuuauucuucucccacuaguuuuguaaagguuaaauaugagugaguuaagcagcaggugguagugacacaagccuuuaaugcuagcucucgagagguagaggaagguggagcucugugaguucaaggccauucuagucuucagagcuacuucuaggacagccaaggcuacaaagaguaacucugucucaaaacaaacaaacaaacaaacaaacaaacauaaaacaaaaagugagauaaacaaaagacuacaaagacuaaaaugaguugugcgggugcuaauuuuuguuuguuuuugguuuuguuuguuuuugguuuuguuuguuuuuucaagacaaccccagguaccaggcccccagacucuuucaagccauuaaacaaugcccucuuuucucuguauagcucuggcuguccuggaacucacccuguagaccaggcuggccuugaacucagaaauccaccugccucugccucccaaguaccacugccugggcuuguacagguauuaauuaugauagcagaaaaauagauccugaagagaucucagacuugaaagucaagcuucuugggaaagggcuuacucaagguagaaaggcauucaaggaacaacagagagggcuacauacauauggccagugugacccaaauggaagaaacaaaagagguaauucagugaccuguggggcaaggguaugcuguuauugauagacuuguguacauguguggucauugguauugcuugcuagugacuuuaaguauguugcuguaccucaguuucuuugcuuauaaaaaaaagugaaaaaaaagugaagccgggcggugguggcacacgccuuuaaucccagcacuugggaggcagaggcaggcggauuucuggauucaaggccagcauggucuacaaagugagugucaggacagccagggcuacacagagaaacccugucucgaaaaaccaaaauaaaaagagacuaaggcuggcaagauggcucagcagguaagagcacugacugcucuuccaaagguccugaguucaacaacaacauggugucucacagccaccuguuaugagaucugaugcccuauucuggugugucugaagacagcuacaguguacuuauuuaaaauaauaaaacuuuuuuuuuuuuuuuuugguuuuucgagacagggguuucucuguguagccuuggcuguccuggaacucacuuuguagaccaggcuggccucgaacugagaaauucaccugccucugccucccgagugcugggauuaaaggcgugagccaccaugcccagcuuaaauaaaucuuucaaagaaaaaaaagugagacuagagccaggugcuaguggcacacgccuuuaaucccagcacucuggaugcagaggcagguagaucucugaguucuaggccagcuuggucuacagagagaauuccaggacaaccagagcuacaaggagaaaccuuguuuccaaaaaccuaaagaaaauaaaaaacaaauaaaaaguaagacuaguauuacucaaacaugugaacccaguugggacacucuguucugcagaauuccucaggccccucaaauggggcagugagaccccaaacccuagucuucuagugccacuuaacaucgcacaaacguggacaagcaacuuauagagaaggacaggugucaccugacguguauguguuugugacugucauggacuaguaguccuguaauccuggcugcguaggaggcugagguaggaggauugcaaguuucaggccacccuggguaccuugcuaacaucuucuguugauagaaggcagaaagggaguugggcuaggugcaaaccuuaaaucccagcacuugggagucagagacagguauauuuuucuuuguggccagcaugcugcacauagugaguuccaagccaaauggguacacagugaacuccucucucaaaucaaacaaacuagaggagcugggcauauaccucaauggcagaggacuugccuaauaggcaugcgauucagguugggucuccaauacugauuguuguuguuguuguuguuguuuuuaaaagucacauauuggagagcaacaagauguaguacuuaaccugcucauuggguucuuaauacucuuuucucaagaucagucacuauuacuguuucaaaaaaaaaucauucauuuauuuaacuugauuuugacaugguucucacuaaguauccuagucuaccuugaaaaucagagaccggguuaaccugguauccaucucccucccuuugcuuucugagcacuggaauuaccagcagaaacagcuaugccucaaugccuggaagucagucuuccgcuaucagccuucagaugaagaaguagaacucucagcucggccuguaccauaccuuccaugaugcugccaugcucccaccuugauaauggauugaaccuuugaaccuguaggccagccccaaauauauguuguacuuuauaagaguugccuuagaaaaggcuccugccaaugugaagauagauggauugcugugacacaccuaccuacacacuauuugcagauaaucaguguccuaugcuguuuuuacaaauaaacuugaagcaagaaaaaaaacuugccuuggucauggugucuguucacagcaguaaaacccuaaaacagguacuuauugguuuauuuuuaauuucuaacuacuuuucuuuuaacgauuuauuuauuuuauguaugugagcacacagucacugucuuuugacacaccagaagagggcaucagaugcccauuaccaugugguugcuaggaauugaacuuaagaccuuuggaagaacagucagcguucuuaaccgcugagccaucucccuagccccuaacuacuuuucucauuuaaaauuuuauuuuuauuauuuuauuuguaugaguauuuccccaggagggcagaagagaacauugcaucucuuggaaccgaaguugagagaguuguggguguugggaaucucacucagauuuucuagaagagcagccaggcagugcucuuaaucacugagccaucucucuagacucuaauauuuuauuuauuuauuuauuuauuuauuuauuguuuuucgagacaggguuucucuuuguaucccugacuggaacucacucugucuguagaccaggcuggccuugaacucagaaauccaccugccucugccucccuagugcugggaucaaaggcaugcgccaccacugccuggcuuaauuuuuuguuaucuguguguguacaugagugcagguguccacagacacaagagaugucagaucucccuguagcuggaauuacaggugguugugaaccaccugauguggacacugggagucaaacucaggucuucugaaagagcuuaccugcugagucaucucugcagccuccucaagccccaaguuuucuuuuuccucucuuucuuccuucuuuucuuucugugaguauuaaugugugagccauaggguccaggggagauuaaaggacaacuuguugguaugacuuuuguccuucuaccaugugggaucuggggaucagauuaagggaaccaggcaauccuuaaccugcugacuuaucucucaggcguguguguguguguguguguguguguguauguguguguguucaagacauguuucucuaugagaccaagccggccuugaauucagagauucucgugccccugccuuccaagugccaugugccacuacugcccaucuaggcucccauuuuuauuuauuuauuuauuuauuuaaacauuuauuuuaugaguacacuguagcugucuucagacacaccagaagagggcaucagaucucaugacagaugguugugaaccaccaugggguugcugggaauugaacucaggaccucuggaagagcagucagugcucuuaaccacugagccaucucuccagcccccuugacuccuuuuuuuuuuuuuuuuuuuuuuuugguuuuucaagagaggguuucucuguauaguccuggcugucuuggaacucacucuguaacucuguagaccaggcuggccucgaacucagaaaucugccugccucugccucccaagugcuggguucaaaggcgugcgccaucaccacacaaccuagacuccuauuuuuuaaaaagugauuuaacaccaaaccucaaggaggaaugcaaaauauuuacauuuauaucucaaugguggugaaaacucgguguuauaaauggcugcaggcaaugugugcucaggagaauuuccuaguauugaaugaccuucacagacaacccauuaaaguagcaagcagggauaugagaacaaagggagaaaagcccauacauaggaggagaaacauucuccaaggaaauauaaaacucuaaggucucuuuuaucagguucugcuuacauucuacugugcuaagcucugaucuguccaucuuguugacccucucuaacgucugagggagaaaacccacacugcaucucuauaagggaaacagugugucacuacaugaacugugaauuaauaugucacauaaccaucaaacucagcuuauaaaaacuacauugugcucccuuccuaaugaaugaagauucugagucuguuucauauucuguguguugcuggggaucaaaccagguccuggcauguucuagcuacagccccagcccuauuacauauuuuuucauagacaguaauuuuccuggauuaugccuuugaugggaaacaguugucucuuucaaccugcugcugccuguuucucggagacuuuuuuuuuccuucagggacaaucauaacauugguauuuucuguccuuggaaccucuguaggcuuauuauuauuauuuuaauucauuuauuuuaagaugggucucuccauauagcccugacuguccugcaacucucacuguucaacaggcuguccuuuuguagccuuuuucuaccaaggcagcagaccuugaaagauuagaguugagaaugaaaucaccucucucgcccuucuuccacuacugggaaugagcaggugggaaacugaaugcuucuuauaaacaggaguugugagaauuucacauauaauuauaauaaggcacuucguuuuuuagugucuagcuaagaucaucuaucuacgauaaaguacaccugcacuuuuggcagcuuguaacguucuuacuggacugacgagucagccccaauucuauuacaacuguaucgcugauucugcggcgcugaaguccuacccaaagaacagacagugcagcgaucggaaucagugucauuuuucuuuuuggaaauauucaagucuuccccgcccucagcccggccaggugcuaccuuggcuuggagaaacuuuuacgcuccuguagguuggccaugacuuuggagcagaugcaggauugagccguugcgguaguguacaguccguugccauagggaccagaccccagcagccucugcguugagggcgggcucacaguugagccacgccuccagcccccgcccccgugagcacucuggagaaaggccaagcaguaaaaguagaccuggagcuggggaugggguauucugagaaccagucaauacagcaaauuugauauuagcuacagaacugaggcagaagaauaaagugagaccguggacgaggaaggcgagcuucgaggucuggccacuuggccagucgggaaugguaguucucagugguucggagucuucguuguacuggcuugugagugagcagugauguacuacaucuuccgaaguucuccaggaacccucguuggccggcuucuacagcgcuaugcauugugggauauguagucuaaaucuggcgaaguauaguaguguccagagaaagguugccgggacucggacucaguuucccuacgacccugggaugcucacggcccauuggcugagcaaggcaaaucugguugcacuccuccccgcccccagugacacaauagcagcucccuccaagauggcggcggcgacggcagacccgggagcugggaacccgcaggcuggggacuccuccgguggggacuccgggggcgggcuaccgucaccuggagagcaggaacugagucggcgccugcagcgcuuguacccugcgguuaaucagcacgagacgccgcugccgcgcuccuggagccccaaggacaaguacaacuacaucggccucucccagggaaaccuccguguccauuacaaagguaucagcgggucuggccgcugggagacaaguuuacugcgucugcagggaggcugugcccauuuucccuuucuuugcccggguuuucugagaguugggccuuagcccagcggaacguccagaguagagggguuggucaggccgggguuuacccugcuuccuuugcucuguuccuaaauauuagacucagagacaacugcauuaaauguccaaaacuagacaggaccuuccacuucagggccacccuucuuuccugagcuggcuccaauuuaugcuaggcccuuuaccacggcuuaguuucagucuuuuuuuugcaaaaagaggugguaacauugccacaguaagugcaugggcugccuggcugccagucaucccgggacugggcuaggcgcugugugcuaaaguuguuguuggugacuuccauuuuugccacuuccuuccccugggcuccaggcugggcuguuuggauucuggagagacggacaacaguauucagugucucucacacacuucuguugccuguaucuaccuuguuuuguuuguuguggaggacaauaucucugucaggacuguuggucugggguggagaugaucuaaaggcgggaggcuuaaguguuuacucaguugucuuauuauuccucagagaguacaagaacuucuucuggccagggaggguugaauuuaccauggcguagagaaaaaggaggccuucauuugcguuuuucugguguugacauuccuuccuuggcuucuuacaucaggucauggcaaaaaucacaaagaugcagccucuguacgugccacccaccccaucccagcagccugugguauuuacuauuuugaaguaaagauugucagcaaaggaagagauggguaagccuacuuaacuaucccuuucccuccucaacauaggacugauguuccccguugucaguguuugaagcuccugaacuaguaucagggacugauauuagccugcugaccuacuuggauccgggcuaccacuccucugacuagagacacgaucuggucugaacagugagugggcuuugagagcagugggcacauuauagguggagcggagggcacuuuuuuuuguauuguaauuagauagucauagaucgggguuguaaguaacaagguuacauuaacaauucaaagggcaagugggguuuccccugcuagcaugugguguuugugacuucccuuguuuucgagguugagguuccuuuuuauggcacugagacaaggagaggcaucaggaagcuucaaagggacagcagagucugcgcagcucucuucaaagcuguggcagccacugucaucuggauaaacaguguucacacagucaaagucaggugaccuugcugcucauaaacuuguuuuucaguccaaggacuugaacaccaguuggaccagcuuuaggaaggucuuauuaaagucagcauuagggagacucccuauuuuagggugaccuaagcagacacaagguaucagaggggacauuuguccuucucuuccuuauuccuccagucuccuuaauccaucuaguaauugucacaaagcagaugucccaagcuacuccagaaugugacuguaacuauuuugggacaagcuuucuuuuuuucccuucuuuuuuuuuuccucucuuucucuuucucucucucucucucucucucucucccuuccuuccuuccuuccuuccuuccucucucucucucucucucucucucucucucucuuucuuucuuucuuucuuucuuucuuucgugggguuucucuguguagcccugacuguuccggagcuugcuccauagaccaggcuggucuugaacucagagagaucuaccugccucuacuucugccuccugaaugcugggauuaaaggugugugcgaucagcacuaccaucacccagcuaagggauagguuuucuuaggucuauuaugggaggauugcaaauccuaccaguggcauucauguggaccugaguguguguuuuuaagcuuuuagauaacuuuugucuccuaacaacugucucacuuauguugugugcaaaaugccagguuuagacgcugagccugaacugagcaugguguugcaaggcuguaaucccagcacaaguagggugggguggggagaaagcaggcagaucucuguagaggccagccuggucuacaaagugaguuccaggacagccaggauuauuucauuagacccugucucaaaacaaaauaaaaaaacaaaaaggcugagucugggcagaacuguugggaucggagccuugaauguuuucuuagugacuuugugacauccuggccuuggaggggccucggacuugaguacaucuuggggcuugagucucaucacagucauucugggaucuaaacugccuuuagccuuaacauucagugacuuuagaauuuuaaucaagggaaucugucgcaucuuuaacuuucauucccaucugcuucauuugcagauagaaaacuuacauuugcuggaagacuuaagauuaauauuucucucuaccaucagauaaaacauauuuaaauguuuaagucaguaucaaugagaaugaccucuuaaaacaaacaccuuaggcugggcgugguggcgcacgccuuuaaucccagcacucgggaggcagaggcaggcggauuucugaguuugaguccagccuggucuacaaagugaguuccaggacagccaggacaauacagagaaacccugucucgaaaaaccaaaaaaaaaaaaaaacccaccuugccgggcgugguggcgcaugccuuuaaucccagcagaagcaggcugauuucugaguuugaggccagccuagucuacaaagugagcuccaggacagccagggcuauacagagaaacccugucuuaaaaaaccaaaaaccaaaaaacaaaaaaacccaaaaaaacuccaaacaccucaaaaauaguuacaguguugacuaagaugugguguuggacucagauauugccagggagacugauggguguacuucuuaagcuuguagggaggaaaauggaucuuuucuuuguggccuuuuuucacagauaagggcugagccagugagagacaagagcagguuuucagaaggggaauauuuaaacguagagaucuggauuccuucagcugcccuuuuagaugucaguggcucuuacugaagaaagcuguguuagaguguguaagcuguguuagagcguguaagcuguguuagagcguguaagcuguguuagagcguguaagcuguguuagacucuaagcuauguuagaguguguaagcuguguuagacuguaagccuuguuagagccuguaagcuguguuagaguguaagcuguguuagaguguguaagcuguguuagaguguaagcuguguuagagcguguaagaguguuguguugcuuacacugugaugcacaccuuuaaucuccaacaauggaggcugagggagacaggcugaccuccauggcaaaucccagaccagccagggcuacauaaugagauccugucucaacaaaaugaagaguguuuuucccagccuuugcuuuccuuuuuaaauaacaaaguuccauguauuccaggcuggcuucuaauuuguuaugacgaacgaugaccuagaacucaugauccuccagccuuuacuuccccagugcuaggauaacagacauaugcuacucuaccugauguagacggugcugggaaucauacccugagcugcuuagacaggaggcagguacucuaccaaccagccacauucccgggaccuauucuugguguuuuuacauauguugaauacacuuguugaguugaucuggaaggcuuaaauuuauaaaaucaugugugauaugugugugugugugugugugucugugucuguaguggcuugcuucaguugacagacaacuaaagcaguaagauagggguggguauauaacuccccaaggcuacuuucuggaaucccugaaaggcuuuuugugguugagauaaaacuaguuauugguaugagccacauaguauaggucagguuuuucuuuuucuuuuucuuuucuuuuuuuuuuuguuuguuuuuuguuuuuuuuuuucaggacaggguuucuuuguguagcccuggcuguguacagaacuccauuucagguuuggcuuuugaggaggccaacagggagacagugccucuccauugauguuggaaguauauuucuuuuuuuuuuuguuuuuuguuuuuuguuuuuuuuuuuuuuuugguuuuuugagacuggguuucucuguauagcccuggcuguccugaaauucacucuguagaccaggcuagccuugaacucagaaauccgccugccucugccucccgagugcugggauuaaaggcgagcaccaccacgccaggcugcgccaccacgcccggcggaaguauauuucugacucaggucuuguugauggcacaagcauuaacugcagcuauagcuauugguuuuguagccuuccuguguugucuuauuugagcaucucuagaaaaugacuggcgcaaaugacgauagauagacuuguuuugugggugagucccugagauguuugguagccugcccuggcugcagggcuuaagaugugcaaucgccucaccugucagauguccuugccugauuccagacacgugucugagcugcugcugacuucucccauuauggcugcuauugccugucuucucuggguuggugugaggaacauccuuacaagaucacagugucaggggauaggacagacagggagaguguucacugaggcuagaaaagcaggccaugucguuugcugggcuugacugacucauguucccauugaaucuguaaaccugucuuucuguagaguuguguguugcuacuuacgguauuuauuaauccauuuuuuuuuuuauugucaugguucaucagaagugcuuuuguuuucuuaguguuuauauagaaaaaacuaagcuagucugguuugguuuuauagaaaguuuuuuuuaagugauuuuauuauuuuuaguuacguguguguguguguguguguguguguguguuuggguauauguguugugagcacaguacuugagguggcuagaauaugauagcauauccccaggaccuggcauuuuagguaguuaccuaccugacaugggugcugggaaucaaacacagguccucuggaagagcacccaugccuuuagccgaugagcucucucuccagccccucacagaaagguuuggucugugugcuuggggugggauccuuuugagacagcuuugcuuuguaguucagcuagcuucaaacaaguggcagucucuugcugcuuaagcuucccaggggcuacagaguaguguuauuucaaggauuuauagaguuguuguuguuguuguuuuuccauccugaauguaccagauacaauagagcagaagcaaagacagcaacagaucagccuuguccucagggagcccguggccuguucaguaggccugagaagagcuuuucauaaggggauguaaaguugagcacugcagugagggaugaguaggaguuuccaguaggcacuaccuguggaucugugacucuaguggguaauuagcuucauggcaggugcuggguguuuggacuuuuccuguuuaggagggagggcucugugaaggagcuaagagccuggcauagacugauaggcuucagcugaacuuugccaagucaccagagcugugaaccuagggagcaggucugauagggugaggagaugcccugccaggggugccccucugagauaagggccaucuggguuccucaggcugauuuuauggaccuguggauguccccagcuuuuuaugaugacacauggaggguguggcaguccuggcuggcagaugcuucagugugacccucaaaauagacuguaacaucauccuaguggcggaggccuccugacaugugaugguuggcucuacccaagaacagcagacuuaggcuagagcacuaggugguguagacagcacuacugggguuguguucagcuagggcccugaguagggaucuuugguuacugccagccaccucucguuugcuugaucacauagcagcacacccacccauccacgcuacaacccaggaugaacauugauuguccuauggcugggcuccaggagcacagacaugaggccuauuuagagaugagagauauaccccuacaagugaccucacaggggcauaggaauuguuaguccauguuauggacccuuucuggguuggcccagggcuuagcgcucucucuacaccucugaguugaggggacacuugcagaagagauggugaugaaaucacaaagagcaguuggaacgcucaggauaaacaaauggagaaacagaugcuuugggcagaagacacaggaaaagauguaggcuguccugggcaugguggcuuaugcuuguaauuauugcgcucaggugccagaggcaggaauaucaaaaguuugaacccagcuuggcuucaaggcuagcuuaggguuacacagggagaccauguuuauuuggaaaaauuggggcccaggacagaguuaaguagggaccaaauggaaaaucccuuguguauuguggccaaggaucgcggacuuuguuuugaggguaguuggguguauagacucuggccagucuggucuagcaggccucuguugagaguguuguccaugugggccaguggcuuuagguccuucccccggagcauaguuuucucuuaguaugguccuuuuucucagagguagagugauucucugcuuacguggucguugucugaugguuugguuuugccagcuucucuuugaaagacaguaucauccuauguuuuaugccuaagcauuuccuucucauguguuuggaucacccaaaaugauuuguaauggagaccgagagucacuuuauuaagaucuuaccugucaccuucuugguccucucauucaagaaccccuccccccauucuggugucugugcaugguucagugcuguugaagcucugcuuaucuguggacuggcuaaugccuucccuccucugcccugaggaguaggugcuauccuugucagagcacugguagguagccagcagugccguccuguucucccugacugccccagagcugguggaauuggaguggcugcugagcuuaaggaugcguguuuccucaagugccaaauacugugcuguuacuggagccucuggagccucuuggggugauagagucuuaccuauauugaaggugaaaacuaguuuggacaucuugggauguagcucuggcauggguugaggaagcuggaauccauuuuucuuuuuuuuuuuuuuuuuuuuugguuuuucaagacaggguuucucuauauagcccugacugucuuggaacucacuuuguagaccaggcuggccucgaacucagaaauccauuugccucccaagugcugggauuaaaggcaaggaauucauuuuucuaguggggacuccucacuauaacuuguugccugcauccaacugugaacucagaaugggaaguaagaacacuuuuuaagauuuaaaaaauugguauuuucuuugggggggguauuauccaugugcucaaauacacauguggauuucagaaggcaaccuagaagaguugguccccuccuuuuccucugccaagugagcccugggauugaagucagcucuucagucuuggcaaugaguaccuuuacccacugcuaucucuaugacucuuagauuuuauuuuauuuuauuuuauuuuauugcuuuuuguuuuaugagacaggguuucucuguguagccugaguguccuggaacuugcuguauagaccgggcuggccuugaacccagaguucugccugccucugacucucaaguguugggauuaaaggcaugugccauuggcuuuuggauucuuuuaaguuaguauuuauguguauaugugugugugugugugugugugugugugugugugugcuuucauuacaucucauacagggaggucagaguguguguguguuugcauuacaucucauacagggaggucagaaggcagcuuguaaaaaaguagcuucgcuucuaccgugugaguauuggcaauagaauucggguuagcaggcuuggcagcaagcaccuucacacacugagccaucucacugccccaugaguggugaugggaguguuugguguuguuuuacucugugacuuuggcuggccuggaccaagcuguguagaccaggcugaccugaaacucauugagguccaccugcuucugccuccagagugcuggguuaaaggcguacagcaccaaacccuggcucucuccuuggguccuuuauaaauuaaaucuuccuuggugaaaggucagccucuagggagauuccuagacuggccuccuuuugcgucuuccgucucugggaagcuugguuuauuucuguagaugggucaguacaaaggggagacucccaguuagaaggcaagccaggguuugucaggcugagcagagagcaugaauuuagcagaccacuggaaaaaguagaguccuggagggggucuuguguggucaaggaucaaguuggaaaaaagacuagugucugagagaagagguagcuguucucagugcaaggauuuuucucugccucucaggauccauauaaaaugucuucauagcuucaagauuuacugugucuuuguugggaccaaaauguggagucauggcugacuugcaaggacuggaggacuugaugauagagcagaggguagucucuugucaccgagaugucagaacaagaugcccuggacguguagggauuugggaggggccuagaaaguucuuuccaccccucuccugccucucuucuugucuuagaagguaucaucagauuucaggacucuuuaggucagugugcuggcucguuuuauaucaauguaauacaacaccuggucaucagaaaggagcagcuuuaacugaaaaaaugccucuagagcuggagagauggcgcagccauuaagcacacugacugcccuuccagggguccugaguucaauucccaguacccaugguggcucacacccaucuauaaugggcuccaaugcccucuucuggugugucugaagacagcaacaauguacccacauacaugaaauaaauaaauaaauguuuaaaaaaaagaaagaaagaaagaagaaaaaaauugccucuagcaaaucaugcuguaggcaagcauguaggcauuuucuuaaauaaugauuuauggggaggguccagccaacugugggcugggucaccccuggagugcugguccugaguuguuaaggaagcaggcugagaaggcuuggggagugagccaguaagcaacacuucuccauggucucugugucagcccucuccugccucucuucuuguccuccuccuccuccuccuccuucuuccuucuuccuucuucuuuucuucuuuucuucuuuucuucuuucuucuuucuucuucuuucuucuucuucuucuucuucuucuucuucuucgucuucuucuucgucuucuucuucuuugucuucuucuucuucgucuucuucuucuucgucuucuucuucuucuuccuucuucuucuucuuccuccuccuccuucuucuucuucuucuucuucuucuucuucuucuucuucuuccuccuucuccuccuccuccuccuuccuccuccuccuccuccuccuccucccccccuccuccuccuccuccuccuucuucuuuucuuccuuuuucccccccucuuuuguaucacuucuuaucagagcuaucacauugauagaacuuuuaaguguaaaggcuugaaguccuguagccaaauucauccugcaccuuaugcaucggucauuauuuaaggugcacaaggauuugguggcccauaagauccaccuucccucugagagccagcgagaagagcuggucugugcucgucauuguucucacuugcuuugggcaagcaggaggggcuucuuauuucuggccugacacaggccagaggacaggcucugaugcuucccacugagcuugcugccagggccuuacucggcuacaaggggcugacugugugugcugaagaccuuccacauaaaaugugccuugugucacuuuaguauucucucucucucucucucucucucucucucucucucucccucucccucucuccccccucucuccccccucucuucuccuccccuccccuccccuccccuccccuccccuccccucccuuccccuccucuucucuucucuucucuucucuucucuucucuucucuucucuuucagacaagaauuucucuguguagccgggugugguggcgcacgccuuuaaucccagcacucgggaggcagaggcaggcggauuucugaguucgaggccagccuggucuacagagugaguuccaggacagccaggacuacacagagaaacccugucucgaaaaaccaaaaaaaaaaaaaaaaaaaaaaaaaagaauuucucuguguaguccuggcggcuguccuagagcuugcucucuuuagaucaggagggccucagacucaguucugccugcuuuugccccccccccccccccgagugcugggacuaaaggugugcacugcugugccugccuaagcuuuuugcuuuuuucaaaacagagucucacuauguaguucugguugucuuagaacucacuguauagacuagacugaccuugaacuuacagagaucuaccugucucugccucuuguguguuguugggauuaaaaucauguaccacuaugccuguccuguuuaucuuguuuaaauguguaauucagugguuguacuuaguaucacaauauuauccuauuaugcuaauuauuuccagucuugagugugcuagcacagccuuuaaucucagcacucaggaggcagaagcagaugaauaaaagguuuaggccagcugggacuacauagugagacucugccuuaaacagaacucaacccaaaacucaguaauucucucuuccucccagccccucauuacauucuguguuuauaaaauauaccuauuuuagauauuuugaaaaaagaauuauuuauuuuguauauauaaauacacuguagcugucuucagacacaccagaagagggcaucggaucucauuacagaugguugugagccaccaugugguugcugggaauugaacucgggaccucuagaagagcagucagugcucuuaaccacugagucacuucuccaucucuauuuuagauaguuuuauaucauuugaauccuacacugugaguccuaugguaucugacuuguugguguaacagugguuugaagguagcugcuguggcuugaacccgagcugcuuccuuuuucaugacugaguuauuucuuacaguguagcuagcuagcuagagaacuaggcauccaggcagacacaugugucuaucugcucaucuguugauggacaggccugcuuguuugcauucauugugaccagugauguugagcaucuucucauaugcuuauucuguguaacuacuuuaaaaaaaaaaacucacaggauuuuuguuuguuuguuuguuugcuuugcuuugcuuuugcaucuuggcuguuuucuagcucacugugugucccaggaugaucuugaacuucugaccuugucuucucuucccgggugcugagauuuuuggcuuugcuaccuugcuuaaacguaauuuuugcaauucuggagaucaaacacagugcuucauguaugcuagacaagcgggcuacuaccuuaacaacuuccccagcucuagcuguuuauaaaccuuuccgcaguccuuuauggaccuuucagcaguccauagggcugcugagauggcuagguggguaaaagcauuuguuggauaaagccugaaaaucugaauuugaccccagaaacccaugguagaaagaaagaaccaauccuuuagaauugucuccuguucccaauacaaaugcauguacaauggcuaacacauaccuacauucauaaaauacuaauaauauauaaaauuaauaaagcacaaaaagaagcagccguaugguuuuuuugucuauuuugaaauuaguuugucuuucuuuuuguuugagcuauaaggauaucuaucuuucuuccuuccuuucuuucuuucuuucuuucuuucuuucuuucuuucuuaaucugagguugacuucauagcacuuacugguuuguacacuauauguagacacacgauaguaacacacgcuugucuugaauuccugguccuucuacaucugccucuugagggcugggaugacuggcaugggucacugcacccugcuaguauuuuauuauuuugcacugcaugcaugugugcaggugccugugugugggcaugcaugugugcaggugccuguguggaggcaugugugugcaguggcauagguaugaaggucagaggacaguucugaggaauaucuucuuuccuuccacuguggaaucuagagauuaaacucagguuaguaguuuugugugggaagugcccauacccacugagacaucuugccugcacacuuaguugacuuuguucauuuguuuguuuaguuugguuuuguuuuuucugagagacagguuuucucugugugguccuggcuguccuggaauuugauuuguagaccaagcuggccuccaacucuugagaguugccagccucugccuccuaaguacugggauaaaaugcaugugccaccacacccagcuucuuggcuucuugguuaacuucucucucucucucucucucucucucucucucucucucucuccucccucucccucccucccucccucccucccucccucccucuuucuuucuuucuuucuuucuuucuuucuuucuuucuuucuuucuuucuuucuuucuuucuucccauucucccccaacuccucuuggauaacuuuuuaacugcucuuccaauauaucucaucuuggauuugcaucuggguaugguacauuuguaauaacacacagccauuaccgacauuaugcuacuaaaaauuaaacuugcuaggucaguucugggaaggagcugagaagcccuuaguuuaacuucucugauagcgaaccugagauguggguugaaauccaagaucugugauccagaaugaggguggagucccugagaacaccuuacagaguuggggguaucaagucuaaaggcuaacugagaagugcuuucagaguuggguaucaugucuaaaggcuggccaaggagugucccugucguuuugcuuuuauuuuucguaaacccaaacuggcugugaauuugaaggacugagaucacuaagaaggcugggcuugaacucccaguccuccugcaucagcuuccaaagugccagaguuagacguacacaccacgccuggcuuccuaccacuuuaaaauugcucauggucugggaagaguaggucagggugcuugccaccaaguuugauggccuaaguuugaccccugggacugacacaguagagagaauggacuugaguaaguuguccucugaccgcuccaugugcaucguggcacaaguguauguacacccaaaauugguaaauauagguaaucuuuuuuuuuuuuucucaaaaaaacccccccaaaaaaaaaaaauaagccaguugugguagcacaugccgguaggauuugcugaggaggcagaggcaggauuucaaggccagccuaggcuacauauugccaggcuuugguggugcacaccuuuaaucccagcacuguggaggcagaggcagaggcaggcggaucucugugaguuccuggacagccuguucuacagagauccaugagccagagcuguuauagagggaaugucucaaaaaccaaaauaaagucuuuagauguuucccuuccagaaauaagaagggaacacuagauuuguuuccaaaaggguucccaacucuauuagaaaaagaccagaaaggugugguguccuccaucuagccucauaaagaacuggaggauaugagagagucuaguggucuuauuucuaaggucccauugucugauaugaccaagcauggcuaggucaggcagaaaaaccaaucuccaggcacuaggaagugcgcugagccuguaucuccucuaacugagcucuggcuuguccucgaggugggaucacaagaugcccuuugagccuccguugccugucaagggaucuugacacuuucuccuguuucuuccagugcagccucagccuccugccacgguucagggagguagguguucugaugagcuagcaggaaagccaagccucgucuguccuugucacugaauugcugcacugggaugaucuagagagaugguuauagcuggcuccuaaaugugauguaaaaucauuccagggcuuaugguuguaacucaguugguagaacgccuuguaugucaaagcccuggguuugauccucagcaccacacacacuguacguuagugcuccaugccuauaaucuuaguacuugggacacagaagcaugagaaucaaaaguucaaggccaucuguggcuacauagucuguuugagaacagccucacuauguaagaccuugucacucacacccacgcacacccacacaccaacuuacacaaaacaaacagaaaacaaaaaagaaagaaaucaaacccaucaucaacaaagaauucauguuauaggaaauauggaaaacagagaugggaagaguccaaguugacaaauauguuugcaucucuccauaugaccaguuuuagcaugcuugcuacuucuguggcagagagggcaggaaugaaugauaggcauccugggccccaguagcugccauccuauucugaaguugaccccuuuugucuaugagucagugguaagaacuucuggguagauauaauaugggugugguuagcugagggccuauccugcccaccuacaguguggcugccccuucuccaggucucagguggaucucuaccuggcuugaucuugcacugcaaagccacaguggggacagagagacucuuguagaugcagcuugcauugugauuuuggcagucaguggcagaaacuaagaaguaagaaaguagcucaugacucugcuaccaccaggcacuugucuuuuguccuucugugcuuccuggcugucuuuguugaauguuaucuccucucuguuuugccgucacauagaagaaaagagcaaaucagauagguucauccugcaguugcuugugagguaaaugaauucucucucuguugaugccugaaaagagaaccacaugaacacacgagguauugggcagacgaaccacuggaucuguccugucaccuguuaaaggaguggggacauuuguugucucccuuccucccagguuguauuaaaucagccagugucuggcaguguucuuagcauagccuggccuguuaccaacaaggaagcaaguguucauguccuuucuccuugguaauccuaaaauaaacaggcauuuguuuuuagaugucccaaguucaggccuuugagacuugccugcuuuaucagauucuccuacuggaagaaccuuggugaccuacuagaacagagcggguugccaucuacacagucaucuaccaucugcuuucccgagcagcagcccaggcgcuccuucauuaguuccggugagcugcugcacuaaggccucucugcauuugagauaacggcugaugaugcaggccccgagaggcaagggacaugcccacggacccauggugaacuugagagcagagaugagauuugaaucugagaauguccuguaugugucucguucagggaucgugcccgggguuguugucaggguuagaacagugggaguuuggcagcugaagccucuggcuaaagcuuuggcuucagaauuuccagguaggccucaguuggccuugcuaugguaauuaguugugcugguccaugucuuggauuuuucaagcuucucccuaccuccuacauucacuauuuucuaaauagcgguuggcuuuuuccaugucuuuuuuuaugucuauugcuuauuaggaugauuuugauaguggcugagcuuucuccuucagucgugucugcuauuugaucaguuguagccuuccuacaccucuuccguggcuuccuauugaucucucaugaaguucaaacuccuuaaguuagcauguaggcuguguguggcccucucccucccccuuuuccuguccugcuaugguucuuuguaugucugcccagccuacaacucagccacccugaaagucuuucaguuccucuacccugugucuccuuucuugccuuuuugccuuugcacauuguguugcuucugcacagcacauacucccuuuagcuucucucacucauuuaccaggccucggcuuagcuuucauguccucagggaguccucccuucaagucagugcucgaugcucucugguucagucucuugacuugcugcuggugggacugaguguagaagccugccugccuguccugugcgcccagcagucucuguggaaggcugacugagaccucagggucucuagaagaagguguuacugguacugagugguuguggcaccuuugccguagucaacuaaccgcauagauaagggcuuguuucuaggcuuccuguuuccaucuuauuucguuggucuuugugucuguuguuugcuaguccuauguuggguuguuuucuauuuuuuauuuauauuuauuuauuuuucuuuuuauauuuauuuuuuauuagauauuuucucuauuuacauuucaaauguuauccccuuuucugguuuccccuccaaaaaacccccuauccccucucccucccugcuuuguauuuuuauuauuguauuuuaguccuagacuacuuugauugaucuagcuuuacuguaguaaguuugaaaucaguaaauaugaguucuccaauuguuuuuccuuuuugaagguuauuuuggccaccuccugccacucgagauuccacguagauuuuuuuauuucugaaaaaaaaaaaaguuuaaugagcuuugcaaagucuugacauugucucucucuuuuuuaaaguauuuauuuaaucuuguguguaugugcccaaguguauauaaguguguccugugugccugaggaggucagaagaggcaucagaucaccuagaaauggcguuauagaugggugugagcugucauguggggguugggaauugaacccagguucucugcaagagcaacaggugcucuuaaccacugagccaccucuccaguccugacauugacauuuuaagauuaaguauuucaguugaugaacagguacuaggcugguucaccuaccugggccuacucagugcugagauuaaaauauaugccauuaucuggccuauuguuauuauuaucauuaucaucauuaucuuuuguuguugcuugcuuguuuuuugagguaugguuucuuuguguagcuuuggcuguccuagaacuugcucuguagaccagcaguacagcccuugccugggcuagauucccaguauuguaaaaaacaaaaccaaaaacuguagcccaacauuuuuaguauauuugcaggguccuuccuuacuuugcucaucuuaggcugauuggaugauagucuuuaggugccugaaaacucacuagaagaugggaacccacaucuauuuugaacaaaaauuugagacaagaucuuucuuuuuuuuauuuuauuuuuuuuuagguuuuccgagacaggguuucucucuguagcccuggcuguccuggaacucacucuguagaccaggcuggccacaaauucagaaauccuccugccucugccucccugagugcugggacuaaaggcgugugccaccacgcccggugagacaagaucuuucuauguagucuaggugauuugcuuuguaguccaggcuggcccucaacuugugccguucuaucugccucuuccuaccaagugcugcuggggaauuacagcuaugugccguuacacccaucugugauacaaacagcuucuuccucuucuuuuauucagugcuuagggcuugaguccagguagcuaguccugguccagaugcucuaccacauguagcccgggaaccuguggcuuauuguagcuucagaaugcccucacuuuggaaaagacuuaguguuuaguguuugaagaguugggaccuggcuccccuagacccugacucagcugggucugcugguuggacucucugugucauugacacccagagguggcauggugcccagugugaaugggugucagcuuccccuggcugcucuacacuugacucaccccaucagauuuugaagcugaggugguaguuuaugcagaggcucucuggccauuaucuaggaaaugccacuccuccugaggaacacagaaccaauaggaacacgaugauggguaccacugaagauagaagagacuucuucuguaggaaggaacaaauaacuuauuccuguuuggguuuuuuauauagugcuagagaccaaacccuaggcuuuguacauuuuagacaaguacuguacuauugagcuauacccuuuacccccuaaugcagcuuguguuuugagcauagaugucuuaguggucacucgucaccauggaacauuguagaaccagaaccagaacuuuggcuuguggccaaacauaacuuuucuugggggauccuugacuuaaaaaaguuugcacuagcuuaaagcaucaaggaucauccaaggagcaaauagguuccaaacacaagcucuuaucuuaguuucaggaaacucuuaugccaguugugggauuacuuguguuaggggacucagagcacaggaugaguggcuaccauccaagcuagggaaccccuggcugugcuguacuugagcaguuuggacaggcuaauugaguuguuuacugcuuggucagcaaagacauccggggaauggagaccagcucuuggcauccucuaccacauaaagccaggaagcugauuauuucggcugcuguuuuucuggggaaaugugcagguucuaaucuaaugggcauuguggcagcagcucacacggcagcuucugaugguccuagaggcuggcccguccuggcaggcaguauauguguuucuuggaagcgcugagcauucuguuuagcuuccagcuguguauuggaccauaucuuuuaucucaaaggaucuaacucugugucccagauauuaaaacaaggaagccaaguuuucucuuaguuauggauaccccucuauaccuuuucuuuuuccugacuccucuccuuuaagcacugugggcuaaauuaauuagugcuaugugcuagucugugucuuuucuuaauaccuguacaugaugaggauugcugggucacugugguauagggcccagugauuauuaggaagcaggagugcaauuccauggcauuaaguccaucggcauuguuaggcaguuaugaaguuacaccgcagccucuuuggauggugguuuagauguuuuaugucuucagcugucuguguaguuuaugcuucuaugugcuucaaaucagaucauuuauauugguuucuacucuuuuacucauuuuuuaaaagauuucuuuauuguuauauguaaguacacuguagcugucuucagacgcaccagaagagggcaucagaucucauuacggaugguugugagccaccaugugguugcugggauuugaacucaggaccuucagaagagcagucagugcucuuacccacugagucaucucuccagcccccucuuuuacucuuaaaaaaugaugaauugauucuuuuauuuuuaaguucuuggggaguuacccauuuucuuauauaccacuuagacugaaaaagagauuuccuuuuuugauuuaccucuucuuacaagugccacuacgacuuggaaguugccagaggaaggccccaccuuucccugcaauccuuacuuagguacuugggauguauuguguaugggggguggcucuggaagcucaagcuuuaccaccucccugccuugugugaucuaggaaguuagcuacagauguacagggagggacucugugugugugugugguguguguguguguguguguguguguguguguauguguauguagaaucaugagaggaagugugucaggguuugugguggagcagaaaggacacagccugccuggcuguccuuguugagugugcugcuccccacuguggagccauugucaccuugcauugcccuaugccacucaguccccagcucuuagacuuuaagcaguggauucuccuauccugguuggaguuugcuggaggacugggggccgugauuucaguacagguuaccaguuagugauagucacauauacuaucucauuuccuuuucuuuuaaagaaacauuuuaaauugcauguauuuguuuauuuugugugcuuaugugugcacacauauaucacagacagauauggaagucagucgaggggcuggugagauggcucaguggguaagagcacccgacuguucuuccgaagguccagaguucaaaucccagcaaccacaugguggcucacagccaucuguaacaagaucugacacccucuucuggagugucugaagacagcuacaguguacuuacauauaauaaauaaauaaaucuuuuuuaaaaaaaaaaaaggaagucagucgaagauuuucaagggucaguauuuucuuuuuacuuuaugggucccagagguagaauucagguuucagguuccuuuaucugcugagucaucuuaugagcccucuucuuucuuugguugcaaagauacuaaguuguuuccauuagaaaucaaaagaccagccaggcaugauggugcucuccuuuaaucccaacacugaggaggcagagagagguagguagaucuugaggccagccuggucuacauagugaguucugggacagcuagagcuacauagaaagacccugucucaggaaaaaaaagaaaggaaggaaggagaggggagugagggagggaagagggaaggagggagggagggagggagugagagagagagagagagagagagagagagagagagaaagagagagagaucgagagagcgcgcgagagcgcgagcuagcaaaaagguagggccuagagaaaucaaaucaaacgcugaggcuccucugagagccauuaguguacugaagacgucuguacucauugcuuucuccuuucugucuucuauugcccuucugucugugaagggagauacagcauacaaaguaaggaguuugaucagggccacucagacauacagaguguucugcuuuguucucauucccucccuguuugcuuucuuuaagguacaugggaauuggacucucagcgcaaggcguuaacaugaacagacugccuggugagucacugcucaagaaaacacugaucugcucucaucuguccugaucucuuagaguagaaguagcagcucaaaggcucaggagggacuuguuuguaggaugucaaggcauuggggggagaauuccaaaugauggucacugaguuaggacaccuuacauuucaacaauuaauuguuagaaacuauagagaaggccuagcaguugaaugcagaaguuacagcccccaguuaagagugcuuccugcuuuuccagaggacuugaguucacuugccggcacucauguccuguugcuuacaacugccucugaggaccccugcacugaagugcagaaacucagacauacauaauuacacauaauuaaaaauaaaacaaaaucuuaaaaaacugaauugacaagugacuguuacuccuggaauuugaacuguuuacuguuaaaaugaagugaccugaacuuacuccuguuggggcuacgccucaguaacccucgauccuauuggccauuggcagccugggacucaggcaugugccgggcaggaggcacguacugccaagccuggcuccuuuuugcuuguuacuccaccauguuaaagaucaaagucuucaaguggcuuuccacguggaacccgguugaggugaauucugaauaaauaaaagauaugguuaggauaucugaauuuguagcuguggguacacagcagauucagauuagugcaacguucuagguucucaucuggcgcuccucucccaggccagcauacuugcaguuguuuucuacccagcucuucauucccaguccuggcugggcacaacugaggaggcagaaaccugcccuaagagcugauagaucccaggggaugcugcuagguccauauuugucucaagcggcggagguacccuuaccuuaagugaugagcuguccuggacuaucgugaaggcaggcaaugaguguccuccugguuugcauuguauuccuugugucugugaugcagaagacaguugacuuuaaaaaaaaaaaagauuuauuuauuuauuaauuauauauaaguacacuguagcugucuucagacgcaccagaagaggucaucagaucucauuacagaugguugugagccaccaugugguugcugggauuugaacuucaaaccuucggaagagcagucgggugcucuuacccacugagccaucucaccagcuccaacaguugacuuuuuaaaagagggaguaacacuucaaugccuuuuccaaauaauuuaaucuucaccacaaauuuaucuauaauggacugauuucaaaagcagucuuggcccaggcagugguggugcacuccuuuaaucccagugcucgggaggcagaggcagagggugaguucgaggccagcuuggucuacagagugaguuccaggacagccagggcuacacagagaaacccugacucaaaaaaacaaaaaacaaaaaaaaaccaaaagaacaaaaaaaaacccaaaaaacaaacaaaaaagggcuggagagauggcucagugguuaagagcgcugacugcucuuccgaagguccugaguucaaacccagcaaccacaugguggcucagaaccaucuauaaugggaucugaugcccucuucuggugugucuaaaggcagcuacaguguacucauauacauaaaauuaaaaaaaaaaaaaaaagacuugcucuggauucaacuaauugucaggcuuuuuucuuuuucccuuuuugcuuugauaugauugaaggcaacuguauaaauguauaaauuagguauagucuuucuauauuuuaaaauucucuuauagaucuguuucuugcuuucagugugaucuuagaacuuuuguauuguuuugguauugggaaaaagagauuuuguuuuuggagacagcuguguuguauaguuuaagcuguacuugaauuugugcuuuuucuugucucugcuucccaaguguuuugaucauagcuaggccccacaggcucugcuuguuucugaccucguucguuuucacugacugcuggcuccucuugaguucauguuguaucugagcucugccggacagcuccuuaggcaguuccaaguacugguacuaaaggcacguaccaccacugccuagcuuguuuguuuuguuuuuuguuuuguuuuguuuuguuuuuaaacaaaacaaaaguuauuacauuuuuuaaaaauuuacuuuguauauaugaauaugcuuguggguauacucauguuggcuuauauaggagacagggcagaacuuucaggaagcaggucucuccuuccauguuuauuccuggaauuggacuuggguuugugugcuuggagacaugcccguacauucugagacaucuuucuggcccuuuauuaucuuuuuauuuuauuuauuuauuuugggggaguuuuucgagacaggguuucucuguguagcccuggcuguccuggaacucacucuguagaccaggcuggccucgaacuuagagauccaccugccucugccucccaagugcugggauuaaaggcgugcgccaccacuucccagcccuuuauauuaaucuuaaggauuauauuauuucauauuuagcccggggagggacauuuguuuugagaaguacuucuuuuuaaaaaaagauuuauuuauuuuauguauaucauuacacuguagcuguacauaugguugugagccuuaaugugguugcugggaauugaauuuaggaccucugcucucuccagucaauccugcucacuuggucccugcuugcucuggcccaaagaauuauuauuauuauuuuuuuaaagauuuauuuauuuauuauauguaaguacacuguaguugucuucagauacaccagaagagggcaucagaucucauuacgggugguugugagccaccauaugguugcugggauuugaacuuuggaccuucggaagagcagucgggugcucuuacccacugagccaucucaccagcccccaaagaauuauuuaucauuauaaauaaguauacuguagcugucuucagaugcaccagaagaggaagucagaucucauuaugggugguugugagcccccauguugugcugggauuuuaacucaggaccucuggaagagcagucagugcucuuacccucugagccaucucaucagcccaaguacuauuuuaugucuccauuguggauaguauugguguuugguauaauacagguuuuugaauuauccauucuaugaacauuguaugcuagguguguaacacccaugauaggcacaggcauguuuaauggagggaagagagaguaguagagguagugaauucugcuucucaguuguguuuauccugauauugaugacucuaccagguggaucuauaguaaggucuaugccugugaguacauauauguuuucugguggggugccugguucccuagaggacaaucagaauuagucaguuggaagaaggguuugcauuucuuccaagacauggugaugguagucuccuccuccuccuccuucaggaagcagcugggagcuacaggauugcuuuguguaggcaagauguggucaaauuaauucccucuaacuccguguagagggagguccuaccagaggaauugaagcugggacucuuggacaguaagaacuuucuauucucagcuuguggaacuguaggcagugguagccuguggauuacagaaagacucuucucucacacuaagauacuaaauggaaacauuuagucaugagugaacuggggccugaggguguagcucaguaaugagguuguggguuugguccccagcacauugcccguccauccuuaaaguggacaguuagguuguaaauguguguauauugagauaacucaguaugucugguuugguugagcagacuccugcugugucauugggagagguccuuuacuucagugcugugugugcagauuauuuuuucuuucugaggguggugaugggaauuaaacacagagucuuacacuugcaaacucucuacuacugaccuauuucacacagccuauauagacuacuuuauauuugcucguuuagaaaaacuuagaugggcaagggagauggcucgauugguaaagugcccgcugcagcaagccugagaacuaaguuuagaucuucagacccauguaaaagcugggugugguagcacacacauguaaccccagugcugggcuguguguguguguggaaacaggcagaucccugaaguucacagaccagagacuauguuucaaaauguaaaagguggagugacaauuuuggaauuugguuucuuaaaaaaaaacacagaaauauaugaauguuucgguuuuuuuuuucacccgaaagauuuauuuauuauauguaaauacacuguaacuguuuucagacacuucagaagaaggcaucagaucucauuaugggugguucugagccaccaugugguugcugggauuugaacucaggaccuuuggaagagcagucagugcucuuacccgcuaagccuccucgccagcccgaauguuuuuguuuuaauccaaguuaugagauauggacugcuucagauuguccgcagcaggugacuaugauuugccuagugauuuuugccagcuggagauaguacugugacugugacauuuggaauucuggggacuuuucagagggcauauaaaugcuagagccuugagaggcagagucaguugguggguuguugguugcugucgguuguaguuuaaguaguggugcaaaaagaagaaacaacaagaagaaauuagauauccugacuguaaagaucaaacuugccccaaggaacucaacgccccuaaucagcaggaagucuaacaauagccccccuuccugaccccgacuuuauucagggaucucuuucuuuucuccauauccuuuuuucucucuuaucuagguuuaagggguugaaaggugggagaaaaaggguggagggaagaagaacccacagguagggaaaucucgcuacaacauacaucccuucuuccaauccaccacacacauagaaacaagacaaugugaaacaacaaagcaaagcaaagcaaagcaaaccaccuacgagucaguacauuuuagagaaagucauuuuuguuuuguuuugaggguuguuugggugagaaaucaaagcuuguuggguuugugagugugggguuugccccuaacaugugguaagggccuuuugugcuuuuguuugcaggucaccuggagauggguguauggauuaugcucaauacggagggaggacuagaaaguggggcuuagucacuucuuucuggggagccauggauauccagguacccguggggagucacaggaaaguacaagaaccucaccagggcugggugugcuggcacacaucugucaggaaccggaggcuggaagcuugugaguucucaaccagcuuaggcccuuuaguaaaaugcacuuugccgggcggugguggcgcacgccuuuaaucucggcacuugugaggcagaggcaggcaggcggauuucugaguucgaggccagccuggucuacagagugaguuccaggacagccaggacuacacagagaaacacugccucggaaaaaaaaaaaaaaaaaaaaccaaaaccaaaacaaacaaauaaacaaacaaaaauuuugcucuucaauuuaaaaacaaauagucaggugugauggcucuugcguucaucucaggagagaaagaucucuugaagccagcuugggcuauguaagugaaacucuguuuuagacaaacagaaauaccuucagcauggauaagaacugugaucugaggggugcacugagcgcuccggcugguuggaggaguuaggugcccucccuccucauguucuggcaacucgccuggaauugcuggguggggucagugucaagcugccgcuucagcauuuauaagugguagcagcaauacucuuucauccugaaagaggccacuagaaugaaaaggaucacccuugauccugggccaaggaggcccuagagguuggccccugugggcuagcuuuuccaguguugcagggaaacuugucagggcacgugcccucaucuucuuggaggucugucuucucuagacaggcugugggugucaaguugccuugcucccuuuguuguggagcuucuggggaagcagcaccaggucuguuuccacaggaagcuugggaagcuuuccuuguuuccauuauagcauugugugaacagaauuuuccuugacccucgccccccaggcccuuugcucuuggggcuguagauaaccaaguggccucguguucuaggcugucuguucuuggugcuuuauggggggugucucauucauuguaacccaauaaugcaucgugcacauacucugugaugggcacugaguguagcccugagguaacuagucuccccuucugugaaacuugcccaguaggggagaaacauguaguugagaaccccacauugggcauccgugcuuugaagggacugaucagggcgggaugagucaggccaggguugugagaugacacgugguaaggggaggucagauggggaagaaagcuguagguagaauaaagauccugauagaagagguacagaauugcugagguguaagaggaugacuggaggccagugggacuggguuguacgguuggcaggguccaguagggcguguggauugucuuggguguuuugaggaagccacaguacagguuggaaggacagcaacagcuacaaggggaccaguuagaaccugucucaguggcccggaacuucaugaagugaccuggacagaauuccugggggagagauggaagcggcuagcucuuugggaggugacugagcaagcccuagugcuuagagcaguggacaguuggacuguaagcuguuuguuuaucuccagagaguugcugaccauugcuuguaaaaaugaaguuugggguugcaacuuacuuggcagaguguuuaccuggcguguaaaguuucaaucccuggcacugcagaagcccacacauggaggauaguuaugcagccucuaauccuugcucgcugggagggagcaaaucagucagaaaguucggguuuucuuggcucuuuggugaguuuugaggcagucugagcuauaugagagcuaugugagacacugacucaaauuuuuauuuuaacuuuuuuguuuguuuguuuggguuuuuuguuuuguuuuucgagaugguuucucuguauagcucuggcuguccuggaacucacuuuguagaccaggcuggccucaaacucagaaaucagccugccucugccucccgagugcugggauuaaaggugugcaccaccacugcccggcuguuuuguuguuguuguuguuguuuuguuuuuuguuaacuuuuuuauuuguguuuuugaagacaggguuucucaguauaguucugguuauccuggaacucaaguuauagaucaggcuggccuugaacucauagaucugccugccucuuucccuugagugcugucuugcaaaauugaaaaaaaaaauguuuuuauuaaugaaacaguggcuguuuugauacuaaaucuuggcgacauuggagccuguaucaaguagcucuugugaaaaccagucagagagguguuaacuuuggaagcccacguuagaucugucuugcugcuugcuguugagaauuaguuggagcuuggccccuaauacugccucuucugaaccuugaaggaguguugcaggcauggacagacacauuuucuuuuuucuuuuuuuuuuuuaaagauuuauuuauuauuauaucuaaguacacuguagcugucuucagacacaccagaagagggcgucagaucucauucuggaugguugugagccaccaugugguugcugggaccugaacucaggaccuucagaagagcagucaguacucuuaacugcugagccaucucuccaacccccagacacauuuucuuauggcccugauccacuugaguguuggaaaccagacagaacuaguaugagacugacagaucuuucuccucuuuccuucucuucccuggacuccucacgucucuaaguuccuguggaucuccugucuuauucuaaugugcaguagcugagugaagggccuauaggagugguggcauaguauuggucuucuuuaagaggaccucauggcuugugaggggucaauugggcuuggccaggcuccgagagggcacugagaggacagcccggggaccguccagcaggagaguccugcucaccgcccugacugcacucagcucuuaagcaagucauccccugagaaucuugguucuuaaggcuggcagacagugaacugcuugcucuauuuuuuuuuuuuuuuuuuuuuagauuuauuuauuuuauuauauguaaguaccauagcugucuucagacacuccagaagaaggcaucagaucucauuacggaugguugugagccaccaugugguugcugggaauugaacucaggaccuucggaagagcagucagugcucuuaaccacugagccaucucgccagcccgaacugcuugcucuaaauggaaguuuucuugcaaagaccagguguccucugcugauagccagacuccuagcccuccagugugcuccuagaguaaccugcaggcccucugcucaucuugucccaugcuucugcugcugucuguccuuucagcauccaugacuuccuuauuggguucuucaccucagcucucugcuugcuuucuuuuucuuucuuuuaaagauuuauuuauuaauauaucuaaguacacuguagcugucuucagaugcaccagaagagggcgucagaucucauuacggaugguugugagccaccaugugguugcuaggauuugaacucaggaccuuugaaagagcagucgguacucuuuuuuuuuuuuuuuuuuuuuaauuuuuuauuacguauuuuccucaauuacauuuccaaugcuaucccaaaagucccccauaccccccccccccccgcucccuacccacccauuccccagucgguacucuuaaccacugagccaucucuccagccccagcccucugcuuucuacugugcacauugugcccugucugcuuuggaccucugauuccucugcugagagagaagacagucuuugcucugccuccuccccaaauaccuccguccccugcucaugcugcacauuccuggcuguggggcaccuccaacaugcugcugacaucccacacugcuaccggcaggcauuguuugauuuugcccugagaugucuguccuuccuccugaccccuagugugauccugcuuggucccuuuaacucugacauguguaaucacuccuugucugacucacaucugucaaauucaugauugaguugugagcuccuuaggacuuggacuucauuuuauugacagggucucacuguguagcccuggcugugguggaacucacucuguagaccaggcuggccuugaguucacagagauccacuugugucugccaugcagaguacugagaucaaaggugugugcuccauaccuggcuguggaguacaucuuuuaaucaugacucaccgagaguguuuacagggccuugcauaauggcuuuggguugaaaugguucuuguauuuugcuguccuuugccucaacauaaugaacuucaguaagucaccuguccuuuuguauccaguuuucaucagauccucuuagccugaggccagccuucagcuuggguaagccuugguuuggaacucagccuacgccagugcccuaagcucugugacacucacugaugguggugggcucuuccaccucauacuuacgggguucagugugugucacugaaucaaaagcuggcucacauuuggucuugcagaagacugcuaacugauuguguuuguguauguguguggcuacccacacagguuuguguauguguguggaggucauaggauaacuugcagugcucaguuaucuucuacccuugagucuggggauccaacucaagacauuguguuuggcagcaagcacccuuaccugcugagacaucaagauucucuugccagccuggaagaucuugagggcugugugguugacuugugaaacugccugguucaguggcuaagaccauggcuggggagccacauugucugcuuuugcacucuugcagcuuuguuaccugcaacaauuacuuuauugcuuggcucuuuaguuucuucaucuguaaauggaagaaauauauuagcauaugaaguaaauacuaauaaaaacuaaagauucuuuuacaaggaggguuuaagauaggaucucacaauacauccccagguguccagaggcucagaaucuuccugccuuagcaucccaaaugcugggauugcagguguguacugccacauccugaugaauguuuauuuguagaaaauacuaagaguucuaccugacacacaaaaagggaguggugcauaaguauagcuaucguuguuggaaaagguaaauguuuuuuucuaccugaaaaugggaggaccugugcacuuauaguucugugagagucugcauauagacuggagguaguuuuuauugaaacugcacuauuuaaggcugggugugaugggggacauguuuaaucucagcgcucagaaggcagaggcagguggaucucugugagcccaaggcuacccuguucuucacagugagguccaggauagcaggaacuauauaauaaagagacccugucucagagagagacagagagggagagggagagggagagacacagagagacagagagagagacagacagagacagagauacagagagagagagagagacagacagagacacagagagagacagagacacagagagagacagagacuguccuuuccccuacagugccuguuuucugaauuugaauguaggcugugcuagcaggaguggcauucuucuggaagguggcugagcacguggucagaauguugaugcuucuaauguguucuuauagguuauuggcucacuggagcuccuuugccuuccaggcuguuggggcagagggguggcacuguggguacuuacuggugcagaugaugacaggcacaucucucccaugaggcugugcugcucagauucuugagagcauuugggagugucuuaguuugcacugucagaaguuucuguugaaagauguagauagaaguuuuguuuaucuuuuguaagguguucuuuggccucuuuaagugugaaaccaaguagcagguguggcuccaaaauaagaauguuggaacccugggcuaaaugacucacaggcaagacuagaugaucuacugguaggugaguguagcugccugcugcugccacacccguugccuuggagaaagagcagggucuggcaaucaagggauuccuugauugaggaagcuggaugaagaagguaggauuguggguggagaccggggguuugggcuucuucaguguuugggugcuugggugcuuugagagauugggggggggguguagauuuuguuucuguguccagggaaacucaugcugugucuaaagaaggaccaugugcaacagagcuagguucuggcauugccccacuugucuuuucuguaguaaggaggcuguucucaugguguuucauauauuaccuugcuuguuacaacccugcagagaagaauucaugcccacuaagaccuauuuucuuuaauuguuggaaagacauaucuggaaggaucuaguuaggguuggcauuauaucuccuggagcagcuauugcccaagccugggcuagggacugagauggcagaggacacagggaggaacagucugcuuugucuccacaggauguggaaaguaacugugcaucuuuccuccuggagugcaccuuaccaagccuucuagcuuggauagcaacaggauagcuagccccagcaggaaagcugcuucuaccagcugggccacauucugcacauaguucaucugucacaucugcacaggcuuaggagaggaaccacagagcagagaguucaggggucagugccagguucauggaagagggugaauaaguaacaggauguucaguauccuuccucuaucuucccaagggugcaucucaagcacuggagaguaucugagguaaauacaguagcagguggugauacacagccgaugauguuucagauacugcuguuuuagauacuguugguagguuuugauagucuggaaaugaugcuuguguauagcugccaaccaggaauuauucuuuccuacuuuauguaagcugggacccuuguugccugguaagcacccacuccaggcucucuguucaagccaucaucucucuggaacgccuuuccucucaggagcuggugcuucaugaggugugcccuguggugcucaggccuacugugagggaagcgguacuuuucuccaucuggcugaguuuaacauuagggcugcacuaagauauggggugcccuucuuucucacuacgcagaauucuugggccuaaaacugggagucauacuucccguuaguauucuaguccuguacauagcuccuaagccagugccuagagacuggcuggagagaagaagcuaauugguuguugcccaguaguucaguccuguagggcauucagguaagcccugacuguaaaggggaucagucaggaacuugucugaagcagcugcccaggggcuagggcuagaagagaggauggagcuaaagagccuggcgcugcccgacccuuggagcucuggcaguaggugcuacagggaaauucagaaugcagauggcuuagcagcugaagaaguagucagaaauccugacggcucaugugauggugcaauggaaggagcuuggauagugugagagccuucauuucucauuuuccuaugcuccugccucccacgugcugggauuaaaggaguauaccaccaccaucuggcuagaccugaacacucuuauuacuugacauugggguucauuguuggcaguauucugaaauaccagcucuuguucgcuguaaacauacuggacuuuaccuguuuuucaguguguuguuuuauaccuauaauuccaucacuugggaaacuaaagcaagaagauuacuuugaguucucaacuuguguuacagagugagaaacugucuaaacaaguguauuuuuuaagcugaucagugcacacuuguagguucagcuacuuaggccaaggcagaggaucauuugaggccaggaguucaacaccaggcuugguaacauagcaagacucuaucuccaaaacaaaauaauaaccccaaaccuguguuuuuucagggcaaguugaguccuuugagggaaacggucuuuuugauaaucaaaaggccaguccuaaaacuugggucuguuagcccuucugagggauucuccaguguguucugaggagacuguguguuagcccugcugagggcuucuccaguguguucugaggagacuguggccaccugagccuggaacagagugggccaguugcuguuccaccccucacaaccagugucuggguagaagucugugucagaagacagugggacucagcugcacuguagcugggccaccuuuugggaaacauuuucuucauauuuacuuauagcuuaggguuuggugaugcaugcaaggucaagcuucucucuacuucauccacacaucaccaguccauuuaguucuucccagaaauuugaaaggagccuuaugggaaaugagcagaagcaagacuguacuccauagaaacagucauccugggaguggaggcugcacacccccauuguguagaacagugcuaccccuuuccuuaacauggcucagugucugacaaacccagauuuuccuagggcaucugggauguaggaaaauaacucggccagaugauacagaugccauuugagccuagaccuagccagacccaguuagacucucuuggucauuccuaggucucuccuggccaccagagaugaugguucaagauuguuuaucccccugucucuuucuauuuuucuuauauuuauucauaugugaauaggguuuugccugcaugaaugucugugcaccaugcacaugcagugucugcgaaggccagaagaguguaucagaacuggaguuaaagcugguugugagcuacccugugggcacuaggaauugaacugguccucuguaagagcagccagucaguccucuuaucugcugagcuaucucuucagccuuuacuaugcaggugguagcuauauccucccuuguccuauucauggcuucaaauugaccccuaaguccuguaucaguggaagauccaggagcccuuggaagacauuccuuacccagugucauuagcuacuuacagaguuguuuguuuguuuguuugcuugcuugcuuguuuuuuccuucuuuagcaugguuuccaugcaaagcuaccaggaagacucugcuccugggucacugcugccagagguuuuaggauugccauggcccaaguucccacccaaaacucagguuaauggccauggggguggugcagcugcacaggucagugaugggagugugcucuguuaccucauaguaacuacugaauagaaacacacacaaaccaucuucugcuucccucuuauccguuguugaucuggugcacacugugguccugucagccuuuaaagauaguugggguuagaggggaagcauguuugucaguucugaauggaaguucuccaacuggcaacuacccuugugggccaacccuacuauugaugucccacacaguccuugugucucuucacaguagcuccaggaccucagaggcuuaggaaacccccagcccagcacauuuccucugcacaccaggcccugagccucugcacauggcucugcaugugcucugagugcugucaacagcugagaacagagugggccugggcuucugcuacuggacccuucaggcuguuuguugggagagaugggcgguaacccugcuugcuacugcagggcaaaagggggcuacacauacagagcacccaagugugauaauuaagcuggugucuaaggcugugagagaaaagaaccucacuagaaauacuuccuuuggcuugucaugcacagucucauggaaucaugccacccgccccugaaagaaagucagcugagagaacucaggaccugagugaagaguugggauucagacucaaacacugagucaguaagaccauuugaaccugugaguuugagaugagccagugcaauauagugaccccuaaacugaaauaaaacaaaaucaagucugcugacccaaaguccacaguugaguggaaugugguaaaauacugguuugaaggcucagggucagccuagcuuuguggguaaggcaugggcuggccccuuuguaugggcaacauuaugccagaaccuagugggcagcuacagccucggccccgcccaggguuuugaccuagaauacugaugaugugcuuugguggccguccuccccacuccuuguuacuuugggacugaagccccugaugugucuugguguaugggagugccaugggugggcucccagcaccaucaugcuggaguccuggcauuccccacagagucucucacucugcauaguauguggggaugccaagacaaugagccauuucccuagcccagccuguacuuagguguugggucuuccuauuuugauggugagucaggggaagugggugguacugggguuccuaaacuggacacauagagccuccugggcugaauguagcuugccuugccuugccuugccuugccuugccuugccuuuguguuuguggcaucugguagguacuugauuguggcaggcaccuugccauuuggcuuuucugauagagugccagugugaucaguucucugagaguagcaauaccugauuucuuuggagaaggaggaauggugacaacauccuguaagaguguuguccccauuuauacagcccagccuucuuucugaaucacagcuaccuggaugugauucccuguagaguccgacccagacaauagugcccaccuguccucucaugaccccuacguccuuugaagcaucuggcucuaguccugguuuuguuuuguuuugcagggcugggcaucaaacccagaggguuucaaguaugcgaggcaagcagucugccaccgaccuucauucaugucuguggucuugcagugggaauggcaaaucucauuagcagauacauaacaaacuuuaccaggcucacccagagaaaggggagugugcaugcuguuagcauaagggcacaaguggggaagaaugcaccguucuuaaggagagggugcuggguaggaggggcuuacucaggcauggguauuggcccccuacauagggagagggaagucagcaccauagauggcucucaaacgucuggggacaccacauccucugccuuguuuauuggugaggaauagagaaccgcaggagggaagcuguuguuagagcagaggcauaucuaccaccuggcuguagucucuuuucaaagugagaagcaacuucauugucagucucuguauacuaggcaggcacucuuaucaccgagcuaugucuuccguccuaauaaacauuccuuguguaccugcaugaaccacauauucaguaguauggacagaaggaugcuuaaauaugguuccuuuagucagaaaacuuugauugcauuaaggaagagaaccucucuuuaaccagcuuguucugcucaucucuggaaaggcaaacagguuccaggucucaaguaccuauauuuuccucaggacucuugccucugcgcucugcuuauuagcuuuaggcuccuaaacugacuuucucuaagagguuagaacaguggcugaaaggaacuuugagagcugcuauucuuauaguuaccuguggaaaguuguuucucaggugggcugauuguauucccuucacccaaaugucugucccccugguccucuuggcaaguagaacucugcucaaaaguauauuaguguuugccuggauauauggugccuaugcaccacaugcaugcaguacccauggagcccagaagagggcaaugaaucuccuggaacugaaauuacacaaaugguugugagcugccauguggguacuagaaauugaacccaggcucuggaagagcagccagugcucuuaaccgcugaacuaugucucugcucucuuccagguauaucuugcuuacuuguuuacuuacauguuaugucuucucuguuccauuccccccuuugcaagcuccucggaguaggcuuuauuaguuuugcaguggccaagggggcagcaccuguccuuuccagaaaggaaggucucaugcuagcuaugaaccguccuguuguuacagcugcuauuccuaaggaaaaacacauucuggguuuuuuaaauauuuuauuuauuuguauuuuauguauaugaauguuugccuacauguucaugugugugcagcccagauaggccagaagaggaaaucagugugcuggaauugaguuacggcaauugugagcugcuuggugggugcugggaaccaaacuuagguccucugcaaagagcacuaagugcucucaaccacggagucaucucuucaguguccugauuuuguuguuguuguuguuguuguuguuugagauaguguuucacuguguagccucaccccacuuacugucugcugguauuaaaggcauagaccaccacacuuggcagcauucuguuguccuugugguaacacaauccucucugugugugugugugugugugugugugugugugugugugcgcgcgcgcacacacacauuuguuaaaguuauuuuuaauuguacugcuaaaauggauaaggagcugggaauauagucaguaguauaauaugcuuaguacaagugacacuacauugacucuccaucacacaaaaagaaaaaaaguacaaaggaugccaggcagugguggcccacaccuuugaucccagcacuggggaggcagaggcagguggauuucugaguucaaggccagccuggucuacaaagugaguuccaggacagccagggcuacacagagaaacccugucucgaaaaaccaaaaccaaaccaaaccaaaacaaaacaaaacaaaacaaaaccccaaacaaauaaagagguugaagccagccuaggcaguuuagacuuuaucuuaaaauaaaauguaacaagaauuaauacagcugagugguggagugccugccuagcauucccaagagccuugguuugaucucuaguaccaucaaaaagaaaacaauacaguauuccccaguuaaaacacauacacgucacuggcgaagcuagaauccuaugacuugggagaugcaggaggaucagaaguucuggccagccuuaguaccauacugaguuugagacuguuguggccucuagagauccugucugaaaagcaaaaacauuguaacagcucgucgguauagaucuucucacuucuagccuacuucuuccagugagucccauccagccccaccucagcuccucagaggugaugauuuggugugcucacuaucaaaauauguguguaacucagcaagauaggcagcugagugggaagaccacacuccugagugcuggcuaagggggcgagaaugugggaaguauaacugagacuucagagccuucuaucaaguucuuauugucagcuauugccgcucucuuccccacagguugggacaagcauuccuaugguuaccauggcgaugaugggcauuccuucugcuccucugggacaggccagccuuauggucccacauucaccacaggggaugugaucggcuguugugucaaccucaucaauggcaccugcuucuacaccaagaauggccacagccuugguaggugcauaagagaccuugagagggcaggcaggccuucaagaagucaaagucguaucauggagccucugcacagcucucucuggggaacuacaggcauuucuagcuauucggacccuuucaggugaauggaaggcacagggaaugccuguuauuaaccugucccuucagcagcauuuauuguauaagcccagggugguuacugggggugcaggaauauucuggucaugaucuugucuugucuguugcacuugauggagaaguuugggggcucugacuguaguaaucagugauuaggguuugaacacuuauaaccugacccagacuauggccaguucuucugagaggugggauacugaagguaacagggagggcugucagacagaaaguaaacaggaaggagucagauagggacagaucucuggccuguucaugguuaacaugcagcaauguugacagaguuacaaauaaaacuccagagagaaauggaaggaugcaguggagaaaggcagguaucccgaggguaacucugaaguggugggcaugaggaaugggaacagagguccagcaggcuagagggaugggcacacuagugagaagagaagcugggcuggugcagguuagacagugaaggaggacagccgggagggcugggaguguggugggcuccuugaguggagcuguucucugcagaaauagaaacuugguguuagaacccgagguggguguggugcugaguuucuggaaccccagcacgacagagguagggcagacagagccggaagugaaggccacccuuagcuaugaguuugagcccagucuagacuaucagagcacuauaaaaacaaacagggauuagggggagagagagagaauaugccagauuuggcauaugccugacaucccaucauuccggagcugaggcaagaucauuuguaugaggugaaggccagcaacuggccugugcaacuaucccaguauuguccugugacucccacacaugugugucccuauucacauaaguacauaguauacaagauaaaaucaauuaauuaaaauuuaaaacauaugauaaacuucagagaaaggguauauucccaaacugucccaauaaucacaaacuuugcuaucuggaucccucaggcauuuuuuuauucaucugcccagugaaugcuuucuauagauccuguacaaagaccuacacauguuuaaacuucauguaauaguacauugccuaauuuuuuuucuaaucuuuaaaaaaaaauucuacagucuuguuuauuucuugauauuugauguuuauuucuaacuuugguuaacucagaguaugagaaauaaguugauuaauaaagacacucaacguccuagaagaggaaaaggucaggaucugagcccucugugcuguugagcuugcucagcuggaccccaacuaguaagaaccugugugugaguuuggagauggaauccacuguuagagugcuugcccagcuucuucaggguccuaaguucaguccuuaguaucauaaaacaaggcaaaauagacacacacacacaaagccaaagagucagguuacucuguaucacccuuacccccaagcuccgucugguagcacagaccauaauccuaauuucuugaggcaggggcuuuaaaaaacucucagggccagcuagggcaucuuaagaaaaaugaauaauaauaagaagaaaugaaaagaaauaauaagaagaauaaaugaaaagagggccggagauaggggccauuuguugguagcgcacggcuugcaucccuaacacuggauggagguggggagguggacgggagcaggcaaaucaagcauauuagcuugaggcccauguuuucuaucugguucauaaauguauuguugaggccuuacugaaauaaggaucaauagguccugcucuuuguguguucuagaucaugaaauuucaugauguuagauugauagaugcuaggugaaucuucccaugucaggugccaacuuaucauuacuaauaugcuucagauucuaguccuguccacuuuagggaaguagaaugauauuuccugucucuggcugcccuggugguccuuuucuuuucuuuucucuucuuuucuuuucuuuucuuuucuuuucuuuucuuuucuuuucuuuucuuuuuuuuaaaagauuuuauuauuuauuuuauauguaaguacacuguagcugucuucagacacaccaggagagggagucagaugucauuaaggaugguuguaagccaccaugugguugcugggauuugaacucagaaccuuuggaagaacagucagugcucuuaaccgcugagccaucucgccagcccccgguccuuuucuuuaucagcucuugagccuuauguucaucauucuguauuuccaguuauucaacauauaccaucucucuuggugacuucaggggcacuuugaggaucagcuggcuuucagcuguuuguccagaccuggugaauaauugaguaaauggagauugaggacugccaucuggucccugagugaucugugugauuguagauucuuucuucuucaugugguucuguacugucucccauggucuucuguucucagcuucagggcuccagacccuguuugguccagaauucuucucaucagcaagccuggcuaucuuguuugccuggccuuucauccugugugucuacccaaaccuuauuaucacaguagccuuguggagcaguguugccuuccacagugcaguauagaugagagugguuucuuucuucauuguccuggaagcccuucaaggacuugucguucuuggugccauugugaggcagaguuaggcaggucugaaugggucaaccucucccagaguguggcagguuuuucacuguguagcccaacagcagucagcuuguaccuagacuacaugauguaucaaacagcuuucauagccugucuuauuuuccuuccuucuuuccuuccuuccuuccuuccuuccuuccuuccuuccuuccucccucccucccucccucccuuccuuccuuccuuucuucuuuccuuccuuccucuucccauccccccuuaugagguaaaggguucuucagguggaccagaccacuuuggauaacuugguaaaggucacauggcaguaauugaugaagcuagagucccuuucuuuuaagggccugugagcgucuccuuaagccugggagagaguagcuccuuggauccuccgagaucuacagggguagcucuccagcagacuacucugauguugggacucugacccuauuugggaggcgcacaagcauccucaggcuauuggagcauaagguuuuugacuuucacuccuggaagaguagaguagccaacuuguacguagaccuagcaaaggcugugucaucugccuucaccuuggcuguuagucugugagccagcgugaggaauagcgcacacuuugucaggcugugcucagacuuccucugugcugcauugcuaaguucucuuuccugccaggggaggguucaggaaguccuuugggagcuucagggaguccguacuuuguauaccccuaaugcagaagcugaggcguucccacauucugaugccccccacuccuguggacauuacucaggucuacuuguauguuugguguugcacgaccuccacccuuacugcagcucaaaucugaagacuagagaugcauuccccacuccuaacaggaggguuuggggaugcauaggcuacugucagccagaucuuggauaauaagaaacuucugagaacuuggaacuuuuggggucugaagaugggaaacauuaaucugucagcuuggcgugcugaacuaggccugugcagaacuaccacugccagcgucucggugacaaaggcagccccuguagccucugugggucuugucuuuaucuguaacugggagaaugagcacagugccugcucuaaggaagugacaucagguguaucagguaauagaugauagggugagagcucauaguagaugucugugcaggcauguuacauaucaagaggcuugaauuugccagccuaggagaaaaaucacuugguuuaguucuuuuuagcaguuauucuuugaaaagguagaaaaacuguagccaauuaauugauuaccuaagguccugguuuuucuucugauuagauuguccaacaagaugaaggcccaggccuaaaacuaccagucccuaguacccuugucuaugcuugaccaccacccgcaccuugaguucacagaccacuggaggccaaggggccaucccuaucuuauggcugaugacuguccuuuccuccccacagguaucgccuucacagaucucccggugaguacuacaguaauggguccuccuccuccugggcuguugagggcugccggggaggaugaugguaccugcaagugcaggguguggagucuggcccuuuccccaagcagggaugugugaugugcuaccagcuugagggugucaguaaggguuaccugcuggccguccucucuucagcagcaaggccugguccuccuccacgucucuuagcaggugacagaaauuuguggcauuuucuaaggcagaguuguggguggggguaaggggguugugguggaagaggguaacuccaugggacaggcugaucugaaugagaugucugcaaauacagccaguagacugggugcgacauguagggauugcuccugaaccaucugaacaaucagaaaucugguccuuauauaugcccaucagaucucugaggaaagucaucaccucuggaaaccuagaaugcuacuauucaggguuuccugacacugggauaugaguuuuguaggcuuuucuuagaaaaggauggaguucucugucagcuuagucugggauucauccccaucuucucuaucccauuacuuuacugagugguauaggcauugucacauacagagccuucacccaaaaugcugggagccuggcaugggucuauuugcccugguucugaaaaggagaaguuugcugacuuugguggcuguuuuaggauccuggguauccgaccaugccccaggaaguauauuugugauuugaggggucucagaaccuuuuugguuguugguuuuuguuuuuguuuuuuuccgagacaggguuucucuguguagccuuggcugugcuggaacucacucuguagaccaggcuggccucgaacuuagagauccgccugccucugccucccaagugcugggauuaaaggugugcaccuccacacccagcggggccucugaaucucaacuguaguucccacagucauguuugaacuuccugucuacguaucagaauccuuccuucauaccuggaacccccagaaaggggcuguuguccuaggcaaagggagcagacucagaagaauucugacucuggcuggggaagcaucuagguauggagacaugacgugaaaugagcugacgugagugugggcagugugcugucaagugcuggaaagauugggaagugucccugggcuuugccagugguaugggagaugggagaaaaagaaaggaagcagaguguguagguuuugaucuaguggugggcugaaacccaugugcucaaaaccgugugugguacuuaugaaugaccuauugccugaagagcagacggugaagagggugccagggagccaagggugguagugcacaccuguaauccuagcucuugggagguggaggcagcaaggucaguucaagaugaccuucaacuacauacacacaaaggcuacgugagaccuuuuuucacgccuuugaucccagcacucggggggcgggggggcagaggcaggcggaucucugaguuugaggccagccuggucuacaguguuaguuccaggacagccagggcuauaccagagaaacccuguuucgaaaaaaacaaaaacaaaagaauggauugggguuccuggaaaaaagugguguuuaguggcacguggaggagguaggugaagauuugggugguggcaugggagcaacugaaugagggauggccucacuaaaguuggucgugggaaauggacacggcuauugcauaagugucacugcugaguaaaccucucacaggaagaggcagccucuccauuaccagcuccggaagcaacucaccaaaucuuugccugcucugcaguguuccuccucccaugugucaccccauuuccucauguaccuccugguagccgagggauccuuggcccugcaucucuucccagaaguuguaaaugaccacauagcacauuuuuauuagugcacauguaggggcauacagcccugucugcuccuguguaccuuggcugaguucuauaagggguucccaggccuuggggacacaguggccuuugaugcagaacagaggcggcuuuccauguggggccuuacuugcuuuucuuuuuguucucccccaggcuuuugaguauaauuuucugcuagugagguagacuaaaugauuggucccuacugcuccugccgugcaagucucuuccaguccuaguguuggcuggcaagagccauggaagugaagagaagcccugcugcccgcaggguccugacugauacucauucuucuccucaggccaaccucuaccccacugucggccuacagacaccuggggagauuguggaugccaacuuugggcagcagcccuuccuguucgacauugaggacuauaugcgggaguggcgugccaaaguccagggcacugugcacggcuuucccauaagugcccggcuuggcgaguggcaggcggugcugcagaagugaguguuccccccccccuccugucccccaggccccaugguacuguagaccugcucaguacuccggcccugcugacaguugcaguggugggcaugccccuggggcacuggagcggacucagcugcugaugcuccccucucaccagugcacaucacucuuugugcuuuggagcugcuccuggcuaaaccuugccugccgcuugagaaauggcucagcaguuaaaaacacauagugcuccugccgaagaccugcguucaguuccuggcacccaugucagguggcucacaaccacuuguaacuccagcuccagaggcucugacaucgcuggccucucgcggcacgugcucucacauguaccaacccacauaggggacugcauacauacauauaacucaaaauaauaacaauuaaaaaaaaccuuccccucagccagcucacaagacuucuguuuguaagaucaccagcacaggcuaggcgugguggugcacaccuuuaaucccagcacuugggaagcagaggcaggcagguaucugugagauuaaggccagccucaucuacaauaguaaguuccagaacagucagggccuugucuuuaaaaauaccaccaccaacaacaaaaggaaauaacucguuuugaaaaaucaccagcagagcuguguuccuucccaggguucuguagaaguucuagaacuacuauguuuuauucuucuguggacacuuuuuuucugcuagaaaaauccauauugcugccaaacgugauggcacaggccuuuauucccagcagucaggcgcaguggcagguguucucugaguuugacacuagccuggucuucagagaaaguucuaggauagccaggauuacuacauagaaaaacccugucucaaaaagccauuaauaaaaauaauaauuauaauaauucacauugcaaggcuuuggcuugaggucacuuuauagagucaguauccagcuagcgugcuccuugguuaguuaaucucuaaauugucuuggaagccaguguugcugagacucccaacaggagggcaaguuugggucuuuauuucucuagccaaccucauaccuggcugaagcagugacucuuacucacccaccuguuagaagguagguguuagcuuggcuuccaagaguagagaagggucuggcuucugcuaacccugaccauuguucugcaaaggcacgaggggccaggaguaggagugcaauguacacuggguucccagucagucuccgucagucucaguccccaccccagcuccucccuucuccuccauugacuuuaucuuucuuuugaacucagggcuuuacauaugcuaggaaaagacuaucacugaaucauagccccaguauucagccuuccuuucuugagggauggauacuaaagcagccuugaggaaggguugagguacagauagcaagacccuuguugggaagaccagcaggaccaccucugguucccagccuagcaggugagaauugcuuccuugagggccacagcaaugccauuucccacaguauacuuucugguugggcuggggaagagguggaguuacuuucagggucugggcucaacacauggaaguuuuuuguuuauauguauguauccaugugccuguaugugucuuaugcaguauuugcuaaaaccugcguauaauuguguccuguuauuucacauaauuuuauaaauauuggaagugguuggguuaucuuggagauagacuugucacaagcuucaugucuggcuggcuuccccuggugagacucggguauuaucaucuuccuccccacuucccuccccuucuccuccccucucugugauagcaauagaacacagauauuugcacaugcugggcagccacaguacugcuucccugaauccccaacccuuguuucuuuuacuggcauagauaacacuuucauaauaaagaaauauauauauacauauauauauauauauauuuuuuuuuuuuuuuuuuuuuuacuuucugggacuagagauguggcucagcaguuaagagcacuugcugcuccuguagagaaccaggguugguucccagaauccacaugacagcuuucgauggguuccagagaauacaacauucucuuuuguacucugcaggcaccagcuauacucacaguauguaugcuuacaugcaggcaaacacucuacuauaugaaacaauaaggaaauaagaagggcuuaaaguuuacuuuggucuccuccaaaguaguguucuuaauuuaagcuaugcuuauucuguuaggaacuuacuaauuuuucuuaccuauguauuaguguuuuaccuguagguagguauguauguguacugugugugugccugguacuuguggagaccaggagagggcaucugaucuccuggcacugaaguaacaaaugggcuaugagccaccauaugagugcugggaaccaaauccagguccucugcaagaacaccaauugcuauuaaaccgcugagccaucucucuagccccaagaaaauacaguuuagaguuaucaauguucauaugggcucaucuaaaccauuuuuuuccaaaauacauuguucuucuguuuaugauaauaauaguuacaguuacucuucaagaguauaauauuuuugucucaaauuaaaacuuuauugaaaaacugacaccaagauaacaaaggaguggacagauuuuuaaaagaguguauuguauaauaaaagguuacauuugcuguuuauaccaccgcacuuaucccuuaaaacauaggaagccagccagccacagguguacagccuuagaacauucucaccauaucuguccacacaggucagaagagcucaucuuuguacacgugcauguacaugaacacaugugcacacguacauauggcauugcucagccagcuuuagugggguuaaauuguuguauguuaugcccuuccacaaagacugugcuccuauuaaccgugaggugccugucucucccuagcaaaaucagccuguuaucuugaauucuugcaccuuugaugcaugguauauuguaaaguuaauuugacccauauuccuccuauuccccuagagcagugguucuccgucuuccuaaugcugugguccuuuaacacguuccucauguugugcugacccucaaccauaagauuauuccuugcuacuucaaacuaugguuuugcuaauguuacaaaucauaauguaaauaucugauaugcagcuuaucugauagguagcccccaaagggguugugaccgauguguagagaaccacaacucuagagccaguguuauagcaaauggcaggcucacuggggacacagguauuucuaacuaguacagauagccccagaguaccacccugugcuucugaccauucgcuuaaguuuaauaguucugucaaguguggcugugucaggcauccucuguauccuggcagcugccaacauugacuggcuaguugcccuuuuagguagccguggguaagcucagugacuagagcugggcuuaucgcagucuuucaggagucagccaucuuuaugagcuugagggcaacauaucucagaaccguagccacuccuaugaccuggggguacagagggaaguucuuauuuucuuuaccccuuccagaucauuccaagguauguguagggugaccucuuggggacacauguagucuguccccuccagugcuccgugagaaaugugggucugaguguuaccuugagcucuucuuuuuuucuagcauggucucgucuuaccuggugcaucauggguauuguuccacagccacagcuuuugcccgaaugacugaaaccccgauucaggaagagcaggcauccauaaagaacagacaaaguaagguuaauuuuucucuccucaugccuuuuaccugucccugacucuguagcucauuucugguuagucugucaagaguacagccucaccauaucuguacuauccuggagaccaacuugcuggcuccagucccugcuccuauccuucauucaagauaaaacuggccgggcagugguggcguacaccuguaaucccagcacuuggaggcagaggcagaggcagguggauuucugaguucaagaccagccuggucuacagagcgaguuccaggacagccagggcuauacagagaaacccugucucaaaaaaaaccgaaaaaaaaaaaaaaaaaaaacagauaaaacugacacaagggcaaccaguggccucagaaggucucagagcagccucccuaacacacuuuggaaaucaaguauaggccugguccugucauggcagaguccuguuccucccuguuuguuuccucucccuguucccugaauccuaaauucuacuuggccuccuauucaugauccccaaaaggaguuuuuguuugugcugcacacugcucugccuuugccauuguguccugagguucaaccauucugccuguuuguagccagagagaggacgacuccugucugaacagggugaagcaaugcucugugacuguugccaugcuagcucccugcuccuaccucuuguccuacccuuugcagauaaccaauucucucuugaccaaaggcagucuccuaguauuccuugcguuugaaacauuuuaauggaaggagggugggauagagaauagaacccacacgguuaagaggaggagagggcaauguaggugacuggauaugugcauguaaaugugucugaaugccugccuuuguuucucugagcccaucaucucugugucugugucugugcaugugucugugucuuccuaaacaagcuguggucagccagauagaaggaacaguauucuauucuugacuugggaucuacagaugagagagccucaggccuagaaucacaacaggaggcaccaggcuguaggacaagagcgagaaggcaauagcaagaugcugauggccagagaaaugccaucguuagagaugcuggugugagguaguccaccucuucucccucauauucuaaacuagccucugccaugguccuaaacaaccauauucuuucagccuuuucugugagcuucuccaacuagcagggugccaagagccagcccaccugacuucucucuggccacaaucuaggcuuggggccagggauauguaggcagucucagcucucacucagagacauguguuucucuacagaaauccagaagcuggugcuggaaggccgggugggugaagccauugagacaacccagcgcuucuacccugggcugcuggaacauaaucccaaccugcucuucaugcucaaguaagucagguuuacgguuccgagccuggcccucagcuugcacccagagcccauaguguggucccaggccagagcaucagugcucugcucccuucacaggugucgacaguucguggagauggugaacggcacugacagugagguccgcagccugaguucccgaagccccaagucccaggacagcuacccuggcucccccagccucagcccccgacauggccccaguaguucccauauacacaacacaggucagccauucuccagagugugcugggaagagcugguguggggaagagaggccaucccacaugccuuuccuuuuggugggcuuagaacuggcaacuagguuggguggaagggaaagggaccacacaagcaauccacuucugaccuccguucucugacccuccuggccucuuaggagcagacagucccagcugcagcaauggcgucgcauccaccaagaacaaacagaaccacaguaaauaccccgcacccagcuccuccuccucguccucauccuccucguccuccucuuccccguccuccgucaauuacuccgaguccaacucaacagacucuaccaagucccagccccacagcaguaccaguaaccaggagaccaggugccugucuugcuccucucccugcacucugcuucuguucugugcccgcuggaccugcccugcucuuuuaaaugcugccuucugcccuuuacccucaccucuguuguaggucuguggcuggacuggaaccugcugacgggucaggcuggacacuugguucuggcuuuugucccuacucaagauguagcugccaauugucuuggcucugguuuugucuggaguugcagcccugccagacuugaacaugauggccugccuacacagggccuccuucuggaggcugggccuguuagaaccucuagggaucaggcucauggacauccaugugaacuggccuguagacucagcuccagagagcauucagcagguccuaggcaugccuagaagcugaccuugguuugggucccagccaaggccacagagauacccaaucaguuugguugguagggaugagagggauacauugaagauauguauuaccucagaggagagccagugaggagagagucacaggacagccuugagacaagaaugggaucacgugacaggcacccagagauaaccacaguagggcuaaguguugacuccuagaaagcuugggcuguucuuucauguuccuggcagaccuugaguuugaugccauuauaggacccguuauggucucucagguaaacgccuucaguuuaccugaagcaauggucaacaaaaccucaaggaggcccaacuccugucucaacccugcuccacagugauagcgagauggagauggaggcagagcacuaucccaauggugugcuggaaagcgucuccacgcgcaucgucaauggggccuauaagcaugacgaccugcagacagaugaguccagcauggguaagugcugguccuuaggaucacucagcuccugugcuccuugagagggcagcacacaguccuagugccacuuccucggagguucuggcagcuugagaaacuuucguuucacuaagucugccacguucuuggucacuucuggauggcauccuuaagguggauuccacuguguaggaagguccauuccugcugccaagacuagaauccuucauggcuaaagagaguucaagaauguggaucucauuagcaccgugcauuuguguagggugggaggagggaaguuuccaagucuuaccccuggucuauauuccagguagauguaggcuucuccaccugcucuccuagcuugccugccuuucagaagcuguagcuuaaugggguccuuguuguccuucccucuucauuugcccucuaacguguuuucugcuggccucugugugcagacgacgggcauccacggaggcagcucugcgggggcaaccaggcugccacagaaaggaucauccuguuuggccgagagcugcaggcauugagcgagcagcugggccgggaguacggcaagaacuuggcccacacggagaugcugcagguacaggauaagcaggcucgcacagcgcuguccccauuugaugccgggcucugggaacaucuaaggguaguaggaguaggccagaaugggcucuagucaugucugcaguggaauguggggugucucgcuguauagcccagggauacugagcucuacugggucccaugccguguucuguccucugaggcuauagaacuguguauagugugcuauauuccccucacgggugcucuguccuuuaggaugccuuuagccuacuagcauacucagaccccuggagcugcccaguaggucaucagcuugaucccauccagagagagcccgugugugcugcucucaacagcgccauuuuaggugagugcaucuaauaaagguaaaagcuaaccaugggugugaaugucgccguagacccuucagaggcuccugggcuuuuaggacuaaucccaaccccagccucccuuugcccagcugaggucauuggcugcuaguucaaugccacaugccacguaccaggucagcuuccuugcucuagaggaggccaagguccucagguuuucccaucaugaaagcaggcccacagccugguggccugguggcuaggacacucaaacauugacacucuucccagaguccugcccauaguuuuaacuccacccuccaucguuaggaauuuugaccugugcccaaguccuuggcuagguacugaccauaccuuguuaucucuuccacagagucucagaaccugccaaagcagccuccuuugaugcucgcccugggccaggcaucugaaugucuacggcucauggcccgagcaggccugggaucuugcuccuuugccagagucgaugacuacuugcacuagcagaccuuccuggcuggcucuggcuggcccuccuucagcccuagggcuggagcagcccuguccuccguaggcaucugguacagagaccuggaagccaugggcagaguucacucuuccuaccuggccgguccauccuccuuuucuccuucccuuccucccucccucccuuguccucuccucccuguccccuuccacgugcagcgaccugugacucaguauuggcugguuacucaugugguagcuucuccuuuaaaggagauuuuguuuugaggagagguugguuuuuuuuuguuuuugaucuuguguuuuuuuuuuuuaacuuuuuuuuccuccugacugagccaccaguguuuaucucgggagaguuugugcugagcuggugucugcuaacuuaguaaugaagccuauccagguugaugauagcuuauuauuuucauaaguaaaaaaacaaacaaaugagauuauauauauauauauauauaaauauauauuaaaaaaaaagucacaguauuuaucguagcacuagugguccagcaccucuugggugaggcuguccagacaccauguguuuuuauuugaguccaacucauuaaaaaagaaucaucucuugucacuucaaucaagugauuuguuuauuuuaggcuccccuuuuguugagccucagguucagcugcugcccaggaaauauggguuuuggggaaggcuguuuggugggcaaggucagacuaagcuguuuugcagcaucccaagaggugugggucucuaggcccccuauagguaaacaaaagaacugcagguucagggauucagggaagugaggugggccaggggcacacagcaaagcaagggaacacaggguccguagccagcaugcugucuaccacucuacccugccucucacugccugccuugccccucucucccaucucaaugccugccuucccuuguuaagauggccaaauaauucauuacucucaguugauugccuggaaacuaccugccuucaucccaagagcugcugugugccaggcugccaagaggaagccauucccaagacagaggcccuuaaggacagggcucuuuucuuccugccagagucuucaccaucacugcccaacccugaugggauugaugcuuucuguggagaaguugguaccucauggagacugauucuuggaucacuggucccagaguggauggaacccuugacuuccugauccggauuucccuacagcuuaaggaaggcugcucccuacagcguggccccagcgacucuuaggaaggggggacuccaugggccuuacauaugucccaccagcuguuucacaggauccucacagcuggcgggacaacagcaacaacaaaacccacuaucccagggcugagaugcugccaggacaugaguaggccaucuguggaggggacugucuaccaaggaagaggagggucuauacagaggacaccuaggagggccaggauuuuaccugcuucacagggugagugaaaagccuaggcaaccucugcaaagauuagggucaacuguggcaaagccacaagugaguuuccagucuccaagugcaucugggcaggggaagcuuuuguucugcugguggacacagaaaucaauggcagagcucgagauguucugugcccaccaguccucacaaggcccacagcuggacaaaauugaauuagaccaucugucagugaggaaguagggccuugacugagauccuccaaaauuuugcuuuagggucuaauccuacaggcuacuauguuuuccugguuccugucagggccuuaguuuacagcuccucaggaggucuuguccuauguaaaggaaauuucauccuguccaaggcugggacacccaagcuccaagcucagguuggaaauaucaggcuguuaacaauggaugggccuuacauuuggaaaugaaaaccagaggcauuugcagagcaguggaacuuagagaaccucuccaccaguccucuccuuuuacagugaaagaaacagguccaggaaauuaagugauuugaccaaagccacacagcaaauaguggcagaaccaggacuaacuacuccuguggguuagacaaguccugucgugaccuaaagcaaaauggcaaaugagcuuuguaagggguuagguuggcgugaguucagcagugccugagcagcuggcaccuuucguggugugacggguagggaugggugcugagacguggauugcggaguggcugagagggccuuggacggcuugggacugcugugugcugcacgggauuguauguccaccuggcucacacucaguacccauggccaccuccccauuuaauucugugccuuaucucacuguuucagcugaguccaaguuguuuacucuguuccucuccagagaggcuuucuguccuaguuggacagcucacuuuggggacauaagccuuuguuccacaagcuguggggagggccaaaaucaagcugcuggagccaguaauuaguccaguccugcugccagaggagaccuguaugcacccccaauuccacuagcccauuuccaggaaucuggagugaggagcaguuccuggaagcaacuuagcaaagagcuggaccugacccuggugugcaaaaggaggaccuggccggguuggguuuguccaguccugagguagcagcauuuccuagcucacuuucccuaggaggcacagauggcagcuccuugcagagcaagggccaaguuggcggaugacucagagucccucucccccaaucccuuccucugagggucuguggcuaggugcagacugggugcagaacaucacaaacuaaagaaguaaggacugccuggcuacccagcaccuucccaguccuuaagcacaaagaugaggcagaggacuguuggggcugaacguuccuuugguugcucacaacucagguaugcaugucauucggcagcuggacagcaaagcccuacuucaccaccaaucacaggcauuuggaccuguggccagaugguggcuucuggcugucccagugcccaccucuuugcaucgguucccuccauuaucaacuacagcugaaacuggcauccuccacagugugcacacuggcucugccuuuguccuugcaaguugauauucggcauuagcaugaaacuuguggugugagaggguugacagaauuccaacacaaacauccuaguaaauuguacuugagaugaaaagauuccuguuguauuuugacagaauuauuuuuauuaaaauacacauccaugagcaauugugucuguuguucagaaucuuacuggaguugggguugggaggcccuaccucuugguaccucggggacuuuugaaaugucaacuuucaacuuuacaagacuccaaaagggacagggacuugagcuguucucgauugaaauuguucucagacauggaaaaaacaaacucaacuucagaaaugugggcuauugcugggcgugauggcgcaugccuuugaucccagcacucgggaggcagaggcaggcguauuucugaguucgaggccagccuggucuacagag

SEQ ID NO: 4721 - RNA, 10659 nt, Mus musculus
gauggggcgggcuuauuccggcggcuuuccuggacaccgcgauauccuguucagagucgauuauuuuccagaugaagcucguccuaagcgaaagguaaaaauguauucgaauggaacguuauggcaugggcuacccuucacaaggauccggaauccugaugguaccgggcgcgugccuggugagcgcaagcgcucuggguauaagaacacaaagacuacaaguuccaugaugccucagaagaacguuuuggugcggccgcgggcugcagcgccuccuaaaggagagguggaguuccugcagaccaggauuugaaugagguucugcagcuugcuauaaaaaacaccccaccccaccccacccccgacccccaguaccuuggaguggacugcauucuuuagccuagaggaaacccgaguccucccagaagaacuucuggagucaauuucuuauauugggagcacucucccgacucucagcuaccucuuacauggauggacucacugaccuaaaccaugucccuacuagcugcuuacaaugugccagacagugaagggaaaacacauucaaggcaauugguggcacacgccauuaaucccagcacuuaggaggcagaggcggaggcagauuucugaguucgcggccagccuggucuaaagagugaguuccaggacagccagggcuacacagagaaacccugucucgaaaaaaaaacaaaaaacaaaaaccaaccaaacaaaccaauauauaaauaucguauaauauuuuucacauuuauuaauuuuaaaaacauucaaaguaaugggagauauguuuauacauauaucaugugugagagugggggaguaauguuugcauuuaugcauguucauaugugugccagugagugucaauuucuggguaucauucauuccucaaggcccuuggccuuuucuuuuuucuuuuuuuuuuuuuuuuuuugagacaggauuucucuguguagcccuggcuguccuggaacucacucuguagaccaggcuggccucgaacucagaaauccaccugccucugccucccaagugcugggauuaaaggcguaugccaccacgccggcuggccuuuucauuuuaggcuggcuggccaguuagcugcagggaugcaccucuagcacugccauuauaggcaugggacacaaugcuugguauuuuuuuuauuuauuuauuuuugguuuuucaagacagguuuucucuguguaguccuugcuguccugaaacucccucuauagaccaagcuggccucgaacucagaaaucagccugccucugccuccuaagugcugggauuaaaggccugugccaccacugcccugcucaugccuggcuuuuuaacuugugaggaagaaucacauugauucaaacccacaaagcauuaaagaagauacucaauuugacucuaccuucaguacauaaauagccuuuaacauacucauggacauucaaauaauaucuaguaaguugaaaguagggacugugccuggucuucagcaccaaaagcaaacaaagugcgcaauuucuccccagcacugucuuaccuauccucuggacuuggcaucucuagugaaaagcaagaaucauauugcaugucucugcuucuaaucuuggguccucuacaucuguuucccuugugacugccaaagaaaaucugacaagccaugggucgcucaagggggcuggagaaauggcucaggguuuaagaacacugacugcucucuggaagguucugaguucaaaucccagcaaccacaggcaugaaucacaaguucaaggucaucaucugcugcguggaaagucugaggcaagucugaacuacauacaaccugucucaaaacaaaacaacagucgggcgguggggcacacgccuuuaaucccagcacuugggaagcagagguaggcagauuucugaguucgaggccagccuggucuacagagugaguuccaggacagccagggcaauacagagaaacccugucucaaaaaaaacaaaaaacaaaacaaaaacaaaaaaaaaacccaaaaccugucucaaaaaaccaaaccaaaaacaacaacaacaacgaaaaaaaaaaagcaacaaaaaacccaaaccaaaacaaaacccaaacaaaacaacaacaaaacccaagacuucuaaagaaaauaaaaauuuaaacggggugcaauagaaaacaccuguauucucgcucaccugcucuugcuucuacucccccccccauugcccuccucccucucuccaggugcccaugggcgaccucuacuccucuauucucucugccucuaugucuacucccucaucuccccuucccaugcccugaauaaauccuguucuauacuaacaaacaaaaagaacggaaggaaggaagaaaacaccuguaacgcaaucaaacagaaguggaagcaggaggcuuagaaguucaaggucaucuuggacuaccuagggauuuugaggucagcuugggcuacacaccacgcuguuucaaaaacaaaaaguauauacgcacgugcgcgcacaugaaauuaucaaaaucuaccauaguggccuacaucugccaucggaguauuccuaugguaaaggcaagagggcuguccagagagguugacccuacauguaugucuggugucugaagagaccagaggaggacauuugaugcccggacacugguguuucuggcagucaugaccuuuccuuacggguucagguucuauacaagagcagcaaguaggccuugccgcugagccauacuucuaguccccuaguucuuuaagauuauuauaagccuuuaaaaaaaaaaacuuuuuuuuuuuuuuuaaaugaagaaaccaugaagucuuaacugguugcaugcuuuccccucaggguuaacaugagaccgccuccaaaaucaauuuacaaucacaucagacccgguuccccagcuguuggacuacaguucccguggggccauguggcagcaucgcgagacuugacucaaaauaggcggugggaacgcggugcucgcugcugcuugagcaguuaggaggggugggguccugaacauggcggaccucagcuuuucugacggcgauccuacuguacgcacgcuuuugcggcgcgugcuggagacggcggauucgcgcacuccgaugagacgccggagcacucggaucaaguacguaagaguguugcggugagcaacuggaaugaauggacaguggugucugcgucuggaaaggaaaaccgcgucucagaguacagucugagaugcugagaucagacucgggguuccuaaucaaauugaacucagcugugcgguuuuguacucucaccguaugccccagggugagaccgcagagucucacucacaacggugcuggaucucuaggagcagagggcaaggcucuguguuuucuagccuguuucacucaccccccucccaggccaagguugucgugacaucuaccccugcuucuaggugacuucaccuuucacaacacacacaguccuacucucugaggcucccauggcaggucggggggcaggaacuggaaagaugcuuugcuuucuuucuuuucuuucucuuucuuucuuucuuucuuucuuucuuucuuucuucuucuugcuuugcuuuuuuucuuuucuuuuucuuucuucuucuucaugcuuugcuuucuuuuuucucucuucuucuucaugcuuugcuuuccuuuuuucuuucuucuucuugaugcuuugcuuucuuuuuucuuucuucuuuucuucuucuuucuucuuucuucuucuuucuucuucuucuucuucuucuucuucuuccuucuucuuccuucuucuuccuucuucuucuucuucuucuucuucuucuucuuccuucuuccuuuuucuucuucuucuucuucuucuuccuucuucuuucuucuuucuucuguuuuuguuuuuucgguuuucgagacaggguuccucuguguaguccugacuuuggggagugaagcuuaaggaggguugugagcagaagguaccgaaguuggcuuccaccagucuggaagaaugcccuucuuuccaaguggagacucguucaugauaagguguuuucuuuuauucuccaaaguauuagugguugauccuaggaucuuaugccugcuaauuaagcacccuaccauugugcgucaucuccagcccuuucccuauuucuuugccacaggaucucaagaaguugccugggcguggcuugaaacuagcccagacaggcuuuggacuccccauccucuuucccuaaccucccuggucgcugggauuaacauguuggucccaccgggcccuuguuaauucaugauggggcauuauguauuuauuuacugucgguguuugugagagaguguguguaggucaaaggacacucuuagagucaguucugaccuuccagcacguggguccaggucauugaacucaggaugcuaggcuuggaagcaguugccuuuaaccacugagcaaucuggccagccccuccggcuauguuuuaggccugugaguaaugagguggaagccugcggaacacagaguucugagacacacuguacuggagaaaaagggcuggggugacccauggggagcuuaaugucacaccuugaugacaacuugaaagguuaaaaguaacuuaaauuuccuacuuggcugauuucugaguucgaggccagccuggucuacagugugaguuccaggacagccagggcuacacagagaaacccugucucgaaaaacuaaaaaaaaaaaaaaaaaaaaaaaaaauguccuacuuggauuguuauucuaaugccugggacgggacaggaugcucuuccgguuuguaaccucugugaccacccuccagucauguuuuguuauucugcuagacuuacccucaucccagcuagaucagucauaguccaucugucccucaggguuaccccucaucccccucuuugcuggggaccauggaagguacaagugguuucugggacccugccccuaaaggaaagcuuuuaaaccacagccccuaaacaaacgucuguaccuccagguccuuacccccaacuuccuacagagaucucagggcagguuguccuguuuuuguuuuuuuacacagugcacaaagaagacggucucaaacgccauacucuaacaggcaggguagccaaacaaagacaagugcuaggaagcaaucccauggagcuaggguaaguguccaccuacuccaugagugacuucauagaacccuaaagucuauuuuuguuuugaagccuaccuugaggggcucucaagccaaaagagagacuaguggcgcuuguacccauagucaguuggcagaucgacucguguucaaggucgugggcgccuggaggaacagacaccccggacucugcuaaggaauaucuuacuaacugguaagugggugucagccugccaguuaaaauuaggugcuaguccaacagugaguccuaugauguccuucuuggucagccccacccuuuucuugcucauucuauagccccagaaucguccacugugaugccagacccaguggugaagccagcacaaguaccagaaguggcccgguccuccagacgggagagcagucggggaagguacacggugaauuucccucauaggcugagccaccucuugggauccccagaaacuaaaauugggcuuccugacauguuugagauaaacuucauccuuacagccuggagcuacaccuuccugaacuggagccccccucaacccuggcuccgggucuaacagccccuggcaaaaggaagcagaaacugagauuaucaguauuucagcaggaaguggaccagggguugccucucucccaaggugagaucuagcacacaccugagcuauuuucucuccgcuugggauauaggaaagacccaagagagcuuucguaggcuuggguaacucacuguggauucuuuuucuuacauuuucuugauggaaccugauagagccacguaggaguaggagugcugauguuucauccuuggcuagguacuguucccuguucugggguuuauacaguauggucaccagauucuaagagauaagucccuuuggggaagcugugucucaggcuuuccuugugucugcuuccaucuuaacagcuccuucaaucuuaccuuuguucuaccuggucagccagagacaguggagagaccuggucuggcucgaagacgucccauccgccagcuugugaaugcuggugcucuuuugcaggaucuggaagacaauuccuuagccucugcucuuccagguaagguuguaaucucuucuagcuuuagggagaagcuaccacucugugacagacaggagacugaacucagcuuugcuccgcaucugaugaggucagggauacugugugagccugagcaggcaucuaggaauuucuguuuuccucacaaacuacuuaccugguacuuuggucuauuaggguucucuagaggaacauaacuuacagagugagugaggguguaaggggaaggauuuauuagaauggcuuacaggcugugguccagauagccaacaauugcugucuaccaauggaaaguccaagaauacagcaguuuaaguccacaggcuggaugucuaagccggucuucaguaugugcuggcuucucaaauaagcaggcuguguugacugagaaggaauagaccugcuaccgagagcgagagcaagcaggcagagagcaaguuuuauagagacaggguuucucuguauagcccuggcuguccuggaacucacucuguagaccaggcuggccucgcacuugccucugccucccaagugcugggauuaaaggcgugcgccaccacugcccagcuuuucuuucaccuuuauauaggcugccagcagaagaugugggccagauuaaaaguggaucuucccaacucaaagaucuggauuagaaguggguuuucccacaucaaaugauuuuuuuuuuuuuuuaaguuuuucaagacaggguuucucuguguagccuuggcuggccuggaacucacucuguagaccaggcuggccuggaacucagagauccaccugccucugccucccaagugcugggauuaaaggcaugagccaccacgccgggcuuuuuuguuuuuuuaguuacaucaaaugauuuaaggaaaaaaacaaaacaacaacaacaacaaaaacccuaacaggugugcccagucauuuggauuuuaguuaauuccagauguagcuaaagguaacaaccaaggagagccauuguagccaggcauuggagccucccaugcacuugcaaauuccaggccagccugcucugcagagcaagcugcaggacaaccaagacuacaaagaggaaacccuaucuuggaaguaaagaaaaaagagaaagacgaacucccagagugggccuagucuucaugucucuguggcuuuuauuacuucauauucuugaacuccagggccaaggguggaggacuuuuccuauaggggcuggugcguguuagaagacgguggggaaaacggguuuuaugaccaauuagcacuaacccgggagccuuguuccagaggacaaguucauguuugaggacggugcugagcagagaauauagauggcugaggcaugagccauccguuuuaggggcuaugagcaagguguacaggcugaggugucagaggaaggaccaggaagaguagccuagcaaggugggcgagggaagguaacaggcuuagaaagcaguuuaccuucuggaaguuccuuagagaagcccugaaguuucacugccugccccuuccaguccccggcuuuagcagguggaccuaggauacagaauuucucugccuguugauauccaggugacagucacagaacaccuguugcugcucugccgauggauguaggcuuggaagacacacagccuuucucacaguccuuggcugccuuuucccuuagugggaaacauucucugcccagcccuucucgcccugggguugaagauguugaaagaguuaugggcccaccaagcucggggaccaggcugcaaagccggagugaguaugagggguggcugacugggagccagcuuagccagugccagaguuagcguagacguuuccuuccuccggcccuuaucugugccccagaacuccagcccaggagucccuccuuuccccaagaguagaauggugguggggccaggagagucugaaucagcgcuuccugcccccccucagugagcagaucuggcccugcugccucuccuucccccuuccuggagccacagccuccgccugcagaaccgagagaagcaguaggauccaacgaggcugcggagcccaaggaucaagaaggaucuucaggguaugaggaaacuucugcuaggccagguaagaggccuagcuuagguaucagugggucaguguuacuagcuucuuaguuccugucuuacagaagagaauuugccccgggcuguuuaugggaacugguaguuucaggggccacggggcguguaagggucagucacuuacuuaacuagagcucucugagggaggcccguaggaauuaagagagggagacuaagccuuuacagcugugugaagugguugagccugacccucgugugacacaacucuuucucugcagcaaguggagaauuauccuccagcacacaugacucacucccagcugaacagccacccccgucaccuggaguugcaguguaagaaaccccaguuguugggaagagggugcccugaagugggcauugugcgcuuucaaguccucauagcuauacggaugauugucaagcacagcagcuccagccugucugccguccuggugccugacccaagauguguagaagagcuuaggugagggggaagcuccuaggccaguaucuaaucauagguggcuuccuggaggacauuugucggcuugggacaggcagugguggauuccuaaggggagagacuguccaguuugagaccugaggguuguuuguuuguuuguuuuuguuuuuguuuuauuuuucgagacaauuauauacucuguauacucagaaauccgccugccucugccucccgagugcugagauuaaaggcauuugccaccacgcccggcgagaccugagguuuaacaagcuugagcaggugccaacauaaauguugaggcuugacuagagcauuggaucuauauuggaggaucagggucacagggaagggccaagcuguuucugguuguaguugucagucaacagccuccucuuucuccuucuccuccuccuguuuuuguuuuuugguguuuuguuuuguuuuguuuugagacaggguuucucuguguagccuuggcuguccuggaacucacucuguagaccaggcuggccucgaacucagauucaccugccccugauuccucagugcuggaauuaaagguguuguaaccccaccccaccccggugacccgacucauccccguuggauuuccaguucaaguuaauuaauuugcaacggucacaguuucagcagagccagcaggacuugucuucacauaggggccuccccaaacugcaguucaaucaccugucugcuccuguccucagccuaucuucagagccccuggagucugugacagcuaagugcccauccaggacccaaacugcagguccuaggcgccgccaagacccccacaaggcuggacugagccccuaugugaaguucuucagcuucuguacuaagaugcccguggagaagacggcucuugagauaguagagaaguggugaguggagcacgugaguggguagaggggccaggucagaagccgacucuuuagucuguucuauuccaaccuuguuggcagccuagacaaguauuuccagcaccuuugcaaugaccuggagguauuugcuucucaugcuggccguaagauugugaagccagaggacuuauugcugcugaugcgacgguaagugcacauaaaagggaggccgaguaugggagggcuggugcuaauucuguuugagccucuuuuucucucacacaggcagggacuagugacugaucaagucucgcagcaugugcucguggagcgguaccugcccuuggaguaccggcaacaacuuaucccuugugcauucaguggcaauucugucuucccugcacaguaggaccaggccuucccuggcaccuacucucccuaccuuggaaaucuugaacccuacacaaucaugaagguucccucaucuccuggcaccaagaaagucucacaaauggguucuucugcuuuguggugcaugucuuaggaccugcccagguugccuucccccagccuggaaaggaauaggaauuaaagacuuuauacuagaagaaaguuagcgauauuguauuucuguugccaggggggcagggcuggcucuagcuugcugggucuggcucucgugguccuacacgcuucgugucugccauccuaagucgaucaagugcagucucaaccuuuauggagauuauccccugcuucuccucauccuccaguggcacaucaauugcagggaucugauaggccuggcucagguaggcacucagagucugcuuguccaugguaggaucuauguucaucagggucccacgcaucuucaguagggucacg

SEQ ID NO: 4722 - RNA, 1861 nt, Mus musculus
aguccuccuuuccaggcgguccuucgcggcgucccccgggccgacuccgaagcgcaggcggacggccggguggguagcgcggcgcgggcgguccgcaaccauauucugggcacggggccucggcccgggacgacugcgccgggcggcaauagugagaggccucugagagccucgcgcggcgccgcccgucgaggagcugagacaggggccagacccggccgucgaagagcucgagaggccggugggccgggccgcgcgucgcagccaugccuggcuuuacgugcugcguuccgggcugcuacaacaauucacaccgggacaaggcgcugcacuucuacacguuucccaaggacgcugaguugcggcgccucuggcucaagaacgugucccgugcuggcgucagugggugcuucuccaccuuccaacccaccaccggccaccgucucugcagcguccacuuucagggcggccgcaagaccuacacggugcgcguucccaccauuuucccgcugcguggcgucaaugagcgcaaaguagcucggagaccugcgggagcugcggcagcccgccguaggcagcagcagcagcaacaacaacagcagcagcagcaacagcagcagcugcaacagcagcagccgucuccguccuccuccacugcccagaccacccaguugcagccgaaccuggugucugccucugcagcugugcuucuuacgcuucaggccgccguagacagcaaccaggcuccgggauccgugguucccguguccacgacucccucgggagaugaugugaagcccaucgaccucacagugcaagucgaguuugcagcugcugaaggggcagccgccgcugccgccgccucagagcuagaggcugcuacggcugggcuggaggccgcugagugcacucugggcccucagcugguggugguaggggaagagggcuucccugacacuggcucugaccacucguacuccuuguccucggguaccacggaggaggagcuccugcgcaagcugaacgagcagcgggacaucuuggcccugauggaagugaagaugaaggagaugaaggguagcauccgccaucugcgucucaccgaggccaagcuccgugaagaacuucgagagaaggaucgucugcuugccauggcugucauccguaagaagcacggcaugugaaugguuccccccagaaaccugcagaauucgugacuccuuccagcccaaggaauccucaggcaaauguuguacuccccaguauuccuguugacagugccgagguuuaggacagcgggacuccaguuggucaguuggcaccuucuuucgucuccucgugaaguaagaguuggggacuucagaaucuggugacaccagcaguuaugacuuugucucucacuccccaguuuauguugcagauucugguuauacacaggcuucagaaccacugaacuuggaacuuacccuggagggggugcagauggaacucuuaagggacuguggguuugaggaaaccacuucuucagguuggccagcaaucagagacagcuuugcuguguguagugauaagagaucucaguaacaucguuucuccuuuccaugcuacccgguucaggugcagucugugauucugauggggacuagcugaucugugccucugucucuuaggaccucucuacccagaaggucauuuaugagagggcucugggugacuugcugauggagauccagcucaccagggacuuagguuuaucucguuauguuugcuacugguuacaaauucuauuuucuguacaauuagacugaaguuuucacuguuuggcaaaacaaauuaaacaaaaaaguaagguuuuuauuug

SEQ ID NO: 4723 - RNA, 1861 nt, Mus musculus
caaauaaaaaccuuacuuuuuuguuuaauuuguuuugccaaacagugaaaacuucagucuaauuguacagaaaauagaauuuguaaccaguagcaaacauaacgagauaaaccuaagucccuggugagcuggaucuccaucagcaagucacccagagcccucucauaaaugaccuucuggguagagagguccuaagagacagaggcacagaucagcuaguccccaucagaaucacagacugcaccugaaccggguagcauggaaaggagaaacgauguuacugagaucucuuaucacuacacacagcaaagcugucucugauugcuggccaaccugaagaagugguuuccucaaacccacagucccuuaagaguuccaucugcacccccuccaggguaaguuccaaguucagugguucugaagccuguguauaaccagaaucugcaacauaaacuggggagugagagacaaagucauaacugcuggugucaccagauucugaaguccccaacucuuacuucacgaggagacgaaagaaggugccaacugaccaacuggagucccgcuguccuaaaccucggcacugucaacaggaauacuggggaguacaacauuugccugaggauuccuugggcuggaaggagucacgaauucugcagguuucuggggggaaccauucacaugccgugcuucuuacggaugacagccauggcaagcagacgauccuucucucgaaguucuucacggagcuuggccucggugagacgcagauggcggaugcuacccuucaucuccuucaucuucacuuccaucagggccaagaugucccgcugcucguucagcuugcgcaggagcuccuccuccgugguacccgaggacaaggaguacgaguggucagagccagugucagggaagcccucuuccccuaccaccaccagcugagggcccagagugcacucagcggccuccagcccagccguagcagccucuagcucugaggcggcggcagcggcggcugccccuucagcagcugcaaacucgacuugcacugugaggucgaugggcuucacaucaucucccgagggagucguggacacgggaaccacggaucccggagccugguugcugucuacggcggccugaagcguaagaagcacagcugcagaggcagacaccagguucggcugcaacuggguggucugggcaguggaggaggacggagacggcugcugcuguugcagcugcugcuguugcugcugcugcuguuguuguugcugcugcugcugccuacggcgggcugccgcagcucccgcaggucuccgagcuacuuugcgcucauugacgccacgcagcgggaaaauggugggaacgcgcaccguguaggucuugcggccgcccugaaaguggacgcugcagagacgguggccggugguggguuggaagguggagaagcacccacugacgccagcacgggacacguucuugagccagaggcgccgcaacucagcguccuugggaaacguguagaagugcagcgccuugucccggugugaauuguuguagcagcccggaacgcagcacguaaagccaggcauggcugcgacgcgcggcccggcccaccggccucucgagcucuucgacggccgggucuggccccugucucagcuccucgacgggcggcgccgcgcgaggcucucagaggccucucacuauugccgcccggcgcagucgucccgggccgaggccccgugcccagaauaugguugcggaccgcccgcgccgcgcuacccacccggccguccgccugcgcuucggagucggcccgggggacgccgcgaaggaccgccuggaaaggaggacu

SEQ ID NO: 4724 - RNA, 1122 nt, Mus musculus
ugguuuguuuuguuuuucgagacaggguuucucugucuccuggaaguccuggagcucacucuuuagaccaggcuggccuugaacucagaaaucugcugucucugccucccaagugcagagauuaaaggcacgugccaccacugcccaguuuagacaggggcuuuaaucaagaagcuuagccugguuuuaucagucaucuccaggagguggggugaggcuaagagggcaaaacagaaguauuaaagagucuucugacuaggaagauagggguguuugcagccauuuuccuuuucugugguucuguggguugguagcagagccauuugcccagcacaggcgggacggagaggcguuacuucaaauauuugugucacccaggaaacugaaaaggauauugaaaguaaaggggaaggggugggaagauuauuuacagucuggccauuuaggaaaauuacguuucgccaguuaucuuucaauaaaaauuaaaguuggaaggugagcuggcuccgugggucgcuaaaccugagagaaucugauuucaaggcccccaugguggaagaacugacuccagaaagcugcuucucuccuccacacccaugucguggcucaucccuccucaacacaaauaaacaaacaaaaauaguugcccugucugcuccaacaaaacaaguaaaccuggaaaucaaaaaaagaaaacccucacgauucuguuuuuaaaaauaccucucuguacacgugagguuaaccucuccaacuaugggcccaccuuagaugaguguuuagaguuucaauaaaaaccuaguuaccuuccaaccaacuuugggauaaguggcuuccucugagacacagcuaacucauugaacaagagaggaguggguuucgcccccguggguugaugcuagaggagcagagcugguagccagggcgccuaaagggaguaggcuuuggacuaggggccuagggaggggcugcugggacaagccagccagcuccaagcuaaaccaggcucccauggaggcggggucaggcuccauaggccacauacacuuaggcggggccaagccagcugggacccagcuacaaccgagaccugauccuugccuggcgccaacuccguguucc

SEQ ID NO: 4725 - RNA, 19994 nt, Mus musculus
guuuacaaacaccucuuuauugcagacauuucaggcacagguacauggaagaagcuguauugcagauuuuauacaggguggauuaagaggcagcuggcaucuaccucucucccaccccuacuucccccaauacacagcagcuagagaucaaucccacuggaaccuucuguguagcguccaggacuaugcuggucuaaccaggcaaccuguggaguauguggaaaucuuuacucuccccucacaaugcaggagagcagggagaagggcauguucaggugugccuagccaauccuaaaccccaaauccugggcuugguucuagcuugcaguugcuauuuuaguagcuuuauacuauccagaggucucaaggaugaaaagcuauaucgguacugagcaagaccugugcccagacuaagaaacagggcagaaacugccauacuaguuaagauuuccugggauuugaagaguguaugggguauguggaaaguaggaagaugguguguaaaugcccugcacaggucuugaggggagaguuagagcacuccuucacacugcuuccuuccaguguggaauuuauacuccaccuaauggcgccuggcucugauaucccaagcaggcagcacagcaucucucgcuuugcuuggggaaugugggcaucugcaugucacuuauuuuggguauagagcaggccccuacauuuaggacuucaacccagaggguauaaauaugggaagccauauuugcuaaggccuuucuagcugcuacagaauaucuacccugcuacuagacccaaaucuacagagcagaggccacaggugguaucagacagagcugacugaagagccuucaguccaagagaagcuucaggccaggccugcguuccaaaacccuggggcuggagagaacucugccccggcccgcagacaugcgagcuuagccacuugagugaaucugcuccuugcaguagguucuguugaggugaggcagauggggguggggaaagugagacaaugggcuggaacuguugaugcccagccaacuacuuaacuaauuaaaacaauuuaaacuguuaagaaaauuuuugugguuuuauuguaucaugaggcauugaaacaucugaacaaaucaauaucugggcgguuggugaggcagcugcuuucuccuucacuucuuuggguuacuagagcaacuugucaguagauuaaaaaaacaaaacaaaacaaaaaauaaaacaaaaacaaaacccgacaaucguuugcauuacuuaagucuuuccaaggcaugcgcugguacaacacaaacuuccugucagaugcgacuagucuagcauccaaacaucaugcacaacaccguggugacagaagcgcccugcacccgcucccgccucggcccugcucguuuguguaugauauuuggagcaucuggaggagugagcuaggauugggaagagggaggaggaaacagcgugacuguggccaggaggaggucagccgaaguugugcagggcaagccugaacaugucauuggugcaaacccaagcaucguugauguucuuuaauagaaacaucugguggaaacccaugaugggaucuucaucagccuguacgaagggagaaagaacagauucagugaaggggcuaaggaacggaaaggauguuuaaugguaguacaaccuagggaucagguacuaauuaucuuaacacugaauuccaguacagaauagguauuugugaacgugaauuacuaugugggaaacugcuggucacauaggugucaauaaauggcuacucacauguauauugaaaggcagcacacuuuaccacuuagcuaggcagcagagcagaggacuugccugucuuuuagcucaaugucucagggcagaagugaucaaaaauuuuaaggaaucuugaaacacuauuauuuauuaauuuaucccaaucagaagaaacuacugauaaaugguuuacauuuuaaaacugaguucacauugggcccaguggcacauaccuccugucaguguguauaugacaaggcuauuuaaaacaagcaaaccagggcuggagagauggcucagugguuaagagcacugacugcucuuccagaagucccgaguucaauucucagcaaccacgugguggcucacaaccaucuauaaugggauccgauacccuguucuggugugucugaagacagcuacaguguacucacacacauuaaaugaauaauuaaucuuaaaaacaaaaaacaaaaaaacaaacuagcaaauaagcccggcucccccaaacaaauaaauacaacacacacaaauuucacaagaggaucagaauuuuauaaggcauuggaauaggauggggaaugaccagcauaacacugcaauagaaagaggcagaccccaaacucuaacuacaauucagaaaagcaggaugaggccuagugugugcacgcaugcuacggcugggccacucacaccaguagggaucugaaacucggugugaagugccuggcacucauuacugcuuauuacuccagcccaagagcggagggugagcuccuggaaaugccccgcaaccccgagggccgacuugguugcagguucugggcagagcguucugaaacggcaagaggaacugauagaaaaguaagguguaguccagagagcuacggccuggccaagaggucaggcaaucuguccugcucugugaagaggcuuuuggcaagugccugacuauaaggaugacagguaaaggagggguaaaggagacaggcacagugacacacaccuuaaauggcuagaggcucuuucccuacaacccuggugaccugaguuggaucucugggacccaugugaaaaugaaaggaaacaaguuguccucuaaccuccgucugcguauuauggcauaauacaaccauuaaggacacauauaauauauauuuuuucauuuucuuuuucuuaugggaaaagggaaauaaacaaggugggacuucauuugcuuugaagguggaagagccagcuugggccagucaugguaguacacucuuuucaucucaguauuaaacagaggcagaaggaucucugugaauuagagggcuuggucuacacagcaagaccuugucucaaagagagacugugggagcaccagcuugggagguagcauugagggcuaucugaggauuaucucuaucuaagugcccagucagcagguccaucuauaccucaggaugacacaagaguuuggcccaagaguuugacaggacagcuacauccugcuccuauucaucuugcccccuuuccauaauagcucuagaccagugcucgucacuagaacuuucugcaacuacagccacugaccacaagcacuauacaacuaaggaaguccauguuaauuuaauuagcacaauuuaaaauuguauggagccaaucuggaauacagagcaaguucuaggccagugagggguacacagugagaccugaccucaaaaaauaaaaaaauaaaaaaauaaauacguagauauaauuguggggccaagggagcggcucgauguaagaaagcaucuguccagccuguacacaauauccagcaccaaggaaagucgggagcggggaagguaaaggccagcuacaguucauggcuguuacacuaaacaaugcagggcuaggcagccacuuugauggguuugguuuuguuuggacagucauuuuggacguccccccaguaaguagguuacauccacagagaaggcacagagcucugcuuugccugccuacuccugcccugaaacacaguggcacugcuaccuugagcuggcccacaaccaugcugaugaugcagcuaucugguguaggcuggugguccugcgccgugaugcuaugcugaauuuucuggaacggaaggcucugcaagagaaagaaugggagguaagcugggggcagaagaggcauuaaaggaggcgccuggucucaguucuggacccuacucacagauagcuucuccacaauggcagcuuuccccuggaacugcuguccuucccauguaaggcaugaugcaucaaucuaaaauguguaggaaggaaauacagucaggagggacagugagagggacuggacagugacagaguaccuguccuaugugcaugaaggccuggguacaauccucuaacucauaaagacaaauuauaucaucuaggaugaauuuguuccagcuccuaagaugccuuuauuuccaagauuucugaaugaacccugacauucuggaagagauaacccugacaacuucugauggcucaaccaggaucuauggugacuccuuccuauccugaguagauccauuugcuuagccugacugaaugcccccguguugcugaaucucaggcagcuaccugaagaaugaaucagaauaaauuaucauuaaaacacgaagcaaugcccaccuagaagagcccuugggguaacuauucuauccccacaggcacucagaugcucuggccucaaaagaagcugcacauaggaacccccagaagccagcgcugcacugaaaauguucauggcugcuaccucccaaggauaaugaauccuaaucuagacuugguacagagaccagguauccuaagggcuucaugaccugauaaagugccaaccacauugaaugacaaagcccaaacuccuuguccaggaucccacaguugcuacucuugcuauccacacugauccccuagguuuuuguucuggcucucacacuggagacuuacauaaauugcgccuaguuggguucugucguuaucaaauaacugguaguaauguugaauaaagcuggauccaaucugcucccaaauuggcuugucucccauccuggagggucacccaccucugagaccugcaagaccagcaagaccaagacagaaauguuaguaucacagaagcaagaagcagccugucuucuccuagccuccucaugcaggaagaucucuguugauacccguucaggguaugugacaagcugggggucucacagaccucacccaacccugaccagugguagggaccacauuuagcccaucuucuaaggaccucuagguugaugacagggugccacauacaagaugguugaggcaauacccggggugaaagaaaaccagaauaggcccuauguccaauaacuggagaagaaggaacuaagcaccagccccagguccaugucuuccuuucauccuuucaauaaccuccaaggccacaguugcugcugcucuacccacuaaucagaccaggaacuacucauguuucuguguagaacauuucucuuuucgccuucaagcuuccaaugucuuagggaugugaugauggugaugggggguuggaaggacacaugguuucuaaagacuccauugcuggccacagcaagucccaaggagccaccuaacaccucugagaccuggugauucuugaccuggucuuugcuggugucaguucuucagugacaaagcuauucucuacucaugucagagcugagaaagggaaagauaaaugaaggcaugaaugggcgcauccugucucaccacuaccccgcuccugaggagugucuccauacagcucgaggccaccaucccaaagacacugaugaaaaccccacguuggcuuuguuaaagcccuccaagagaaggcaagcgcacucacuuccuguggccgagagccccaucugcugcucuguaugguucugacucagaggaacacauacucuguccugagaauaggucugagacguaacaguacgagggaaacuucaccccagcagaaaagcauucguugugguaggagcugauacacggcacugcuucuagggcucccacauccuccucugcaaaacugaagacaguaacuccagcuugcuggugguuauguagcuuaccaugcuaaguacuaagucucuaugaccucaccgaaggccagaggagccagcaggaagggacggaguaaaggaacagagaugaauucaauccuccagccuaggauacucuagccaaugaaaggccaggaaaugaagccaguuuuauuuuaaguucccuaggagguagcuguacuaaaaauagcaacuaugcucagaugacuaagaaauguccaggaaagccuaaaacaagcagaggagaaagcuuggauccagccaugcccauacacaggaacacaaggugugucccaguucacauuuguagcaagaaacaaaucaacaaaugaaagaagcauagaaucuacaaucauuuucacaugcaguuuuggucacauuucuaaauuuccaagaaauguacauauuuccuacccuuacauuucuacaccuucuaccauaguauccacucagcaugucccaaacugcagaagccaagauacuuaguccaguucccaagagcucucagggaaagcugcaggaagaaugagggucagacuuccuucugcucucaacccauauuaaggggaagaccuagaaaagaacacaccaggcagaagaaacagcaccaccaacuaugugacagcaccaaaccagcugacggauggaaacugggacaucagaaaaggaaaggaaggcugagagaagagaaacaggcuagcgugugcuaagacaguggggcagcauaggaaauaggagggugucuuuuucuuuuucaguaguauuguccuaucuaucuuauuuacccaaaguaucuaucugggaaagagucucacuaggcugaccuagaacaugcuaugcagaccagacuggucuguuuccaucugacuuugccuccugaguuuuauuaaagaaaugcacacacuaccauguccagcuagguaggguuuuguuuuguguuugcuucuuuugaagcaggguccuaguauguagcccuggcugcccuugaguuugcuauguagauccaccugacugccugcagaggcguacaccaccacacccagcaguagaguaagcuaacucucuaauaggaaaaaaucucuggcuaaagcaguaacagagggacaaaaugaaacaccgguccacaucggcagcauaaggacuggggaacaagagaacuuaggaguucucagagaggcgaaaaggaaucuucaaaacuggauaaagucuggccugguacuacaagccuauaaugcuagcuacuugaaaagcuaacuuaagaagaacccugguccaaagcuacagagugaguucaaggccaauuuggguaacuuagugguaucuugucucaaaauagaaaauaaacgaaggccuggguggagagcgcuugcccaauauacacaaaaccuugggugugauccugagcaauucgaagaccagaucuaaguggcauaugccuguaacaccaagacuugggaaguagaggcaggaggaucaaaaguccaaggugucucuuggcuacacaaggaauuaagaggucagucuaggcuagaaacaaaguuucaaaaacaaaacaagacaaacuaacaaaaaacaaaaccaaagacugcauaaagaccuuugcuuuaaggaaaccaaaggcagccccaggagccaacaccaacuuuacuccaggucugccugacugugcacuuauugccauggccugaacauaugacaugugauaagguucccaugucaccaugcuguagauauaagaaaacguaggagagguugaacaaugcagaagggcucaccuaaaguuuauucagauaucagggcugacauggucuugucuuacugaacccuaaauuacaaaguuggucacaugcucccuuuaccacuguagccauugucuaaagcugacccuaaacuaggcuugguauugccuuccuccaguuccagcacucaggcaggccagggcuacaaggcaagaccccucuuaaaauaagcagccaggaacaugguacauccuauaauucuagcacuugguaggcuacaguaggacuguuguaguuccgggccacuagacuguacagugacacaacuauuucaaaaaaauaagauucaguugugaugguacaggcuaaccccagcacuuagaggcagaggcaggaggaucucuguugaguucaaggccaccauggucuacauagugauauccaggccagucagagcuauguagcaagacccuguaacuuacaaacaaacaaacagaaccaaccaaccacgggacuagagagagcacucagcggucacuauuguuuccugcucuucuagaggauccuaauuuggcucacagcaucuacacugggcguugaacaacugcuuguaacucuagcuccaaugauaccuucuuuuggccacacaacagacauacaaaaaaacgcaaaaaccaaaaccauauaacacaaacugcuagugugacauauaaucguaaucccagcuuuugggaugcugagguggaaagauuguuggaagaucaaggccagccuggggagcaacauagcgaguugaagacuagccagagcuagagugaaagccuagcuaaaaaaaaaaauucuggagcuggagagauggcucagugguuaagggcacugacugcuccuccagagguccagaguuccgauuuccaacaaccacaugguagcucacaaccaucuguaaugggaucugauguccucuucuggugugugucugaagagagcuacaguguguucauauaaauaauaauaacaaaucuuuaaaaaagaagaagaaaaagaaaaaugcaagauggggcuggagauggcagagugguuaaaagcuuuggccuuucuuccagagaaccuggguucacgucccagcacccacauaaccucuccaacucugaugcucucuucuggccuccaaggggagcaggcucauacaaaacacccauacaaaugaaauacauaaaaacgagaugaagcagggcacaccuuuaaucccagcccucaggaagcugagguucccagaguuugauaguagccuggucuacacaguaaguucuagguacccagaguuacacuagacccugucucaaaagcaaaaccaaacaaagccaaaacaagaaagaacaagacgaacaaagaggaucagacccuauaguugugcuguugguaaucuaugcccaucccugucuuguuggccauucauucugucugcaucuaacaucacacacacacacacacacacacagacacagacacacagacacacccacacacacacacaaaaacaggcccagugguugcucaccaggacuuaugugaaugucauuuccugggcuggauacaaugucuugcuuggucaauucuuuuuuuuuuuuuuuuaaaagauuuauuauauguaaguacacuguagcugucuucagacacuccagaagagggcaucagaucuuguuacagaugguugugagccaccaugugguugcugggauuugaacuucagaccuucggaagagcagucgggugcucuuacccacugagccaucucaccagcccgcuuggucaauucuuauucuuccuccaagacacugaucagaccuauuuguuugucaacucauuaccaggcagcagugcugacccaccucaaguauaaaucccaucaacuuuccuggauguuuuggaauuuacuuuguagagcaggcuggacucaaacucagagagccaacugcuucugccucccaaauacugggcuuaauuaaaugugugcccacaacaccuggcuaccugugccaacuuucacgcacauaaugguuacauauccuucccuacuacagaauguacagcacagcaauugauucaauuuaaacuuacaguuuaaagacagcaugccugaaucuaaaaggcggcagaacacagaggcccuucccauccacaugcaggacucccugggggagggaggguccgggacagggccgaaugcuuccucagaacaugggccagaaagcccugggcguguucuuaacauguucacuugaaaguaaaaccccgaaacaaaggacucacagaugcagucucacaucagguuaagaacuaaccuuuaggggcuggagagauggcucagcaguuaagagcacugacugcucuucucuuccagagguccugaguucaauucccagcaaccacaugguggcucacaaccaucuguaaugggauucgauucccucuucuggugucugaagacaacuacaguguacucauauacauaaaauaaauaauucuuuaaaaaaaaaaaaaaccucuguuaaauauugaccuaaaaaaagcuucaucugcauuuuuaaaucucaagggucuccaauagcagugaucugcacaucauggagaugcuggucucaaaaccaggcauagaucaagcagagagagaacugugcaaagaaccuuaugugcacuccccaacccuagcaauacucaugagagaugaaccaaaggagacccaguaagcccaucagcucaggagcugcucgguagaauuggacuguccaaguuuggugggccucagagccaggacuccaaugacaaccugaguucucuuaagagauaaaaaugagcagacugaauccgugaaacaggagucucuaggcaugaaguccucaaccucugagagcagcaaagcaggccgcucucagagauuuuuacucuaagggcuaaagauggacauauguaguaguucaugccuauaaucucagcacucaggaggucuagagaggaauacugugugaguucuaggccagucugugcuaagagaugccuugugucaaaacaagcaagcaaacaaugaauaucaucaggagacuacaaagaugacucggcaguuaagauaauuuacugaacaccuagguuaaacaccuuggcucagcucccagcauucaaguauugacuaccaaccaacuagaaugccaguugcacaggauucaaaacuggcaccugugcacaccugcauguccacagugcauggacagacaugcgaugagagcagacaggugagaagggucagaagucuggcaagaugacuccguaggugaaagcauuuacuaccaaaccuguuggaaccaacacggcagaaguaaagaacagauagcuccaaguuguuuucugacuuuugcaugcauuguagcguacccccuccccacaaaacguaauaagguaaaauaaaaggguuggggauauaguucaguuguggagcacuuacuuugugugaagcccugggcuccuccagccacacccacauccacaugcaggguaguagccacccuagacaggaagguccagcagggcaccugccuguccuucuguuuggcuguaaugguacacacucauaaucccaccacuugggaacugaaggcagaaggaucaggaguguaagguuauauuugacaacauagggagagcaaggccaguccagacuacaagaaauaaagcaaaaccggaaaacccugcaugguuaagagcacuuauuguugcaaaggaccucgguucagcucccagcacccacacagagccuuaccaucuucuugggcaccaagcacagcacucauacacauaaaauaguaaaaauaaaucuuaaaguaguuuuuaaaaaauccugccucucacugggcaugguggcgcacgccuuuagucccagcacuugggaggcagaggcaggcggauuucugaguucgaggccagccuggucuacaaagugaguuccaggacagccagggcuauacugagaaacccugucuugguggggagggggaaauccugccucucuagucucaugauguagaauccagaauauguaacucaggaucuguggucuuccaauacuuccuaguaugccuggguccaaguguaugcagggcagaggaaaacuugcaggaguuggucucucuucucaucacuugggucccaggaacugaaggcaggcuuagcagcacacaccuuucacccacuaggcugcuauuccuccugcacaggacuuuaucccccgcccccaggaaucuuaagcaagguuugaugcugugacucuccagcccagucccucacugguucuuagacccagaccuguuaucugggcccccuggcugucuaaucuugacuuugccaccuacuuuuuugcuaguuuuagaacagauggaggccuuacacucuugcaacuagauaccugguacuccgucacgugucaauucaaucaaaugucaccucuucacuggugcauucgcugaccacauuucuuuaacggguuauuuacuagagcagggcaaucacaguggcgacaccaagcuaaucccagcaaccauuagcaaucaguccuguaacugcucaaagagggaugggagucuugugagccccuccccuuuguggugaaauaucaauggcccaguguuaugaagguacccauugcuacugugggcucaugagugccucauucaugcuguguccagaaagcugguuacucacguuuucuccuguacagguuucucagcauucacccugccagagcaccauacuuuauugugcuuugaaucccugaccagggcauucuuaauguuucuauuguaccuggcccagccuucaaucacuuuugcuaacuaaguggaugaaugugugggagccuaaccuaagcuggcuguucucugcucagugacccauguucuccuucacccacaccuuguaucuaagaugucaggaagugauccuuugauccauuuagcuaccugagugacauguggcaaguggagccuggccccaacccuuucuuucaauccgaaggcccuagucaccucagggacagcuauggcagacacacagacaacuccuucaagaucuggacguuaggcuucuucacuucucccuugaguuauugucuuguuuucucaucaguaacuugggcaaauuagggagaaauuaaccaaggugguaaagaagaacccagugguaaggaguuaucaucagccucuaacagagaggcuacacaggggggcauucucgacccagaaagggcaacugcccaacccaccacuccauugcuucgaguuuagagacauuuuggugcacaggugauuagcccaggcagagcccuuucccagaacugacaucugaagucuauauauuccuagcaccacuuggaccuuuuccuaugccuggaggccuccagaguccagacugacccaggagcugaagccugaggccugcguuccauacucugcucugcacuuacuaccccagugaccucccuuucccagguaguugcacaagaucucuaaggcccuaggcuuucuuuagcuucuauuugugaacugaguuucagggcuugaacgcucugaagaggcaccaugguagggagugaggcuccucaauaacugcuuccaccgucuuccacuacuauccuuggccagcacugcugugauaccacgagacugagcagagccaaggaaaggacggaguccacagaugguaaaaggacccuucuucuuuccuguguccucugacuugagccucacaaugaacugguccuacaagguugguauaguuauuuuuaccucaaaagcccccuugauggcuggagagauggcucagagguuaagagcacugucugcucuugcagaguucaauucccagcaaccacaugguggcucacaaccagcuaugaugagaccuggugcccucuucuggccugcaggauacaugcaggcagaaugcugugugcauaauaaauaaauaaaucuuauuaaaauuuaaaaaagccguccagcacagucagcccuugaguacccauagauagccaggaugaacagggaaguaguaguuaccccagcagcugagagccacgauggcagaagcacacagggagcaaggacaguccaugcuuuucuucccgucucauaucagcaagcuccaggcgcccaaggauaagaaauaccugagcaugugcucaguagcucacagcugauucaccacagggacaaccacgagcuugcauucucucccauucuccaggugaugcggcccauacagauccuuccagaggcagcaggcuuuccuguuucuaugaagguugggauucaguuggaauugguagcacaggccuggaggccaaggauggaggaugagaaagggcagccgggacaaccuagugagacccaucuuuaaaagguuaagagagcgccagggaugggaugcaugcauggaucucuguauguucaaggccagacugcuuuggguuccaggacagccagggcuaauacagcucaaaaacaaaaaacaaccaaacaacaacaacaaaccccaaaacaaaaagcuuuaaaggguuagaguugauguggugagaauucuggaauuuuauuucuuuaaaaaacagagcugcauguugguggugacagcacaugacauuaaccccagcccucgaggcagagguaggugcaucuuugugaguucaaggccuagccuagucaacagagugaauuccagaacagccaaggcuacaaaguaaaacccuguuugaaagggggaaaaaagccaaaacaaaacaaaacaaaaaccacagaaauaguauuauguucuuguuuuguaccccaggugugggauacggggauacuucagacugucccagcggcuggcuaugauaugcuggcuaugauaugcuucguucucuagcagagguauggcuuuugccagcugcagauauagcauaguuucugcgacugugugacauuuggaauucugggaacuuuucagaggguaaaugcuauaucucaccccccucuauucuucuuucucuccuaucuagugauagggguugaaaagagguggagaggagauaucaagguggggggggggcuacaaagcagcaaaaaccagcuaugguuuagcauuaauaauuacaaaauaaaaacugugguucaacugagguggaaaauaagaggguaagagaaacaauucacugguagaguacuugccuacuuuacccauuaagccccagauucaaucuccaagagcacaaaacaaaggggcguugggggcuggagagauggcucagggauuaacagcacugaccgcuauuccagaggucccgaguuuaauucccagcaaccacaugguggcucacaaucaucugaaaugagaucugaugcccucuucuggugugucugaagacagcgacagugugcccacauacauuaaauaaauaaauaaauaaacaaaacaaaggggaacaggguagcacugaggugacucagcagguaaaggcaaggcacuuugcuagccacucugacaaccugagcucaauccucaggguccauguugcagaacagauucccacaggcuacccugacuuccauguauacuauggcguaugugugugagcagacacaaccacaaaaugaauacauaauaagagcugagccauagcucggugguuacgagcacuuaguacuuuugcagaggacccagguucaguuuccaccacccacaugguggugcacaacaaccuguaaccccaguuccagggaccugucucccuuaucuaauuuacuagcacuugcacaaaugugauacauucugguauacacaaaguaaaaugaaucuuuaaaagaauauauauguauauauacauauauguauauauauauauauguguguguguguguguauauauauauguauguauauauauacacacacacauauaaaauguuuuuaaagaaauguaaaauauucgaaaacuaacuuuauugucuggccacuccagagguggggagcagaagaacaggauggauuucaaggaaaaacugauugucacuugauccaagcugcucaagggggagucucuguuaagugagauguuacacacccauauuucagguaaggggagaggccagacuaugucugugacacuccuaggcauucugagaguaccuggccccugccaggcauuuugccagucacuggacccacuaaaguuuugcccucaaugcucucuggccuguuaaaagcccccucuucugcacagcaucaagaguccuugcaguucucuccaacuaagcccucagcacacaaggccagcacuacucccucaucuuucguacugacaccuuucucuaacaucaggaauagacaggauuugugcuguucccccaccacuccccagccucaucccagagucaaacauagagaaaggaccaaagaaugguuguggaacagaaaucugaauacucagaggaaaaaacaaaccuugcuccugucaaauaaaaugcuaauauccaacuaagggaauccugaagcuuauuuugagacauggccucauuauauauagaacugacuguccuugaacuguauuucuguuuuucgggacaagauuucuccguguccuaaacuugaacuauagacuagguuggucucagccuagagauccaucugccucugcccaagugcugggauuaaagacgugugccaccauuuggcuggucgugaacucuagccuccugccacucaccaagggauaagauuaccagagucuucugcaugacccucaggcacaggugcgugccuaaaggucaaaagaaaccaucagaggucgagcucuuggguggagccaggcugacagccagcaagcaccagcaaagcuccugucugcuucugaccaugcugaaguucuaagaguuuggccaggcuuuuaacaucgguguugaggauucaagcuagugucuucacgagcaaacauucuuacccacucagcuaucuaucucucuuacucugaagcagugguucucaaccuuccuacugccuagaccuuuuaauaaggucccucaugguguguaugacccgcaaccauacaacuuuuauuguuacuucguaacuguaauuuugcuacggucauaaacugcaaugcuguguuuucugaugaucgacccugugaaagggucauucagccccaagcagguugaggaccugaauacuaagagacugagcacucugcuugcccaggucuucgggaccucuuaggccuuuuaagaacugugacacagaagccagcaacagaccagagaauccaaccugacaagagaugcuuucugccacguuuuuguuguuaucaaugcuguuuuugaggcagggucuugucccaggcuggucugaaaugcuugaucaccccuucagucucacaagugcuaggacuacaggcauaugucaccauuuacauuuuaauuaauuaacuaauuuauuuauuuugguuuuuccgagacaggguuucucuguauagcccuggcuguccuggaacucacucuguagaccaggcuggccucgaacucagaaauccgccugccucugccucccgagugcugggauuaaaggcgugcgccaccaccuccuggcuccugagaacuuuuuuuuuuuuuuuuuuuuuuuuuuuuaaagauucauuuauuuauuauauguaaguacacuguagcugucuucagacaauccagaagagggugucagaucuuguuauggaugguugugagccaccaugugguugcugggauuugaacucugaaccuucggaagagcagucgggugcucuuacccacugagccauuccugagaacuuuuaaggaauaaggagaaacccaaauuucuugaacacuaucuuuuugauccugaagaugcaaaaguauacauagccuaguguuuauaaaguuaagguuugauuccuacccagcacuaugaaaagaggggagagggagagggagagagauaucuccucugcacacaccacccaaaagcuuggaauaugcaagcugaucuacagccauaaacacaacucaucuaaaacugagacaagcuggaguugguuuuaguucuuugaggcggggucucauguaucccaggcugaccuugaauuucccaugcagcugaagauguaacuugugauccucauguuccuaccucuaugaugguagguaaguaaacuggacugcaagcuuguaccaccauacccaguuuauucagugcuagugaucaaacaagaaaucuaucaacugaguuacaucccugucuccaaaaaaaguguggaaauagcugcuuuuaguuccaaguggcuccuacuucuuugaccuuuuauguucuguggauaguccuucccaacugcuuagcuuagcacaccagggagucucuccagagccuauuggcuaagccuuacuuccaugugcuuaacagcuauaauagagauuaagaagcugagucaguccauagaagguaggcccuggugagagcugagcaauuugcuuguggccuuugacuagggagaaugacuggacagagaacuguacuggagggggaaaaaaaaaaucaagugaaagccagagcaacaguacugaggaaauauucagggagcagggggcgcuaaagauaguggcuuucagcuuucuggcccuaagucagucauccuaagagacugggcacucugcuugcccaggucucugggaccucuuaggccuuuuaagaacugugacacagaagccagcaacagaccagagaauucaaccugacaagagaugcuuucugccaaguccugggagcuuuucuccacuaguuccuaaucaucacucaaaacagaagugcauucucaaagccugccuacuaguaacuagucaaauacacuacaucuccaggaauucaaggugauggaugaccugaggugccauugcuaagguacuuucucuagacccauccagcuucuugacuguucacaggcagcccuagcacacgugaagagaaagcagacaucgugacuucuaguucuagaucuacaaaacaacuucaaaaggcaaaaacagucuaagccagugccauaggcacaaggccccuuccaccuucucugggcucaaaaaccucaagcauggaguccauuucuucaugaauuaaauccgaccucaucacuucaguaaggagucaucuuccugcuaacucuaggagguucuaacguacuuuagaauugggcccugacugagaaaucuaacaaaaacacuggaggcucacacaacccaccccagagcuggagucuagucauggauaagauuggagcugccucuccaaagauacuagguccuuauuuuccaggacuagcuagagguaaagucccacgaggcauccccucccaccccagaaucccugcccuuguccuccaugcuggacacugcagcaccgguucuaccgagguagagguuaaguuucgugcacucccagcaggcaaucaagcagagaagcguucaccuacauccuagccgggcuaugguuuggaaccgggcaauggucccaagccccagcagcggcaggagggccacccuuacccaugcuggcucuggagcgagcuggguggcguugcccauccccggaucuucgccggcggguggugggacgugggucugggaucggcccgccaaccugccugcagagguugcaggauucgagcaagccaggcaaggccacacagggccgggcccugagagcuauccugaucguccggacaaaagaaaaagaucuggccaucagccaagacacaggguggcccggacagccguccaucaggcucucagcauuccccgggccgcggccgcagacaauccgcgguaggcggagccgcgcgcgacacauggugcgggccccgugccucuucgggccgccgugggggugugaagaggggaggggccucccagggccucgaagcagaagcucccggcggccuagagcgcggcuccugcggcccagcccccgccccggagcgcuggccccaacacucacccguggggcuggcacgauggcggcagcggcggcggcaacccagcgcggucugcgaccgacugucccuucccccuugccuucccucgcccgucccgcugcacucagggaaacguagucccaguaugcuccuuauacgccuuagugagcuuagcuagaacuacauuucccagaaugccauucgcagaggcgcagccacggcucgcagcgcgggaggagaggcuaaguuagggagggaggcgguccgggugagccccugagaauuguggucuagcggaagccucuggaacacggaguug

SEQ ID NO: 4726 - RNA, 1459 nt, Mus musculus
gcuuacagccagggaugaugugcaacugcugccacugccacuggcgccgccgcugucagcggcuacccugugcccugacgcuguugcugcuacuaccacucggugagugugagcguccugggcccaggcugcaaacccucucagagguccuagccagacuggguguaggguaugggagcaaaggaguuggagaugagcagugagggcucugggagcaugcgauaguggcuucaggauggaaaguacagugcaaacaccucagcugucgggggagaacuuuuaaauccuguagcccucuucugacaaagggagucuggcccccaguagagcucaagccauggaucucugaucuuagagugacuggcuuugauccccacccagcccagucaguuucagccgacacacuugucuuuagggaggcaaucaaagugccagguggagcucaugaagacuacaggaagacugccuucugcccacgaccuccugcuuccagacccucuaccccugaaucugucucugaccuagagucccaggaacuagagaaggagcuaagcucugggacccaacacccgcuuucuguucccacaucacaccuccaugugcaucacaguccaaagccuaucuugagaguuaagccaagugaucuccagcuacccugaaguuccccggggggcaccucuuucacgcugagucacguccccagagcagcauccgguaaacaagcuccugacaaauggacucuagcucacucuauuaaccauucuccauccccaacccacuccuaaucucuacccacccagcaguggccucugagggcccaaaccgcugugauaccauauaccaaggcuuugcugaaugucucauccgccugggggauggcaugggucgaggaggcgagcuacagacugucugcagguaccggcaggugggaggcgauggguaggucggugggaagcaccaacccaaucuaugcuacugcaccaccaccccagggccccgagucucuucccaguccaaaucguugugcucuaaccccccuaaccccauucuguaacagauccuggaaugacuuccacgccugugccucucggguccugucaggcugcccagaggaggcggcugcagugugggagucacugcagcaagaagcucgccgcgccccacacccagauaauuugcacauccucuguggcgcuccugugaguguucgggagcggauugcuggcccagagaccaaccaggagacacuacgggccacagcuccugcacuggcuccagcuccagccccuguguugcucgccgccgcucuagcgcuugccugccuccuggggccucuggccuaaacagucugguuggccagccaacagugcccuugccucccaucacugcaugcaguggcugccaugugagcucugcaguaugcacacuuuucauuaaagguauuuauauuugcaccaag

SEQ ID NO: 4727 - RNA, 11895 nt, Mus musculus
ccauaugagguaguaugcuugcacugcauucacauuuacacacacacacauacucucacacacucacacacacacuagugcagcuugcuccagggucuccccugugaaccccaguguucuggagagauccuggguaggauggagacaggugggccuugcuuuuugaugcucuuguauuccccacagaccaucaagaacaugauggacauugagaaagucaaaggcuucugccagguagugguggccagcaagguucgagagggacuggcccaccucauccagucuugcggccugggcggcaugagacacaacuccguggugcugggcuggcccuauggcuggcgacagagugaggacccacgugccuggaagaccuuuauuggugugugagggucuggcgccuaagcugggccaggggccaagggccaggguuaaagugagguggcagagaccagagggucacaggcuggcagucagcggugccccuccucccuagacacugugcgcugcaccacagcugcccaccuggcccugcuggugccaaagaacauagcuuucuaccccagcaaccacgagcgcuaccuggauggccauaucgacgugugguggaucgugcaugauggaggcaugcuuaugcugcugcccuuucugcugcgccagcauaagguaugccagcuggcugggugugggcaagggcagcugggcucucgggaagcccggcaugacccagcugcucacacgacccucggccacagguuuggaagaagugccggaugcgcauuuucaccguggcccagauggaugacaacagcauccagaugaagaaggaucuggccaucuuccuguaucaccuccgccuggaagcugaaguggaggugguagagauggugagcugucuuuggccugcucuguccccgaggaaccccccuugcauucccccccaccaaucaugcauccugauacucaucccccuccccccaccagcacaacagugacaucucugccuauaccuaugagcggacacugaugauggagcagcggucucagaugcugcggcagaugagguugaccaaaacugagcgggaucgagagguaaauggccaucuuggcuugggcuuggguaagggccacaucaugccuuugucugguggauauaacaaugaaugauucaggacuaggcuugguggcccauaucuauaaucccaguacucaguaggcggaggcagguggauuccuuugaguucaaggcuagccuagucuacagagugaguuccaggccagccaaaggaccugucucaaaaaaacaagacaaaaccaaacaaacaaaaagguaggcauggugguccgugccuauaauuccauugcuuaggagccugaagcaagaggccagccugucuuuaacaaagaacugcaucuguuugccugaaucagaaaggucuuagaggcaggauaguccuauugggccaagcaggcccccauuuucccaggguaccaaggauaucuccucugguuguccucaggcccagcugguaaaggacaggcacucggcucuuaggcuggagagccucuacuccgacgaggaggaagagucuguggcaggggccgacaagauccagaugacguggaccagagacaaguacauggcugagcccugggaccccagccacgccccugacaacuuccgggagcuggugcacauuaagccgugaguacaagccauggugaggucuggaauggagggagaguggggacgggcaugcugugcagaugggccagggacaaagaucgcuggccugugaccagccacuuggucugcagggaccaguccaacgugcggcgcaugcacacugcugugaagcucaacgaggucauugucacgcgcucccacgaugcccgucugguuuugcugaacaugccuggccccccuaagaacagcgagggcgacgagaacuguauccuuuuguguaaaugcugacaguggggagagguccucuccuugaguggaaaguggccuugguccuguggcugccuccuugaccugacaacccugcagacauggaauuccuugaaguccuaaccgagggccuugaacggguguuguuggugcguggcggcggccgggaagucaucaccaucuauuccugagccccgauggagucuuguggccuggaguuggggugucuaggacaacagugcccggccuugcaccuacuugccaguucugcuuugcccagccuugcuuuggaccagcucugcuacgucuccagggaaaccaagcuugggccuugcaguggaaauggauccgagggcccaggggacccugguggauuuagggacuguccccucccauacuccaauagaggccuauccugacuagagaagacuggugaggguugauacgggauuugaauucccagaugggcccacaagugcuauuuauuguauauuuauuguuuggaugucaucauuucagaaaggggaagaggggcacaguaagagggggagcugagcugggccugccugcaggaagaccuggcccaggcugcugugggcagaggcccucaucaagccaaguggaauggagccggccaagcugagccugacuuuuuucaauaaaacauuguguacuucugggccuccugcugcuccggcucuuuuuucccuggcgccaagggaagaaagacggaacugaaccccaguccagagccagaucccaaaggcuaugccccuuccuggccacccccauuggccgucugucccucccacuggccccgggggccccucccacccccgguccagauaaggccagcccaggacugccucaucugucaguaggcacugggcugugauggggcugccuggcuccccauggcagcgggugcuguugcuguuggggcuacugcucccuccugccacccccuucuggcuccucaaugugcucuuccccccgcacaccacgcccaaggcugaacucaguaaccacacacggccugucauccucgguaagcccccacuaggccccugauacaucaagcgagaccccggggagccuggguccuaagcccgacagcagcagauucugucaagguucucuuggcccaccaugagcccucacgagccugaauugguguggggaaggaccaaaggcucguucuccagagacaucacuccuuucuucuucauacuauucugucuccaaguugucuucuccgggggucugggguuggggugguggucggcgaaugggaauagauuugccugaggccuuggccagggcacuacaagccaugaccagcucuagauacauuggauacuggguuaagucccacacuuccuuggccucugucuuaccaagaacaagauacccagccagagauacccagcuaucccaggcaggauagcaggagaggucuguaaaggccugcccccuguucaaggcccagccccuguccccccuuaccuauuuguucuccccuuggacuuuggcaauaauggaaagccaggcuggguguuugcuuugugggggcaggggucaguggccuugguuccuggaaccuuccgugccugaagggagccuggaaucagcgguaccggugggacaguaagaauggagccggagagaggugucauuagaaccuugaggaggguguacgagauggaggggugggcuuuuuugggugguaggguugggggguuggagagaagccaagagguucagaacaaaagcuggugcccacagugccuggcugcuuggggaaucggcuagaagccaagcuggauaaaccagauguggugaacuggaugugcuaccguaagacagaggacuucuucaccaucuggcuggauuucaacuuguuucucccccucgggguggacugcuggauugauaauaccagguauguccuguguggucuaccaaaccccugcacguugacccuuggcugcuggcugcuaaaugucccacuauccccaggauugucuacaaccacagcucugggcgcguguccaaugccccugguguccagauccgugucccuggcuuuggcaagaccgaaucuguugaguacguggaugacaacaagcuagcagguguguguacccgggaaaggcaaggacucuucuuggccaccgggcuagccugcgggcauaauggacagaauccccucuguuucugccuccccacaggcuaccugcacacacuggugcagaaucugguuaacaacggauaugugcgggaugagacagugcgggccgcacccuaugacuggcgucuggcaccccguaaguguuugcaggugaugggcuggggccuugacagguggucccagguccuaacuacccugaccuaucuacucgucuucagaccagcaggaugaauacuacaagaagcuggcuggccugguagaggagauguaugccgcuuaugggaagccugucuuccucauugggcauagccuuggcugucugcaugugcuccacuucuuacugcggcagccucaguccuggaaggaccacuucauugaugguuuuaucucucucggggcuccguggggugguuccaucaaggccaugcggauccuggccucaggugaggagccucuugggcguggucauccagugugggguaaggaggagugaagcagaucacagagcuagcuagccgucacuccagcucugcucaguguugccccggggauauugucugucugucugucugucugucugucugucugucugucugucagggcacaccuguuguccuuuagccccuugaaagcagcaaccauuuggacaucuccuuccagaguccuugagugcugauagaggaagccaaucccagucgucugucaaccccagauuugcuccugguagcccccaaguccuguacacuauggcuuuuagcuacauuuuaccucccagagccccugugcccaggaaucuguuucauugaggacaugaucugccacggcagggccaaaccuagggauccuucuugcuccuguuugugcaguagccccagggacccaguacuaauacagcuacugcucacuaaacaccaccguauacugggcguagccagacuuagccuucacugugaaguuuacagucuagugagugauccaccagacuguacgacuggauguaaagcagauaccauugccgggcagugguagcacacgccuuuaaucccagcacuugggaggcagaggcaggcagauuucugaguuugaggccagccuggucuacagaguaaguuccagaacagccaggacuacacagagaaacccugucucaaaaaaaacaaaaacaaaacccaaagaaaccaaaacagauacugucuaaaucuccugaaaugcaguccugugaccacuguguagcauaggcagaggaccuaaggaagaauagccaacacacacacacaaacacauaucccuuauucucuuuaacugucauacacucuguuugaggccccaucuucccugucgucuucccuguuugagcucugucuuaccagcauagccucuuuuauuuauuuauuuuaauuuuuauuuuuuuaagauuuauuuauuauuguaucuaaguacacuguagcugucuucagacacaccagaagagggcaucagaucucauuacagaugguugugagccaccaugugguugcuggaauuugaacucaggaccuuuggaagagcagucagugcucuuaaccacugagccaucucuccagcccuuauuuuuauuuuuuuuaggauuuauuuauuauuuauauguaaguacacuguagcugucuucagacacaccaguagaggguaucagaucccauuacagaugguuguaagccaccaugugguuguuggauuugaacucaggaccuucauaagaacaguagugcucuuaaccgcugagccaucucuccagcccccgcaaauaagcauacggagcacuuaaccgaacaccaggccugcucuugucuguguuuuggaaucaagaucagguuguggcagaaacaagguggagugcuuuugccgagguaaacuguggaccaggcccagcucccugucccaccuuguucuccccuguccuaggugacaaccagggcauccccauccuguccaacauaaagcugaaagaggagcagcgcauaaccacgacuucccccuggaugcucccagccccucacguguggccugaagaccauguguucauuuccacaccaaacuucaacuacaccguccaagacuuugagcguuuuuucacagaucugcauuuugaagaaggcuggcacauguuucuucagucucgugaccuacuggagcgccuccccgcaccugguguagaaguauauugucucuacggugugggcagacccacaccccacaccuacaucuaugaccacaacuuccccuacaaagaccccguggcugcacucuaugaagauggggacgacaccguagccacccgcagcacugagcucuguggccaguggcagggccgccagucgcagcccguacauuugcugcccaugaacgagacagaucaccucaacauggucuucagcaauaagacacuggagcauaucaaugccauccuacugggugccuaccgcacuccuaagucgccagcugccagcccaagucccccacccccugaauaaagaccuagcuguuauaaauaagugcaggguguuuguuauggguuaaggggaaggcacuacuagguuccuuagauaaccugcaucaccuggcugaugcaugcuugaucugggcuuaggggaacacgggguucagugggcuuugcuaaggccccagacuggacugacuuugagauauguaaauagauuuucauuguccuaguugagcugcucaggaagcuugcucuguggcuuccuucuuaggggcccaggacaauauucagaucuggguauauggcuguuagaauggggacacagagaaauaggauuugaagucgacuuuugaguucugguuggauacagaaauuuauaauaaagcaugguggugcacgccuucaacucaacacuugggaggcagaggcaggcagaucucuguaggccacucugauacacacaguuccaggacagccaagaccacagagauucuguccccaaaacacaaacaaauaaauagaauuuaagauauuggggcuggggauuguuaauguaagaacuuggauuccaugacagccggagcuauacagagaaaaccugucucgaaaaaacaaacaaauaaauggggcuagagagauggcucagcgucuguugaaagaagcuguuuuuccagaggacccugguucaauacccagcacccacauggcugcucacaagugucuguaacuccaguuuuaggggagcugacaccucacacagacaugcaggcaaaacaccaacgcacauaaaauaagccauaaaaaaauuaaaaaauuagggccacguggugguacacaugccuuuaaucuucucauccaggccaaccuugucuacagagcuuauuccagggcagacagggcuacacucaacuacacugaaaaacaguuuuucaagcgccccccccccccaaaaaaaaaguuuaggaucugaagaaaagacaguucaucuaaagaagauuuaaugugagacauuagagagagagagagagcaagcacucagaaguuaagagcauuuuuuugcacuuggagaggaccugaguuugguucccaacgcccacgugguggcacgcccacaugguggcucaugaucaucuguaacuucaguuccagggaaucugaugcccucuucugaccuuggugggcauguggcaugcacauaccacauucacucacacacauaacuaagccugcaagggcuucauuucuacuuacuuuuaagggguuaugugugugaguguuuuaccugaauacauguaugugccugcagugcucagggggugucagcagagaugggaauggaggaucuaaggcgcaccauaggucuggcaaggaguguaauagccccuuccucaaguuaucugggacuagcagcaaagacgaaagugaaagagaagaugcacacagcagccaacagccucugaacuagggugggggugaaagcgaaaguaggaagcguccggaaaaaccccacagaagccaggacagacgccucugcucccccuggcugauccacucaucgagacccccgcauucucacuuggccuuccugcgagaugcugaagcaggcaguggaacccacaggaggcuucucuuucgagaacugccagaggugaaaggggaguggaguucuagucacgaacugcuggugccuuguuuuauugguggagugggggaacccuauguugggugaccaaguaggggcuuaagccaggagaugaguagaaauggguuuggggaccgguucagggacccucccuugaugcagaacugaaacgcgagucaccccaauguuuccaggaaugcguccuuggaacacguccuuccgggacuucggguuccucaugcacgcaagaccgggacuaccaucgcggggcuuguguuccgaguaagcggggugauaagggcuggagggcuagaagggcagccacugcggagaucaggugggcauuaaggcugggcucugccucugcaggauggagucauccugggagcggacacgcgggccacuaacgauucgguuguggcggacaaaagcugcgagaagauccacuucaucgccccuaaaaucuagucaguaugccccggaccaguccccauauucaaacauaagcugcacugucgcucacucccuacuuugucccugcacgucccuguccacauccaccaucccuuugucccuuagcugcuguggggcuggaguagcugcggacacugagaugacuacgcggauggcagcuuccaagauggaacuacaugcgcuguccaccggccgugagccucggguggccacggucacccguauccugcgccagacgcuuuuccggugagcaaguggggcuaagaugaccccuaaacgggguaucugcagguggguggaguugacaggaggcgggacguggagugggggggagcggggcugcgaccugcagggagaccggaagaagacagaccaagcugaguuccggaagaggcagcgucaauugcaggacgccaggccaaaggaaggggugggacucagaccaaaaggcaguguaaugggcggggccugucugcuaacauuaacccugccugcuccuccacagguaccaaggccacgugggggcaucacuggucgugggcgggguugauuugaacggaccucagcucuacgaggugcacccacaugguuccuacagccgucugcccuuuacugcccuuggugagcucuuccacccuuuaaaucacacgaauccugcuccugcaaccccaccuucaagguuuguaccuccgcagcuaacaacugacuucggaugccccuucccaccugcaggcucuggucagggugcagccguggcacuguuggaagaccgguuccagccaaacaugacggugagcgacuucuucaugcucacuggcggggagugcugaaaaacccuagccaaguauagaaauaagaaaggcuuguaggugugaaggggacaacugaguagggacugaguaaaguugaagaugggagggccagucaggaaccaagcuuagaccacagagagaagcagaagcucacaacggaucauuacugaaggaagagguaaaugauguuugagauuggacuugggagugggauagaaguaagugacuaugugcuucagagauaacuaaggcccagagagaaacacgugacagacugggugggaagacaacuuggggggggguacauguaagcaacacugagaaguuuguacagaggacagugaguggagggcacacaguuuuggaggagagggggucagaagccaagggacuggaauuuucaauggauggagagaaaggagguugagcuuacauaaagagcaaauugucuagacuucaagauuaacaaguccccugguuagagugugguaacacuagguccauuuaaccucauuuccacuacccagcuggaggcugcgcaagagcuguugguggaagccaucacagcagggauccugagugaccugggcucugggggcaauguggaugccugugugaucacugcagggggugccaagcugcagagagcauugagcacccccaccgagccugugcagagguaagagcacaggaagggagggcucuguguguguucacacgugugcauggacaggcugcauucuaaaaggcuggcccuccucccuucuagagcuggccguuaccgauuugcuccuggaaccacaccuguccugacccgggaagugagaccccugacccuggaacuucuugaggaaacugugcaggccauggagguggaaugaaguggccugagauguagaguuuggaaugagggugaauaaauccgggaaacacaaacacuuaaacagaaggcugugucuuucuugagaggagugagccaagcaucuguaggaguuuuguggcugagguauucaccuaaggacgacagacccaguucuuggccugagguccuccuccuccucaccucagggaucuauccgugcagaagcccaggacuauaagcuuugggguagaaagcuauauccugucauccccaaaccauaguuccauaugguagaaacuuaccccaccaguacccugucuuggaagaccccgauggacaauccccacuguuagccuuucccuuucuuaucaguaaccaccuuuuuccaccagcuacccugggaccuuaggaggcuaaaaugcugauagagcaaccacuuccugacaaguucccacuaagcaccucucaccaccuacaguuccucuacuuaggacagcccucagaggaccgaacaugugugagcuugugagaagcugggcuuugucuacacacgugggacugugaggaaggagauagccucuguccucugggcugaaaggggugguggacuugcggggcaagaugacacagcuaauguuucauagcgaggucucuucacugagugccaggcccucuggguagaaacacccugcccugcgaguagcugagcuccacuggggcuucagaauggauaaggcacguucucuagagagguucuccuccaggcuggacacccuuggccccugauuguucccccaagacuuuauuaugaaaaauaguauauacgauaguaaagcgaaagggcuaguuuaguaaacaucccuauguccaccagccuuuauaauucauauuuccucauaucugaucuguguucuuuauuuacccguucaccugcuucacauuuuagacugagguauuauuauuauuauuuuuuuuuuuuuuugguuuuuucuagacaggguuucucuguauagcccuggcuguccuggaacucacuuuguagaccagguuggccucgaacucagaaaucugccugccucugccuccuggcacucagugaagaagagugcugggauuaaaggcgugcaccaccacaccgggcuuagaaugagguauucuugagccugucaaagccuuugaugcccuagaaaaauucaagccaacucaccauuguaacucugcauauagaagcacccucucuccaccgguucaagcucagccuggagcucaauaauaaauaugcugugcacauaucucgccuauggcaagcugaggucuagaaaaagauuuucuacuaccagcuucaacccagggucucuuagccacugagagcucacacuuaccaguaacauaggucucagagagucagacguaugagguuugccuugugcugguaagagaauggccucucugggcaaaccucugacuccuguuccauacug

SEQ ID NO: 4728 - RNA, 2731 nt, Mus musculus
cuucuguuuaaguguuuguguuucccggauuuauucacccucauuccaaacucuacaucucaggccacuucauuccaccuccauggccugcacaguuuccucaagaaguuccagggucaggggucucacuucccgggucaggacaggugugguuccaggagcaaaucgguaacggccagcucuagaagggaggagggccagccuuuuagaaugcagccuguccaugcacacgugugaacacacacagagcccucccuuccugugcucuuaccucugcacaggcucggugggggugcucaaugcucucugcagcuuggcacccccugcagugaucacacaggcauccacauugcccccagagcccaggucacucaggaucccugcugugauggcuuccaccaacagcucuugcgcagccuccagcuggguaguggaaaugagguuaaauggaccuaguguuaccacacucuaaccaggggacuuguuaaucuugaagucuagacaauuugcucuuuauguaagcucaaccuccuuucucuccauccauugaaaauuccagucccuuggcuucugacccccucuccuccaaaacugugugcccuccacucacuguccucuguacaaacuucucaguguugcuuacauguacccccccccaaguugucuucccacccagucugucacguguuucucucugggccuuaguuaucucugaagcacauagucacuuacuucuaucccacucccaaguccaaucucaaacaucauuuaccucuuccuucaguaaugauccguugugagcuucugcuucucucuguggucuaagcuugguuccugacuggcccucccaucuucaacuuuacucagucccuacucaguuguccccuucacaccuacaagccuuucuuauuucuauacuuggcuaggguuuuucagcacuccccgccagugagcaugaagaagucgcucaccgucauguuuggcuggaaccggucuuccaacagugccacggcugcacccugaccagagccugcaggugggaaggggcauccgaagucaguuguuagcugcggagguacaaaccuugaaggugggguugcaggagcaggauucgugugauuuaaaggguggaagagcucaccaagggcaguaaagggcagacggcuguaggaaccaugugggugcaccucguagagcugagguccguucaaaucaaccccgcccacgaccagugaugcccccacguggccuugguaccuguggaggagcaggcaggguuaauguuagcagacaggccccgcccauuacacugccuuuuggucugagucccaccccuuccuuuggccuggcguccugcaauugacgcugccucuuccggaacucagcuuggucugucuucuuccggucucccugcaggucgcagccccgcucccccccacuccacgucccgccuccugucaacuccacccaccugcagauaccccguuuaggggucaucuuagccccacuugcucaccggaaaagcgucuggcgcaggauacgggugaccguggccacccgaggcucacggccgguggacagcgcauguaguuccaucuuggaagcugccauccgcguagucaucucaguguccgcagcuacuccagccccacagcagcuaagggacaaagggaugguggauguggacagggacgugcagggacaaaguagggagugagcgacagugcagcuuauguuugaauauggggacugguccggggcauacugacuagauuuuaggggcgaugaaguggaucuucucgcagcuuuuguccgccacaaccgaaucguuaguggcccgcguguccgcucccaggaugacuccauccugcagaggcagagcccagccuuaaugcccaccugaucuccgcaguggcugcccuucuagcccuccagcccuuaucaccccgcuuacucggaacacaagccccgcgaugguagucccggucuugcgugcaugaggaacccgaagucccggaaggacguguuccaaggacgcauuccuggaaacauuggggugacucgcguuucaguucugcaucaagggagggucccugaaccgguccccaaacccauuucuacucaucuccuggcuuaagccccuacuuggucacccaacauaggguucccccacuccaccaauaaaacaaggcaccagcaguucgugacuagaacuccacuccccuuucaccucuggcaguucucgaaagagaagccuccuguggguuccacugccugcuucagcaucucgcaggaaggccaagugagaaugcgggggucucgaugaguggaucagccagggggagcagaggcgucuguccuggcuucugugggguuuuuccggacgcuuccuacuuucgcuuucacccccacccuaguucagaggcuguuggcugcugugugcaucuucucuuucacuuucgucuuugcugcuagucccagauaacuugaggaaggggcuauuacacuccuugccagaccuauggugcgccuuagauccuccauucccaucucugcugacacccccugagcacugcaggcacauacauguauucagguaaaacacucacacacauaaccccuuaaaaguaaguagaaaugaagcccuugcaggcuuaguuaugugugugagugaaugugguaugugcaugccacaugcccaccaaggucagaagagggcaucagauucccu

SEQ ID NO: 4729 - RNA, 2731 nt, Mus musculus
agggaaucugaugcccucuucugaccuuggugggcauguggcaugcacauaccacauucacucacacacauaacuaagccugcaagggcuucauuucuacuuacuuuuaagggguuaugugugugaguguuuuaccugaauacauguaugugccugcagugcucagggggugucagcagagaugggaauggaggaucuaaggcgcaccauaggucuggcaaggaguguaauagccccuuccucaaguuaucugggacuagcagcaaagacgaaagugaaagagaagaugcacacagcagccaacagccucugaacuagggugggggugaaagcgaaaguaggaagcguccggaaaaaccccacagaagccaggacagacgccucugcucccccuggcugauccacucaucgagacccccgcauucucacuuggccuuccugcgagaugcugaagcaggcaguggaacccacaggaggcuucucuuucgagaacugccagaggugaaaggggaguggaguucuagucacgaacugcuggugccuuguuuuauugguggagugggggaacccuauguugggugaccaaguaggggcuuaagccaggagaugaguagaaauggguuuggggaccgguucagggacccucccuugaugcagaacugaaacgcgagucaccccaauguuuccaggaaugcguccuuggaacacguccuuccgggacuucggguuccucaugcacgcaagaccgggacuaccaucgcggggcuuguguuccgaguaagcggggugauaagggcuggagggcuagaagggcagccacugcggagaucaggugggcauuaaggcugggcucugccucugcaggauggagucauccugggagcggacacgcgggccacuaacgauucgguuguggcggacaaaagcugcgagaagauccacuucaucgccccuaaaaucuagucaguaugccccggaccaguccccauauucaaacauaagcugcacugucgcucacucccuacuuugucccugcacgucccuguccacauccaccaucccuuugucccuuagcugcuguggggcuggaguagcugcggacacugagaugacuacgcggauggcagcuuccaagauggaacuacaugcgcuguccaccggccgugagccucggguggccacggucacccguauccugcgccagacgcuuuuccggugagcaaguggggcuaagaugaccccuaaacgggguaucugcagguggguggaguugacaggaggcgggacguggagugggggggagcggggcugcgaccugcagggagaccggaagaagacagaccaagcugaguuccggaagaggcagcgucaauugcaggacgccaggccaaaggaaggggugggacucagaccaaaaggcaguguaaugggcggggccugucugcuaacauuaacccugccugcuccuccacagguaccaaggccacgugggggcaucacuggucgugggcgggguugauuugaacggaccucagcucuacgaggugcacccacaugguuccuacagccgucugcccuuuacugcccuuggugagcucuuccacccuuuaaaucacacgaauccugcuccugcaaccccaccuucaagguuuguaccuccgcagcuaacaacugacuucggaugccccuucccaccugcaggcucuggucagggugcagccguggcacuguuggaagaccgguuccagccaaacaugacggugagcgacuucuucaugcucacuggcggggagugcugaaaaacccuagccaaguauagaaauaagaaaggcuuguaggugugaaggggacaacugaguagggacugaguaaaguugaagaugggagggccagucaggaaccaagcuuagaccacagagagaagcagaagcucacaacggaucauuacugaaggaagagguaaaugauguuugagauuggacuugggagugggauagaaguaagugacuaugugcuucagagauaacuaaggcccagagagaaacacgugacagacugggugggaagacaacuuggggggggguacauguaagcaacacugagaaguuuguacagaggacagugaguggagggcacacaguuuuggaggagagggggucagaagccaagggacuggaauuuucaauggauggagagaaaggagguugagcuuacauaaagagcaaauugucuagacuucaagauuaacaaguccccugguuagagugugguaacacuagguccauuuaaccucauuuccacuacccagcuggaggcugcgcaagagcuguugguggaagccaucacagcagggauccugagugaccugggcucugggggcaauguggaugccugugugaucacugcagggggugccaagcugcagagagcauugagcacccccaccgagccugugcagagguaagagcacaggaagggagggcucuguguguguucacacgugugcauggacaggcugcauucuaaaaggcuggcccuccucccuucuagagcuggccguuaccgauuugcuccuggaaccacaccuguccugacccgggaagugagaccccugacccuggaacuucuugaggaaacugugcaggccauggagguggaaugaaguggccugagauguagaguuuggaaugagggugaauaaauccgggaaacacaaacacuuaaacagaag

SEQ ID NO: 4730 - RNA, 2269 nt, Mus musculus
cauucauucagucucagcaaacuugcaucacccaggcuuugaguggauugcauaucuacgaaaacaucgucgaacuuuguaccuuuggaguucuaugggaugacugagcgaggcaaugaagaccacaaguuaagacuaucagaaauuaagcacucaaaugacagaggccauccucacucgauuccuugagccagggacccauggcccccuccuacugcggacucccauuccugccuccaccgaguacccuuccccaaagaugacuccaaucuggacaucgccaugccggguggaaaccuacagaccucgcagccacugaacucuuaaggauccuccucccuccuuccagccggugcugcagcgccacacgccacccugauccgcgccagccaccguacuccagacuacgguggcgugcuugacgucauuagcgcgcgccucuucugcaucaagggaaauauggcuuuagccgggccaucgcggcugcuggcguuagcaguacgguugcuucuggagccucgacggaaccuaguggugcgcgguuccgaccaguccuugccaguggugcgcguuccgcgggcucugcagcgacggcaggaacagcgacagagcggccgugggaguuugcagcggccagugcuagugcgccccgguccccugcuggucucggcgcggcggccggaguugaaccagcccgcacgccucacgcugggccguugggagcgagcgccacuggcuucccguggcuggaagcaucggcgaucgcggcaagaccauuucuccauagagcgagugcagcaagaggcgcccgcccugaggaaccucucgucccggggcagcuucguggaccugggucuggaaccccgagugcugcuggcgcuucaggaggcuguccccgaaguugugcagccaaccucagugcagucgaaaaccauccccccacugcuucgaggccgccaccuccuuugcgcugcggaaacuggcaguggcaagacgcuuagcuaccuacugccccuauuucagcggcuccugagagggucagaccuggacucccgcaguuucacggcuccucgaggcuugguucugguaccuucccgagaacuagccgaacaggugcaggcaguggcccagucacuggguggguacuugggccugcaggugauagaacuuggcggaggccucgggaugaguaggcucaaacuucagcuguauagacgaccggcagccgauguguuaguggcuacuccaggggcgcuguggaaggcucugaaaagucaacugaucagcuuacagcaucuuaacuucauagugcuagaugaaguagacacacugcuagaugaaagcuuccuggaacugguggacuacaucuuggaaaagagcccuauagcagaaaguccagccgaguuagaagaccccuuuaaucccaaagcccaguuagugcuggugggagccacguuuccagaaggccuaaaccaguuacugaguaaagucaccaguccagacagucugaccaccauuaccagcuccaagcugcacugucucaugccucaugucagacagacauuuaugagacugaagggagcagacaaggugacagaacugguucagauccucaaacagcaggacaaagcaaguaagacggaacccucgggaacuguccugguauucugcaacagcgccagcaccgugaacuggcuuggguacauucuggaugaccacaagauucaacaucuaaggcugcaagggcaaaugccggccucaaugagggcagguaucuuccagaguuuccagaagggcucccagaacauacuugucugcacagacaucgccucccgaggccuagacaguguccacguggaagugguuaucaauuacgauuuccccccuacccugcaggauuacauccacagagcaggaagggugggucgugugggcagcgaagugccaggguccguuaucaguuuugugacccaccccugggaugugagccugguucagaaaauugaacuggcagcucgccgaaggagaagccuuccaggacuagcaucuucagugggggacccuuugccucaaaaggccugauuuuugguuggcuugaaucuagugcuagagcaggaaguugaacacuugucagugggcgacauugagucacgccagcccuugccucucugaaagcaugaugaauuguuuggagauuugaaaaguaaacuacuggacaggauuggaaaguaacguucagaaaauaaaguggauuuugacuuuacacuau

SEQ ID NO: 4731 - RNA, 962 nt, Mus musculus
uaauuuuauuuuucuucuuuauuguagugaggaugcaggccagggccugugcauugguaauagucaagugccuuacuaguaagcuacaguccugaugcuugauuguugcccccgacccugugcuuucuuucuucauggaccccuggcuagcuuagagcucaccaugcccagccccaggcccagccccagccccaaccccugacuuuuuauuuauuuauuuauuuauuuauuuauauguaaauacacuguagcugacuucagacacuccagaaaagggcgucagaucucauuacagaugguugugagccaccauaugguugcugggauuugaacccaugaccuuuggaagagcagucagugcucuuaccugcugagucaucucaccagcccaaccccugacuuucuuuuuguuuccacagucucucccuucgaaauauuucuagaacugcuuaccaaccucguugaaucgcugucaucucucaaguugauuuacugaguugccuuugaguugaucucccugcugucuguccauccguuccuccauccgucugggugcaaguccccucaugaccccuuccccuguuugcuguuaauacaguagucagugugauccucugacaacaugagugagcuccugcuacuuccccacuuauaacccuuuacagggucacuuuuugaagagccaacagagucuuaagacucaaagaccugcaugaucugaguacugccccauaucaucuaacugcugcuccuaaaacauuggucuuccacaauuuucccuguuguguaguuuauauuauccucuuuacgacuccuccaacauaccagauuaacuucugccuugggucuuucucccuggcuaucgccucuguugagcguucuucuagaucccuacuugguuaauucacaucucuguuuaagucguaucuuuuuaauugaagcauaccucagcuucucuauua

SEQ ID NO: 4732 - RNA, 72731 nt, Mus musculus
gccaagaaggguacuuuucucugugucugcucaacuuccgucaaggaccagaccuggucccucugauuuaggugaggccuagcuagaaugcauggcauccucuccgggccggcuugaggggacaaaggcacagccacugagacggggccccaccccagaaggguggcucugaaucgacuccagacuugucucgcaagguuuucuucggcuccacccuaaccuacccaaaaguucgaaccaaucccuggcccucuccaaguuacgccaucgaaguugguauggagggaugcgggggaugagugguaacuuuugagguggucuaacgaacguauccacucuaaacucagcuauaagugaaaaguaccucuguggggccaaauauccggacaccuauaacccuggcgcucugcuacccacuuccucgacaugagcuccgcccgaugagggggaaaaagauagucuccaauuggccuacguggguucccaaucuaauuagacagcgcuauuggcccuacccuggucuugguuuagaaacugcggaagaaagagaguuuuaacuacaacuuccgagagggagcagggcucuggcgcuucuugcucacgugacuuccuccucgcagaggacucacgcgauaggucggugaggaggcggggcccguggcugucagcggggccagcggccuaugggcugccccgucgggcgggagcgcggcgaggggcggggcugggcgcgcugcagggcgcgggagcgcgccggcggcgguggcggcaguggcggcgacuguggggguggggggcggggagccuugguugaggcgaccguggcuuuucugcacccucgaccggcggcggugacggcucccggugcggcggggcgcucggccagcuuucuaggucggaacggaacgcucggccucgcgggccccgcccggaaaguuugcaguggagccgcgaccuccuggccggcgcggcccagcaugaagcggcgcugaggagccgccgcggccgccugaggaggaggcgcugcaccccgggccacgccgaugacuacugcaaacuguggcgcccacgacgagcucgacuucaaacucgucuucggcgaggacggggcaccagcgccggugucccaggucucgcggccugcaggugggugccgggccggccgggacuguggagcgugcccucgccgcgcucccgccagcucgccuuccccucggucccccuggugcgugcggguggcgaggaaagcccgauuuaauuugaggaggagaaggaggcgugugguucggggcgacguggaagugucuuggcugcgagcgaacuaguagggaacucgacuccgagaggccaguggccggcggacgcccgggcuuuggaggcagagguuguuggggccaaagccccaagagguuucugguugucguagcugugccagcguggugcagaggaaaugucuccgagaaguguaagcgcacuucgcugucuuuaggcuaguuguaaaauucuuuauuugaaagaugcguguuuucaaauuccacuuuaaaaaaaaaucuacuuugcuagaagagcgaguucgaguuaguguccacuuguguaaauuuauauuccauccacgcuuaguuucaaguauacuauaacggaccuuucugaaaacuggguuguuuugcuugggcaaaguguuucuggagauuaaaaaacaaaaacaaaaaaacaagauacguugccuuuuaaaauuacaguucuccuagaauguucuagaaggcauuuuuuaauaauuuuaaaaaaaaaagcucuucucagaagauguuuuaaaagauaaguugggaaagcuggacaccauaaugcuugcgggucaaaccagucaguaaauagaaacaggaugaugacuggggacuuaacucucuccugugaccugguuuggaauagugugguucguuaaguucagcuucccuauuacauaugcaagagaacuuagaaaaagaagauggauaagaguauucauguuuauucuuuccaguauuaagugaauuauuuaaauuuuuucauaguauugugagggcuaauacauuguuuucucagcguugcauugaaucucuaggugguacaauaccuuuuaguuccuuuucagccuucguauacuguuuucaacguaauaaauauaaaguuaagaguugacuguagagccggggcguggugacgcacgccuuuaaucccagcacucgggaggccgaggcaggcggauuucagagugaguuccaggacagccagggcuacacagagaaacccugucucaaaaaaccaaaaccaaacaaacaaaaaacaaaacaaaacaaaaaacccaguugacuguauucauuuccagucccauuagcauuauuuuaaucagccuuaaugucgaagauacuaguggauacucacuggguaguguauacugaugcaggcuccugcuccugaugaaaauugggaaacagaugagacacagcucaaacagcuauuacucggcaaacuaaauugucauaaauuuuauauauaaaauagaaaaaugggguuuauggagcugauggcauugaguugcacuuagguuauggaaauugaaaaaauaaaacaacuuguuugagugaauuuguagaaaacaaguuugcaauuggauuuguaguugaaauucccaaagauaagcaugaacaguuuugccagaagccgacuuuaaaacguucugggcgguuuucucgccccccccccaaccccaccuuuuguuuuuucuaucauuucuuuuuuagagucuaguucugucaggucugccgccucaucuuccaagugcugguauugguggccaugugccaccauaaucaguggucauuuucuuaaggauauuuguuuuccauuaugguggaaaucauaugaaaaaguaaaacuuuaugcuuuuguauuuuacugagacaauguuucaguauguaucacaggccagcuuagaacuguccauguaucccaggcuggccucagaauggagauacgccuccugcuucagccuuugagacuacugggguuacugauguaaaacaccguacucggcuauuuuauucaacacaguugugguuuuaugaguaaauaccacuuacguuuugaaccacgacucguuuuucaugguaguuagcauuguuuugguucuuuggcugauuggucaguuccacaaaauagcagauuuuggaaauuuuggccuauauuaguucuauguuucucugaagguuugagaguacuuagagcacauugagguuuccaugcauugaaaauauuuuugaaaacuucuuuguggaaauuaaaaauggugucacauaccuugaaucccaguacuugggaagcagagguagguggagaucucugugaguucugugccagacugguggucuacauagagaguuccagaauagccugucaauauauuuuuuuaaaacaaacuauuuuguuuuuccuuaguaucuaacuucaaaaugaccauauaccccaguaaauagaaacuuuagaagcauuaauauagugccagacaaaguauuuacuauaaccaguguuuguguguuucuaaucuauacuucagaggaaguagaggcaggcagaccacaaguuugaggccaauaugauuuauguaggacauuccagaacuauguggugagaccaugcucaaaaaaccaaacacaauaaacaaugaaacucaccuauguauagugcauuccauuauuauaaagagcagcuuccaauacucugguguucuguuuacaucucucucuuuaguuugcuguuaagauaaucaugaucuggcaauucaguuuucugugugugugaacacauaguguguaaguuacagcucaucuucgggugucauccuggguaaagcugccagucucuucauuuuuaaggcagugucuucauuggcccggagcuuucuauuuaggccagauguaguugucuagugagcccuggggaucuuccugucucugccuccccggugcugccauuacaaaccuguacugccacauccagcauuuuuauauagccucugggaaucaaacuuagguccuaacacuuuaucuacugaacucucuccuuauccuauuuauugauugauuuauucagacaaggucuucauauauuauguauuccuagcuguucucuucucacuguguacuagagggugaccuuggauuuuaguuggaaccaucgaaugugauccuuuuacuucucaaaugcugccauuauaggcauggcuuacauaugccuagcuuucaauuucaauuuguuuacuuaagacaguguuccacaaaacauagguuagaacucacucacuuugugugugugugugugugugugugugugugugugugugcgcgugugugugcgcgcgcgcacacacacacacaggucugaggaggaagugcaguguucugcuuuaucauucucugccauauucccuugaagacaagaucuuucacugacccugaagcuaugcugguggcuggcuagcuguaacaguccuccugucucaaccuccuaccucacugcagugagagacaguugagagcuacccauuguggguccucauaauugcugagcuauccauccuuccagccccaaaauuuguuaaauguuuucuaguuuacaaugagaaucaccaaaagaaaggcaugcaacauuauguauaguaucuuaucuauuauuguuuuuugaagagcagaaauacuuuuguuuuauaauguauuuuuuuugcaauacauuuacuuuauauauccucagcaaauacugaauauacuuuuuuuuuugauaaagauaaaguuuccuacucccgaacucaugguaguuuuccugcuucagcuacaccuaggcacagguuuuucauguguaaacuugaggauuuuuuucuagcuauauugucuagugcucagugucgucuagugcugauuauauauguucaauauaauuuauucuuugauaaauuaucuucuuaugucccagggguuuuuuguuuguuuguuuguuuguuuguuuguuuuugagacacgguuucucuguguagcccuggcuguccuggaacucacucuguagaccaggcuggccucaaacugagaaauccgccugccucugccucccaaguacugggguuaaaggcgugcgccaccaaccccaggcugguuuuuguuuguuuguuuguuuuguuuuguuuugcuuuuauauauuugaggcagagucuuuuuuuuuccuaauaauuuacuuauuuuuaaauuguguuuugccugcauguaugcaugucugugugaggguaccagauauuggaguuauagaggguugggucuucuggaagagcaguuggugcucuuaacuaccaagcuaucucucuagguccaccauguggauacugggaauuucauccaggaccucuggaagagcagucagugcuuuuaauuacugagccauccuucuagccccaauuucauuaucuuuuuuuauuuuuauuuauuuuuauuuuuuauuuuuuauuuucuuaguggugggcacacuggcaugcaccccagcauuuggaaggcagaagaaggagaaucucugugaguucaaagccagccuguucuccauaguguaguucuaggacaaucagggcuacauaaacccuauguacacaaauacaauucuugcucuauuuaccuauuuugugugucugugugucugugugcaugucugugugugguccacuuggagaucagagaacaauuugagagcauuaguucucuccuuccaacauguggguuucaggguuggaaaucagguuuucgggcuugauaagcaaugucuuaaccugcuaagccuuuuggccaguccuguuuugauuuagucuuuacucuuuucaguguuucuuaccucuguauaaauacuuguauucuuuugcuuuuaaauucuuuuccucuuuuguucuaguuuuagaguuguugacucaguaagguuugaaaggagauugauuaaauaaucauacaaauaugguuugauaauuuggucaggauaaaaaagggaaguugcuuguuaagaucuucuguaauguuuguacaggucacuuacuagguaucauagaggagaauuuaauugcugcuaaucuguauuuucauaccuagauuuuucuguagugaaaguaugcauugagugauugagucagugauuugcauuucauuguuuacuuggaagaauaguaguauguauguauucauuuuauuuugagguaggguguuguguaugccaggcuggguuauauagccaaaacuggccuugaacuccugacaugcuaccuccaccucccaaguacaggaauuacaagcaugcaccauuaugcuuggcuuuuuuugguuaguuuucuugagacauaaaaucucacuguguagaccaggacagccugaaacucacagaacuucuccuccugccuuugcuccucaagugcuuaauuaaaggaguauaucaccaggcuuaguuggcuuuuuauuuacuuuuuuuuauuauuauuuuuugagcuaggaucucauguaacccaaacuugccuagaacucuugguauagccgaggagaaucuuaaauuccuuauccuucuaccgcuaccucuccaaugcugagauauuacagguauagaccauuaugcacuguuaacauucuguuuguuucacacuuuucuugguauggauuaaagggugcuucuagggauacuagcaaaguuaugugauagagagaagugaauaaguguauuuuaguaaguaugaggaaaaaauccagucagaaagaaaagugauaaguguuuuguuaaaaacauugaucuagcugggcaauggcagcauugcugcuuuaaucccaacacucaggaggcaaaggcaagcagaucucuugaguuugaguucaaggacagccuggucuauaggacagccagaacuacacagagaaacucugucucuaaguaacuaacuaacacugaucuaaugugauuauagguauuaauccuagcacuugaauaguagaggcaggaagaucaggaguucaaaguuggccuguaauuacuagauaaaacauuugaggucauccugggcuaccugagauucugucuccaaauaccaggauuggcaaaauaucauggcagucaaaaugcuugcuaugaaggccuggugaccugaguuuaaucucugaacuccauguaaagauguaaggaaagaaccaauucccaaaguuaccuucugaccuucaugucuguauugaugcaucauacauacauauauacauaucauaauuuuaaaaagaauuuaaagcaaaacaaaaaccugugcucauuuuuggauuuuucuucuuuuuuuaauauuuauuuugugugugcauacacugcuacaacuuuuuuuaaaauaauuuuuaaaauuuauuuauuacauguauaugaguacaguguagcugucuucagauacccaagaagagggcaucagaucccauuacagaugguugugagucaccaugugguuacugggaauugaacucaggaccucuggaagagcagucagugcucuuaaccgcugagccaucucuccagcccccugccacagcuuuugaguagagguuugaggacagcuugaaagggucagugcucuccuuccaacucugugagcuccagggguugacucggacuguggaggcagacacccuaacuugcugcgcuggccugcaugcauuuguuuucauccugcuguuuuggaacugggccuugguuuugugugugauuuuuguuuguuaguuugauuugcuugucaauauuguaaucuuuguuuuuuguuuuuaauuucuauuucuaaugguacugcugcugauuuuacuucagucugccauacaauuuaaaauuguucccgucuucagagagcuuucuuccuuuagcucuagcccuccagaaggaggugaaaauuguacuguaaaguauuuuauagcaagaauaguuaggauccccaaaauagugacuuucuuggcaguuaaaagguagaaaggcuccacuuuguguuaauuuuagagcagucuacauuacuugcugcuucucuguaggaguuagagccugccccagcauugauugucuugaggcuucuggauaagugguugugaaaagaaucuucauuccugccaggcagugguggcguaagccuuuuuuuuuuuuuugucccagcacuugggaggcagaggcaggcagaucucugaguuugaggccagucuggucuacagagugaguuucaggauagccagggcuacacagagaaaccuugucuggaaccccccuccccccaaaaaaaagaaacaaaaaaacaaaaccaacuucauuccuuucccaaauaaccacaagcaguaucucagaaauuuuaagcagaauuaagaguugcugagacucuacuuaaaaggaaauuucuucauugugaccaaauacucaaaaagacucuaauuuggguaaggagaauuuacuuugguucaugguuugagaggauacuguucauuauaacagggaagguuaacugugguaguccgaggugacugcugguuauauuguuucacaggaaacaaagcuggauacugguguuccauuauuuuuuuuaucuuuugaagcaaaucuauguagcccagacuccaauucuuuguuguucuguuuugguuugaaauaggcuuucugugugacucuucuggaacuugcucuguagaccagguuaggauggaccucaaggaucugcuuugagaucucuacuuccccagugcugggauuaaaggccaccacauccaguuuuguccuucaguucuuuuuuuuuuuuuaagacuuauuuauuucuuauuauauguauguacacugcagcugucuucagacacaccagaagagggcaucagaucucauuacgggugguugugagccaccaugugguugcugggauuugaacucaggaccuuuggaagagcagucagugcacuuaaccacugagcuaucucaccagcccuguccuucgguucuuaacccugccucagcuucccaaauguugguauuauaggcaaugcaccaccacagcacacacagaaauagaacuauaagcuuuguuauuuguauacuuaguaaggucuaauuauuugcuaauacaaaagagauauuugggugaguauucugaaauauuaguaagguuauacucuagucuuuuauagaauaacacagaaauuuaaaacuuguguugcauaaguagucaaggguggcaugcagaguaguguacacuuguuaucccagcacuugggaggugaaagcaagagaaucaagaguacaaggccagucuuagcuacauaucaaguucaaggcuagccuggguacaucagaaccaacuuuaaugguuuuuguuuuguuuuucuugagacaggaucucauguauucuuagaugaucuugaauuucuauacugaagauaaucuugaacuucugauucuucuuuguagaguguugagguuacaggugugugcuaccacacuuaguuuacuggagauagaacccagagccucuugcaugcaaguuaguauguauucucuacuaacuaaacgguaucccuagccuagaaucuacuuacuguuaugauuuacauuucagcagcauccguaaaauaucccuaaacucauuguuauuuuuauggcaggcauaguccaaacucuggcuuuugagguuugcuuuacuuuauuuuuuuuccaguuaagucuaagcauaaggacauuuuuggagagaaauuauacugcuugcuuuucuucagcuauaaaagcugauguuccggacuagaauagauuggcuuagugauuuagagugcuugcugcuuuugcagaagacuggaguuugaucccauaauggacaguuuguaacgaccugugacuuuagcucuguggguaaucaacauccucucuggcccucaagggcaccuucacacaagugucuguacacacacaccaauguaugcacauauaauaccuucacacaagugucuauacacacacaccaauguaugcacauauaauaccuucacacaagugucuguacacacacaccaauguaugcacagauaauaccuucacacaagugucuguacacacacaccaauguaugcacauauaauaccuucacacaagugucuguacacacacaccaauguaugcacauauaauaccuucacacaagugucuguacacacacaccaauguaugcacagauaauaccuucacacaguguauguacacacacaccaauguaugcacauauaauaccuucacacaguguauguacacacacacacaccaauguaugcacauauaauaccuucacacaguguauguacacacacaccaauguaugcacagauaauaccuucacacaaguguauguacacacacaccaauguaugcacauauccccagcacuugggaggcagaggcaggcggauuucugaguucgaggccagccuggucuacaaagugaguuccuggacagccagggcuacacagagaaacccugucucgaaaaaccaaaaaaaaaaaaaaaaaaaaaaaaaaaaaguuaauuggagagagagagagacagacagacagacagacagacagaaaaguaugguuaauccugggaccuugacaaucuagggaaugauauaauaccgguuauaguuccaucuaugaaacaaaaacuuuuuuuaaaugcuaauuuuuuaaacaaaaccuuuuuaaaggauagguaaggauggggcuaaggaagcuauaaugcugugagggcaaucacauuacuccuaagagguaggaaaccugagcagguugagcccuauuugauaguaugcuguacuuuggucacagcaguaacaugaauaaggaagguguuuaaagcuaucuugguggguaaggagaauagacacaguagucuuggcaguaagccuggcuucuaaaacugaauccaagucaucaaauuugcccagacaugccauaugagguucaaguaaccgaggaguaaauuuuauucagggagacuuaaaagagacaaacaagagcaagcuuuuuuucuguguauauauuuauaucacacaacuuuccugcgugcuuguaguuggcaagcuuuuggcaagagagacaacuggagcuauaagauuuaaaaguaagauagauagcccaugaauugauaacuuaccauuaccugaaauuuguuuggaaaguuuuaguugacacauugguauuugugugugaaaaggacuguaauucaaugaaagccugaaaaucccaggcauucuuaaguaacuuaaaaaguuucauuucucauaaaauguagaguuuccauaugucuugcuuuuugcagcagguaagagcucugcauguaaaauauauaucucagccaagugugauugaugacuuuauuucugcaauucuaguauuugagaagcuaggccagggucacugcugugaguuugagucugaccuuaguuuuauguuaagucuagguuagcuugguuuuuaaugucagauccuuugucaaaccuuugccuuuuauuuauuuguuuguuuguuuguuuguuuauuuauuugguuagugcuuuagacuuuuguuuuucuuagcuaggcagugguggcaugcacuugaucccaucacuugggagccagaagcagguggauuucagaguuuggggccagccacuacagagugaguucucagacaaccaguacuacacagagaaacccugucuaguagguaggguagggaguggggcagaggugcaggcaggcagacgggguguguguguguauuuggagugaaauuuuuaccagcuuuauuuuuuucauuuaauuuuugcuuauuuuuuuucauacaaucauccggaccccagcuuucuccuuccacuucucccaguuucccuccaucuucccuuuccccaggcucacguacccccccccccccccccccauagcucuucuuaguugauucugcaggcuuuguucucccaguguccuugaccucucuggcucucacaauuucuccuccccucuucuaugggguucccuaaacuccaaggggaaggacccacaggagaucuuuaaccugggcugugggucucugcauacauucccaucagcuggcagaggcagucucuguuaguauagcagaacaucauuauugauugggccggggcggggggagggaggcagcuguguugguucuguccagggucucugggcuuuucucugguuccaggucauccaggcaguguuaggcauggguuuaauuauaauacucuuuaucauaauuuagaauggauagaauuauaugagcucugaaguugcauuaauuuuaguuuuuuuuguacucauucauucauucauucauuuauuuuaggcacacuguagcugucuucagacacaccagaagagagcaucagaucaaauuacagaugguuguuagccaccaugugguugaugggauuugaacucagaaccucuggaagagcagucaguucucuuaaccauugagccaucuauccagcccugcuuuuuguuuuuuaagacuggguuucucuacaaagcccaucaagcucuuuaagaugauaggauaggggauuugugaggggguugugaucaggauauaaagugaauaaaaauaaauaaauuauugaaaaaaagugacaggauaggaaaaaugcuuauuuuagaaaauaauauuguauggccagguuuuggugguacacaacuuugaucccagaggcaggugguuugagacuagcuggucuacagagcugguucuaggacagccaagacuacacagagaaacccugucucaaaaaucuauaccuauacuuauaccuccuuuuuuuuuuuuuuuuccugagacaggguuucucuguguagcccuggcuguccuggaacucacuuuguagaccaggcuggccucgaacucagaaauccaccugccucugccucccaagugcugugauuaaaggugugcaccaccacgcccggcaugaccuuaccucuucuuaagcuaaagucacuacuguuaaccugaccaugcuccuuuaaauaauaccucauuucugccuuuaguaccccuaauuaaauuaauugauuaaccuuuuuuuuuuaaaguggagggagguugaagagauggcucagugguuaagagcauugacugcuuauucagagguccugaguucaauucccaucaaccacauggugacucaauaccaucuguaaugggaucugauuuccucuugucugauguauucuucugucaugcaggcauacauuugaauagaguauaaauauacauaaagaaauaacucuuuaaaagaaaaaagaaaaagaaaauuacagggugaaagggaggauuugagagaugguucagcauuuuaagaguacuuguugccccugaagaggacccagguuugguuccuagcacccacauaauggcuugaaaccucuguaacucuaguguuuuuuuuuuuuuuuuuuuuuccugaucauucaguuaucacccuagcccugccuguuuuuaauuuuuuuuuuuuuuuuuucuuccaagacaggcuuucucugugugguccuggcuauccuggaacuuauuccuuagaccagcuugggcucaaacucagagacccacccaccucugcuuucggagugcugggauuaaagguauaugccuuuaugcccagcuugguuuuuguuuuuguuuuuuuuguuuuuugaggcaggguuucaaucuguaugcccuggcugaccuacagcuuguuauauaguccauguguugaacuugcugugauccuuuuggcuuugccuccagaguucuggaauuacagguguaugccaccaaaccuggcugaaugccuuauuugaauugucuuugcuuaauaugaaacgaugggacuauauuacuuuacuuuuuguuacuuuuuauugcaauauguuugcauucaaguuguaauguaauuuucagcaauuuuucuuauuuauuuauuuguauguauguauguauguauguauguauguauguauguauguauguauauauuugugcaugcacaagcccagaagcuaggggaagauauuggguggucuauuuuacccuugagacagaaucaaucucccacugucuuuugccucugcuucuuuaguucuauuguuacaggcuucuguugccacaccugguuguuguuuaaucuuaaaugaaugucugcuuguauguuuguuuuuccuuuuuuuguuuuugagucaugguuuuccucugcugguuaggcuggcuugaagcauacuauaucuuaaauuugagauccucugccucagccuugggauagcugggauuagaggcaugugccauuacgucuggcuuuugacuguuuuaaguuuugaagcuuuucucucaguuguuuggugauuguuguuaccugcuuaucacuuaaaacgaagcaccgagauauauuguuuggugaucacagugauguuugcuaaugcagccuccuuguagggguucuuacuagguugccuuugaggucauuaucuguaguucguuuuccuuuggcuaauuagagucccaagugaaaagucugccagucuauugccuagaguguaaguguguaugcugugagccaagggaguagaagagcacuuaggguuucaauauacacguuuuagaauggcuugguuucaucauccuguuuucaguaugguugcccagguucucagccuuccuucuuucuccuugucagaagauuucauuuacugccuaaagaaaaagagugguagguguggaaauucaggagcaggguuaguuacucauucaaaaagcucugaauccagcuaguuuuuuaguuuagccuucacuucuuucuaauucuggauuugcuuauucuacauauguacuauaaagggcauaauauaauggugugugacuuugugucuaugucuuucacuuagaauguuuucaggcuguagccuuucuuuccuuccuuccuuccuuccuuccuuccuuccuuccuuccuuccuuuucuuuucuaaaaaagauuuauuuauuuauuauaaaauaacuaaguacacuguaguugucuucagauacuccagaaggaggagucagaucucauuaugcuugguugugagccaccaugugguugcugggacuugaacucaagaccuucggaagagcagucagagcuccuaaccgcugagccaucucuccagccccaccuuuccuuucuuaaugagagauucuuguuuacuguguugcuucagccugcuaaguagguugauugcaguuguguagcaccacaauaaguuuuauuuauucuuccuuacuagguuauccauuaaucuauugagaauuaucugauuuuuuuaacccuuuggccauuucaaauaaugcuauuauaaacauaugugucuaaguuuuuauauagacauauuuuuauucucaugaauacauaauugagaagaauugcuuaguccauagucauucuuuucauugcauuugcuuuuugagauaguaguccagacugaucuggaacucaccauguagcucaggcuggccuugaauuugugccaguccuccugcuuagucuauugaguacuugaauuucaguuaugagucacugugcuuugcuaaagaauugaaagcagggcuggauugaggagccagguguauauagucaagggugaucuagaauucuuaaccuuuugccucaacuucccagugcugguauuaugaccuugugcuacuauguccaucuugcuugauuauuaauugauugauuaguugauuauuguuguugcucuuauuuugguuuugagacagggucucuuuuuaccccccucucaucucuguuuuugagacaaagucuugcucugacaaacucuuucaguaguucuccugccucagccauccacauccugggauuacuguuguuagucaugaggcagagacaggagaaucacuguaguucaacacaaggcagguauacauagaguuguaggcgagcuuuguguacauggcaguuugccaaccaaucacagauacauagugagacacucccuccccuauuucucugucuuuaaaaacaaaagguguuggaggacuucauauagaacuugauguacuauguuuguuugcccaguauuuguaacaccuuagguucaguccugaaaaacacaaaacaacaaaacuguauuacugugucccgagcagcaaugcggcagaacuuaaaguguuuuuucacaguugcucuucucuaucuuugugggaacaugaccauggacagcacauaauugaguguggccaaguuccaauaaaauuuuauuuauagacacagaauuugaaucacauuauauccauaaaauuuucuuuuaaaaaccauucuuaacuuguaggcugucauuuaaaaacaaaaaaccaggugguaggacagauugggcucacaggcuguauucugccagacccugguuuacuguucguaaagacgugaacaugcucucuguauucucuagauuacugucugcuuuccuagggcccucugguggcugauagaacauuuacaaaaauuaaauuagucaaaaugguucuggagcaucaugaagucuacgguugaaaaucucaaugacuguuaaagugugguuggagugagugccaucgucucagaguuaggacuucuggacacguggggaaaaagaugaaacuauuuuguguguguguguguucaugucuuuguauuacuuuaagacauuguguggguacacucaugcucccgugcaugaggaggguagaggaggaggucagguguuucucugugacuguucuaugguuuugacacagggccucucguugaaccaggagcucaccauuucagcuaggcugacucaccucccgggaaccccugagaccugacugccucuuagcccucggugccaaggucacagacacuuggagccaugcccacccucauuuaugggucacagggguuugaauucaaguucucaucccaguacagaaagcacuauuacccaaugaacuguuucuaucagccucaagacaccauuuguguauuuacuuguuuuuaucuacaguuugcugggaggaaguuacaaauuucagcauuaaucaacugcuggaauaacauugauaaaauaauuacauuagaaugaaacuauaaagacuuucagcugggcgugguggugcacaccuuuaaucccagcacucgggcgguagaggcaggaagauuucugaguucgaggacagccagggcuauacagagaaacccugucucgaaaaaccaaccaaacaaacaaacaaacaaaaaaaaaacuuucauaggugauuuuuauucaaaacaagauuuuuaaaguacauucuuaaguaaaaauuuguuuuuuaaaaaaauuggauuguauaaugauaaagaauauaguaguugcuaguauaguuguugcuggcaggacuugcuuaaauauaaaaaaacaagggguggguuuuauuuaauuuuauccauuuuaauuuaauuuauuuugagacagaguuuuucuuuguagccaaagcuauccuuaaagucucaauuccacagcacaagcuagagugcugggauaacagaagaugcaugccaccaggccuagcgagggaguaaauugaauagucuaaauuugugaagauuaaugaucaacuauaauuuaauauccucagucagcuauuuuuuauuuagguaaagaaucuaguggugucuggucgcuuuuuguuuuaauuaauuugauguguucgauguuuugccugauuaugucuguguaccauauacaugucuugugcccucggaagaggacauuggaucacugggacuggaguuucagacacuugugagcuucuuuaugggugcugggagucaaaucaaacccaggcccuggaaagaacagccagugcucucuacuaaugaaccaccucuccagccccaucuaguggcuuuguaaccugaucugcugugugcagacgugaauucuugaugauacgacuacugaggaagaagaugucuguguuaauuauauacccuuccuaaaagaaaagagaaaucuugaauuuuacuacaaggaaaauaccuacagagaguaaauaaugugaauaagaggccaggucaauguuaaugguggggcaguacaaauaacaacaaagcauaccucuaccagaaauuaauaaaaucccaucuuuaguuguuugguuuugagacagaauaucauugugugucccagaugggcuucaaacucacagccugaccuggucugguuuagaacugucaaucuuucugccuccuaaauucuaguaugaacuauccaucaucuccucccagcccaaaggugucucugucucgccugucucucccucauuuccaccuuccucccuccccacucuuguauuuuugagauaugguuacucuguguagcccugucuguagucuuggcuguacucacucuguagacaaggcuggucucaagcucauagagauucaccugccccuaccuccugagugcugggauuauagguaugcaccaacaucaccuggcucccaaggcgcuuuucaaaggcucugcuucacucagucuuaaacugcaauugucaaauacaguacaauuucuauccuuaaaaaaaaauccuuagggcuggagagaugagucuguguugaaagcaccugcuguucuugcagagggucuagguucuguuccuagcauccacaaagugacuuacagccuucuguaacuccaguucuaggggacguuaugccaccuucuggcuuccaagggaacugcacacaugugguguguuaauauaaaugcaggcagacacacacaaaauuaaaauaauaaaaucucuaaagacuuuaauuaaauucagguuuuaggggggggaugugggugugugugcacaugcuacuauguguguggggugguauagggugugugugugagugugcacaugccauugugggguggaggugcacaugcuacuguugggggggguguagggugugcacaugccacugugugugugugggggggguguaggguguguaugugagugugcacaugccacugugcucagauaggagucauacaacagugugcaggaguuggcucucuccuaucaugugggucccagagguugaacucagaccuuuugguuggcuguaaggaccuuuauucacuaagcuaucuugcuaguccaauuaucuuauaguucuaagaugguuuuaauuuuuguguguaugcaagagaguacacagaaauauaccuucuauaaaaaacauucauuauucucagauuauaauuuuuggaaauguagaaguaaagaaaaagaaggucgcauaauuacauauuuccuuauguaacauauauucauaucugcaaaaaaugaauaaauguauuuuuaaaaagucaaccuuuguuguuguugagcuaugguuugaccaaauagugaaagcuggcuuaaaacucacuauguaggcauugaacucuuaguaauccuucugccugcguguuguuaacauuuaacagacaagaaucacugugcccagcucuuuugugaagcuaaugacaugcauuuugauguccaaauguuuuuccucaggauuguuucuacuguuucaucuaauaauuuauacacuugaauuuucuaauuucuucuuuuauugaccuuuuugguugugauuuuuuucuuuucuuuuuuuuucauagaucuugaaccagaugauugugcauccauuuacaucuuuaauguagauccaccuccaucuacuuuaaacucaucccuuggcuuaccacaucauggacugcugcagucucacucuucuguuuugucaccaucauuucagcuccaagguuacaaaaauuaugaaggaacuggugauauuucugaaucuaaauauaguccauuaggugguccuaaacccuuugagugcccaaguauucaaaucacauccauuucuccuaacugucaucaaggaacagaugcucaugaagaugaccuacauauaaaugacccagaaagggaauauuuggaaaggccuucuagagaucaucucuaucuuccacuugagccauccuaccgggaaucuucccucaguccuaguccugccagcagcauuucuucuaggagcugguucucagaugcaucuucuugugaaucucucucccacauuuaugaugauguggacucagaguugaaugaagcugcugcacgauucacucuugguucaccucugacuucuccagguggcucuccaggagguugcccuggagaagaguccuggcaucaacaguauggaucuggacacuccuugucaccuaggcaaucuccuugccacucuccuagaucuaguaucacugaugagaauuggcugagccccagaccagccucaggacccucaucaaggcccacuucucccugugguaaacgacggcacuccagugcugaaguauguuaugcugguucccuuucaccccaucacucgccuguuccauccccuggucacucuccuagaggaaguguaacagaagauaccuggcucacugcuccuguccacacuggaucaggccucagcccugcaccguuuccauuucaguacuguguagagacugacaucccuuugaaaacaaggaagacuucugaagaucaagcugccauacuaccaggaaaauuagagaucuguucagaugaucaagggaacuuauccccuucccgggagacaucaguagaugauggccuuggaucucaguauccuuuaaagaaagauucaucuggugaccaauuucuuucaguuccuucacccuuuaccuggagcaaaccaaagccuggccacaccccuauauuucggugaguugguagaaauggcugcugaucacuuuuucaugcuuccaggucauuugcauuguauaacuacauuaucugaccucuuuuccucucccuuccuuucucccuuucauuucuuuucuagucucuccuuccuucucucuccccucucuuccuuguuuuucauuuuuuuaaaaauaaauucuauuggucaaauaacuuagaaguacuuuuuuauuuuucuuuaagucuuuaaaaguguuuuuaaauugacuaaaguuacguuuuaaaaguaaauagauaggggcuggagagauggcucagcaauuaagagcacugacugcucuuccagaggucccgaguucaauucccagcaaccacaugguggcuuacaaccaucucuaaugcgaucugaugcccucuucugaugugucuaaagacagcgacaguguacucauauacauaaaaucaauaaauaaaucuuaaaaacaaaacaaaaagacgcuaaaaaaauaaaauaaaaguaaauagauaaaaaaaauaugugauagacuguagauaacaguaaaugacuaaggcuccuuaggagaaauuucguuaucuagaaaagauuauuguauggguagguuauuauauuacuaaugaauuaacugaauuugcauauuugaaggacuaugugugggagcguguguguguguguguguguguguguguguguaugucugugugugugucuguguguucguucauguucguguggaaaccagaagacagccaugaguauuacuccucaggaggcauacaucuuguuuuuugagacaaguuuucuuguuggccuagagcucaccaagcugccagcuuuagaaaaaaaaaaugugugugugugcauacuaauggaugaugugugugaauguggacaugugugucaugccugugugguguguaaacagcuuucugaaguggagcuagucuuuccuucugccuuuauucugguucugguucuggggauaaggcuugcacaguauggcaggcacuuuuugaguucuccucuugcuuuguccuauuaauagaaagcauuuucucucacaauguauuuacuuuuaaaugcuuauuuaauugagaugggaucuugcuauauugucuguauugaccccuacugaccuaaaauguauaauccuacuauuccagccucccaaaguagcugggacuauagguccaugcuauuggccuucucccucccaccaucccaccccaccucccccaaaaaaaucuuucuuugagacuggguccuauguagcucagacuggccuuaaguuuacuacauaauugacaauggcuuugaaguucugauccuccuaccucuaaauccuaaauucugggauaacagguguguaucacuacaccuaguuuuaugcaauacuaggguucauacucagguuuucuugcaugcuaggcaagaacucuacuuacuaacugagcuuuguguccauuacuguuugauuuguagauguguaaauaauuuuacaguucuuuauuuucuagggguguguguguguguauagauuuaugugaaagccagagguugauugacauuggauguuuuccuaauucuucauuuguuucuccacuuguuuuuaguuuacuuauuuguuugguuuaguuuuguuuuuuuuuuuuuuuuuuuuuuuuuuugagacaggguuucucuacauagcccuggcugcccuggaacuugcucuguagaucaggcuauccucuaacucagagauguaucugcuucugccuucugaguucuaggaucaaagguguccccacaacugucuagcuucuacuugauuuuaaaagaggaucucucguugauccugguuggcuggaaagccccagggaucuuccugucucucuucccagugcugggauuacaggcuugggccacuguucugacuuuuauguguguuuuggggauuugaaccaagacccucauuauagaauggcaagcacucugggcugcugagauggcucagugguuaagagcacugacuguucuuccgaagguccugaguucaaauccuagcaaccacaugguggcuuacaaccacccuuaaugagaucugaugcccucaucuggugugucugaagucaucuacaguguauuuaugauaauaaagacugaagaaguagaguugaccagagcaagcagggccaaccagagcgagcagagguccuaaaaacucaauucccaacaaccacaugaaggcucacaacuaucuguacagcuaguuguacucacaugcauaaaauaaauaaauaaaucuuaaaaaaaaaaaaaaagaauggcaagcacucuuucuacugaacagucuuccaagcccuuguaauauuuuuaauauuaauagaucuaaauuaaccuuuaggucuuuacaauauuuaaauaauaauaauucuucuuccucuuccuccuccuccucuucuuccucuucuucuucuuauuuauuuuauguauaggaguacuuuguagcugucuucagacacacuagaagagggcaucggauccaauuacagaugauugugagccaccaugugguugcuaggaauugaauuugggaccucuaggagagcagucagugccuuuaaccacugagccaucucuccagcccuuaaauucuuuuuuguuguuguuguuguuuuuguuuuuugagacaggguuucucuguguagcccuggcuguccuggaacucacuuuguagaccaggcuggccucgaacuuagaaauccaccuacuucugccucccaaaugcugggauuaaaggcaugcgccaccaccgcccugcuuuaaauucuuauuaaucaaggauauaauaaccuuuuaaaaacauaccaaaaugcuuuauguuuauuucaagcaguuauguacugaaacuaaacuucgucaaucacaggauugcuugagauaagcaguucuucagagagaagagugaaaugauaggaaguagaggaggccacaggcagaauagauugguuuccacagaguccuacuagagcagggagaaagaaguagaaauacugaaagaaguagaaguguagcuuuugaagguccuuagucuuggggacuggguagauugcucaguuuuuaagaguaucugcugcucuuccagaagacccagacucaauuccuagcacccacauggcagcugacaaccaucuguaacucuagcuccaagacauacaaugcccucuucuggcuucugcagcuauuugacaugcacaugguacacagacagacacacaugaaggcaaaacacucauacacauaaaauacaaaugaauaaaaugacuuauucuucacagcuacgggcuuuaagaaauugaacuacuaggaggacuaggaugacaaacaacuuuaaucccaguacuugggaggcagaggcaggugaauuucugugaguucgaggccagccuagccuauagcacuagauccagaacagccagugucacuuaaguuuuuuguuuuuuuagagauuuauuuauuuauuauaugugugugcacuguagcugucuucagauacuccagaagagggcaucagauuuuuguuacagaugguugugauccaccgugugguugcugggauuugaacucaggaccuuuggaagaacagucggugcucuuaaccgcugagcuaucucaccaaccaccacuuaauucuuuagguuaaagaauuauuuauucacuaaaaaggauagagacccuggugaugguaguguacgccuuuaaucccaguacucaggagccagaggcagguggaucucuaugaauucaaggucagacuggucuacagagcaaguuccaggauagccaaagguacacagagaaacccugucucaaaauagccaaaccaaacaaacagaaaaagaauagccuauuaaauaccuuccaugguugguacuauaacuuacaaaugaaauaagguaauuuuggaauacuucuuuuuuuuuaaccacuggaaaaaauauuggaacuggcagagagaugcuuugagucuuugacucugcuuugcaauaauaauaugaugagguuguuuguguguuuuguuuauagcacaucuucauuaccuccauuagacuggccuuuaccaacucacuuuggacaaugugaauugaaaauagaagugcaaccuaaaacucaccauagagcccauuaugaaacugaagguagccgaggggcagugaaagccucuacugguggccauccuguugugaagguaagagauuugggagcuuuucccuauagacaugcaugguaaugauugaauaaguauauugauuuagcuaaaagaaagaaaacucaaauuugaagagccucuguuuuguaugguuguugauguggcaguauuuucuuagcuaguccaaaagaaaccuuccugacuuucuaucuggggaaauaagauguugguggucaaauuguuguuuuucugauuuuaaaaagacuauauugugucagguggugauggcccaugccuuuaaugcuagcacucagaagucagaagcaggcagaucucugaguuugaggcuagccuggucuaugaagugaguuccaaguacaaaucauuucucuauaccagagaaacucugucuuggaaaacaaaaaacaaaaaacaaaacaagaccaaaaaaaaauguguguauaauauacuagauguuccuggggaaacaacuuaguagaggaagcauguucuguaagcaugaggacuugaguuugacaaugacuuaaaaagccagcuuugcccaaaugugccugucucagcacuaggguauagaaacacccuccugauuucaggaguuuucugaccaguugccagccuagucaagaaagcuagcuucaguuucagugagagaacuugucacaaggcagaaaguaauaaaggaacuccauguguauucaugacaugcagcacacauauacacacauacaaauuaaaguugugcagaaaguagaaagaauaaugcaauagauuacccagauuugucacccugaaaaauaagcaacauuugauaacauuuuagucucuccccucaucuucucuuaaauauauauugagaggaaaacuagauaguugucugaaagaugaauuaaguuuuuaaaauuuauuuuaccugcauuuguguaugccugcuuauuuggaauuacaggcaguugugagccuaaggauguacaugcugauaacugaaccaaguccucugcaagaacagcaaguguacuuaauugcugagacauccucuagccgcauuaauuuuuuuuaaggaugguggguuaguaaacuuuccaucacugugauaucauaaaugagguaaccagcuuguaaugaggaagguuuauuuugguucaguuuuggagguuucaguccuguugauugguucuucuacauuagggccuaugguaugccauaggcuauuuuguuuauuucaaguaugucucauauuuuuaaagcuuugaauuaaguuuuuuuuuuuaauuuuaaauucacaugaauggaguauaacauuuaaaaauaaauaaguaaaacuaagauaugcuuaguuuuaaaccauugauggugauuuuugcuuggaaucccagccuccagaauguugaggucaaggggaucacuguggauucccaaggucggccagggacacauugugaguucuaggacagcauggcuaccaaagagacgcugucuuuuaauaagggggaugagggggauaaaaacaacaaacaaaaaaguuuuuuaaaaaugcacaauagggaccuggagagauggcucaaagguuaagaacacugacugcucuuccagagguccugaguucaauucccagcauccacaugguggcucacaacugucuguaauggaauccgaugcccucuucuggugugucugaggggagugacaguguacucacauaaaauaaauaagugaaucuuuaaaaagaaauguacaauaaucugaacaccaacauucauaaaugucaauaagcgcaaauuagaaacaacucagugcauuaauaguuacgcaauuguaguuuacuuauaggcuacuaccacccaucuguaggaaggcacaaauaguugcuguaugcaacaacuuguguaguucuccgugguguuuugguaugucauagauauaccauuacucccaguucucauggcucucuauggaaguaugaugauuaaaaaaaaaaaucugacaggguuacauauagcuuuccaaguugaauaaacuguagagacacagauuaauaguuucuaggaaacagaguuuuaagugucacaaauauaagaaaauuuauucaugugauggauaugucuguaucuuuaccaguguaguaauuacuuaaaucucucuuuaauaaaaaugcauacaaacaaacauauaagaauguacauauauauauggaaagugugggacuguaguuggcagcuauacuggugccaguuuccuggugucugugaacagaguucaguguugugagugcaugcuguauucuguuugugaauucagguacuggggauucgguaacuuucacuaaggaaaaaaagagcuuauaccauauuguuuggcuaaccuggucugcuuggucagaccuuaucucaaaaguaaauuaaaagaauauagauuauauucuuuuauagugguaagcuuuuuucuuuucuauuuuguugcugugcugggggccaaacccagggccucauacauaaagggcgaguacuguacaacuaaacucugucccuagugugauacagaaauauuucagucuuaccauagaaauuuuaaguuugaaagaugagguuuauaguuuugcuguucuuagacauuguacuuuaucauagguaaagauccauugccuagugaugacuugguuuuguuuuugauuuuuuuuuuuuuuauacaaagucucauauagcccagguugaccuaaaagucacuguguagcuaagaauggccauaaaguacugauucuccugccuguguuucaagugcuaguaaugauuuuuuauaugacauuguaauauauacaucaacacuuaauuuuguuuugucacauuuuugccuuucagcaauuuaugauaucgaauuuuauuuuuguuucuuuuaguaucccugcaguguuucaaaucuguucauguuucugauauagacagaucagggguccuucccaaguaauuuggcaggacugauaauggaacugcuguuauuaaagucucuguaguguguccuguagugaccuucaggcuuuaacccuccagcuuaaguuaaauuaagcaggcacagaucuuuacuauggaaacgauguagaaacauagcaaacaggcugacaguggccugacuagcagaguacugauaauagaugaaagaugcuagaggauucuuuuugguuuuuuuuguuuugguuugguuugguuuuuuuugguuuuucgagacaggguuccucuguauagcucuagcugaccuggaacucacuuuauagaccaggcuggccuugaacucagaaauccgccuguuucugccucccaagugcugggauuaaaggcgugggccaccaccgcccggcuuagaggauucuuuaacaguagucauuuauugauagcauauaacauaaauguuccuucugugauuggauaugucaguaguguaacuaguuuguucuuuuuaaaaaucacugagacacagaggagcaguccuauuuuccuuauccuguauuauauguacuuaagcagguguugucagaaauauauuuauauauauucccuuugaaaucuuauaugcacgauuaccuucccauagccguaguuuauuuuaucaaagugaaaaggacagguggcuuauaucuuugccaagcuaguauaaauaugagucauguaauaugacuaaggacucuuugguauaaggugcuuauccccuuugugauacuuauaauaacauuuauguauaauaguaacauuuaaauuuauuuaggauuauuuaauuaaauaauuaaagcagaguauauaaccauucucuaucuugacuuuuuugucucuagaaguauaaaagacaugguaguuuguauguggcauuaucauuuaacucauuugcugcuaaagaauuauaagaaaaaauuuuaauuucuacacauguacauuuguauguguguguuuuuccaauuucuucuuuaguuauuuaggccuuuuuuuucuguguucauauugaacauuuuguuuuauuaaccaguuuccauucgauuaaaucucaauuaaauuguuaaugacaaagcaauuuaaagguauuaaaaaugaaaauauuggaagauuucuuuguuauauauguauuaaaauacuuacagaaagcugcaaauucugcuugaguauagugaauugcacauugcuguuguacuuuaagagccuaagguaaugucaggaauugaggcacaaaugugucuggaaagggcuuaugagaugagggugaaaacauucaaauuggauaaaagucuauaauaaugaauuagguuucaggcagacagacaacagacuguguguguaugugucuguaucugugucuguauuguuaccaagugguaacuuuugucacgaaacagugauagugauuuuuaguagaugauauaaaaucuccauuaagacgugagcuaaagguucugaggggagcacuagcagaucugcugaaaaugcaauugaacaguuugcauacuaaagaguaaacccuaugaugcccucucuuaacuuccagaagacuugagauagguuuauacucuguuagaugagagucuggaagauuuaucagaggugcacaacagaaaaaaauacagaaucugaaaaauaaacuucauuauuuuaaaauguuuaacuuauaguuacuugaauuuuucuguuauaaagggcuaaacauaaccuuagcauaaaagacauauauuaacacuaguucaaacagaaaguuuaauaaaaaaauguaguuaagaucuacaccauauaggcauaguggcucuuauauaaaaggcauuaauuaacacuagcucaaacuaaguuuuaugaaaauguaacuaaaacucuacaaagaaagcuaggcauagugguuuacaccuguaaaccuagcguuugaguagcuuagaaagaagauugccacaaguucaaggccaaucugagcugcugagugagacccuaucucaaaaacuaaaacaaaguuauauguauguauuuaaaacauggcucaucuguaacauacaugccauuauagugcaaacacagaaugcugguuuaaauucuuuuguuguuguuguuuuguuuguuuggguuuuuguuauuuguuuuguuuuguuuuugagacaggguuucucuauguugcccucguugucauggaacuuacucuguagaccagaguagaucaacuugccucugccucccuagugcuaggauuaaaggcauacacugccaccacccagcuuaaauaaaacauuuuaaaguauaaauuuuuuagugaaauuaggacugaagauguacauauguuauuuaaaagccaccagucucauuuuuuaauuuaauuuauuauuuuguguguauggguguuuuggcugcauguauaucugcacuauuuguguguacaaugccccuggaaaccagaagaaacauugggucuuccuagaguuacaggcagauuauuagccuccauauggguuuuuuaucuuccuagauagauggucaaaagauauauaucuuuuaaaaagauacaugucuaccuccaguuccgaggaauccacuacccucuuuuguucuucaagguuauugcacaugaagauaguguauagucauacaugcaggugcaaaacacucaacacauaaaauaauuuuuuaaaaagugguaucuuagccaggugguagugguggugcaugccuuuaauuccaguacucaggaagcagaagaaagcagaucucuggauuugaggccagccuguucuacaaagugaguuccaggacagccagggcuacauagagaaacccugucuuaaaacaaaacaaaaagugauaucuuuuguuaaucaaagauuuuuccacuuauuuauuagccauuuguuuucuacuuacaucuauguguccuuugaaaaagguuguuggaauuauggcuuaucauucuucucaaauuaaguugugucuggaaugugaaugacacucauggaucuugccuuuuauaagauggugcccuaaguccuugguuguaucccuagaucuuuaugccacguuacuugcagauuuuauagaccaguaguucucaauucugucagaccuaagccuacccucuaaaacaacaauaaaauggaaauucaacaauaguauagaugaauuugcaugcaguauuaacaaugucaauguuacaguguuaaaaggaaguguaggcugggcggagguugcgcacgccauuagucccagcacuugggaggcaaaggcagguggauuucugaguucgaggccagccagggcuauacagagaaacccugucucaaaaaacaaaaaaaacaaaaacaaacaaacaaacaaaaaaaaaguauaaagcuaaacuauaaagcuaacuuaaaguaaugaaaauaauguuccaaaaugaagagacuagcuaaugacuuaaagaagacaguaaaguagucauuuaacaccugcaauucagugugaguuuugcagguacaaaggcgcguguauugaucaguagccuaaauuucaagaauagcauuauuugcaaugacaugauuuuuugaaaugaugaacuguuuacaugguaauuaagcuuaugaaaagcuuaucaauguuaaagcuuaaaaaugauagccaggcgugguggcgcacgccuuuaaucccagcacucgggaggcagaggcagguagauuucugaguucgaggccagccuggucuacaaagugagcuccgggacagccagggcuauacagagaaacccugucucgaaaaaaacaaaacaaaacaaaacaaaaacaaaaaaauguuuuguguuuuuauauaccaagggucuggcuucuaggcuuauaaucuuuuucuauacucgguugucugauggggcauucuaaaauacuguauguuacauaggcuaguuaguuacuuugaaaaacuaugacuauugaauaaauugaugggaauuucugucucuaaccccuucucaauaauugccuauaguauaucccauuucucuuguuaggugaacaugacuacucuacuacaaaaaacauuucucauguugauaacuaaaauucaaaauagccuucuagccacccccccacuuccuagagugcaauacuguccauguuaagaaggauuauucugacccacagccauaaaucagguggacuucaaggagucuuguggaagaggggaguggggggaguugaggaagcuggaggggucaaagacaccacaagaagaccuacagauucaacuagccuaggucuacaggggcucccagaagcugcgucaccaacuagggaguaugugggggcuggauguagcaaauugcagcuagggcugucuaggucuguucccugccauuggauccuuuucucccuaccugggcugccuaauugguccuuagugggagaagaugugccugggacuagaugucccaggguugagugauacccaaggggggcucccccuucucugaagaggagaggggacaauggaggagggauuuguaagggaggaaaggaggugggagcugugauugggauguaaaguaauaaaaaaaauauuggagaaaaaaauagaaacuuaaaaacaaagaugggagggcaugcuggagagauggcucagugguuaaaagcacuggcugcuuuuccagagguccugaguucaauucccagcaaccacaugguggcucacaaccaucuguaaugggaucugaugcucucugcugguguaucugaagacagcuacaguguacucauauacauaaaauaaauaaauaauaucuuuaucgauuauuugaacauuucacaucauauacccugaucaugcucacugccccguccucuguguccacuccccaucccuuuuagcaaugcccguccguccguccguccccccaccccaaaaaggaagaaaaagcaaauccauuuugugugguccauauacucaguguggcauggucaggcucucacggguuacuuuacugucuguuuugugauaauacuuuaauuuacagugguauguaauacaaauauaguaggcuuauaaucuuauuuuaaaaugccuggauaaugaaguguacuuucuuguguuucuucuuuucauuuagcuccugggcuauagugaaaagccaauaaaucuacagauguuuauuggaacagccgaugauagauauuuacgaccucaugcauuuuaccaggugcaucggauuacuggaaagacaguugcuacugcaagucaagagauaauaaucgccagcacaaaaguucuggaaaucccacuucuaccugaaaauaauaugucagcgagguauuuuuuuuggauuuugguuuugguuugguuugguuuuuuugagauggggucucauuauguagcccuggcuguccuagaacucacucuguagaccuugcuggccucagacucagauucaccugccucuaucuccagccagcuaacuuaaaaccuuugcuaacacgaguaagcucaaugguuaaaaucccauauucuucuuccagaggacuagaguuguguucucagcacccauuucaggcaccugacaacugucuauaauuccagcuuccaggaucucugauacccauagccaucacaggcaccugcacucaugugcaucaacacgcucacauaauuaagaauaagauuaaaaaaaaaaaaaaccuaaauuaaaaaaaaaaucaguuuuuuuuccuugaaacaaaacugcaugguuuguuuggcuuuggguuuuagcuaacuacaaaaauauaaaauuguuuaaagcuaacugacuaacauuacauaaguaauucugaaaauuuugcucaggagaacaguaaguuuccuauuuccagaaagacaguuggugacuuguaccuguaaucccagaaggcaggaagaacaggaguucaggguaauccucaacuagauggugaauuagaggacagccugagcuauauguacaagauccuaucucagaaauccagaaacaguagacgggguaguggcucauaccauuaaaagucuuagcauuucagaggcagagguagauggaucucuuugaggucugccuaacuacauuuucaguucuaggccagccaagucuauagugagauauugucuaggaacaaacaacauaaucucagcacuugggaggcaaagacaggcggauuucugaguucgaggccagccuggucuacagagugaguuccaggacagccaaggcuacacagagaaacccugucuggaaaaacaaaacaacaacaacaaaacccaacaaacaaacaacaacaaaaauacagaacaugguacuuuaaauaucuacgcaaagccucuuccugucuucaaaauagggcuaaugugaaugagucaauguuauaccugauugaaaauucaaguuggggcuggagagauggcucagugguuaagagcacuuacugcucuuccaaagguccugaguuuaauucccagcaaccacgagguggcucacaaccaucuguugagaugugaugaccacuucugguaugucugaagacagcuacagcguacccauauacauuaaauaaauaaauaaauaaauaaauaaauaguuuuuuuuucaauuuuuuauuagauauuuucuucauuaacauuucaaaugcuauccugaaaguccccuauacccucccccugcccugcuccccuacccacccacucuacuucuuggcccuggcguuccccuguacuggggcauauagaguuugcaagaccaaggggccucucuucccaaugauggcaguuuaggccaucuucugcuacauaugcagcuagagacacaagcucuggggguacugguuaguucauauuguuguuccaccuauauauaggguugcaggccccuucagcuucuuggguacuuucucuagcuccuccauugggggcccuguguuccauccaauagaugacuguaagcauccacuucuguauuuaccaggcauauagcaucauaagagacagcuauaucaagguccuuucagcaaaaucuugcuggcauaugcgauagugucugcauuugguggcugauuaugggauggaucccuggguggggcagucucuggauggcccauccuuuuaucucagcuccaaacuuugucucuguaacuccuuccauggguauuuuguuccccauucuaaggagggacgaaguauccacacuuuggucuuccuucuucuugaguuuuguguguuuugcaaauuguaucuuggguauucuaaguuucuuggcuaauauccacuuaucagugaaugcaucucauguuuaauaaaucuugaaaaaaaaguuaauuuguuuguauauaccucuaauccuaacacuuagaagucuaaagucaggacaacuuuugaguuugaaguuauuugggcaacaaagugaaacccuaucucaaaaaacaaaaacaguaguuuuuucaaacaaauuuaaaauuguuuuuuguuuuugagacaggguuucucuguauagcccuggcuguccuggaacucacucuguagaccagacuggccucgaacucagaaauccaccugccucugccucucaagugcugggauuaaaggcuuacaccaccacugcccugcaaaauuguuuuuaaagauuuauuuuauauaugugaguacacuguugcuaucuucagacacaccagaagagagcaucagagucuauuacagaugguuucgagccaccaugaccuuucugggaauugaacucagaaccucuggaagaacagccagugccccacuuggggaaucccucccauaaacaaccaccaaacccagacacuauggcagauaccaacaagagcuugcugacaggagccugaaaaagcugucuccugagaggcucugccagugccuggcaaauacagaagugaaugcucacagucaucuauuggacggagcacagcguccccaaugaaggaacuagagaaaguacccagggaguugaaggguuuugcagccccauaggaggaacaauaugaacuaaccaguacccccagagcucucugggacugaaccaccaaucaaaaaaaaaaaacacauggagggacucguggcucuagcugcauauguagcagaggauggucuaacuggucaucagugugaggagaggccuuuuguccugugaagguucuaugcccaaguacagggcaacgccagggccaagaagugggagugggugggaaggggagcagggggagggggaacuggauaggggauuuucggaggggaaacuaggaaaggggguaacauuugaaauguaaauaaagaaaauagcuaaucuuaacugcugagcaucuacuaucuuaucuaucuaucuaucuaucuaucuaucuaucuaucuaucuaucuaugauucaugugcauggcuggugcccaaagaagauaaaagaagggcucugauccccuguaacuagaguuagacaguuguuagcugccaugugguuguugggaauuaaacccagguuccuuggaagaguggucuguacucuuaacugcugagccauuucuccagcccaauuacuuuauuuuaauuuauuuauuuauuuuaaaaaauccuuuuuaagauuuaucuauuuuauguguaugaguguuuugcucaguuguauaucuguaucauauguauucuggaacuggaguuacagacagcugugagcuaccuuauggaagcugaguauuuuguguauauuuuuauauguguauaugugugugcugagugauguuugugcauacagugcccaagaagaucagaagacugugucagaucuccuggagcacguguuacaagcagcugugaacugccuggggggggauuaggacucaaacuuggaugcucugcaugaacaguacaccccuuaagcacggagccaucuuuagagcuccuuauuuuuggucuuaauuaaguaucuuccaaauauugggauuauuagaaugugcuaccacacccaccccaaauuuuucaccuaauuugggguacagaguucuuucuggaaauuuuuuguuguuuugagagauagucucuucuaacccauuuuggccuugaacucauagagcugagacugaccuagaacuccugauccuccccccucucuaccuuucuagugcugagauuauaggugugcaugacuggcaaauugacacuguauaucuaugccacugaauuguucagaaccaguuucugacuaauaaaauuuaaaauguauuguuuuuuuuucuaguauugacugugcagguauuuuaaagcuccgcaacucagauauagaacuucgaaaaggagaaacugauauuggcagaaaaaauacuagaguccgacuuguauuucgugugcacaucccacagcccaguggaaaaguucuuucucuacagauagcaucuauuccuguugagugcuguaaguaaccuuguguuguguuuuaaaauuuccauguaaguuuuguuuuuggggggguguuuguuuguuuguuuguuuguuucgagacaggguuuuucuguguagcccuggcuguccuagaacucacuuuguagaccaggcuggccuugaacucagaaauucgccugccucuaccucccaagugcugggauuaaaggcaugcgccgccgccgccaccacccggcuguauuuauuuuuuaucaaaaugggauauaaacuaaaaauacagcgagucugaguugcugguuuguuuuucugacaugaaaauaaguuaacaagguaaaaaagagugcuaauuuuagguuagaaauguuuucucacuguaguuugauucuaggcagcuauacggcuguagagaagcucuucuugccucuucucugccucccucucugucuugccuccaacuuacauuuuuuucuagcuccugccugaagccuguuggaauugaguauagguuuguaccaccuucucuaccuguaaaugaaaguauaugaggauccuguggugaagcugugaucuugaugcuuuuaguugucacuugauuaucuuucaaguguuaaccuuaauauaauagaauucuguuuugcaggcuuaucccucagcugaauaagaauuaaugggguugauugguugguugaagacaaggucucacaauguaauacugguuggccuagaacugucucuagguagauaaagcugaccuugaguucacagagacccaacugcugcugccuuuugaguauuaagauucaaggcguguauaaacccaugcuggguuuauaacaagggcucuuaaacacugagccaacucaauagucucugccuuuuauuuuggaauacaaagucucauguauggcaaucuggccucaaauuuacuccguagcugaguaucaccuugaguucauauacuucugucugugucucaagugcaggaguuacaggaaugcaucaccaugccagguuuguguagaucaaaucccagguccugggcaugcuaggcagcaucuuaccaacugaacuaccuccccacucagacuacauggacucuuaauuggaggucacauggaauuauaaaaucuuccuuuugucuguuugguaguugcugagucaaaguuaaauuuuaucaucucccaaaugaauguaagaaugccugagaaaaucuuguugauauaacuuacuauagaacaaguuuagauauuuuaaaaaguaauauggguauaugguacagaauuuauaauggguuuagggacaugugucuguaauuucagcacuuuggaggugaaagcaagaggaucaggaguuuaaggucauccucgacuacagaugaaguucaggaccagcuuggacucugacucaaaagagggugggguggggaaacuauauuguuagcuguuaaagaacagaaaguagcaggaaaagguggaauaaaaacuuaaguaauacuguacauuagaaaucacauuauagccaggugucgugauauacaccuuuaguucaacgauuugggaagcagaggcaggauuugggaaccaggccagccuggucuacagagucaguucuaagacacccaguguuaugcagagaaacccugucuugaaaugccaaucaaucaaucagaaaaaagaaaaaagagaaucggauuauguuccugaaauccuguggaaguagaaaaauauagucauugcagaaagucauuguugcuuuuagaaauuaaauaguaaaauaugucucccauuauguuuuaguuaauuuauuuuaaaaauuauccuccauagaaguccauguugccgggcgugguggcgcacgccuuuaaucccaacacugggggcggggcgcgggggggggggggcagaggcaggcggauuucugaguucgaggccagccuggucuacaaaaugaguuccaggacagccagggcuagacagagaaacccugucucaaaaaacaaaaaacaaagaaagaaagaaagaaagaaagaaagaaagaaagaaagaaagaaagaaagaaagaaagaaagaaagaaagaaagaaagaaaagaagucuaauguuguaaugagaaagaguuguuuggucuguaggaguuacuuagaugcuugucuugucucaauugaucauaguuuaauuacauauuuuggacuugauuuuuauaauuauauuuguaaauuguaacaguucuauggauggcauauacuugaguuaaauuaaaaaaacaaaauauuaaguaaauguaugggagccaaugcauuaguuagaaacauuaauuucucuuuuucagauuuuuuugcauuuguacucuaaaauaauuucauuucaacucaauauaacucuguuucuaaacauuuuagcuuuuuuaauaagaauuauuaccaauguuuugauuuuuuuaaagauuuauuuauuauuuauuuuauauauaaguacacuguagcugucuucagacacaccaggagagagggagucagaugccauuacagaugguuguaagccaccaugugguugcugggauuugaacucagaaccuucggaagagcagucagugcucuuaaccgcugagccaucucuccagcccccuaguguuuugauuuuuaaaagccuaaauuaauuaauuccaauguuuauuuuauaguauggacauaucuugaaugugugaaauauuuuaaaauaauauuuuguuuuucuuaacuacuaaaaacagcucagcgaucugcucaagaacucccucauauugagaaguacaguaucaacaguugcucugucaauggaggccacgaaaugauugugacuggaucuaauuuucuuccagaauccaaaauaauuuuucuugaaaaaggacaagguaaauaauauaaaauacaaauuaacucaguauaagugauuaaagaaggaaauaaauuaaguagauauuucaguuauauuaaucaccaaauagucuucauaaaauuauaggcauccuguaagcaacuggguuuuauugaaaacuuacaguuacuaaauucacauguauguguuaaauucucuuuaauggcauauuaaaaguaauucacccagcauuucuacuacaugauguucacucaggaaaccugggacauauguccacacagaggccgagacacagaugccuauggcagcguuguucauaacagcuccaaaggaaagaacaaaauccuuacugacugaugagcagacaaaagcaauaugcuguguccacaguacccuaguuucuucucucuugcuuugauaaaauacccagacauuuagguaacaaaaggaguuugguuuauaguuccagguuucagcucugugggaaguaaaggcagggauucaggcaucaaaucacacccacaggucaagacagucccucaccucaugccacaggccagcuugguccagagagucccuguguagacucuucagaugauucuagguuguaucagauugacaacuaaaacucaucgucaugcauaagugaaauauuuaguauaaaaaagggaaauacuacuaauguauguugcaauguggauaaauauuagagacauuaaaagaagccauaacagaauacauaaaauaagcaaaucauagaaguaggaaauagauuuagagcuuugcaguuaugcaagaagugaccagggaccauaaaaauggucuagaauuaguacaacucugugaauauccuaacuaaauuacauagagauaaaauuaacaagguauguucuaaauacuuuugguuaguugguuugguuaguuugguuuguuuuucaagacagaauuucucuguguagcccuaguugucauggaacucacucuguagacuaagcugaccuugaacucagagaucacccuugcuucugcugggacuaaaggugcgccucccacccaccaccaccuucaccaccacugcugacuuggucuuaaauucagcccuuaaacugaucccgcugcccucuacuuucaaggcuggaauaucagccaucugcccccacauugagccccuuuucuuuaguuuuauuuaagauuguuuuucucuucauguuugaaguguguuuugaagguauauauguuuuguuuuugugcauguuuuggaggccagagaucaaugucaguuguuuucuuuaauuauuuucuaauuugggaggagaggagagagaaaaauuucucacuagcuagcuguuaaccuggacccccuaauguuguucuuucuuuauuauuauuauuauuauuauuauuauuauuauuuuagauuuuauauauguaaguacacuguagcugucuucagacauucuagaagagagcaucagauuucauuagggaugguugagccaccaugugauugcugagauuugaacucgggaccuucggaagagcagucagugcucuuaaccacugagccaucucuccagcccuucucauuauuuuuuaauacuacauuuucuuuuuuuguuaguugggacucuugugagaaaaaaauucccucugccaauauuuugugauacuacauagauuagauuuucuguuuucaaacuuaaauugcuuuuaacuguaaauuuuuucuuuuaauagauggaagaccucauugggaggcugaaggaaaaauaaucagagaaaaaugucaagggguaagaaauuuaccuuaauuauuuaauuaguuagaaguauuuaaaaaggggcuggagaaauggcucagugguuaagaacacuuguuccuuuugcagaggaccaggguucaguucuuagugaucacaugaugguucacaaccaucuguaacugcaguucugggacauccaaucucuauuucugaucuucucagaaaucaggcacacacgugugguacauaauacauauguacaggcaaacaguuuuucacauaaaaucuuaaaaauauauaauucuuaaagaaauauuuuauuaaaaaaguaguauuuaaggacagacauggugacauaugccuuuaaucccagaacaugggaggcagaggcaggugcuugccugugaguugaaggaggccagucuagucuugauagugagacuaucuuccuaguguugaaggaaguauugaagaaacuuaguagaaaauugaauaauguaguuuuauaguaugggaaagaauaaugagaaaaagaaaaauaaauuagaguuucuauuacuuuggaagugugauacuuuucugguauucauauuaaaguuuaaaaaaauaaauaaacaaaccaggccaugguggggcaugccuuuaaucucagcacccuggaggcagaggcagaccuaaucucugaguuuaaggccagccugguguauacagugaguuccagaauagcgagggcuacccugucuugaagaaaauaaacaauauauaucuucucuucuguguggaaaaagaaaaaaauugaaaaugaaaaauuagaaauggaagaacuuucauaauaaaaaugucacuaugcugagaauggugccccacaccuuuaaucccaauagaagcagcagaaucucugauuuagaggccagcuuguucuucauggggaagucuaggccagccaaggcuacauagugagacuuugucucaaaaaagcaaagaauguguauaguaugguagcuuguaacuacugcacucaaggggcagaagauggagaagguaggucugaggccaucugaggcuaaauaacaagucuaaaacuaguauguuccuccuaggcccccaaagcaacuaugcugucuaguuuuaugucaacuugauacaagagcuugauacaagagggcacuucaauuaagaaaaugagaacauuauauguauguguauacacacacacacacacacacauauguacauauacauauauauauauuuauuuauauacauauauauaaauuguagccucaauuaagaguauagaaugcuacaggcugugagcaagucuguaggacauuuucuuagugauugaugugggagaguccugcucauuguggguggggcuaucguaagcagcaccugucaguguccucugcauuggcuccugccccccccccuuuuuuuuuuaauauuucuuuaucuuuauuauauguaaguacacuguaguugucuucagacacuccagaagagggagucagaucucauuacggaugguugugagccaccaugugguugcugggauuuuggucuuuggagagcagucgggugcuuuuacccacugagccaucucaccagccccuccugccccuuuugaguuucuguucugacuuccuucaugaugaugguaauacaaaaguauaauccaaauaaaucauuucuuuccugaguugcuuuugucaucguggggguuuuguuuguuuguuugguuuuugucaugguuuuuuaacacagcaauauuaauccuaauuaggauaguaauguacuucuuuuugaguaggcacaacccuuuucucaauaaauaucaacuuugcuuguagugggacaagccccuaauuuguauuuaauuugucauuaaauacacuuccuaacaccagagcuacucauuaagccauuaagcuuuccagaauccuuacuagaagaaccuguggucuugcaucuugacuggaauagacaacaguuuucucuagacuaguaaauagcacuuuccaaaauacuuccuaaagacuuggaacagucagauugauuagauuugauuuuggauaaagacuuucacuuugugcguauagguuuuauauacuucugacuuagauguuuugaauauaaaacuaaugcuaagaaaucuaaacuagaggcuggagauauggguuagcaguuaagagcacuuguugcuguuuuagaggacuugaguuuggcccccaguacucaugagguggcuaaccuucucuuaaccccaguuccagaggauacaacaucuacugaccuuggguacugcacacauguggugcacaaacauacuuguaggcaaaugcuuauuuaaauugaaaaaaaacuauauauaauacaacuugcgaaguguuaaucaugaucauauauucaaguaggccuccugcuaagguauuuauaguaggggcuggagagaggagagauggcuuagcugguaagagcacugacugcacuuccagaggucuggaguucaauucccagcaaccauaugguagcuuacaaacauguguaaugggaucugaugccuucuucugguguguccugaagacaguguacucauacguaaaauaaauggggaaaaaaaguguacacacacacacacauuaacaugaguguucaguagagccauguauuucaguacauacauaguauauaauaagacuuuauuuuaaaagguauacaauguagcucaggcuggccuugaauuuaucuaucuauuucuaccuccugaguacuguggcuacaaauacgcaucacuaugccuaaagucucuuuauuuuugcucucacuagaagcacaauggguagguaaaaaucaguuucuuuaaucauuaaagauuucaucuuugucaacaaaauauucguguaaauaaaucuccaaaugacuuauuugacaacuuuacaugcauaauuuucugugauggggaaacacuugcauuaagaguuucaugaauugcuuugaguuuggcaggugcauuucauuuuuaguucuuaguauaacacagucuuccuuuccuuguuccucaggcucacauuguccuugaaguuccucccuaucauaacccagcaguuacaucugccgugcaggugcacuuuuaucuuugcaauggcaagaggaaaaaaagccagucucaacguuuuacuuacacaccagguacaagaaguugugaugauuuuaagaguuuucuuuuauaauaagaaccuuguauuaaauguuucauguaaugccaacauauuauuuuguuguuuuguuguucucuguguagccuuagcuguccuagagcuugcucuguagaccaggcuguccugggacucagagaucuaccugccucugccucccaagugcuggcuguaaagguguguaccaccauucccuagcuuuuguugcauuucguuugacaagucacaauuguaccggccuaugagcuauggaggguauaaagucaacgucaagaguuacccacuggggcuggagagauggcucagugguuaagagcacugacugcucuuccgaagguccugaguucaaaucccagcaaccacaugguggcucaugaccaucuguaaugagaucugauacccuuuucuggugcaucugaagacagcugcaguguacuuggauauaauaauaaauaagucuuuuuuaaaaaauguuuuguuuuuuuuuaaaaagaguuacccacuaaccaaaacagaccucuuuuugcuauuaaauuuuccaguuuuuuuuuuauuaugaccuaaguauuguauuuaguaauauauacuacugguuaaguacuuaaagaacaaauauuuauacaggucuucucuguggugggcacugggcuugucaccaaggcagaugugaugaugaugaugaugaugaugaugaugaugaugaugaugaugauguaguaacgaaccuuugucugcaagaagaaacuuuaaaaauuuaauuuaaaauuuuaucuuauauguacggguguuuuggcugcuugaaugucuguguaccucuugcauacugguguugguggaggccagaagagggcuucagauccccuguaacuggaguuauagagaguugaagucccaugugaguguugggaauugaaccucaauuucucugcaagagcaaccugugcuuuccagacccucuugcaaaaacuuuuaccuuuuauauuaagaaaagaguuggcauuuuauuugauuguugauuuagaaguaguuuuuguuuuguuuugucuuuucauuuugagacggggaagggcucacucuguagcuggccugggauucacucuguaguucagacugaccuaaaacucuuggugauccuccaucucagcuuccucagugcuaaaauaauagguauaugcuaccauguaauacuggugauuauuaaggguuacucauuugucauauauuucauuuauagucuguaaagacuuuauauuuucaguucuuuuuguuguuuguuuguuuguuuguuugaaacaggauuccucuguguaauuccagcuguccuggaacucaguagacaaggcuggcauugagcucacagagaucuucuugcuucugccuccuauaaggcauacacccccaugccugacuuguuuucaaaucuuagucauacauagcucugugguuaauggugucauggaauuuuaugagaccuagaagacacaauguguuaacagggaggagacaucauauucaggucuugggauauagccuguuuacuuuuagguugugguuuuuaauuggugguauuugguuggcugauuuuuguuguuguugguggugguguguguguguguauauauauuuauguauguauagauaauaaaaaauaauaaagaauaucaaauuucugccuaguagagguaggcagauaucuuaaauugaggccaaccuggucuacauagugaguuccaggacagccagggcuacauaaagaaggugaaaaggaauaagauuuuaaaauauagagguugaagucaggcauaaugguacauuuauguaaucacaauacucaggaaguaagacagagaagaauaucgugauuguuucuccuggccuguguaaugagaccauggcucuagcacacugugguuuggguagaccgaagaggauaacaacucugagucccauacucaugaauuuguagggccuagcucuccugguuguauuuacuuuaagguugugggguuuguuguuguuguuucuguuuguuguuguuguugguuugguuuuuuuguuaguuuguuuuggcuguuguuugguuuuuguuuuuguuuuuguuuugagacagucucauugacuggcuuggaacuccugaagaucugccugucucugcuucugcuuccugaguguugagauuaaaggcaugcaccaccaugcccgguuguguaacuuucuguugcugcacucagaaguuaaaguacuguugugaugaaacucaucucuguccugaauaaggaagaaugcuucugugauugcaaaaaauaagcacuaugaucagcaaauuagagguauugauuacuuccuaauagugguaguaauuaaagggcaaaagcaaacaggagaggcuaugcugcuuugauuccaucucaugaauuaggaggauacuauaaagauauaauuuauuggcauuauguaucaaaaugaaaaucacuagagacccaggauggagaacaacauuggauuggccuagaacuaccaccaagccuuagccuugaacuugcuguguagcacaguaugaccuuaaauuuccagauucuccucuuuacuuuauaaauccugggguuacaggaauguaccaccacauucagcuccuuugucuccuuuuuaguucacaguaagcagccaguuacauagccaagcucuccacuuagccgaguuaagggaugagaguagucagccauccugccugccuucucucuucuccccccucccccuauuucauuuccuagccuguccuguuuucuuccuuuaagauagggucuaacuuggaaaucagagauccaugugccucugcccuuugagugcugggauuaaaggcaagugucacugagccuggccauguauauugguuuuguguauugcaguguuuguugguuucuuauagauuuugguaguuuuucauuuuuacauuuuuuuuucuguuuuuuguuuuguuguuguuuuguuuuucuuuagacagggacuggauagcccaggcuguucucuaucuuuguucuacugaguacugggauuacaggugugugcuaccucaugugguuuucaguuuuucucuugauagucacacagugguagaggaucagaccuaucacaugagagguauguuucagauugagaguccuagauucagugccuuauaggucauaggauuauuuuugguguguuuucuuguuauuuuuuauuuagcaaucauccucuuuuuuuuuuuuuuuuuuuuuuuuuuucuuuuuuucuuuuuuuaagacaggguuucucugaaaucuuggcuguccuggacucccucuguagaccaggcuggccuugaacucacagagaucugccugccuuugucucccaagcacuuggauuaaaggcaugugccacuacuacccggcuguucaucucuuuuuaaauuauguuuuaagcuuuucucauguauaugugcacauccaaaaauuaauuucugagugauaagcacugugcuugcuguuucccaaauuuggaggucggaggacaaccucaggucucaggugucaggccuugccuuccaucuuguuuaagagagggucucuugggaggcagaggcaggcagauuucugaguucgaggccagccuggucuacaaagugaguuccaggacauccagggcuagacagagaaacccugucucaaaaaacaaaaaaaaauaaaaaaagagagagucucuguuuaguuuuugagcacugcuuaugucagacuagcugguuuaugagcuucuagaacuauauauacauauaacaaauaaaacauuuuacaugaacuuccuucucuaaagacauugaguucauccccaucguguuaugguuccaaacccuagaauuauagaauuacguugucauaaucaucuuguaagcuauauaauaaugcuugcuuuaacccuuuacuuuucaguuuugaugaagcaagaacaaagagaagacacagauuugccuucaguuccaucuuugccugugccucauucugcccaggcccagaggcccuccucagagacagggcacccccaugaccgugcgaugucagcaccgggaagccugcuuugucaagugcagccagcauauacaucuaugguagccuccacccauuugccacaguugcaguguagggaugaaggugcugguaaagagcagcacauagcaacaucuucagucaugcaccagccuuuccaaguuacaccaacaucuccuauagggucuuccuaucagucuauacaaacuaguauguauaacgguccaaccugucuuccugugaauccugccucuagucaagaauuugacccaguuuuguuucagcaagaugcagcucuuucuaguuuaguaaaucuuggcugucaaccacugucaccaauaccauuucauucuucaaauucagaugcgacaggacaucucuuagcacauucaccucauucugugcaaaccccaccucaucugcagucaaugggauaccauuguucaaaugcaggacaaacagcucuuucuucuccaguggcagaccagaucacaggucagccuucuucucauuuacagccuauuacauauuguccuucacacccaggaucugcuacagcagcuuccccagcagccucucauccucuggcuaguucaccgauuucugggccaucauccccucagcugcagccuaugccuuaucaaucuccuagcucaggaacugccucaucaccaucuccaacuaccagaaugcauucuggacagcacucaacucaagcacaaaguacaggccaaggaggccuuucuguuccuucauccuuaguaugucacaguuugugugacccagcgucauuuccgccugguggugcaacugugagcauuaaaccugaaccugaagaucaagaaccuaacuuugcaaccauuggucuacaggauaucaccuuagaugaugguaagucccagcuccuccccaccucgcccuacuuacccuaccuugugaauguguguguuuauguauuuugaguuaggcuggccuugaacuuacuguauaguggagagugaccuuaaauuucugauucucccaaguguuaagaugacagguauguaccuccagacccagauaguauuagagauugaacccuaggacuugcagaacuggagcucagugucagcucaggcugaccucaacuguauggugaucuuucucccucagccuccuaaugcuggaaagauaaaagugaaccaccacauauguuacguguaacacauuauauaguuaucuguagccaucaucuagugaaaauccuaaagauuccagagcuagauauagauuuuuaguuuucuuucuaauucuauauuaaucugucuuaggaaaauaauucuaaaccagcuaucuagaucaggaacugaccuagaccuagcuugucuccuguuacagguuuguagcuacacuagauccauuccauaauggagaaacugucauuaaauaucaggucauaggacugaaguguugucucuccaacuagcuuauaacuugauuaacccauguauucuagucuaagccugccacauggcugguuacaaauucucaguuucauacaucucacucuaucccagaguaccuuucucccuaugggaacucucaccuccuauucccuaccucagcuucuuggccaaucagcuuuuuauuggcagaugauguuuccauacaguacacaaaagaaucucucuacauacccaccugacaguucauagccuguaacuacauucccagaggauccagugucuucuuuuguuuuuuugguuuuuugagacaggguuguagguacuguauguggugcgcagacauacacacaagcaaagugcucauauauguaaaauaaaaacaacaaaaagugccgggugugguggugcacgccuuuaaucccagcacucaggagucagaggcagguggauuucugaguuccaggacagccagagcuauacagagaaucccugucucaaaaaacucaaaaaacaaaaaacaaaaaacaaaaaccauuuaaacguaaaguccuuagaacaaagggcaaagaaagcaauauguaaccuguaaguuuuuggggccugcuauucacaccuaauaccugauuacaggcagucagaauuacucuaaccaaaguauaaaagauccacauacuacuagaagguuaguagagauauguaugacagauucauaggaaugacuucacaaggcuuccauaagucagugguauuugaagaugaauguauguuuuuaauaaauucgaaucaaugggcaacucacauaauguaacuuuggcaagggaacaaaugguacauuagaggauaguuuucaaagacacaagggagauaucccaggucuguguuguaaacauaaaauguauauguaaacuagagcaauucaaaguagcaucuuucuauugucuauuuccgguuaucugauucaguucuuaacauuucugcuacuuaugagcagguggucugccuacagugucacacuagucauaguuauugcaguagagcacaggcuagauucagauuuguuuauucuagacuuagcucuuguaccacuauagcugcagcucagugugauguggaugauaagagcucuuuguuaaagguauccauagagccgggcauggugaagcacaccuuuaaucccagcacuccggaggcagaggcaggcagauuucugaguucgaggccggccuagucuacaaagugaguuccaggacagccagggcuagacagagaaacccugucucgggggugggggcggugggggggacccacaaucuaaaaaacuaacaaaacauucccagauugaagcaucauagaagacagacuggcuauugaauuuuucauugccaugcauuggagaguugauuggugucgagcuauaacuggggggaagucaacaguacucugggcaccgcagauacugagcuguucacucuuccagugaauuucuuuucagaugcauauucuaggcuaguguguuacuguagagccaaauuuccagccauuuguaacuugacuucuuguuugaauuuucugugaauuucuggguuuuuuuguuuuguuuuuuguuuuguuuuuguuuguuuguuuguuuuuuugguuuuucgagacaggguuucucuguauagcucuggcgguccuggaacuuagaaauccgccugccucugacuccugagugcugggauuaaaggcgugcaccaccacaccuggcuuuuaaauucuuuuguuguuguuguuguucuguuuuuugggguuuuuuuuuuuucgagacaggguuucucuguguagcccuggcuguccuucuguuguuuuuuuaagacaggauuucacucuauaaagagugcuggccuuguagagaggcaccugccuuugcaucccaagaacuagguaagaugaaagguguguacuuuuacaccuggcccauuugucugcucaggagagaauuuuuucuugagucuuucuaugauuuuaaggccagacuggucuacagugugaguuccaggauagucagggcugcacagagaaacccugucuuggggaaaaaaaauacuuggggagaaaaaaaaaaccuguauguuauacugcauuaugcuuuagauuuuggaccaauugauauauauuaaaacaugauuuuuauaacauauagaaauacucgguuauguuuuaaacuuuuaaauugagauuauuuuauuguguaaaaguaucuuuuacucaucugaaguaauuauugucuuggagguuuacugcugaauaagcucacccuuucuagcucguucugaugucugaccagcugguucaaacuaguuucucccagcuuucugacugaauuguucugcuugaccucaaacuuaacucuagaaaccuaucuaaucuucuggcuccucauucucuguaaaacugcuucgucugcaccaacugaacugaacucaaaaacacgcuccacuccacuccacuccacuccacuccacuccacuccacuccacugcacuccacuccacuccacuccacuccacuccacuccacugcacagugcagagcaccagccuuaagugacugaacuuacagaacugcccuccaacuagagaagucaccuucaaacaccacugcuuccuucugcauacuaaccuuacuuucauuguuuggaauuaaaggugugcacuaagggcauguuuguauuccagccagagggauuaaagaugugugguccuuugccagagcagccauguuacuggauuaaaauuccucugugguauuguaaaacuagauaacuagacuagugguucuuugcuuuaguuugugauugaacuaacuaaauucuguuaaaauuguccucuaauuuuuccucccauugucuuccuuuguucuuagacuaacagcacagcugcagcucuuccuucagagaagaggcugcacauuuaauguaguucaaacagcugcuguggugagacugucacugccacugccacuugcuggcucugugcaacagcaugcugacccugaauguagggcaggugcugauugacaguuaacgcucuagauaccacucagcugcuucagcucucuauauaaguguugcuuauagggggcuggagggauggcucagcaguuaagagcacugacugcucuuccagagguccuuaguucaauucccagcaaccacauguuggcccacaacuaucuguauugggauacaaugcccucuucugguguaucugaagagcacaacagugcacucacauacauuaaauaaauaaauaaaucuuuuaaaaaaaaagugaugcuuauagcccaggauuaucuauucauaacuguccuaccucuggcauuucaaaugcugaaauuauagaugucugcuacaaugccuggguuaacgaaugucuuuuaaaaguaaagaauuaauaaacacaagauucacauggcuacuugucagggguguagaagacuauuauggaggaugaguagagagauaauauggcaguguuuagugcaugcauuuauuggauagugguuucgcugguguuuauuauauuuauauaaauauuuuauuauauuuuuauauacuuguguguauggacaggagagacccugggaaugauuguagaggucagagaacaacuuauagaagucaguucucuuucaaccauagagguuucaggaaucaaacucaguaaccaaguuugguggccaguaccuucuaagccaucuugcuggcccuagauaauuauuuaauauuuauuuaauaauuuuauuuaauauucauucaauuuauauuuaauauuuaauaguguuuauccaauuaauauuuaaauaauaaaggaagucauauguaaccaauagggugaggauaucaucaaugauauacauaauuacuccauuuauuauccaucaaugauauauauaauuacuagggguuauaggaagguagguaguauugaauuguuccuuuaaccgaaaugcuaggaccucuuuuggcuacauacaugaaucaucagccuucaaacauauuuaugaugaagacuuuuaaagguugaaagaacuaauaaagaaugcuguguagacugggaauauauagcaaaggguucagaaccacccugggauaugcaguaagaaaaauuaguuucagcuagguguggugguauaugccuuuaaucccagcauuugggaggaagagggagauggaccgcugccagccugguuuauuacauagugaguuguaggacagccagggcuauaaaauaaagagaccuugucuaaaaggaagaaaggaaggaagcaagcaaguaaggagaaaagaagaagaaaaagaaagcaaaauuagagccgggcgugguggcguacgccuuuaaucccggcacuggggaggcagaggcaggcggauuucugaguuugaggccagccuggucuacagagugaguuccaggacagccagggcuacacagagaaacccugucucgaaaaacaaaacaaaaacaaaaaaagcaaaauuaauuucuagauccagugaagaaauauuugauguuauaucaagugaguauauaucuccagaaaaacaauguaguuguagccuuauaaaaaaaaugcugcauauggugguauaaacauuuuuuuuuuuuuuuuuuuuuuugguuuuucgagacaggguuucucuguguagcccuggcuguccuggaacacacuuuguagaccaggcuggccucgaacucagaaauccgccugccucugccuccccagugcugggauuaaaggcaugcgccaccacgcccggcugguauaaacauuuuuaaucccagugcuggagaggcagaggcaggcagaucucugaaguuacauaguauguucuaggacaccagagcuauguauugagacucugucucaaaaaagcaaaacaaacccaaaaaugugugugugugugcauuguuuugucugcauguguguuuguguaccacaauguguuccugagacccucacauuccuugcaacuaaagcuacagacagcugugagcugccguguguguccucggaaaugaaccccaguccucugaaaaguauguagugcuaucaaccacacagccaucucugcagccccaguugguaccuuuauuucuaacaagauuugaagugugaauuauuaggcuuauugguauagacauugaucagagagguaagcauacuuacaguguucugugacuacaaauauuaugaccagaguuugaguuuaaguuuguaaauacucuuuuuuuuguuuuuuuuuugguuuuucgagacaggguuucucuuuauagcccuggcuguccuggaacacacuuuguagaccaggcuggccucgaacucagaaauccgccugccucugccucccgagugcugggauuaaaggcgugcaccaccacgcccggcuguaaauacucuugcauguguuaagucguuucuagaacagcuguaauuaauuucuuggcauauucuggauucuguaaauauaacaauagguuuguaaagucugcucugggaaagauagaaaagucacuuucuuaaagaugcuauucuauuuuauaauuuguauccucuuuucaagguacuuagauggguuuuuuuuuaauuuguugugguuguuuagauuuauuuauuuauuucauguacacaagugcccuguuuuuaugcacaccagaaaaagguaucagauuccauuacaaaugguugugaggggcuggugagauggcucaguggguaagagcacccgacugcucuuccgaagguccaaaguucaaaucccagcaaccacaugguggcucacaaccacccguaaugagaucugaugcccucuucuggagugucugaagacagcuacaguguacuuacauauaauaaauaaauaaauaaaaaaaaaaugauuaaaaaaaaaaaaaaaaaaaaacaaaugguugugagccaccaugcaguugcugggaauuaaacucaggaccucuaaaagagcagucaguacuguuaaccucugagccaucucuccagcccuggagaaagaaaggguuucucuguguagcccuggcuguccuggaccacacucuguagaccaggcuagccucgaacucaccaagauccucuugccuuuaccucccaagugcuaggauaaaaggcaccagcaccaccuggcuggaagauggauuauuacuaggguaaaaguuuuguuuggggagccggcucuuuuauccuuaugccuugguaauauucccuguguccucgaagggaugguauacauaccucacuuagagagcuggagagauuauucagaggauaaaagcacuuccagagaacccagguucaauacccacaugauugcugacagccaccuguuuaacuccagguggagaagaucucugaugcccucuucugggcuccuggaguacugcaugcaugggaugcacagacauucaggcaaacacucauacacaaacaaaaucucaaaaagauaccgcauuuacaccugagcauucaacaguaacuuauucuucagccuguuaugaguuacacuucccuccccccccaaaaaaacccaaaagaauauuuuaacaaguguaaggaauugagguaucaaaauuguuaaggauaacuuuugcaguauuaacaggagaaaccaaucugauaauaagccuuuuccuuuucuaggacaugccaacauaauuggccucaccuaugcuaacauuacagugaauccaaguacgcauuagguaaaucccaacuaauucucgguuaucucauuuucaggguuguaguaauguagucccagauaguugaacugaacuccuuggcaccucgggaggcuugagcaaaaccuucagaaacagagggacucguuauaaacagguucgagaggauguaacuaagucacuggaugaaaaggcauaggaucagucgaccccucuccuaccuugcauagauaccagacacaaaacagguagcauuuaaagccaucaagauuuuuuucccguuugcuacauggcucuucccccugugccuucccucucccugcuuuuggcuaccuuccugcccuccaaugcacaccagccacuguuaagcugaggccaccuccgggcucgugagauugaggucacuuaaaggcccacauagcugccugcgguccacccacagcuccaccauugcguguuuguagccugcagugcugcuugguuuuuuguuuuguuuuuguuuauuuguuuguuuucuccuuaauguaaagcagcuaaacccagagcaagaaugggaacauucuguuacuccucaaccccucccaguuuuuucugaaguagccaaacacucuuuuuucuuccggaaaccaaggacaugucucuugaacauagucuaggaauugaugaagcuacagugcuuccauucuacuucugagguuuaacaaaaucuuccauuguaccaacauguaacuaccuagcuccagauucugcuagguagaaucauugccugucuuuauauucuacuugucccaguguuuuaugccuaacugaaauguguuccccugccuguauuauuuguuccuuuauccuuauuucuucccucuauuuauuuaguuacccguguaagcaugcuucuuacaacagcauucuuuuguguggccaauaagaguucccuguagucguguguccauguucgcggcucugaucaggaccccauccggguaccuuacuggguccuugcacaacucuagggacuugaccugacuggggcaguagaggaaugaagaaauggcagacaugaacacacagggaagcugagguuggguggacuugggcucucugauaaagaaaccuuaguacuccagaaacucagcauguuuuuuauauacuguugaacaggcagaauucuuguacguagcuaaauuaacaagauggguuagcuaaucucaguaggaacagucuggauggagaaagcugugcugaauuguuuccuguuguugcugguggagaucagaagaggguuucagacuccuucaacuuagaguuuacagauguuccucugcaagaguaacaacugcucuuuacugcagaagcugucucucuagccccauauuaaccuuuuuuuuucuuuuuucuuuuucuuuucuuuuuuuuuugagacagaaucucaugcagcuuagauuagagauucuguaguuuucuuaugauuuguuuuguguuguagcucuguaaauggauccaaaggcuuuguguaugcuaggcaauuaucuaccacagagucauacucccaguccucuuagagccucugucugauuuugauacuggauaaugccuugcaaagaguuaggaguuauucuguucucuuugauuuuuuuuuuuuaaaguagggaaggugagugaaaaucacucuuauuuuuuaagauuuauuuuuuaauuaugugugggugagugugugaguggguauuuguacuugaguguguacaggugccuuuggagccuagaagaggguauuaggucucuggagguagaguuucaagccugauaagauucugagauucaaauuugugucuuccauaagagcaauacacgcuuaugccugcuguuuguuuauuuggaagacugcugcuuuccacagagcacaaucuugaaguaugaccaacuuagccccaucccaaaaggccucagugucugcuggccucuuugcuuauuccuacacuuauuucuaauguauauguugauuuauccaaagucacacauuucaccuacaccuuaaagucuguuuuggagguuuacuuuuuaaacaagcacucucagaaaguaugauuuuaauugaucucuuaaaaagaaaaaagaacuuggggcaguaaaaaaaauuacaugacagaguuuuuuaguuuguuuuguuuuuaacucccuugugagaguacauuacuacaaauuggcucagcuuauguuugcuuaagauaggaguauuaauguuuaaggaugcugcauacagauucuguccuucaaaagauuuuuuuguuuuucaagacaggguuucucuguguagccauggcuguccuggaacucacucuguagaccaggcuggccuugaacucaagugcugccucugccucccaagugcugggauuaaaggcaugcgccaccacugcccagcaaaaguugaacucuuacguuugaaguuguacaauaaagacccagaagaguucuuacaggucagaggaacuucuuuucuuaucuacugugauaauuuaaaacugaauuuaccuucuuaaagccaauaaaaacauuaccuuuuuaauucaaaaucaucuauuaugccuggcaaauauuaugguggcacacaccuuuaauccuagcacucagaggcaagaggcagguggaucuccaaauuccaggacagucaaggcuuuacagagaaagccugucuggaaaaaagaacaacaacaacaaaaaaaucauccauuaccuaaacuaucuggauuccaguauuaaacuaucuaauaaaaugugggaagucaaggagaauuuaauuccucuuacucaggaagcaaaauagaaaacaauacugggcaguguaguagauuaaguacaaccucugguuuguuccauucaguagugauguugucuucuuugacacagaccaguuuauaucugacuuggaacaccagccaucagguucaacagagaaauggcccaaucacagugaguucucauguccaguuccuuucuggagaaucuagagggugaguguugauuaaaauguaucauuguucuuguacacuagucugguauuugcaugccauggcuggauuugcaugugcuacaaaggagggguaugcacaggcauccucaugguaggcccggccccuucauugucuuuguagguacacuuucacuuuuauacuuaggcucuuacaccugaucugcaaauuuuaguucuaguuuuuuuguuuguuucuguuuuguuuugacaggguuucucccugcccugguguucuagaacuauucucuguacaccaagcugaccuagaacucagaaauccaccugccucuuccacccgaauguugggguuagaggcaugcaccacuaccacccagcucaagagcuuagucuaguuuuauugagaggcgaauguuuaaauaaauuuguuagaaccaaggagacuucucgguauauauaaaacuuauuuauggcuuggguacuuuguaaguuuguuugcugggcugaugaaauaauucaguggguaaaguacuuacuucuggccuagccugaguuuaaccccuagaacucaucuggaagaagaaaacuggcuuccucgaguuguucacuaaccuccaugaacucaacuguggcaugagcugugagugagcacgcacauacacacacaugcacacacacacugaauacaauuuuuuaaaaauaaaguuuaguagcuggaguacuaagucuauauaguucggaucaaguacuccuaaguuagauacaagacuguaugaaauagaaguagagcagaaaauuguguccaguauuuagagauaaucuagaguauucauccuugaucgcccuuuagacccacauuuguacuccuguaguucaucuguggcucuacuuggaagaacaccaaagccauaguaacagcauagguucugugaaauaggaccaaagccuuuggccucacccucaaugcugucuacagucuucccucacuauuggaucagcuccuuuuucagauucuuuuagagucacuuagaguaugugggugagcauggugguagugccauccuccuagcuaccugcugaggagcucaaguucaagaagugucucagaguugaguuuuguuuguugucgucuccuccgcucuuucuucuaggaucaucucccuguguagcccuggcuggccuugaacuugcaauuuagauuagaucaaacuguccuugaucugcuucugccucugccuccaucuccuaauacuaagauuaaaggcauaugccacuaaauuccacccaaaaaggaaaaugauuacagugcuugucuggcacguagagaaguccuggguucaauucucagugcuggagcgaggggaagcaugugauagaaauuaaaaauacauagccaggcugugguggcccacgccuguaaucccagcacuugggaggcagagccaggcagauuucugaguucgaggccagccuggucuacaaagugaguuccaggauagccagagcuauacagagaaacccugucucggaaaaccaaaaaaaaaaaaaaaaaaaaaaaaagaagagaaaaaaagagaaaggaacuagaaauauguggauuccaguuaccaaaaugccauuugauuuuaagauuguucuuuuuuaugcauauggguauuuugcgugcauguauuucuauguaccacguguuugccaugugugcccuugaaggccaaaaaagugcgcuccuucuucuggaacuagaguuauagcccaugucaguugcuauuaacuuucacuagaaaaggccuuagguggcaugauuaauacucaggauuuuaagauuuuuuauaaaauccuguuuuuggaucuugcuguauguacaucauguguguaugguaucuuuagaaaauaaaagagagcauuggacccccuggaauuggaguuacagaugacuuugcacuaccacguggguacugaaaauggaaucuaucaccuuugcaaaaacagucuucacuccugugccaucucuccagcccaguauuauaggaguuugagaucucuugauuaccagacaaaaccuuagaacccuggauuucugacuucuuuaaaagcuaggacuacucugcuaucacauaauuccugucuaacugugauagaaacagaaguguuuauuccacucauauaacaguucaucaucaaaagcaguuagagccagcaagaacugaagcagggacagaaccuggaggcaggagcugaugcagaggccauggagcagugcugcuugcugcuuuguucccuggggcuuucucagccuguucucuauagaauccaguaccaccagcccagaggugacucuacccaugauugacugggcccuucaaucacuaauuaugaaaaugcccuacauguuugccugcacccugauuuuuggaagcauuuucucaauugacaaaauauacucaucucucaaauaauucuagcuugugucaaguuaacagaaaauuagcacaguauggaaaacuacagaauuuuagcuagaaaacuuuaaauaauuuaguguugggagugguugguguguaucuuuaacuccagccagcacuuggcaggcaaaguuacauuaguagaucucugugaguuaaaggugugcuuggucucuacagugaguucuaguucuaguguuuaaccguuccguguucuucccauauguagaucaccaauuugucaauaaugauguucaucacuaguuauauuggcuuaaaaaaaaguauguguguauagcuaguauauauagugcucagagguuaagagcacuugcucuuucagagaaccuggguuugguucucagccccacaaccugcacuccagcuccugggagucucacacccuuuucugacuuguucaugcauuguuugcacacauguacuaaacagacagaugcaagaaaacacagaugauaguaacuuuaaaaggaugugaagcugugaaaugaaagaaucagauauagagggguguggucuaauguuugauuuguuauagaggguggggucuaauguuugauuuguuagaugugaagggguggggucuaaugauugauuuguuagauauggaggggguggggucuaauguuugauuuguuuguuuguugcuugagaugcugacuuauccaggcagaggcuguugggucucugugaggucaaggucagguuccuugauauauagcaaguuccaggacagccagagcuacauagacccuaaaaauaauauaaagauaaguaaaccuacauauucuguguugccauuaugguauugagcuuagugucuguuuuaagauguguucucaccuuguaaaugccuggucugguacuggaauguacaccaaacuggccuugcauuuagagauucaccugccuuuaccuucugagugucaggauuaaaggcgugggaauaauacuuggucuuuauuucuguuaauaguguaucaaacuagcauaauagggaucccaaauuauaaugaauuaauuagaauaggauucucuuuuuaauuuuuuuaaaauuagauaucuucuuuauuuacauuucacauguuauccuccccuuuccugguuucuccuccaaaaacccucuguuuaccaacccacccacucccacuucagaauaggguucucuuguaucuccuacucguucaguuaagauucuuuuuuccuuuuccuuuuuuuuuuuuuuuuuuuuugagacaguguagucuuggcuguccuggaacucacucuguagaccaggcugggcucaaacucagaaauccgccugccucugccuucaaagugcugagauuaaaggcaugugcuaccacugcccagccuccuuuugauuucuuguuuuucuuucucccaaguuuuaucaaagcaguuaccacuuugaugacuaaaucuuaguccacugagaggaguggaggaaagggcaaagaguaaagccagagggugaugagcaagguauauucucccuuuuugucauaguacaguggagagaucuucaccagcuacacgggcagcugagaagcacucugaaacuggauugccaagugacuagcuaaauaaacuucaguuaccaaugaagacugcaugaugcugcaugugguggugcaugccuuuaaucccacacuugagaagcagaggagagggggcuggugagauggcucagugagcaagaacacugacugcucucccgaagguccugaauucaacuccuagcaaucacauggcggcucacaaccaccuguaauggaaucugaugcccucuucuggugcaucugaagacuacuacaguguacuuauuuaaauaauaaguaaaucuuugggccagagugaacaggguugaccaaagcaagcagaaguccuaaauucaauucccaacaaccauaugauggcucacaaguaucuguacagcuacaccguguacucagacacauaaaauaaauaaaucuuuuuuuaaaaagagaagcagaggagguaguuuuuugugaguuggagaccagccugugaguucuaagguaacuagggcuauguagaaagacuuugucucaauuaaccaagccaaaaaauauugagacagcaaaaaaauuccgauaccugcuaaauauuuuagaauuuauuucugucuuuagcuugagaaggcacauugaucgggcuuuaauaaguuaacaaaaaauauuuuugauacauucuaaugguagcucaaucuauccuugaccuucugauccucccacguccagccuaaauauuucucccauagucucucccucccaucugccaauccaguuacauacaggaugucucuaguauguaacucugguuguacuagaacucacuaaaguucacaaaagauccaccugucucuuucucugcugggauuaaauaagaguccaaauaggacccaaaauccauuacaaagaugaaagaaaggcccuuugaaucaguccuuaucaccacccugggcaaaaaagggaaggaaaaauuauuuugacagaagguagaggcaagagugucucuguaaauuugagccuagcuuggucuacauagcuaacuccaagaaagcaaggaauauguagagacccugucucaaaaaacaaaccaagccagguggugguggcccacgccuuuaaucccaauaccccagaggcagaggcaagcagaucuuugggaguuccaggauagccagagcuguuacacagaaacuggggaaaaacauacccaaaagccucuugaguuuuuguauauuuguaaguauuucaaagauauacccuggucaccuuguucguccucaucugauuuugagggguuuuguuuguuuguuaauuuguuuuuucaccauaccaguuauugugaaauacaacuuuagauucuuuugcaugggaaguauccuuaaagggaggccuaugacuauauaacacccuguucugcuguggaggacauuucagagcacugcuaauuugaccauuuccuaaggaacauuuuguugucauuacuguuuuguuuuggcagcugcagauacugcugguguuuuuuacuuguguugugcuggcacagacaaauucagguguugggaguuaagaguugugagcugcuaaacugggccagaugcuaugaccuacauaaucuguugguacugguaguaaagacuguugacuuuuugggcuuuuaguucauuucauucuuugaagggaagaaaauggcuagacauaguaucacacaccuuucaggaagaggcugguagauaucugaauucaaggccagccuggucuacaaagugaaaccccgucucaauaaauuuaauacaaggagcugggcaugguuguacacaccuuuagcucuagcauucaagagucaggaggaucucugaguucaggccagcuuagagagaguucuaagacauggagggaugcauagagaaccugucucaaaauaccaaaaacaaagaagaaaaugguacaguagggaacuaaauaucucuuuuaccaucugaaaauggcagaaacauguaaagcaucguauauaauugaugaacuaugauacaaauaagugaaugaacacauacauucaaaugaagugaaaauugaaguugcuucuggauaugauggcaccugcuuguaaucccaggagggagggagagaagggguaaagagaagagacgagggagagagaguuuugaauacauauguauaggcagagagagagagagagagagagagagagagagagagagagagaggauaugaauuuaguucuucacucuccaccuuauuauuuuaagauaagucuuucaagcuaggcagacagcuaacaagccucagagaucauccuaugacucagaucagcuugcuucugccucucaagucagaaauaguuuuuuuuucuuuuucuuugacuuuuuuuuuaauuuuauguacauugguauugugccugccuguaugucaaugugacauacauccaagggaugccagauucccuggaacuggaguuacagucaguugugagcugccauguugauguugggaauugaacuuauuuccuuuggaagagcagccagugcucuuaacuacugugccaucucuccagccccagaaauaguuaucuuaaaaaggaaaauuauauagacauacuuuuuuaauccacuugcacauauauauaggaauguaaucuuuaaauuuguuaaaugacuucauuuauguguaugaguauuugaccugcauuuauguaugcacauuaugugccugccuggggaaccuggaagaagacauuggauccccuggaaugggaguuacagaugguugugagcuaccaugugagugcuggaaacaaaaccugggucuuguguaagagcagcaagugcucuuaacugcagagucagcucuucugccuccaggaauggaaucauuaguugaaaagaaaggcuagguaugauaguagauaccuauaauccuagcagucuggagacugaaacagaaggaucccaguuuaggcuacaucaguaagaccuugucuacuaacacaaaacacccgccccaacccucacccuccauaagaaaagaaaaguaaaacaggaaaugcuaugagaagaacuguguuguguuuugucuuuuucuuuucuccuuuuuuguugguucuucuccuuuuguuuguuucuuggggaggacaggguaucacucuagcccagccugaccuggagcucagucugucugucucagucugucugucuagauuggcuuccugagugcugggggguuacauguaugaguuaccacacccaacuuuuuuacuuuuuucuaucaaauggaaauuuauggcauuugccucacaagcauugugcuuuuugagguauugggcauauuagagaaagcaagagccuguaauuaaaagggacuauguauacacaaaugcccccacauaauaaaggguacauguauuaggaucagacaacaaagcaccccccaaagcuugguaguucacucuagcuaaaucauuucuuucacuugauauucuuagauggcacugugggaaaccaaaagggaaaacuuucccaggggaauucaaaguaggaaaaguuagaauaaggugaauauauacuuuuuaaagauuuugaguuuugccugcauguaugccuuguaccacacccaugccucauaccuucagaagucagaagaggcaaggcguggaucagaagucaccccugaacauuuacuuuuuacagucauuaucagcucugcucuggagugaggagaagaauguuucugugggagcuaaggagaugacucagcagugaagagcacuuucuagacaguaggggcucaugccuuuaaagauguauuuauuuuaugugagugcucuaucuacauguacacauacaugccagaagagggcaucagaucccaguuagaugguugugaaccaccacgugguugcugggaauugaacucaggaccucuggaagagcagacggugcuuuuaaccacugaaccaucuuuccagcccacacucacucuucucuaaucccagcacuugggaggcagaagcagauggaucucugaguucgaggccagccugguuuauacagcaaguuccaggacagccagagcuacagagaaccccugucucagaaaacaaauagaugaccugcugcucuuuggauuugacucccaguacccacaucgugguucacaggcaucugcaacuccauuucuaggggaucucgucugaccuccaagggcaccaggcauaaagugcaugguguacagacaugcauacacauagaguaaaguauauuuuaacaacagauugccuguucucggccauuacuuuuaaaguccaaacugaaguuagguggggaaaagggaguucuugagccccuugaggagugaugcuuccaucuuagugccagucugcucugcagcaagccaucggaaggaagugucuuaagagaagaaaagaaaaccucauacgauauuccuuugaaguugcuaauacucuucuuuuucuuuuuuagugaacgagauuauugggagagacaugucccagauuucuguuucccaagccacggaggugaugagagacacuccucucccggguccggcgucuccagaucugaugaccucucacagugcucagugagccuuuugcccaccacggacugcucagccugcuucucucccggaacuuaagguccagccagacuucaggaucuguugcaggaguuggacucacugugggaaaagcagcguucccucuccuuaagccacaggcagauuguguaaaacaggaacagcagcggcuguuucagcugugggaaacgagcuuugcuuuuauauauauauauauauauauauauauauauuuaaauaggauacuuuuauaugaugggugcuuugagugugaaugcagcaggcucuaucucagaggugcugcucuugcaggugaccugguugcauagcuaggauuaguaauuuguacugcuuucuggucauuugaagagcccuuuaguuuugaugauauuuuuaaaauagaacuuuuugauaaaaaaaaaaaaccuuccagaugcagacaaaaaaaauuauccuaagcccacacuuacaccucagaaacuuagcaugcauccugaaaugaagccuuucauagacucauagggaauaaagccaaauguagcucuuacucuuuauaaaauaaaguguuagguaaauugagaagaccauuccaucauugaaguguugggauaugaauacauuccagagcauagccuuuuguaauuuuagguaguuaucaguuucuccacuagcuccauguucuagcuuuuuccuccccacaggaccuuggguaaaauggucauuuguaaggugaauuucaaagggaggguuuuagcuuagguaguuauuuucuaccuaacuuuucaaguaggagccucugccuuuagucaguagucuuugaagcaaguauccugauaguuuaaggcuuugcaauuuuaacuccuugaggccaggccagaaguguuaggagcuaaguaugaaugaacuguguaauaagagaggcagagaaaaugcaggacuccaguugagaaggcuuaaucuccuguuuacagcccacaaugauucugucccaugguguccuggcuauaugaccuaaaaaccagccuuuccuccacaaggcuuugagacacauccagagaugaggugguaucagaccuguccuuccacaccaaagacaugguggugcugcugcugcugcuucugcuggugaagucuguguccaaggcaggggccagcagaaacuccagccugcugucuaccaaaggacuguucccagacccugucuuuacccuucccuuuuaaagucccugaauuuuacagucugcuuucaaaugaaauauuguacuuuaauucauucaggaagcaaauugagugccuauaagugagacacugugcugcacuggcugaagacuuaaugcuguuacucuagguaguuggaucccuugaugguggggacugucuuuacuaaagcuacaucaggccuacuaagcaggagcuggccuguugccuaccaccccuaguaagcaggguaggagcaacagauucaagaugagagaaguauguguuuguuuuuaacaugaugcuaguuagagaacagucuuaucagcaaauuacucuggccacucuuggagcuagauauuuuccaaauuuucucugaaggugaguuuuauaucaauaaguaugaauagagauuuacuuuaggggucccaugguugguagcccacagcuucuucuaaagggcauuggccucucaggugaacuugcagagacuuggccaaauuugcuuccucuuuccccuggggcaguugccucauauggggucauuacaagaccccuugggggugcugcuuugcugccuucaagaauaaaagccucuaugauccagaguugcuaugcaccaaauuuugaugccuuuuaaauaccuugaugccuauagcauuagaaaugcuuuccuauuuaaaacagguuagauuuuaaaauagagcuuuguauuguguaaugguuuuauauauuagcuuuguauaagcuuucauguaagagucauauuuuuuggcuuuguagauaaagacuuaaauuuuugugcaaaauaguggugguaaagcacacaucauuggacuaugcaaguugauuucuaggagcagcacugagcagcuggccauugcuagcacacacccuuucccucaccuguacuagagcuuggcuugaggaaggaaugaaggagcagccuucuguuuacuagaaaaauguuuggguucacacguggugcugcugcccuggguacagcccaccaacacccagggccagccaguaucaccagaccucugcuggaccuagucaagaagcccaguuaacauguagagcaugggcucaagaugaaaccuuguguuuauagaacggauguuuaggugaagaaauugguucuugguuauguuuacagcacuugggauuguguuuucuuguacauuuuguauuuuaaaaaucuuuuauaggagugcagugcuccuauacaaagggaagaugagccagcaguccaggcuccuccucaguuacagugcugacauaauaaacagugacagaucaacagucuccuugaaaucugaguuuuucuccaccuggggcugguguggagcccucugggccaaaggcucuguggcuuuuuaaaaguccgcuugaccaggaaccugaguucugcacccuuuaaucagugcaaaggacaugccaugguguuugcuggcuuuuggacaacuggucuuccaaguguugcaagaaaaaguuggcaaaguccccuuuaaccugaguuuacauguguuaccugcccucugguauucucugaggauauugcagcagcacagucguuacaaaacauaacuugggguuuuguuuaugguagagggcuauacagccuuggcuagacuagaauuugcuauguagagcacacuggauuugaacuugaggcaguccuccugucuuugccuccugaguacuggaguuacaggcaugaacagcuaaugguuugucaucccgaacuccuugggccugguuggagccggguaagcauacuuauugugaagccaccccugccacuucugaguccagauauccugagggcaagugcugacuugaugccucccugccuccagucaggcucagguggacuccugaaucgcccaggagucauaaauaauaaagguaccaggccuuaacauuuuaaaaagaaacacaggccuucugugcacccuucaaacucaguauuugagggccaaagacagauggaagguuuucuggcugucacaccaucagggauggagcagcccuaucacaucuccagcccugccuguaaggcggccaucaucuuuagaauaagcaggcagaggaacaaggggacaugggaggaaggagagcgaugcugagcuuggucuuuuccaggugccuuguagagcuuugacgagccauaaagaagcugcuggauugagggugcucugggcucagcagaggcuuguuagcuggggacaucagcucauucugucuccugguuuccucuucuacaaacacacccacuccuuaggggcuuguaacacagugcgaggugggucaccaacaggcaucagagugguguagucaucagga

SEQ ID NO: 4733 - RNA, 2036 nt, Mus musculus
uacacauagaguaaaguauauuuuaacaacagauugccuguucucggccauuacuuuuaaaguccaaacugaaguuagguggggaaaagggaguucuugagccccuugaggagugaugcuuccaucuuagugccagucugcucugcagcaagccaucggaaggaagugucuuaagagaagaaaagaaaaccucauacgauauuccuuugaaguugcuaauacucuucuuuuucuuuuuuagugaacgagauuauugggagagacaugucccagauuucuguuucccaagccacggaggugaugagagacacuccucucccggguccggcgucuccagaucugaugaccucucacagugcucagugagccuuuugcccaccacggacugcucagccugcuucucucccggaacuuaagguccagccagacuucaggaucuguugcaggaguuggacucacugugggaaaagcagcguucccucuccuuaagccacaggcagauuguguaaaacaggaacagcagcggcuguuucagcugugggaaacgagcuuugcuuuuauauauauauauauauauauauauauauauuuaaauaggauacuuuuauaugaugggugcuuugagugugaaugcagcaggcucuaucucagaggugcugcucuugcaggugaccugguugcauagcuaggauuaguaauuuguacugcuuucuggucauuugaagagcccuuuaguuuugaugauauuuuuaaaauagaacuuuuugauaaaaaaaaaaaaccuuccagaugcagacaaaaaaaauuauccuaagcccacacuuacaccucagaaacuuagcaugcauccugaaaugaagccuuucauagacucauagggaauaaagccaaauguagcucuuacucuuuauaaaauaaaguguuagguaaauugagaagaccauuccaucauugaaguguugggauaugaauacauuccagagcauagccuuuuguaauuuuagguaguuaucaguuucuccacuagcuccauguucuagcuuuuuccuccccacaggaccuuggguaaaauggucauuuguaaggugaauuucaaagggaggguuuuagcuuagguaguuauuuucuaccuaacuuuucaaguaggagccucugccuuuagucaguagucuuugaagcaaguauccugauaguuuaaggcuuugcaauuuuaacuccuugaggccaggccagaaguguuaggagcuaaguaugaaugaacuguguaauaagagaggcagagaaaaugcaggacuccaguugagaaggcuuaaucuccuguuuacagcccacaaugauucugucccaugguguccuggcuauaugaccuaaaaaccagccuuuccuccacaaggcuuugagacacauccagagaugaggugguaucagaccuguccuuccacaccaaagacaugguggugcugcugcugcugcuucugcuggugaagucuguguccaaggcaggggccagcagaaacuccagccugcugucuaccaaaggacuguucccagacccugucuuuacccuucccuuuuaaagucccugaauuuuacagucugcuuucaaaugaaauauuguacuuuaauucauucaggaagcaaauugagugccuauaagugagacacugugcugcacuggcugaagacuuaaugcuguuacucuagguaguuggaucccuugaugguggggacugucuuuacuaaagcuacaucaggccuacuaagcaggagcuggccuguugccuaccaccccuaguaagcaggguaggagcaacagauucaagaugagagaaguauguguuuguuuuuaacaugaugcuaguuagagaacagucuuaucagcaaauuacucuggccacucuuggagcuagauauuuuccaaauuuucucugaaggugaguuuuauaucaauaaguaugaauagagauuuacuuuaggggucccaugguugguagcccacagcuucuucuaaagggcauuggccucucaggugaacu

SEQ ID NO: 4734 - RNA, 6575 nt, Mus musculus
uguuuucuuguacauuuuguauuuuaaaaaucuuuuauaggagugcagugcuccuauacaaagggaagaugagccagcaguccaggcuccuccucaguuacagugcugacauaauaaacagugacagaucaacagucuccuugaaaucugaguuuuucuccaccuggggcugguguggagcccucugggccaaaggcucuguggcuuuuuaaaaguccgcuugaccaggaaccugaguucugcacccuuuaaucagugcaaaggacaugccaugguguuugcuggcuuuuggacaacuggucuuccaaguguugcaagaaaaaguuggcaaaguccccuuuaaccugaguuuacauguguuaccugcccucugguauucucugaggauauugcagcagcacagucguuacaaaacauaacuugggguuuuguuuaugguagagggcuauacagccuuggcuagacuagaauuugcuauguagagcacacuggauuugaacuugaggcaguccuccugucuuugccuccugaguacuggaguuacaggcaugaacagcuaaugguuugucaucccgaacuccuugggccugguuggagccggguaagcauacuuauugugaagccaccccugccacuucugaguccagauauccugagggcaagugcugacuugaugccucccugccuccagucaggcucagguggacuccugaaucgcccaggagucauaaauaauaaagguaccaggccuuaacauuuuaaaaagaaacacaggccuucugugcacccuucaaacucaguauuugagggccaaagacagauggaagguuuucuggcugucacaccaucagggauggagcagcccuaucacaucuccagcccugccuguaaggcggccaucaucuuuagaauaagcaggcagaggaacaaggggacaugggaggaaggagagcgaugcugagcuuggucuuuuccaggugccuuguagagcuuugacgagccauaaagaagcugcuggauugagggugcucugggcucagcagaggcuuguuagcuggggacaucagcucauucugucuccugguuuccucuucuacaaacacacccacuccuuaggggcuuguaacacagugcgaggugggucaccaacaggcaucagagugguguagucaucaggagccagcugcagaagucacacauauuuagggguuggagcuccaggcucagcuaggcccucgagcccuccccacagcacaaccucaccugguaggcuugaaagacacugaguagguccuucauaccagcuguguauggcacccccugcauucggaccagggcuccugguugggacagcauuguggugggcguagaggccaaggcaguaggagguguggugagguagcccacaguagugggggagacuggggggcuagggugugagagacaggaacuuagucauacauccuaucuauagccuagaccaagaccauccucuaaaguacccgugccuuauguuuaauccugugcacuuccugaacccucugccucuacagugauauccucagucuguuggcccacacccgcagcucccuucccaucucaaaauaaauucuaacagaucuuugguuaucuccaccagaaaugagucaggaucuucccccaagugguugagcagaggucugaggcugucugaguagcaagauaccugggauaguaggcuguguaguucauguagaguugaguggcuggcccuggguaauaggcaagaggaguggcagcagcggguacccuggcagcuggcagcagugcagaagagggauauagugcugucgucucugugggaaugagggcugggguggccuggaagguggcguagguagguggugagaggccuagagacagguaaagaguacauuauagagagcccacagucagucacccuggauaggguaacuggaaauggaauagaaagugguagcuuagaacagcuuggcucccacucacagggcaguuugcaggguggaggggacaggccacugcggcucagggaaccccccaucagcacacggcucaucuccucuguggaacaagggacuacuuccacauagcguucuuucaucaucuucuuguggcaucgcugggcagcagccagagcacgcuccaccgacaucaucuggaugaaggcgucaccggauggccggcccugugcacaccaccuugugagcaguuugucacauauagaaagugccuuacuuacacaugcauguagaugcccuucccaagggucgucucaccuguugguugagcaccauaugcacaccaugaggccgaaugucagcugcugccucuccuagaaaacucagaaugucuucaaugguggcuguguagggcaggccucuaaggcgaacacagucccucccaguuccuccugccaguggaaagggaaugggcagcaguggagcagucagugugggaaggaguggacuggcugcauagcgguuaaggaccuaguaagaaaagcaacagauucauuacacuaaguaggggacccauggcacaugcugaagaagcagcacauuggggcacaaggagccuugagagugcucaccugcugcaccucggcugccgugcuccugaagaguucaauguaucgcuuacccagcaugccuuugugccugcgcagagcagccugugccagcuccucacaggcaaagagagcaaaggcauccccaguaggccugccaucaggguggcggacaaagagcagcccaucagcacccccagucacugggcauucuggccccaggaagccuagaacaucuguuggcccggcugaaaaggguaguccccguagccucaggaucacuugaucuucccgugauaggaaacgggccaccucuagugaugugccuagguuggaaggacaggggucccuugcugaguuaauccuuguagcgugcacccacaggggacccaaaagacagugaguguagggaaugggguacagaucaagacaaaagggaacuaggaccuucuaugggcacacucacccccugcaaucuuuacgaauuccuccccuguggcuuuauauaccugcagguagagaaaccagcccauaggucucagcccuuacucaguuuugcccugcuccacuucuagccaaaagccccaccucaauauagcggacacccaugugguguuugugucucugcagcgcuaggucccgcugcucgcuguccacgaaucggaugagggccucgccauuucugcggcccugggcguugagacagagggccacaccaccccuguggagccggguguuguuagugccuccuggguaggcuugcccucuuaccccucccauccugucacacccaccuggcaauguugagcccuuugaagaaucgagccacauccuggucugaugauugccagggcaacccacgggcccguacuacagucucauuguccaccacaucagccuugcugcuguggggggcagggcaaaggaucagaaauguccaaggauugucacccccaucccagcuccuacacucaccaagggccugucucguauuucugcuuuaccacuucuggcuucgagaacaacugaccugagaggagauggcaugggggucagcagggucugguggaggaagucucuccaccaagcucagcaaaaauaggaccggugagggcauugaggacgcggcagagggguuucuaccuuguguucucuuagagaaggucacaagucagcaaggggacucuguugaagggaugggcacucacccaguccugacaguagcuggcaagcagggcaagaaucuuaccauuggacccuucaaguagguggagaauaacagcuaccauagucuucacuucccagaccccaaagucaucuucgguagcaucuguuucuagucccaagucuauaggcagagaagugacaacugagguccaggucuguacaucccacgucaccccgaaacacccagagaauccuagcaaacacuaguuguggcccaguucauacauguaccuacagguccucagaccaaacacagacauguccacauuccaaauguaucccaaagaaugaggcuaaaaacauagaccugucuacauucauacagcccauacggcaucaugcacaugcuuggacauauuagucaccccuccaccuuaauuuugaugggucacagauacccugugccauggugcccacugugaggucucuggcggagcaggugcuugggugcugcauauggaauucucugcggaggucguagaaggagaagaaggugucggggagcaccagguucugggagcacaugggagugggggugaauagguaaccuaagguguuuacaacaggggccuugggaacccaaccguacccaugugcccucaaugacauaccuuccuggaggccucaggaugcagaaccugucgcaacagcugcugcccaucagugcagagcacauaggggcccccgcccagcagagccacauccccgcucaccagcugugagaacuggggacagggaguggagacucagacauagacucacagcuagacagcugaaacugggggggagggguagcaggagggagggacucaggcugcaaagcugguucaucaggauguucaacccuacccugccugggaaguaaaaggccuugcccuaaaucccaggcuccuaauccccaccccuagccuaguucccugucaccuccucuaggccaaaugagagcagucgcacauaacccaagcccccauuaaacacacuccaggagucuggagucgggccagagcaaacaccugguggagugaggcaagcagguggggaggggaggagcaaagcagguuaaaccuguccuggaccaggcaccacccucagacaggugggggagguucacaccugcccgagggccaaaaggcccauggucaauggcagccccgccccuugguccgaccaacccaggaacagagccaccaaggacagagcuucauacuuggccacucgcagcagccugagcuuugacccacaccccaucgaccaacuggcacagaacuguuugcucguagagggggguggguggcacucugaaggcuauccagcacgauccggcccuuucccuuggcaauucugugacacuuuccaaucuaaggccgacagagcaaggcaaccagauuuuuuucuacagcacccucccaggugagcagugggccuggagcccuucuguaaccuggcaucuguaggucuucucauuaagaacgagagucagaagaggaaaggacuuaacacucauuacaacucagucauggggugagugagcaaugcaaacagggaaaacucacucccacuuggccagggugcgggguggguaugggagggggcaugcgccuaggccuuugcgcucauugggcagguagccccuagauaauguucggacagcacccacucacccacgccuggccagucagcugggacaggcaggccuaaaccagccggccucaccuagaggcgucugcccccgaggcagacaccgcccgacgcccucgcuucagcgguucccaggagagcaggcggcagagaccaagugaucuaccgcuaaaccugagcccaccucgacccuauuucugacguguccucugcuagcggggggagugggagggagaggaaggggccucggggggauggaucccuuagccgcuauugucaacuuccucggcaggaguggaugucuguaaagguuggaagguaagguggcucugggaauggccuagcacgcuuccacgcgguagucgcucaaaaguuucaaacaagaccuuguccuacuggccgugccacugggucgcgucgcuccaggucuccccuccuccccucccccucgaaguagugucccugccacuccgcaguuccaccacccacgcgggcccccacgcucaccuguugcagcacuuuguccagggacuccgcccgcgcuaggcugucugcgcugaguccacucgccucgcggcauuguggacucagggcagccgccucggcgcgaacuagcgacuugugcagcguccccaccuaaaagcaccgaggguaaccccaugagccgcugugccucaacaggcucugaagcgucccgagguccccucuuucccacccuaccugucggcugcgcggcuccaccacuugccaaacuaggaggauuaagucggucucguccgagccuagguccggccccagcgcaccggcaguggccccgaacaaaaccaccagcgacugagguucgggacaagggucuguggccgagucuacugcgggaucugggcccgggggugggggcggcggcggcggcggagucauggccgcagaggaagggggcgcucggccacacacgcggaccgacgaggcgcacacacguaccgaccgacagcagacagacgagcuugggcgggauccgguguguugggggcggcaccugcggccggguguagugggagcugcagagacccgcccgcggugcccuuuggggcugggcggugcggcugccuaucccugccuacuccggcga

SEQ ID NO: 4735 - RNA, 14367 nt, Mus musculus
cuuagcaagaggcgggucuuaauugacugguaucugcgagcggugggguuaacuagcugagcugcggcccgggccuaggcacgaucccuaaucucuaaagcagccccuuggaccugcgaccacagucucacgccauggaucgccaucucugcaccugucgcgagacccagcuccggaguggccuccuguuaccucuguuucuacuaaugaugcuggcagaccugacgcucccggcccaacgucaccccccgguggugcugggugagacucguguucaggguggugguggguggauccugcaggauccagugcagccagggucuggugggccaacugcucuguugugcaucugcuuuaagcacgaaacccagagcauuugguuucuaaccugggucaguucgguuagcccaccucccgccauaccgggcauggguguggucuggagcccucugaaacgugagaguaaagggaauagauaaugucuggcuuuccacuccaccuaacugcaacagcuccaaaccuugccucgccaugcccccauuucuuagcuggaaagacugaggcaauucaacccuacuucagcggguuccuaggcagucucagaaucggucauuaccuccuacccucucuauuucacagggaaugagugguagcaaguucuauccacgcuggcccccaaaagcauuucucugcucucagcuuauggaauggaugguauugacuuucgaggagauggccuaagggaaacaggguggcuaagggaagggaggagagaggaaugggguugggacaacagucuugaacuggcguugagggaguccgggagucugagagcaugccuccacucuccgcuuccagaccuaauuacucuaggcuguacugaggccaggugacauucccugcccacuugcucuucugucuuagacuuggcagcggaacagaaauaacaauguuucuaugugguaauaggccaggcuaaaaucucuaggagucuuagaugccccauucagccaauggaagucguuuugaacugguguuucgcuggccaggacuccugagaacagagacaugcugaaacguacgcuauauauauguuuauguauguauauguguguguguguguauauauauauauauuuucuuucugcuggagcauaaauuccugugcucuuucuucccuuuuuucuuuuugucuugucuuagacaggguuuuucuguguaacccuggcuguccuggaacgcacucuguagaccaggcuggccuugaacucagauacccaccugccucucccucccaaguacuaagaucaaggguguaugccaccaugccuagcugagaaacccucucuugaaaagcaaugucauucuaggucagcgaaggggaugggggauucugagccuagguucccuuugagauuuguauacagcuggaccugccucucucaagcuuccuggaugguaguaauagugccucucagagaggucauccugagaggugagagagagaggugugggagcgcuggggaagccuuccuggaauaugcaggaaguaagguggcuuggaagauugcuccaggcuggucagcauggaacugggggaaggcaggagauaugggugguguagaacuugugacuuggucaucuggacuuuaacccugaggaccagugugaagaagucacgugugaauguaagaagaucuaagaauaaggcccaugacauugagauguguguauucucugaccacauacgcguuuccuacuugaggcagagucuuuguagccuugucuucuugcuguagaucaggcuggucuugaacucacagagaucugucugcuucucccucccuagcacuaggauuaaaggagugcaccaucacaccuggcuuauuugcagcauaguaucgcuuggacagaugggcacuaacugccaauuaaucuaugcagacuuugguuauccuaaaucauagcugagaagccuuagacucugaaagaaucugagcuccuguauccuugugcaucuuuucaaggaccagggcugcugccagagagagcuuuuucuuguuuuguuuuguuuuuguuuuuccgagacaggguuucucuguauaguccugacuguccuggagcucacucuguagaccaggcuggccucgaacucagaaauucuccugccucugccucccaaguccugggauuaaaggcgugagccaucaccgcccggccagagagagcuuuuucuaggcacaaaaagugcugcaggguccugaguuagugggagagguagcagaaaacugaucuuggaacaggggggugggaucuuaggcaaacaguuugcaucccucucagccucagucuucuuaucuguuaaaugaacaaagagggccugcaagaugguucaguggacgaaggggauugccaccaagccugaagacccgaguucuauccccagaagaaaccaauucuggaaaguuguccuccagccucugcacaugugcuguguugugcucucgucuuaccccugcacauacauguagacuaaacauaauuugauaauguguaugaaaguaaagaggacucuucccaggguuauuugaaguaaaaguuuugugucugguucuugucuaugucucaaccaccaaguaucucaggaaggggccauugcuauuuuuagaggccucccagccugaccaggaagagggguaacugguggcuuccucuuucacccauuuccucgucagugcauggagacauugaccagucgucaugcccugcucauagguaugucaugucgaagcucccauggugggaauuuccugcaucagcacccacaucaugaagggaguggaaggcacgugucuucccacaacacucugaagacacugggauaacugcuuaggcaaggacaugugcuaugcuggguucaaagacacuguugagaaaagucaaggggcucuuuauagugacugugggucucaaaaaggguuuuuuuuuuuuacccccucgggcguugguaccacaccccuuugaucuuaucacgcaggaggcagagauaggcagaucugaguuccaggacagccagggcuacacagagaaaccuuuuaaaaaaaaaagacggggaggggagguuguccuuguaaaguuguacagccuguggauguagguggugaccuguaagguaacaggcuuuaaaugcugggaguugaagggauggguguaagcuuggguguuaucagggcccuaggguuugaguggcucaaagagauugacaggagugguauccagucaugcuuggaacuuggucacacccccucgccccaugccugcuguggcuuguuacugcagauuaaccaucaccagcacaccucugcacugccuuaaggcuuuccacaggaccuacccucugcaacuuuccuggccuuuagcaaggccuacacaucuugguaggucugcuggaaccauuacagaugucucucauuuguguuuuuuaucagggcuccuacugaugagcuugcaaucccagaauuuggcagguuggagaagcaggcuuuggaugucagcaagacccugucucagacaaaagcuaaaacuaaauagaagaguacugccucuggguuuaauucuugguuuaccacucuaucuugugucccacugccuggggguagagaagaccuugcuuaccuuuuuuccugguuuaagccuggagagggugguacauaucuaauaucagggccauagcacuggccaaauucuggagguucugaaaaacucccaugagccucaaaaucucuucuaguuaagaguaugaucuggaagccgggcggugguggcacacaccuuugaucccagcacuuggaagacagaggcaggcggauuucugaguuugaggcuagccuggucuacagagugaguuccaggacagccaggacuacacagagaugaucuggguccauuaacccuagaaaccaucaguagcugaggucucagagggauccacagccucucucagggaaguaacuuugguuuuuuaauucccuucugaauggccaacgaggaaguuccauucgagaucguggagaaguuauuuucaucccauaacaauacauccccccaccccaaacucccacccccaaacaugccaggccucucuuuaagccuccacuaucugcugguagcuucuuucccauuaauguggcucuuguuuuuguuuggaaauaggaucccauuguguagcccggguugaguuagcacgaacuugauccuccugccucagccucccaauuacuggauuuacagguauccacugcggucccccgauaguaggggcuuuucuuugugaaggugguguccuggccuuuucugauuuucccaacccuggcguuguacuucaacuugagagugggauugcaaagaugugccaugguauucaucacucuggguggcucuuuugcagacugcaagaggcuugggggucuccagccugcuggggccuggggccaugccugucuuuuucuccugcagugccuggugauuuggguaaccaguuggaagcaaagcuggauaagccaaagguuguacacuaccuuugcuccaagaagacggacagcuacuucacacucuggcugaaucuggaacugcuucugccuguuaucauugacugcuggauugacaauaucaggugagggcuggugcacacaagaugauggaucgcucauccuaggggccuagagaggccuucagaguccuuguccucauuccucaauagauggaaaaaugauaucucucucuccuaggcucuccugcccuugaucuggucuggucuggucuggucuggucagcacuagcuuacacucucagaagcaugaauuucuuuuucuuccugcuaguuccaguucuccuucuuccaguucaacuaucagguuuuaagcucagguuuuguuuguuuuauucuuuugccuaaccccuauucacagacucugugugguuccccuuccuccuuugccuggguccuggcuaagccugccucucuggcugcuuuuuuuuuuuuuuuuuuuuuuuuuuuuugguuuuucaagacaggguuucucuguguagcccuggcuguccuggaacucacuuuguagaccaggcuggcuucaaacucagaaauucgccugccucugcgucccgagugcugggauuaaaggcgugugccaccacaccuggccauaacuguaauuuuacuacuguuaugaaucaugguaaguagcuaauaugcaggauaucugacaugcaacccccacagugguugcaaaccagacugagcaguauugcccuagguugguucuuggcacccacaggguagcucacaacucuuugugacuucagucccggggaaucuguugcccucuugacuucucugggaacuguacacacaaacgcucauacacagaaaauaaaauauauaaaaaucucaaaaaaaaaaucaaaacaaagccaaaaaaccgccuuugcugguaacucacccuuacaaaauuguguugccaaggaacuggguuuuacuaaauuccauauaggauauauauauuucuguuauaaagugaauuuuauugccaacagagugugguggaucaaaaacuccauucuuacuuuacccaucaucgucaucuugcuuuuaagaaacauguauauauaugaucaaucuaaaccugaucaguuauuaaccauaaauauguuuauaaacuagaaacaauguggguguggugguuugucuauaaucccagcauucaggagagaugcugaggcaggaggauugccaccaauuugaggccugcuuggguuacagaaugaguacaagccagacuuaaguagcaagaccuugucccaagacccaaaacaaacacugacagguggagugacuccuuuuacgugccagccgaucagcgguguucagcagguuaaguuaugagggcugagaaguaaacauuuuaauuggauggcagagguuuuaguggucuuuuugguuuuuguuuguuuguuugguuuugguuucagagacagguuugcuucauguagcccuggccguccuggaagucacucuauagacaaggcuggccucaaacucauagagaucugccugcuucuaccuucugagugcugagauuaaaggcuugugccauuaucugccagacaaauacaaaugacuucuuuuuuaaaaagauuuauuuauuuauuucauguauguggguacacugucgcugucuucagacagaccagaagauggcaucagaucccauuacagaugguugugagccaccaugugguugcugggauuugaacucaggaccucugaaagagcagucagugcucuuaaccacugagccaucucuccagcccaaauggauuuuuuuuuuucuuuuugguuuuucaagacaggguuucucuguuuagcccuggcuguccuggaacucacuuuguagaccaggcuggccuggaacucagagauccgccugccucugccucccaagugcugggauuaaaagggagcaucaccacugcccggcgugaaaucuugucauagcagcaaagacugacaaaacaaccaaaagggguuaguaagguggcccaguagaucaccugcuucucuugcagaggauuugagccccaucaguuacucgguggcucauaacugucaugacagcaguuccaagggaucuaauggucugucuugaccucuguagguaucaggcacgcauguggugccuguguaugcaugcaggcaaaaauucauacucauacaauuaaacuuuuuaaaaauuuuuuauuuuauuuuuauuuauuuauuuuuuuuuugguuuucuagacaggguuucucuguguagcccuggcuguccuggaacucacuuuguagaccaggcuggccucgaacucagaaaucuaccugucucuguaaacuuuuaaaaagguauuugagacagggcucuuaccauguagcucagguuggccuuuaauuccucguguagcccagacuggaacugacaauccuggcucugccucuugaaugcugggauuagggugugcuuuaucagcucugucuccugugggugaguaucuugauugccucaaguguacaccugagugagugaccuacacucuagauuugucuacucaguaaugaacuuucuaacucucuggaaauggcauugucauuaaacuugcuuuaaaggaggaaguggggguguggcucagugauaagucacuugagugauaaucacauaaguaaagcucugaauuugagccuuaaaaccacaauaaagcaaacugacuuuauugauaaggaaagauggaagcgcaaagaauuuauaaaauuggcuacagcccuuucauucacaugauaaaucacagcaucagaauucagacucaaaaauuguauuauucuuucuuuuucaucugcuugcuuguuuuuguuuuucaagacaggauuucuuuuguuuuuuuuuuuguuuuuuuguuuuuuuguuuuuuuuuuuuauguaagcacacuguagcugucuucagacacuccagaagagggagucagaucuuguuacagaugguugugagccaccaugugguugcugggauuugaacucuggaccuucggaagagcagucgggugcucuuacucacugagccaucucaccagcccaagacaggauuucuuuggccauccuagaacuguucuguggaccaggcuggccuaaaacucaagaguuugccucugccucugccucugccuccugggugugguauucuaagguuccccuugcagagagaaaucuuuaaaggcagagacuauguaucuauuuguuuguuguuuguuucuagauuuauuuuauaauuuuauguguaugaguguugcuugcgucuauguaaguguaccacaugugcugggugccagagaaagucagaagaggauaucagauccccuaggacuaggagggaguuacaguugguugugagccacuguaugggugcugggaauugaaccuggguccucugcaaaagcaacaagugcucuuaauagccaagccaaaucguucuucaauuugaguaauuggugcuggcuggcaaauguuugagcugauuagagcuucaucaauuaaaagcuuuucccagaaaccugcuagcugauccucugggcaccuaguccagacgguugucugugccgcccucuuuguugacuguuuuuggugugugguugcagcuauuccugggcuguugaucuacauugcuauuucugucguggagacucguggccucaggugcugccaguggaggcacaggccgacgauaaccgaugcuggccggagucuuuugucuucauugcuccucugaccuguuucgauauucaucuugcacaaaacugccuuggugucuuacagccauuuucuguacuuagcugguaucuacugagaguggccuccagcccuaucaugugaucaauguuagggguuauagcugaguuuuguuuguuuguuuguuuguuugauuuguuuuuuuuuguuuuguuuuuguuuuuccgagacaaaagggguuucucuguauagccuuggcuguccuggaacucacuuuguagaccaggcuggccucgaacucagaaaucugccugccucuaccucccaagugcugggauuguuuguuuuuuuagauaugguuucucuguguagccguggcuguccuggaacuuguucuguauuauaccaggcuggccuugaacucacagagauccaccugccuaugccuccugagugcugggauuaaaagcgugcacuaccauuuaauacguauggauuuucugccuuccuguaugcuugugugccagguguguacagugccuguggaagccaaaagagguggaagaauccucuagaacuggaguuauagauggugugaaccaccacguggguaauggggcugcaacucuggggccucggaaacagcaucaagugcucuuaaccacugagcccucuucuccgggccucuugguaguugaucuuuaaugaugguaggauucaggaccacuaaugcacucagcuuuucgugggcauguuuaccucuggugucuccuaguacuucuccuggccuugccuacaccuggccugaggaaguuugguuguuuuuuuuuuuuuauggcaaccacagaagcuaugcaaugauaaaaucuugaguuaggagcugcuaaaucuguggcuguguagcucagucugggugaggggacaccuggggaagagaauuugcuucagggcuccccacccucacccccuuagucucuggaguaaggcuucaugggguuuggauuuuguuauucugauccucuguacuguuggggguuuuguuugcuuguuugagacaaggucuccuauagccucaaacuuauauguaaauccuuaaagaauaucuucuccccccacccccccacagagacaagguuucucuguguagcccugacuguccuggaacucacuuuauagaccagguuggccucuaacucagaaauucaccugccucuaccucccaaguguugagauuaaaggugugagccaccacucacugccccuggcuuaaaggauauccuuaacugccugaucuucccaacucuacuucccaaguccaugaauggcaucgaucuguguuuuauaagccugcuuuguuuuuuguuuuuuuucaaaucuccuuuagaccucagaccaaaucugcacaugaggcuggaguguggcuaaggucacagggcaguauugagacagacugagcucagcgguaccagugagcuccuaacucacugucuucuccugacaggcugguuuacaacagaacaucucgggccacccaguuucccgaugguguggacgugcgugucccuggcuuuggggaaacauuuucuauggaauuccuagaccccagcaagaggaauguggguauguagcucuugcucaagaccuccaggguauguggcuggggccuccaggcucugugggccuacuacguugcuuugaagggguagccugcgagcuuucuuugauuaguagacacagguuccuuuuccacuccuucagggagacagacgucacugucucuggguguggugcagguagcuaacacugguuauauuuuauauaauucuaagcauucugcccuuagguucacugucucuggguguggugcagguagcuaacacugguuauauuuuauauaauucuaagcauucugcccuuagguuccuauuucuacacuaugguggagagccuugugggcuggggcuacacacggggugaagacguucgaggugcucccuaugauuggcggcgagccccaaguaagaagucaccccacccccacccuguuccauucccuagggacugggaggcaggaauaagguagucuuggccacugauaguccuugggcucuuucuacaucugagucucuggcuuccugugcaucuggcacuuccacagcucugaucaagucuugcuuugucuuucccugucauucuaggauuucuggaccucugagucuuggcaggggcagaggcuaaguccgaggggcggugguuggaagggucacuuugcccucuaugaaccuuuggggaaacuagucugcuccuacuuaguuuccaguacccuuugcacccccuaguccuggguccgcucugucgauugguuagcgauucaggucccaggacacuuccugccugaccccugcuuggcucuggccugcagaugaaaacgggcccuacuucuuggcccugcgagagaugaucgaggagauguaccagauguaugggggccccguggugcuggucgcccacagcaugggcaacguguacaugcucuacuuucugcagcggcagccacaagucuggaaggacaaauauauccaugccuucgucucacugggggcgcccugggggggcguggccaagacgcugcguguccuggccucagguaagaccuccugggccccucgugcaugccaguugccagagugccgucuccugucgucgguggucucguuauucugccggcauccuucaugucucuccauccuagacuaacagaaagaaggcuucuguuuuaaauauccaucucuggggagggggagcaguaagauggcucaggaauaaaggagcuugcugugcaagcccaagagcuugaguucaauccccagaaccgguauaaaggaggacggagcgaaccaacuccacaaaucccguguaugagcuucaccugccucugugggccguucagggaggcaguagguggugaugcugcugugucucuucucuugggccuucucaaacugacuuguguuuuugugacuguaggacccacuaucugcagccgugaggcagggccuccuggugcagaaagaagcuagcuacccuacccuucuccaccaugacugggugguagcccuggggaaccccucacuuggggacugugaaccaggaccauccugagaaucccuagacuaucucucugccaucacugguacugccugaccggcucgcucaucugaucaucguaaugaucgggucagguucauaaucucgcccagugauccugaguggagaggacaguaacgucauggcccagugacucagguguuuagaugcggggaggagucaucacagccaguaugcuuugucauuccugggcucacaggaagaaaugauggcaccuucagaaugugacaaggagacaugauaaggauucaggcauuggccgucucaaagcuucccugugaagcccccuuaaaucuuugccucagaugucggaaacuuucagcucuaaauccggggguggaagagauggaaauccaugcacuccuaggaguuucccuuuucccaaggauucuagugguagcaggcaaagcugaggccccagggucagccacaaauucaacccugcuuugagacaguguuggauaaugggcggugauaauacuugcaccaugaguagccccugucugaguugccugagccacugaaagucucauugggucaugggaagagcugacucuagugguugcucuccacccuauugccuuccuugcagcaagccuggccuccugggcccauggaaggcaugcagucgugcagcaugauggaacaaacaaccagaaaccaaaacagcuggccuauugacuugcagcuucaccgaagacaaaacuugugcccacaggcagggugguugauauauacuuagcugaggguguccuucacagaugaguagacauaguaaacaauuugaggggggaggcucucugaaucucuggugagaaaauacaaagggauguauguuuuccacguacagaaagaaaggaaaaggaaaucuguggugcguggauaggacuaugaugguaacuaauggucuaagauugugaaguauucacugagccauugguuggguuggugaaccuccuuccugagcgcaggcugauguagcuuuguccuuccaggagacaacaaucgcauucccgucauugggccacugaagauccgggaacagcagcgaucugccgucucuaccagcuggcuacugccauacaaccacacuuggucacaugaaaagguauuuguauacacacccacgacuaacuacacgcuccgggacuaucaccgguucuuccgggacaucgguuucgaagauggcugguucaugcggcaggacacagaagggcugguugaagccaugacgccacccgggguggagcugcacugcuuguauggcacugguguucccacgccaaacucuuucuacuacgagagcuuuccugaucgggaccccaaaaucugcuucggcgauggugacggcacggugaaccuggagagcguccugcagugccaagccuggcagagccgccaagagcacagaguaucauugcaggagcugccgggaagcgagcacauugagaugcuagccaaugccaccaccuuggcuuaucugaaacgugugcuucuggaaccuugauguccuccgccaggcagggcugcuggauggcuggaccacggagcuuuucuuggccucugacucuuucacggucuacaagcuuggcagaguuugugaccaucauucaagucccaggaggcaucugccucggaggaaugcuauuucucaaccuuucuucuguagaauggccaugaagaaggaagaagugaguguggacauuugaaggagacugcugcugcugcugcugcugaauugugaccucacgcuggcucuggaggcuggcuuguuuggccccucaccccagucccuaacuuggaccgugcaauccucuuagcucucuggucuuucuacucuagcucacugggcccuaaccuucccuuuugagggauguuaguuacugagcugauguccugccaugaaagauuccacagagauccccgggugaccuucccacgcacuggccucagguugcccacuacacuggccacagguggcuagagcugcuggcuucccugugaccucgcugguggacauucugaguguggggucuccuggaggcagucggguaagccccugcaggcaggccaguugcucguauugucuccgugaucccuccaggcuggguucuuuacagucugcuccuaccucucauuuagcagcauccuaguucuggacuggacagcagaggaccucucaauucuugggggccauguccuaagauuccugaugucccagcuugugacggaggucccgguacugaagcuggcucuguugguucugggaccuguaguuuaaggggaggggauggggcuucuuugaagguuccuagaaagaaagugagcucaagggaacagccacgguugcuuagagcuucccaugagucaccuucuugagaacucuaccaucauggugcaccccgcugugggguauuucuacuauccacuugggcuggcacaggguugagaggugguagaguuccugcccaacacuaccaccaggcagcugaauggguuuugguuugcaggaaaacaguccagagcuuugaaaaggcuccuaagagagcuaggaacuuagagucccagcuuggggguggggggggauuguuuguuugccccagggaugccacauggucucugugugacagcagggauggggaaucugggacugccuuagggacaguguaccugacuaugggcuuggguacagcuuuuaaguuggggucucaaaaccacuuagaagcuggaccacacugccuucccauaucguuucugaugcuggacuucccuuguuaagcacauuccuaucaucugucccucaccugaguguugggacccccccacuuggggcccugagcaaacuguaccucgauuuuggcaauaaaaguauucuggauguuguaaggug

SEQ ID NO: 4736 - RNA, 14367 nt, Mus musculus
caccuuacaacauccagaauacuuuuauugccaaaaucgagguacaguuugcucagggccccaagugggggggucccaacacucaggugagggacagaugauaggaaugugcuuaacaagggaaguccagcaucagaaacgauaugggaaggcagugugguccagcuucuaagugguuuugagaccccaacuuaaaagcuguacccaagcccauagucagguacacugucccuaaggcagucccagauuccccaucccugcugucacacagagaccauguggcaucccuggggcaaacaaacaauccccccccacccccaagcugggacucuaaguuccuagcucucuuaggagccuuuucaaagcucuggacuguuuuccugcaaaccaaaacccauucagcugccuggugguaguguugggcaggaacucuaccaccucucaacccugugccagcccaaguggauaguagaaauaccccacagcggggugcaccaugaugguagaguucucaagaaggugacucaugggaagcucuaagcaaccguggcuguucccuugagcucacuuucuuucuaggaaccuucaaagaagccccauccccuccccuuaaacuacaggucccagaaccaacagagccagcuucaguaccgggaccuccgucacaagcugggacaucaggaaucuuaggacauggcccccaagaauugagagguccucugcuguccaguccagaacuaggaugcugcuaaaugagagguaggagcagacuguaaagaacccagccuggagggaucacggagacaauacgagcaacuggccugccugcaggggcuuacccgacugccuccaggagaccccacacucagaauguccaccagcgaggucacagggaagccagcagcucuagccaccuguggccaguguagugggcaaccugaggccagugcgugggaaggucacccggggaucucuguggaaucuuucauggcaggacaucagcucaguaacuaacaucccucaaaagggaagguuagggcccagugagcuagaguagaaagaccagagagcuaagaggauugcacgguccaaguuagggacuggggugaggggccaaacaagccagccuccagagccagcgugaggucacaauucagcagcagcagcagcagcagucuccuucaaauguccacacucacuucuuccuucuucauggccauucuacagaagaaagguugagaaauagcauuccuccgaggcagaugccuccugggacuugaaugauggucacaaacucugccaagcuuguagaccgugaaagagucagaggccaagaaaagcuccgugguccagccauccagcagcccugccuggcggaggacaucaagguuccagaagcacacguuucagauaagccaaggugguggcauuggcuagcaucucaaugugcucgcuucccggcagcuccugcaaugauacucugugcucuuggcggcucugccaggcuuggcacugcaggacgcucuccagguucaccgugccgucaccaucgccgaagcagauuuuggggucccgaucaggaaagcucucguaguagaaagaguuuggcgugggaacaccagugccauacaagcagugcagcuccaccccggguggcgucauggcuucaaccagcccuucuguguccugccgcaugaaccagccaucuucgaaaccgaugucccggaagaaccggugauagucccggagcguguaguuagucguggguguguauacaaauaccuuuucaugugaccaagugugguuguauggcaguagccagcugguagagacggcagaucgcugcuguucccggaucuucaguggcccaaugacgggaaugcgauuguugucuccuggaaggacaaagcuacaucagccugcgcucaggaaggagguucaccaacccaaccaauggcucagugaauacuucacaaucuuagaccauuaguuaccaucauaguccuauccacgcaccacagauuuccuuuuccuuucuuucuguacguggaaaacauacaucccuuuguauuuucucaccagagauucagagagccuccccccucaaauuguuuacuaugucuacucaucugugaaggacacccucagcuaaguauauaucaaccacccugccugugggcacaaguuuugucuucggugaagcugcaagucaauaggccagcuguuuugguuucugguuguuuguuccaucaugcugcacgacugcaugccuuccaugggcccaggaggccaggcuugcugcaaggaaggcaauaggguggagagcaaccacuagagucagcucuucccaugacccaaugagacuuucaguggcucaggcaacucagacaggggcuacucauggugcaaguauuaucaccgcccauuauccaacacugucucaaagcaggguugaauuuguggcugacccuggggccucagcuuugccugcuaccacuagaauccuugggaaaagggaaacuccuaggagugcauggauuuccaucucuuccacccccggauuuagagcugaaaguuuccgacaucugaggcaaagauuuaagggggcuucacagggaagcuuugagacggccaaugccugaauccuuaucaugucuccuugucacauucugaaggugccaucauuucuuccugugagcccaggaaugacaaagcauacuggcugugaugacuccuccccgcaucuaaacaccugagucacugggccaugacguuacuguccucuccacucaggaucacugggcgagauuaugaaccugacccgaucauuacgaugaucagaugagcgagccggucaggcaguaccagugauggcagagagauagucuagggauucucaggaugguccugguucacaguccccaagugagggguuccccagggcuaccacccagucaugguggagaaggguaggguagcuagcuucuuucugcaccaggaggcccugccucacggcugcagauaguggguccuacagucacaaaaacacaagucaguuugagaaggcccaagagaagagacacagcagcaucaccaccuacugccucccugaacggcccacagaggcaggugaagcucauacacgggauuuguggaguugguucgcuccguccuccuuuauaccgguucuggggauugaacucaagcucuugggcuugcacagcaagcuccuuuauuccugagccaucuuacugcucccccuccccagagauggauauuuaaaacagaagccuucuuucuguuagucuaggauggagagacaugaaggaugccggcagaauaacgagaccaccgacgacaggagacggcacucuggcaacuggcaugcacgaggggcccaggaggucuuaccugaggccaggacacgcagcgucuuggccacgcccccccagggcgcccccagugagacgaaggcauggauauauuuguccuuccagacuuguggcugccgcugcagaaaguagagcauguacacguugcccaugcugugggcgaccagcaccacggggcccccauacaucugguacaucuccucgaucaucucucgcagggccaagaaguagggcccguuuucaucugcaggccagagccaagcaggggucaggcaggaaguguccugggaccugaaucgcuaaccaaucgacagagcggacccaggacuagggggugcaaaggguacuggaaacuaaguaggagcagacuaguuuccccaaagguucauagagggcaaagugacccuuccaaccaccgccccucggacuuagccucugccccugccaagacucagagguccagaaauccuagaaugacagggaaagacaaagcaagacuugaucagagcuguggaagugccagaugcacaggaagccagagacucagauguagaaagagcccaaggacuaucaguggccaagacuaccuuauuccugccucccagucccuagggaauggaacaggguggggguggggugacuucuuacuuggggcucgccgccaaucauagggagcaccucgaacgucuucaccccguguguagccccagcccacaaggcucuccaccauaguguagaaauaggaaccuaagggcagaaugcuuagaauuauauaaaauauaaccaguguuagcuaccugcaccacacccagagacagugaaccuaagggcagaaugcuuagaauuauauaaaauauaaccaguguuagcuaccugcaccacacccagagacagugacgucugucucccugaaggaguggaaaaggaaccugugucuacuaaucaaagaaagcucgcaggcuaccccuucaaagcaacguaguaggcccacagagccuggaggccccagccacauacccuggaggucuugagcaagagcuacauacccacauuccucuugcuggggucuaggaauuccauagaaaauguuuccccaaagccagggacacgcacguccacaccaucgggaaacuggguggcccgagauguucuguuguaaaccagccugucaggagaagacagugaguuaggagcucacugguaccgcugagcucagucugucucaauacugcccugugaccuuagccacacuccagccucaugugcagauuuggucugaggucuaaaggagauuugaaaaaaaacaaaaaacaaagcaggcuuauaaaacacagaucgaugccauucauggacuugggaaguagaguugggaagaucaggcaguuaaggauauccuuuaagccaggggcagugagugguggcucacaccuuuaaucucaacacuugggagguagaggcaggugaauuucugaguuagaggccaaccuggucuauaaagugaguuccaggacagucagggcuacacagagaaaccuugucucuguggggggguggggggagaagauauucuuuaaggauuuacauauaaguuugaggcuauaggagaccuugucucaaacaagcaaacaaaacccccaacaguacagaggaucagaauaacaaaauccaaaccccaugaagccuuacuccagagacuaagggggugaggguggggagcccugaagcaaauucucuuccccagguguccccucacccagacugagcuacacagccacagauuuagcagcuccuaacucaagauuuuaucauugcauagcuucugugguugccauaaaaaaaaaaaaacaaccaaacuuccucaggccagguguaggcaaggccaggagaaguacuaggagacaccagagguaaacaugcccacgaaaagcugagugcauuagugguccugaauccuaccaucauuaaagaucaacuaccaagaggcccggagaagagggcucagugguuaagagcacuugaugcuguuuccgaggccccagaguugcagccccauuacccacguggugguucacaccaucuauaacuccaguucuagaggauucuuccaccucuuuuggcuuccacaggcacuguacacaccuggcacacaagcauacaggaaggcagaaaauccauacguauuaaaugguagugcacgcuuuuaaucccagcacucaggaggcauaggcagguggaucucugugaguucaaggccagccugguauaauacagaacaaguuccaggacagccacggcuacacagagaaaccauaucuaaaaaaacaaacaaucccagcacuugggagguagaggcaggcagauuucugaguucgaggccagccuggucuacaaagugaguuccaggacagccaaggcuauacagagaaaccccuuuugucucggaaaaacaaaaacaaaacaaaaaaaaacaaaucaaacaaacaaacaaacaaacaaaacucagcuauaaccccuaacauugaucacaugauagggcuggaggccacucucaguagauaccagcuaaguacagaaaauggcuguaagacaccaaggcaguuuugugcaagaugaauaucgaaacaggucagaggagcaaugaagacaaaagacuccggccagcaucgguuaucgucggccugugccuccacuggcagcaccugaggccacgagucuccacgacagaaauagcaauguagaucaacagcccaggaauagcugcaaccacacaccaaaaacagucaacaaagagggcggcacagacaaccgucuggacuaggugcccagaggaucagcuagcagguuucugggaaaagcuuuuaauugaugaagcucuaaucagcucaaacauuugccagccagcaccaauuacucaaauugaagaacgauuuggcuuggcuauuaagagcacuuguugcuuuugcagaggacccagguucaauucccagcacccauacaguggcucacaaccaacuguaacucccuccuaguccuaggggaucugauauccucuucugacuuucucuggcacccagcacaugugguacacuuacauagacgcaagcaacacucauacacauaaaauuauaaaauaaaucuagaaacaaacaacaaacaaauagauacauagucucugccuuuaaagauuucucucugcaaggggaaccuuagaauaccacacccaggaggcagaggcagaggcagaggcaaacucuugaguuuuaggccagccugguccacagaacaguucuaggauggccaaagaaauccugucuugggcuggugagauggcucagugaguaagagcacccgacugcucuuccgaagguccagaguucaaaucccagcaaccacaugguggcucacaaccaucuguaacaagaucugacucccucuucuggagugucugaagacagcuacagugugcuuacauaaaaaaaaaaaacaaaaaaacaaaaaaacaaaaaaaaaaacaaaagaaauccugucuugaaaaacaaaaacaagcaagcagaugaaaaagaaagaauaauacaauuuuugagucugaauucugaugcugugauuuaucaugugaaugaaagggcuguagccaauuuuauaaauucuuugcgcuuccaucuuuccuuaucaauaaagucaguuugcuuuauugugguuuuaaggcucaaauucagagcuuuacuuaugugauuaucacucaagugacuuaucacugagccacacccccacuuccuccuuuaaagcaaguuuaaugacaaugccauuuccagagaguuagaaaguucauuacugaguagacaaaucuagaguguaggucacucacucagguguacacuugaggcaaucaagauacucacccacaggagacagagcugauaaagcacacccuaaucccagcauucaagaggcagagccaggauugucaguuccagucugggcuacacgaggaauuaaaggccaaccugagcuacaugguaagagcccugucucaaauaccuuuuuaaaaguuuacagagacagguagauuucugaguucgaggccagccuggucuacaaagugaguuccaggacagccagggcuacacagagaaacccugucuagaaaaccaaaaaaaaaauaaauaaauaaaaauaaaauaaaaaauuuuuaaaaaguuuaauuguaugaguaugaauuuuugccugcaugcauacacaggcaccacaugcgugccugauaccuacagaggucaagacagaccauuagaucccuuggaacugcugucaugacaguuaugagccaccgaguaacugauggggcucaaauccucugcaagagaagcaggugaucuacugggccaccuuacuaaccccuuuugguuguuuugucagucuuugcugcuaugacaagauuucacgccgggcaguggugaugcucccuuuuaaucccagcacuugggaggcagaggcaggcggaucucugaguuccaggccagccuggucuacaaagugaguuccaggacagccagggcuaaacagagaaacccugucuugaaaaaccaaaaagaaaaaaaaaaauccauuugggcuggagagauggcucagugguuaagagcacugacugcucuuucagagguccugaguucaaaucccagcaaccacaugguggcucacaaccaucuguaaugggaucugaugccaucuucuggucugucugaagacagcgacaguguacccacauacaugaaauaaauaaauaaaucuuuuuaaaaaagaagucauuuguauuugucuggcagauaauggcacaagccuuuaaucucagcacucagaagguagaagcaggcagaucucuaugaguuugaggccagccuugucuauagagugacuuccaggacggccagggcuacaugaagcaaaccugucucugaaaccaaaaccaaacaaacaaacaaaaaccaaaaagaccacuaaaaccucugccauccaauuaaaauguuuacuucucagcccucauaacuuaaccugcugaacaccgcugaucggcuggcacguaaaaggagucacuccaccugucaguguuuguuuugggucuugggacaaggucuugcuacuuaagucuggcuuguacucauucuguaacccaagcaggccucaaauugguggcaauccuccugccucagcaucucuccugaaugcugggauuauagacaaaccaccacacccacauuguuucuaguuuauaaacauauuuaugguuaauaacugaucagguuuagauugaucauauauauacauguuucuuaaaagcaagaugacgaugauggguaaaguaagaauggaguuuuugauccaccacacucuguuggcaauaaaauucacuuuauaacagaaauauauauauccuauauggaauuuaguaaaacccaguuccuuggcaacacaauuuuguaagggugaguuaccagcaaaggcgguuuuuuggcuuuguuuugauuuuuuuuuugagauuuuuauauauuuuauuuucuguguaugagcguuuguguguacaguucccagagaagucaagagggcaacagauuccccgggacugaagucacaaagaguugugagcuacccugugggugccaagaaccaaccuagggcaauacugcucagucugguuugcaaccacuguggggguugcaugucagauauccugcauauuagcuacuuaccaugauucauaacaguaguaaaauuacaguuauggccaggugugguggcacacgccuuuaaucccagcacucgggacgcagaggcaggcgaauuucugaguuugaagccagccuggucuacaaagugaguuccaggacagccagggcuacacagagaaacccugucuugaaaaaccaaaaaaaaaaaaaaaaaaaaaaaaaaaaagcagccagagaggcaggcuuagccaggacccaggcaaaggaggaaggggaaccacacagagucugugaauagggguuaggcaaaagaauaaaacaaacaaaaccugagcuuaaaaccugauaguugaacuggaagaaggagaacuggaacuagcaggaagaaaaagaaauucaugcuucugagaguguaagcuagugcugaccagaccagaccagaccagaccagaucaagggcaggagagccuaggagagagagauaucauuuuuccaucuauugaggaaugaggacaaggacucugaaggccucucuaggccccuaggaugagcgauccaucaucuugugugcaccagcccucaccugauauugucaauccagcagucaaugauaacaggcagaagcaguuccagauucagccagagugugaaguagcuguccgucuucuuggagcaaagguaguguacaaccuuuggcuuauccagcuuugcuuccaacugguuacccaaaucaccaggcacugcaggagaaaaagacaggcauggccccaggccccagcaggcuggagacccccaagccucuugcagucugcaaaagagccacccagagugaugaauaccauggcacaucuuugcaaucccacucucaaguugaaguacaacgccaggguugggaaaaucagaaaaggccaggacaccaccuucacaaagaaaagccccuacuaucgggggaccgcaguggauaccuguaaauccaguaauugggaggcugaggcaggaggaucaaguucgugcuaacucaacccgggcuacacaaugggauccuauuuccaaacaaaaacaagagccacauuaaugggaaagaagcuaccagcagauaguggaggcuuaaagagaggccuggcauguuugggggugggaguuugggguggggggauguauuguuaugggaugaaaauaacuucuccacgaucucgaauggaacuuccucguuggccauucagaagggaauuaaaaaaccaaaguuacuucccugagagaggcuguggaucccucugagaccucagcuacugaugguuucuaggguuaauggacccagaucaucucuguguaguccuggcuguccuggaacucacucuguagaccaggcuagccucaaacucagaaauccgccugccucugucuuccaagugcugggaucaaaggugugugccaccaccgcccggcuuccagaucauacucuuaacuagaagagauuuugaggcucaugggaguuuuucagaaccuccagaauuuggccagugcuauggcccugauauuagauauguaccacccucuccaggcuuaaaccaggaaaaaagguaagcaaggucuucucuacccccaggcagugggacacaagauagagugguaaaccaagaauuaaacccagaggcaguacucuucuauuuaguuuuagcuuuugucugagacagggucuugcugacauccaaagccugcuucuccaaccugccaaauucugggauugcaagcucaucaguaggagcccugauaaaaaacacaaaugagagacaucuguaaugguuccagcagaccuaccaagauguguaggccuugcuaaaggccaggaaaguugcagaggguagguccuguggaaagccuuaaggcagugcagaggugugcuggugaugguuaaucugcaguaacaagccacagcaggcauggggcgagggggugugaccaaguuccaagcaugacuggauaccacuccugucaaucucuuugagccacucaaacccuagggcccugauaacacccaagcuuacacccaucccuucaacucccagcauuuaaagccuguuaccuuacaggucaccaccuacauccacaggcuguacaacuuuacaaggacaaccuccccuccccgucuuuuuuuuuuaaaagguuucucuguguagcccuggcuguccuggaacucagaucugccuaucucugccuccugcgugauaagaucaaaggggugugguaccaacgcccgaggggguaaaaaaaaaaaacccuuuuugagacccacagucacuauaaagagccccuugacuuuucucaacagugucuuugaacccagcauagcacauguccuugccuaagcaguuaucccagugucuucagaguguugugggaagacacgugccuuccacucccuucaugaugugggugcugaugcaggaaauucccaccaugggagcuucgacaugacauaccuaugagcagggcaugacgacuggucaaugucuccaugcacugacgaggaaaugggugaaagaggaagccaccaguuaccccucuuccuggucaggcugggaggccucuaaaaauagcaauggccccuuccugagauacuuggugguugagacauagacaagaaccagacacaaaacuuuuacuucaaauaacccugggaagaguccucuuuacuuucauacacauuaucaaauuauguuuagucuacauguaugugcagggguaagacgagagcacaacacagcacaugugcagaggcuggaggacaacuuuccagaauugguuucuucuggggauagaacucgggucuucaggcuugguggcaauccccuucguccacugaaccaucuugcaggcccucuuuguucauuuaacagauaagaagacugaggcugagagggaugcaaacuguuugccuaagaucccaccccccuguuccaagaucaguuuucugcuaccucucccacuaacucaggacccugcagcacuuuuugugccuagaaaaagcucucucuggccgggcggugauggcucacgccuuuaaucccaggacuugggaggcagaggcaggagaauuucugaguucgaggccagccuggucuacagagugagcuccaggacagucaggacuauacagagaaacccugucucggaaaaacaaaaacaaaacaaaacaagaaaaagcucucucuggcagcagcccugguccuugaaaagaugcacaaggauacaggagcucagauucuuucagagucuaaggcuucucagcuaugauuuaggauaaccaaagucugcauagauuaauuggcaguuagugcccaucuguccaagcgauacuaugcugcaaauaagccaggugugauggugcacuccuuuaauccuagugcuagggagggagaagcagacagaucucugugaguucaagaccagccugaucuacagcaagaagacaaggcuacaaagacucugccucaaguaggaaacgcguauguggucagagaauacacacaucucaaugucaugggccuuauucuuagaucuucuuacauucacacgugacuucuucacacugguccucaggguuaaaguccagaugaccaagucacaaguucuacaccacccauaucuccugccuucccccaguuccaugcugaccagccuggagcaaucuuccaagccaccuuacuuccugcauauuccaggaaggcuuccccagcgcucccacaccucucucucucaccucucaggaugaccucucugagaggcacuauuacuaccauccaggaagcuugagagaggcagguccagcuguauacaaaucucaaagggaaccuaggcucagaaucccccauccccuucgcugaccuagaaugacauugcuuuucaagagaggguuucucagcuaggcaugguggcauacacccuugaucuuaguacuugggagggagaggcagguggguaucugaguucaaggccagccuggucuacagagugcguuccaggacagccaggguuacacagaaaaacccugucuaagacaagacaaaaagaaaaaagggaagaaagagcacaggaauuuaugcuccagcagaaagaaaauauauauauauauacacacacacacacauauacauacauaaacauauauauagcguacguuucagcaugucucuguucucaggaguccuggccagcgaaacaccaguucaaaacgacuuccauuggcugaauggggcaucuaagacuccuagagauuuuagccuggccuauuaccacauagaaacauuguuauuucuguuccgcugccaagucuaagacagaagagcaagugggcagggaaugucaccuggccucaguacagccuagaguaauuaggucuggaagcggagaguggaggcaugcucucagacucccggacucccucaacgccaguucaagacuguugucccaaccccauuccucucuccucccuucccuuagccacccuguuucccuuaggccaucuccucgaaagucaauaccauccauuccauaagcugagagcagagaaaugcuuuugggggccagcguggauagaacuugcuaccacucauucccugugaaauagagaggguaggagguaaugaccgauucugagacugccuaggaacccgcugaaguaggguugaauugccucagucuuuccagcuaagaaaugggggcauggcgaggcaagguuuggagcuguugcaguuagguggaguggaaagccagacauuaucuauucccuuuacucucacguuucagagggcuccagaccacacccaugcccgguauggcgggaggugggcuaaccgaacugacccagguuagaaaccaaaugcucuggguuucgugcuuaaagcagaugcacaacagagcaguuggcccaccagacccuggcugcacuggauccugcaggauccacccaccaccacccugaacacgagucucacccagcaccaccggggggugacguugggccgggagcgucaggucugccagcaucauuaguagaaacagagguaacaggaggccacuccggagcugggucucgcgacaggugcagagauggcgauccauggcgugagacuguggucgcagguccaaggggcugcuuuagagauuagggaucgugccuaggcccgggccgcagcucagcuaguuaaccccaccgcucgcagauaccagucaauuaagacccgccucuugcuaag
